United States Patent 7,868,149 (PLANT GENOME SEQUENCE AND USES THEREOF) - sequence listing, part 108

SEQ ID NO: 58729 - DNA, 12335 bp, Oryza sativa
gattagaaacttttctccaaatattaagatcataatgtaagattgcatcttactacaccaataacaaaaatccgtccatcgaaaacatggggcttacttataaacttattagccattgcaaaaactttagatcggtaaaaatctaaagaagaaaacgagctctgataccacttgcaggatcgaatactaactattgttgtattttcttgcctttttttttctgcaaaattgtgtcattctgtctattcatcttgcattttcctgcataagtcgacgtgttctatctattcatcttgcattttcctacataagtcgacgtgttcgtgccgtgggaacatgccatgacatgccagaatacttaagtcgacatgtcttaagtgctctctttaatagtagttttgattttctatacgtaccatgccataatgactgttatgcagaaaacaagaagatgattaggtaggatttcgttttctggccttttccagcattgtgccgttatgttttttttctatctttgttcaggttgaagttttgtttccctctagctgcattttcctaaattctgcattgtcttatgtctatgttgaaaagtacctattactatattttctttaacaaaattatccaagcaagtgctaaataaatatgagaattgctattactacattacattgtattctagcacacctttagggcccctttgaatcgtatgaatgaaaaaatagaggaataggaaaaacgtattctaacaggaatgtaaatgcaaaacagaggattgcaaaacgcaggaaaaacaggaatgaccgtttgattgaaccgcaggaaaaatgcaggaattcgaatgttttcaagaggttgaagctcttgctaattttcctccacaaaatctctataggattgcccattccataggaattttaaaggatatgataggattcaatcctttgtttcaaatggcttcattggaaattttcctgtaggattcaaatcctctaaaattcctatgtttttccttcaaatcaaaggggccctgagtttctttatcataaaaattaacattgtattgttcatcatgcttggattagccgccgaattacatttctaggtgtggctggtggggttgtgttgctaatctatgattaaggtcattttttttatgattattgttagcagtgtcactagatgtttctattatggcagtgtcactagatgtttctattatgtagacaccacgtattgactttttgtctgcctgacattccgctcaaatgatttagacatgtatttagcatcaacctatctaagtatcacttgattgtcagtgatttatcacactgccctagtagtagcaatataagtgggaaattccgctacacgcataaaatccatatttattcccacttgctaatttatagaattgtgataagcggaagaaataagcttgcccacccacttacatcttttaatgtagtatggtatagctatgttataaccacaccggctaaaaaaatgcatatgccgctacctactggatatatttatattggcttataggttgcatgatatttttgggaggttctagacttatattattcttaaatatctttgaagagggttctagagagcatgtctagcacactgaggagtatatcttagttgtgttatggattaatagagtacactaacagatatgggtaaaagtacatataggtctctaatgagttttggattgttgacgacaagaccaattaatggattgataggtttattgaggataagtgaatgtattagtccctattgtgattctgataatgtataacgacatctacaaatgaaagcaacattaaaaattaatatcgtattgttcgtcatgcttggattagccgtcgagttacatttataggtgtggctggtggggttgtgttgctaatatatgattaaggtcgtttttttcaggatcattgttagcagtgtcagatgtttgtattatgtaggcacgacgtattgactttttgtctacctgacattccgctcaaatgatttatgcatgtatttagcgtcaatctatctaaatatcaattgattgtcactgatttatcacactagccctagtagtagcgatataagtgggaaatcccgctacacgtataaaaaccacatttattcccacttgctaatttatagaattgtgataagcgaaaaaaaataagcttgcccaccccacttgcatcttttaatgtagtatgatatagctatgttataaccacaccggctaaaataatgcatatgccgctacctattggatatatttatactggcttataggttgtatgatatttttgggaggttttagacttttattattcttaaatatctttgaagattgttctagagcatgtgtagcacactgagatagttgtgttatggattatgtagtatactaaaagatatgggtgaaagtatatctaagtctctaatgagttttggattgtattagtccctattgtgatattgataatgcatgacgacccctacaaatgaaagcaaggttaaaactctcaaggcatttacattattttttattttgaattcgagtcataggaaatgccacactatggagaggtgttcgagtcaacgctgacttttgtgtctgctcaatgttactttgatctttagagagagacgttgcgcaacacccacatgggaaagatggggttcttatagcttccatattggaacttctgatagttgaaattggaatctccaatcatagctctatgcctattgtggagggacgatggaaagtcccggtggagatcattggaagttctgatcagtgctcctcgccaggacagaggattgatcggaagtttcaatcccctttctcacaatatgcgaagtgtggattaaagttctgatcaatctaatcaaaacctatgatattcaaatatgtgagtaatgactaatttcgcggtaggtcaagtatttaaatgtttccatccactctttggaaggttagctttcaacctttcagacctatcttggatcatgagtatctgttgatgcgaaaacacgatggcctcgaagatttgcttaacttcagtgtaggtccaaagcttcaggttcagggcatgccagttgatttgatcctgcaaccaataagatagactatagcaaacattagaagatgatagccaatcagctgatgttgtatctgtggggacacccgataaagtcatggtgcccccacgaatacgtaaccgcctaggatgttcaattatgcatgaaatgatataaaagcataaacttcgattatacattacttaagtcacttagttcacaacacaacataaatacaaaccattacatatatggcctataaatccttatttctacaaacagataaactactagactccaccacaggaactgcctgatcatagaatgacctagaaaccatagctgtcccatctaacaagtcaacgggatctccacaagcatcttcctcctcatgatctgaacccatttatgaatacaaaaggtactcaacaagacatgcttatgatagcaaatacaataattgcaatataaaacatgccatattaagagcaggaaggtttaaaccctaaccttaacaattatttcatagagcctatcttaattatcatttgatataaacaacactattgaacatttaatcttaaaaataataacgggcataaaaatataaatgttacttataaataacttgaatagaacatcaagtaataaataagttgaccatattaattaatagccatttagtttaacttgtggccacaatctggtatacccatagacacatctccattaactgggagcacgtcgtattcgaatactctacgactctgcagcgtctgcccagctttacccacacgatatccacaggctgaaaagtaacaaggtgtaatattgctccatatatctctcttttctgcttagtaagttaaaggatgctcgggtcgttactcggagtgatccggtccgaggtgtgtaccaacctacctccgcatccacttaccattgttcgttactgggtggacagcccagaacttcatgggcccatagggcagttctaaactctcgggcccatcaagcccacatatataaatcatataaacataaaccatgtcactttgcttcacacttgaaatctaatggccagtacaccgaaaggcctatagaagttcaatcaattggagcaatatacggctaggttcgacaaattgatcgtgtggatgggcgaaactatgtcattcttattgacacaagggggctgattattatatcaattttaaataagaaataaccataaatatatccatatattcaacacgaccataaacaggtccataaaaccaaacacatgaactctatcatgtgtaccacccactcacaagcggtgtcaacagttcttagcatatagctattaacaattccataagcatgttttcatatgcgataataatatccatattaaaccaatagcatgctaaataattaacagtttgttaagtgctcctcaaattttatcctaagcgttttagactctaaggctctttaatgtgtccataatagcaacagaaaatataatgcaataatagcaatataatttagaagcattcgtgcagtctatcatactccaaaggacaagtacggtaccaaaataactcactaactactgggattaaattgttcaagggagggtgcatgtcttgcaaccttcgggctcgatgtagtcgtaggaccaatgttagcgttttctatttatgcaacaatcaccatcacaataaataatagaaaaacaaagttaaacataacaaatggtatcataaagtgcaacgatgggtggaaaggattttaaagatttaattttagggatttttggaatttcggtgaacgacgaaccctaggggtaaaattagggtcgcgtcaacggttgctcagattgcaacgaaactgacacggatggattcgggataattctatgagtttaaaacaggtctcggattttgattttgaggtcaaacggatggtcaacataataggaaaagaaaaagggtattttctgatttatttttcaataggataatctaattttcttttcttctctcgctctgcacaggaactggccggcatctccctggcgccggcggtgaagatggctggttttggacaagggggcgccggttttgcggtctccagggtgcggcgactccgttcccgtggtcggcgatggcgaggctggcgacggcggccaggagctggaggcggcggcggcgactccggcgaactccggggtgggcggcgggcctggtgagcatcaatggagtgagatgagtctcagggtggcgacggccgaagctagggtggcctggagcagcgcgagcaatgcagccggcggcggccgaacagggcggtgactccgggaggcagcgccggcggcactccggcgacgggctgagggggaaaagagaggggaaagggagtactcatcatggagattccatttttaccatcaatttcagagggttggcgatgtatgcgacgaatttcggagattcttttaatggcgccggattagggtttcggggattttttcccccgacgattgagtccgcgggagttggggcggattcgaggaggtgaaagaggttgaaattgcggttcttttgcctccggtcttgtcacacccggaatttctatccaaaattccaaacgcttacatgtgtgtgaaccctcgtccaggaatcagccgaggcacacaataacaaattgataatagagtacaattatcactctaattaataagcgaataaaatgtcattacagaggtagatagttgctctcaatcaataaagatctaagcagcggaaaaaaaagataaactgcgcagacgactccactccacaggcagcttgaccagggctacacctaatcttccacaccatcaacatcactgtagaactcctcctctgatgaatgattgcaaggtgagtatatgacatactcagcaagccacgcagcaaatatgcaagtgcacaggataacaaaggatggcatagtatagtcccatttgcataaacaacatttaataaatattttagaatttaataaaacagttaaatgataattaaacaatattaattcaacgttatacaacataccctgttgcataggcccaaccattctgaacaaccaatcccggctgcacagttctatctccaaaccaggaattaaccattccaaaccaggagctaatcaaattattaccagttatagaatcttttattatgattggaagtgtgagactaatcacgaaagacattgttagacccgtccataaccgcgggcacggctattcgaatagttttacactggccagaaatgtaccactatacccacaagacacagccccacgacatgtcaccatgcgcctcaataccaccacggtacctcggaaaggagctgtgacagtacccctcgcacaacacaatccaccacagcgcactgttcctggatcataatcgcccccttataaaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcatgaccatcaaaaccatgtgctcacaacccaccattatcaggttttagttggcaaattaattaattaaccaatcatgattaaccatcatgagctatcattaagccatcattaaataatagtgagtcaaaagttatcccaatagtgtgctaatgtttctaagcatggctaagcaatcatatctgatatctagctgaaccaatatataaagctcaactagtcaagttataataacccaaggtatcaaggaataaagtaatcaagaacaaaagggctataacaaacaataggttaattccaccccatgacattcgaaaataaatgcaatagttgaatagaaacaatagctttaaatgggatcaacatgctcaaaaggttgtttgggatctgtgtgacttgccttgctggccttggaactcttcaaaatcttctcctgcaaactcagactctccaggaacgtcggaatctaaagagaaaagagctaaatcaccaaaacagcacataaacaagcatgaacagtacatgtggatatttttaacatgtagatctcaattttagaaaaatttagagacttgaaccaactaaatccgagctaagatgaattagttatgaattttcaatgattaaatcagattaaatcatttatatggattttaattgaattatgacgcaataatgcattatttttgaaaaggaaaagggtattattgcgtcagcggctagggttcgcggtggatcgggtgcacggcggtggctcacggaaacgaacggccgagatcgatcctatccacaacggacggccaagatctaacggtctacgaccggtctacgacggacggcaacgatgacgtcatcaccggcggcggctcgggcgcacaagctcgccggcgaacgacggcgcgacgacacgaacggaggacaccaacacgtagagggcgacgcggcgaactcaccggtgaccaaaacagcggcggaagatcaacggacggcgacggcgtcgaggaagaagcggcggcgaccttcggcttgacgacgacggcagtgctccggcaacctacggcgacgacggaggggtggacgagatcgacgacggcttggtgaccacgacggtgacctcctcgagcagcgacgacgaccagagcgacggcggcgcatggctggagctgcggcggcgacggcggcgacggcggcgcacggctgcacggtgctagggcgctacagacggcggcaggcaatggcgagggtggcgacggataacggagacaccgggggtccttttataggggctaggaggcggcggcgaaggcccacggcgaccggcgacgcgatggaaggtttagggttcggaggagagagatcgatccgaatcgaactcgaatccacggatttccaaaccgaattggcgatcgattccaaaaggaaaaaggtagaggagatcccgggaatcatttcccctctattgatttcaccagagaaggaaaggcgcgtccgaatttggaaggagacggcggcgcggcttggttagggttcggatgcggcagcggcgcgaggtagacgaagactaacaggcgggccccacctgtcagcgggcggacgcgcccgcgcgggcggcgctcggctgcgggccaacctgggccggggaggagagagagagaggtttgggccgactttcggcccaaagccaaaagagagatttttaaaactttttccaatttaaattattcatgaaatgcaattccatttattaaaaatactttcttggctcaaataaatcccagaaaaatctaggaactatagaatcaagtaaagtatttaataaaattttatctggcccaattttatattgggatttattatttaaaaaaaatagatcttctcgtctaggcttttaaaatcatttctaataattccatttaaacaacaatttatatatttaggatttttagggtgtgacaggtcttgagccttttagtggagggacgaaggagatacggaggcgggaaactggaggtgtcacggcggcattcttctgtcgttcgtcctcgtgtgtgcgcgtgcgagtgtgtggcatcatgcgtgggctggcacgagctgggcgcaaggcggcacgggtttggcgcgaggcagcaggagaagagaagaaggaaaagaaaacagagagagaggggaaagaaaaaggaaagaatagaaaagaaaataaaatagatggaaaaagagaattaaggtaaaattagagaaaaagaaaatatggggaaaattaaaataaatagtatttgaattgttgtaggctttaaatggttttctactcgggatagaattgaatttggatcaaaaagaattgttcggaaggtgagatgcacattgcaaccgaattaaacaagaaataaacactagaaacaaacatggaaaataatattttaaataaactactaactcgacggttataattttagagaaccaaagaaaattaaatcggttttaaaaagttgtcaaaatttagggctgttacagtatcgtatcagccgatgcacgaatgaatcgggtataggtgaataggatgctactcatagactagctttagattgaatataactgtaaacagcttttctttaacaggaccaatctcataggtcgaacctaatcgatgtagcataagattgaagtcatttattatacaattatataacctaaatagctagccgatggacatatatttataaactaggcccaacataactacaatcgactgtagagataaatgacttgtaattactaatttaatctttctcttaaatacaagcaactatgatagatcggacataatcgacacaatattaattgctgatagccaagatcagacaaattaataattatatggatttatatcatagccggtgaagtaacttaggtgattgaagataatcaaatttagattaaagaatataaaatttaggttaaatctatttaacaagctgtaatcccaatagatcagacctaactgagaccgcacggaattgatggcaagtttaatagatttaaaggtttgataaacttatataagatgacagatataacacattaagcgaaagacaacttgcaatcttaaagcaaaacaattatacaggtaagatcagctgaaactcgatattacccctaccgacaatcaatgagcatgttaattcttacaacttcaactacaaattagtaggtcaaacttaattgatgcaaaaccaagttataattgaaattataaggtccaaacatgcttttgattgtgttaacgaccaaatttggtaatatcagtatcggagatgaagatgaaatcgaagcagaatcgaagataggggttttttcggaaacagagtaagaatcggctggagtccggatcggctacgactgggatcggctaatctgagttggactggttaagtaatacagccgattccgacaatatgacccgtgtgcgacattgggtttgagttgatgtgcttcaagatgattgccacgcatggatagagtcctgagaaggcaattgtatctattaattaggatattttatgtaaattccttagagatatgttcgggcaaaagtctgccgcaaagacttacaatatcttagagtttgttagagataagagtcgtgttcaatatggacatatcttgtattcctcggatataaatagaccccgagccctatgtaaaaaaaaacacaacacacatccaatacaattccggcgcatcgccaccttttgctttagttttatttcgacgagttcttgctttcaggttgagctgcaccggtttcgatcttcaacaagaggtaaaactcgtcgtggcgaattatgttcttagggattagtgcttccatcttcatgacattctaatctcgtttatataattcgccgagttatcatatatcttatataatctctagcaatatcgctatctaacccacaatcggctaacatctattaacagacggcagccgattgggttaaatgttgacattgatctagattatataagatatctaccattctatgaatcttctagtagcttgattgtctagatatcattcttcttttcatacttaatgctgcatcaattgagtttgatctattgagtcgtgcttagaatattgatctctagcctgccacctagttgtcgattagaatagcatcggagtttcagccgatcgtatctgatttaactataattatttctatttgctttactgatatgttaaatctgccctttatgccaagatattgctgtatttgaatatattaggcatttgcttgatattctatgcctgttttaatatcctgacataaggtagtatcggggtatttgccgatacatgctagatctatatgatcggctatgctgtaagcttatatagtcttgttattagtatatatttcggtctaagtgattcattctgtctcggcatggcgacgatctatcccagtcacttgatttaagtatatatcgagataaggagtatatatcgctaacatctacagccgatcaagtaggtttagttttcttccttatttattcacgattgtcgatcgatgcacagatgacatcggctcagatataaatgatatgtcatcggtaccaaaccgatcggctatcatttataggtttaactatggttcttttgtctttatttcttgttgattgtaggatgaaatcaactggcacgctcatacatccgaaggcaagttttggacctgcactggagttaagcagatctcccaggcctcgtgttttttgtcaacacgcttttggcacgcccagtgggacctgattagaagtcaggcgttagttcttcctcatggccgagaaacaagcaccactaccatcaagcccaggctctgttaaaggcaaattaccgaagccgggattgactgacatcattgatgacaatgtcctgccgatcgatcccgagaaatttacgcctgacaacaagcaggagtttgaagcaatgatgcagcaagcacgggatcagtatctgagctcgttcatgcaaacccgcaagggaacgctagttcagaagtacaagttaaaactggttgctgatagccctggaaccggttcttccaaagatagagaagtgaaacaagctccagatggctcagctcagccgaacaacaagggtgctaccgggggttctataggaaatcaaggcgataaccctcaagaagtgcacggagctccaggtgatgctgctcaagggccgcaaggaggaaatcttaatcagaatattgagctagcacaagattttttcaacaactttcaagattgggttgattacgcggtgcatcatgctttgatcaatcaatccggggtcttagtcaatacaatgtcgaacatgaataaaacgataccactaattcagccggtggtacagccgatccaacaacaggtcgtgcagccagttcagcaagcaccatcaacgcagtagcatctccaaccaatctagcagacaccgccaaggcaacggcttcagccgatccaacagactccgatacgacagcaggtcgttcagccgattcagcacctggggt

SEQ ID NO: 58730 - DNA, 2780 bp, Oryza sativa
gttgccatctattgaaaactgtcctgggtgcagtgacgtcattgagagctcaagccgaccacataatcagggtgatcggccaagacagacaagacttcctgttcatcaaagattgggtccgatgagtcaagatcatggtcaagaagatgaagggactaggaagaatcaatggtgtccctctggtatttacacaaaaaatcagaaaaggagggtccagagattgaggagcagggaacgttttcaagaggttgaagagggaatcaatcatcggctgaggaaaccaagaccaaggcaggtgtggcgtgttaagaatcaagctcctacagccgatgatgctgcagccgatgaagcgaagaggttggcaaaaggaaagagtgttgttacagcaccaatcaacatggtctttacgctaccagccgaatttggaatcaatcaggccgatgttgatgaagtagaggaggaatcggccaagttggtcctgtcaccagagcaagcggtattcgaaaagcccgagggaacggagaatcggcatattaaaccattgtatgtaaacggctacgtcaatggaaagccgatgtctaaaatgatggtcgatggtggggctgcggtgaatttgatgccttatgctacgttcaggaagctgggtaggaatgctgaggatcttatcaagacaaatatggtgctcaaagattttggtggtaatccatcggagaccaaaggtgttttaaatgtggagctgacagtcggcagtaaaactattcctaccacgttttttgtcattgatgggaagggttcatacagtttgttgcttggaagatattggattcatgccaattgttgcatcccttcaactatgcatcagtgcttgattcagtggcaaggtgacaagatagaggttgtgccagccgacaggtcagttaatgttgctaatgccgatttagctctttgggagatggatgaccttgattgtttatctggaaaagtctgggatggagattttctaaaagtatccgattctgatatacagccaatcgaagatggagaacccaagctattactttgagggcgttgtggagggttcagatgtttacgctaaggatacagtagatgatctcgatgacaagcagggtcaaggttttatgtcggatgatgatttggaagaaattgatataggcccaggtgatcagccaaggccgacattcattagcaaaggtttgtcttcggagtttagaaccaagctgatagagctcctaaaagagtttagagattgcttcgcttgggagtattatgaaatgcctggactcagccgatcgatcgtcgaacatcggttacctatcaaaacgggagttagaccacatcagcaacctccgaggagatgcaaagccgatatgcttgaatctgttaaggctgaaattaaacgattgtatgatgctggttttattcgtccctgccgatatgctgaatgggtttctagcatagttccagttattaagaagaatggcaaggttagggtgtgcattgattttcgagatttaaataaagcgacaccgaaggacgaatatccaatgccggtagccgatcagctagtcgatgccgcgtcagggaacaagattttgagttttatggatgggaacgcaggttataactagatatttatggctgaagaggatatctataaaacggcttttaggtgtcctggtgcaatcggtttatttgagtgggttgtcatgacttttggcttaaagagtgctcgggcaacatatcaaagggccatgaactatatatatcacgatttgatcggctcgttggttgaagtttatattgacgatgtggttgttaaatccaaagaacttgatgatcacatagccgatctaagaaaagtttttgagagaaccaggaagtatggcttgaagatgaatccgacaaaatgtgcttttggtgtatcggctggccagttcttgggatttcttgttcatgaaagagggattgaggtaactcagaggagcattaatgcaatccagaaaattaagcccccggaaaataagaccgagctacaagagatgatcggcaagataaattttgttaggaggtttatctctaaattatctggaaggttggaaccttttacacccttatagcggttgaaagccgatcaagaattcacttgggggcagagcaacaaaaagctttggacaatattaaggaatatctcagttctcctcctgttttgattcccacacggaaaggaataccatttaggttgtatttatcggctggtgaaaagtcaatcggctcagttctgattcaagaattggaagggaaggagcgagttgtgttttatcttagtcgacggctcttggatgctgagactcggtattcccctatggagaagttatgcttgtgcctttatttttcgtgtacgaggttgaggcattatctattatctaatgagtgcactgttatatgcaaagccgatgtagtcagatatatgctgtcgactccaatattaaagggatgaattggaaagtggatattttctttgactgagtttgatcttcggtatgaatcaccgaaggcgattaagggacaagctatagccgattttattgtggaacatcatgatgattcaatcggctcggttgagatagcaccgtggactttattctttgacggatcggtacgcactgatggttgtggcatcgacttagttataatttcccctaggggggcatgttttgagtttgcttatactattaaaccatatgcgactaataatcaag

SEQ ID NO: 58731 - DNA, 56518 bp, Oryza sativa
gatgttaaagttgaaattgcggcaatgtcagccgatgactggaggtatgatgtgcatcagtatttgagcaatccgtctcaatcggcttccagaaaattgcgatataaggcgttgaagtatacgttgctgggtgatgagctctattatcggacgattgatggggtattacttaagtgcttgagtgccgatcaggctaaggttgcaatcggtgaagttcatgaggggatttgtggtactcatcaatcggctcacaagatgaagtggttgcttcgacgtacaggatacttttggctgacgatgctggaggattgtttccgatattataagggttgtcaagattgtcagaagtttggagcaattcagcgagcaccggcgtcggctatgaatcctataattaaaccatggccgttcagaggttggggaattgatatgatcggcatgataaacccaccatcaagtaaagggcataaatatatattggtggcgactgattatttcaccaaatgggtagaggcgattcctttgaagaaagttgattcgggggatgctattcagtttgttcaagagcatataatttatcgatttggtcttcctcagactattactatggatcagggttcaatatttgtgtccgatgaatttgttcagtttgccgatagcatgggtatcaagctgttgaattcttcaccttattatgcacaagctaatgggcaagccgaggcgtctaataagagtttgattaagttgatcaagcggaagatttccgattatcctcggcaatggcatactcgattggccgaagcattctggtcttataggatggcttgtcatggatcgatccaagttcctccttacaaacttgtttatggacatgaggctgttttaccatgggaagttagaatcggctctcgacaaacggagttgcaaaatgatttgacagccgacgagtattacaatcttatgcccgatgagagggaggatttggttcagtcccgattgcgagcccttgcgaaggttactaaggataaggaacgtgttgctcggcattataataagaaagttgtgcctaaggatttttcggaaggagaacttgtctggaagttgattttgctgattggtactcgtgataataaattcgacaagtggtcgccaaattggggaggaccgttctagattcaaaaggttgtttctaagggagcatatatgctgcaagggcttgatggtgaagtttatggccgagctcttaattgtaaatacttgaagaaatattactcgagtgtatggattaactcgtgatcggctactaatgtcgatacatgatagccgatgtgtgtacatcgccttgtgatggccgatattattatatcgcccttagttgttttataatgtaatcggctgaggtttgccaattgacaatggccgatattgttatatcgcccttagttgttttatagttttatcaatgcttgttgccattgtaaaactaggggggatagatttgttacaatgcagtatatatagtgcaaaattttttgagcaattctcccagtcatactaatcgcacagaaggatgttaagggatgaagaatgtttagccgattgcagagctataaagtcctattccagtaagattactgcgataagtattgctggatagccgatatagctttctgcctaatctgctctacttcctctatggcttgagcatcttgcgcatcggttgcaggaataacttttaaggacttggtcagttcagcaacatgcttaatagcctatttgagcctagctttctgctcttcaatggactgggggagatcggctagcttcttgcgttccatatccagctcagcgttgcattcttcaagttgtgctaagagatcaatcttgcgagcttcaagccgatcaatgttagatttgattggaccttcagataattgatcgagcttggatttttcttcatgcacaagttgacggttggcttggatagtgcctcgatgtccttacgttctcgctgttcggccagtcttaatttggctttctccaacttgaattggtgctgctcaaggtaaacagctggagtaaggacatcggctaattcatctgggattaaggcttggatttcatgcagccgagccctgattggaccatagtcgactaccaagctatctagcgatgatgcttctagccgatccaagatacttcttagagttttcttgacatcatcagataaaggagccaatgctttgcttgtgacatcttcttctccttcgtcaagatagtctttgatgtcaaaagagaaaagatcggctaggacctgtggtgacaatttagaagcagttagaggttaaacaattatagccgatttggatgcttattaggagaaacttactgggatagcaagagcggctagttgttcttcttcttcaacatgacgacatcctacagctgatggggtccgatcgcttgatgcttgttgaataggaggggaaggaggctaaaaatagataggtgttatataaaatcggtcgagattaactaatgaaagaaataagattattgtaccggtggggctggctcagatgtcattggagccgatttcttcttcacagcagccttccttttctgcagttaccgagtatgtgagcaatcggccataaagtgatatgattacaaaagtgattagagaaggttgcttactattgtaaaatgagttggagcagaaggagttggaggggcctgcttaggtgaagccgatggtgttctttcaatatcgcttacctcggctgcggcttgatcaacatcttctccgatttcttcttcatccagagcttgttcaatggatggatctagggcaggcagatcatcagctggtttagctttctttttgatcttcttctttggagccggggctaaagcatctacagccgatgatctggttttccttttcttaccggcatcggctggttctctgataagcccttgaagaagagctgaagtcttgggggcatcatagccgatgacaggaggagatggcccacctccattaggaattaagcctggggcgtaggtgatatccctgccacgttgctttgatgaggaggggaggattctgttgcctacaaattaaagaaacaattagttaagataaatcggctaagcggtcattcaaatgaaatcaagtaaagttaaagacttacttgagggacaacatctggaaagaggtctatcatgtacattgaagctggttggtggaatagatgcaacttccattcaccccaccatctatcaaagtttttgctcctgaacattgctagttctatgttttcaatgctgcctagagggggtcctggaaggttgagcagccgatccatcatcaaggttgatgaaatttctcctcggcattggatcttgtcagcaaagaataagccgattgggagttggcccattccaagctatctagctgaactcatcaggtgatagaattcgtaaggggcttggatgtttcttccttgatggacgccgactggaagaatgcatgggctgattgcagctgtgaagacttctctggatgtttggaatctttcatgattaatgtcttctaatctgaaatctgatggaagctcgaggtctgctgaatcttcatagggaaaccaaactcgagcatctttttgaaagccttcatagaagctgcaaaaccaatctttgagcagttcggctgataactttgctccagcatcggccggtgtggatgcgtattctccatataacgtacatcggcgatgagtgcgttctttgttgtcctctatgatcggctctaatcttggaaattcagcttctgtgacggatagccgattgacgactttcatgactattagattcaaccaagtctgcagcagccaccatggtccacctgctatgactattgagccgacagctaacttagccgaagcattgttcagcatttggtacaagtagccgaggaggattttgcctaaaggaaattgtttctttgcttccaaagcttcggctacaaactgccagttggttgtaggaccacagcttaatctacaaaagagaaatttctctagccacatgagcaaaaaggccacatgttctcgaggggtgacagaaccctgacccatgtatgctgttacatagcctgaccaacctcctatactcttggtcttaaagtcatattggttttttgtgttcagactcatggggttagccgatgaagtgacatccagacccgtgatcataatgatgtctatgagagttggggtcatcggttcttggttgaataagaaggcgttgatggtgttggaccagaaataggaggcggctgccattagaggttcatccttggctgagtttgctatggttaggttaagtgcttggccgattccaatttcgtcccaatgaactcttttgctagccgatatgcgcttgaaccatgtaatccaacttttctcgggtgaagttttttctagagatggccaagatttaaaggtattcttccaatgacctagatctggattggatagtctgaaaggaatcctattggtctcaccgatgatgaactcagtggggtcgaggttgccgactaggccgagaaagtagtggttttcatgcgacaaggtgggaattgcgaccaaattggagagatgctacaagttcaaagtaaccgagaaaagaaagcagtaagaggcgagagaaaactgatccaatgatgaaaaaggggatctagctgatggtaacttacctcagcgtattcggctgatggtgcggcggatggactggcggagatcgacatcgtcgtaggcggagatctggccggagatgaagtcgcctagggattgccttgcgcgtcggagggatcgccggagagagagagggtaaaagttttgcttaagcggggaaaacggaagtcacggtgtgagatctcggggataacggttagtatttgaagcactagagtaacaatcgggaaaatgttagagtgcgaaacttgttcggagtcgatacacggcaaatccggaacattaccaaatatcccggacttggggggcatgtgttaacgaccaaatttggtaatatcagtatcggagatgaagatgaaatcgaaggagaatcgaagataggggtttttccgaaaacagagtaagaatcggctggagtccggatcggctatgactgggatcggctaatctgagttggactggttaagtgatacagccgattccgacaatatgacccatgtgcgacattgggtttgagttgatgtgcttcaagatgattgccacgcatagatagagtcctgagaaggcaattgtatctattaattaggatattttatgtaaattccttagagatatgttcgggcaaaagtctgccgcaaagacttacaatatcttagagtttgttagagataagagtcgtgttcaatatggacatatcttgtattcctcggatataaatagaccccgagccctatgtaaaaaaaaacacaacacacatccaatacaattccggcgcatcgccaccttttgctttagttttatttcgacgagttcttgctttcaggttgagctgcaccggtttcgatcttcaacaagaggtaaaactcgtcgtggcgaattatgttcttagggattagtgcttccatcttcatgacactctaatctcgtttatataattcgccgagttatcatatatcttatataatctatagcaatatcgccatctaacccacaatcggctaacatatattaacagacggcaaccgattgggttaaatgttgacattgatctagattatataagatatctaccattctatgaatcttctagtggcttgattgtctagatatcattcttcttttcatacttaatgctgcatcaattgagtttgatctattgagtcgtgcttagaatattgatctccagcctgccacctagttgtcgattagaatagcatcggagtttcagccgatcgtatctgatttaactataattatttcagtttgcttcactgatatgttaaatttgccctttatgccaagatattgctgtatttgaatatattaggcatttgcttgatattctatgcctgttttaatatcctgacataaggtagtatcgaggtatttgctgatacatgctagatctatatgatcggctatgctgtaagcttatatagtcttgttattaatatatatttcggtctaagtgattcatactgtctcggcatggcgaccgatctatcccagtcacttgatttaagtatatatcgatataaggagtatatatcgctaacatctacagctgatcaagtaggtttagttttcttccttatttattcacgattgtcgatcaatgcacagatgacattggctcagatataaatgatatgtcatcggtacctaaccgatcagctatcatttataggtttaactacggttcttttgtctttatttcttgttgattgcaggatcaaatcaactggcacgctcatacatccgaaggcaagttttggacctgcactggagttaagcaaatctcccaggcctcgtgttttctgtcaacagattgttttttaggtgatagatacactaaacaatctaacaaagagcaatctaaacgatatcggcttattcaacgcgaatcaaccgataaggataaataacactatttaacttagattaaatagcgtatatgataaattagcacttgtatcgactggtttagagtgtcgaacttaaccgatggaaaccctagccctgccgatacaagcaactacagacggaactcatctcttgtcagagatcgaacttaattgatgcagcccaactcaaagacaagaactcatcgagaaaaatccttaccaacacaactcaaacttcccttaaggataaagcaaaaattacaagcacagtcgaactatacaaaaaaagaaaaataactgactccacctaattaatagataaatcaccttgccatattctcctcgaactcagcctctccttgacacaatatgacaaactttccccaaccaagtctgactagaaatcgacttctgaccattgtccatcttccgtcagctacctccgtaatctagcttgcaactgatgtactccagccgatactgctttaccaatcttaattagccgatgcaacgttctaacttataatacgaaacggaggtagtactaattattttaaacctgaatattagattaatatgatttttctaaaagtaacttttctatagatttttttttgcaaacaatacatttttaggagtttgaaattcgtgcgcacgaaaaacaacataaatcttctctcaatctctagcgaatgaaaacgcccttagagttcatacataccaccagccaaacaaagttttctatacatccatcatcttctatacaaacaactacatgtatatatcctttgttggatcaaactcgacctggattagagaaatgaactacgagcaagcaagagcaaacacaccctacactcctaaacacatcgccggccacgatatagccagcccatggagtcgcattgccatcgatcccttcgatatgcgtgtgtacaaccccacgaattaagtacacctggccggctgcgtttgggctagctcagctcagctgctctcgatcgatcaggtggtgtttggatccagggacttaactttagtctctgtatttagacactaatttagagtattaaatatagactacttataaaactaattagataaatgaaagctaatttgtgagacaaattttttaagcctaattaatctataattagataatgtttactgtagcatcacttaggctaattatggattaattaggctcaatagattcgtaacgcgaattagtccaagattatagataggttttattaatagtctatatttaatatttattattaatatctaaacatatccgatgtgatagggatttaaaagttttaatcccatctaaacaagtccactcggccacaaaagacaggtagctatagtgtccgagtgagtgagagagagagagaaggcacctgcacgcacgagcgggtagcagcagggaggcagcgactggcactgcgactgcaccggccgtaccgcgcgcgcactcattgcgacgactcctccactgtcgctatatgtgttacatccgttatatttggtgttagatacatgtttgtgtttgtaaaacggggggagtacgtaggagtagtatgaatgatcaacaggttaaagatgaaatgaggaggcagaaaaaaaaaacaaaaaaatgataacgattcaaagttaattgctcctacttctttttgtgggcaggaaaatcattcccctttggcattaaaaataaggacaatttgaaccatgccacataaattttacaaaatttgtgatatgccacctgatccacgtatcattgacttatgtgggtcctacatatcattgagatacgggtggcatatcttaaattttacaaatatagggtggcatgattccaacaaacccttaaaaatactgtgcccacaacgctttgttcactttagagcttgatcacgtaaaacacattgtaaattatttttccaaatccggtctccgtattcacgaaacggacgtacacggtcaaaacatattgtaaatacacggcaacaccaccaaaataatgatgttgtagcatgcatgcatgcgcgtcatgttggctcgagccaaggcattcgatcgtatatggctactgcatgggattcactacatactctagaacacatgcataccccactaaatagggctaaatcgaaagtgattaattgcttgaagattcctacacccaggccgtgtttagttccaaaataattcttcaaacttccaacttttttatcacatcaaaactttcctacaaacacaaacttataacttctccgtcacatcgttccaatttcaactaaacttctaatttttgtgtgaactaaacacagccccaattccttctcctcatggcagtagcgacagagctatgaggatgttttcttttttttttggggggggggggggggagggggggtcatcaccaacgcggttagctccttccctcatctattttcctccaaaaatttctccaaatttactttgtgtatgtactcatgcttatacccctggctacccacatgaacatgcacataagagcatctccaacagcctctctattgagttgcatgcaccgaccagttcaacccaaaagcttaactaaggtgggcaatccactttatattccaacactatctactcaactctccaagctaaaaattcggcaaatgaaccaaatacactcctccaacagactctccattcaactctccaagccaactgcctctccatccaagcccacccactggccaatattggccagcctcctagtctagctatctctccagctctcctctactcgtgcttctctcctctccctctagctccactgccacgccacatttttgtcgtcagggtcaccgcggcgccgcctctccgtcaacggcatcgttgtgccgtctctccatgttgccatcgtcgcctatgggaggagcgtcatcgtcgtctccttacaccgggaggagcgccgccgtcttccccctccttcctccgcggccgtcatcccccgagccaaggagcgctgatgctatccacatctcgatctgccaccagcctcgcctcatcactccgtccaccaccggcctcgacgagggagaggattggagagaggggaaggaagaagaaagctcgagaaggggaaagaaaacacgcctgtctcgcgtggtcgtcgtcgcgagccgctgccgccaccatcgctagccgccgccgccccgtcgtcgctgcgcacggcaaccgtcgctgcgcccgaagactgctaccccgccgtcgccgcgtgcggccacactgccgcaagcaaaaaggggattggggaagagagggagcaggataatgagaaagaaagtggtatagaggctgacatatgggtcccgctgtcatagactcagaatagagaggatgaatggagaggctgttagagaaaacaatgaatttgacttgctaaattaaatggagagttagctaaatatatatttgaagagactgttggagggcaacatatcctatgcacacaggccctcacgtgtacacacgtgcacaccaactaaaaaatgtcaccaaaaaatctagaaaaaatcatacacatacttttaattgtattacacctagagttaaaatcttaacgtcaaattcattatattttagccgtaacaaaaaaaacaaaaaatctgacaattttaaggttgcaattttgtcagaattttatcttttttgttattctctatgtagaatgaatttgaagatgcgactttgcacgtagatgtaatactattgaaagtacatgtatgaattttcctagaattttttatgataatttttagttggtgtacacgatgtgtacacgcgagggcctgtgtgtataagatacgctcccctgttggagatgctctaattaagatgctagacccatccatgtcgtccttttcccatagatgctttcactagctacttaattatctaacagcaatgcatcatgtacgatgtttgatggtagcatatatatatatatatatatatatatatatatatattatatatatatatatatatatatatatatatatatacacacacacacacacacacgtagcattgctagctctacctagctactccctccgtcccataatataagggattttgactttttacttgtactgtttgaccatttgttttattaaaatttgtttgaaatttttatttattttatttgtgacttactttattattcaaagtattttaagcacttcgtttttaatatttacacaattttttttaataaaacgagtgatcaaacagtgcaaacaaaaagtcaaaatctcttatattatgggacggagggagtaccaatcttctaggtagctagtttggtacttcctccgtttcaggttataaagacgttttgactttggtcaaagtcaagccacttcaagtatgactaagtttataaataaatataataatacttataataccaaattaatttaattaaataaataattgaatatattttcataataagtttattttgggttaaaagcattattattttttctacaaacttagttataaagcaatttgactttgaccaaaatcaaaacgttatataacctgaaacggaggcagtagtacgaacatatctgcacaaaatgccgactagatgcatgacatgtactacatatatttcctgtcgtgttggttactgtactgtctgtacattgcaatataagacgaatttatttgtacttcattttttgcaatttgcagcaataggatatttatgcagctcgatcgatcacgtaatccatgtagcactgaatgattttcagaaacgtgtcctgcatataatgttcgcgtacaggtcatgcatggcccacgtacagattcacaccacatgaacaaaatcttgctctagttattacacggtcaaaggcgcccttcgcccccaattgcttcatgcatgctgcggccacagtaaaaactactgtttaattaattaaataaatagtatataatccaaaaattaaattgatccaatacctgctacattatatagtacaggttaatatgatgctagctgttcattgatctggcctgtcaaaaatgaggtgctcatcttacatggacccttgagctaacaccctaaatataaagctgcatctatctatctgcagctatagaatggcaatgtgcaaataaaggatagcttaattagagcaagaataatagcaagctataagaagactaaacgagtaaatgatgaggtggataagatatgagaggagagagatgagaagtaggttgtaagcttacagccggcttagacacaggaactaagaaaatatataagacagacaggtggaccatatatttatagtgaagaactaaccactatatgagtgagctgagagatatactataaagatctatacaatcagcagttgggtgtattattagcctgactctgaattggctttctgacatgaacagtgaagctacacaaaagctatggccagtataattcctaacactagctagggcaatgtgttggccaaccaccatgaccatgttccatatagtatatgcatgggccctacccctgaaattcactgtagacacaagttaacaaaactcaggaggactacacccatgtggtagggtcctccagtaaagaaaggtgtagtgtagctgattttgatgaccaagaatttttcatttgtaagattcctttcttcctagctatagctcctctttgtgcatgatcatcttctctcaccttagaccatgggcacaatcagtgagatgtatggcccccatgtgtctggaggaagagaggcaggagaaatgccattctagaggaggggaggagcaggtgtgaggagaagaaatgataatcttttcaattgagttagtagtagagatgactagacgtgtacttgtacaagtgtatgtacagcaaagaacactgcatgcatgcatgcatgcatgatgtagaagaaatgataggattgcatgcatgcattcattcataagtgtattaaaaattaaatctcatatggtccatgcagtatagtttaagggatcatatagcaccgtcagtatgtccttccaataaggataagaacgcatggtctaattccttggataatattacactcagatttacacacctcttgcaattaatgcatgagttcagagtttggtgttggcaaaatcaattcccccttgcacaattggtttatgcgccagatacatttttggattttaatcgaacaagctagtggtaattaccatgtggattttgtgatgcgattattattaagacgttgtaaaaatataaatcattagttggtttagtttgttattaattacatgaccaaaaattaaaagaggatttagccatgcgatacggtgtgctaaattattcaaggatctaattaagatggcgtactaattatgaaaaagccgcgcaaaatgctcaaattaaggcgagatatcaaattatcgattaagaagaattatagaaacaaaatattaacaaaaaagcacgggaatcttgtatgatgcaaacactatacatgtagtagctaccagggtttttaattttgaaattggattatttgctagggggccaaaatttcggtaatttcggaaatttttggcagaaattatttgaaattttgactgattttgaatgaatttgaataaaatttgactaaattcaaaaaatataaaaaaaggaaaaatttcgggcgagatgtgagcatgccagtgggggcgaaattaccgaaatttcaaaccctggtagctatatctctgtcccaaaatataaaatatttgagggagtagggagtaaaaaccataatatattctacgacacaacatgcatagatggatccaaatgcgtatgcttttcatggaattgtctctgcacgcgtcatcatttgatcgaggtagcaaaacgacgacgatgggggagagagatgttgttttccatgcatgttcccggggagagagagatgttgttttccagctgaaacaatgtacgcttgcatgtacagtactaactaattaagaagatgagaataaattaacctctacagctctactagctaattgacaccacttggatgaaatttgtgcgttctcaacttaaaaatcaatctgcatttgaactcaatttctttgtgttcttttctaagaaatgcacactatccatacttgtaaacagtatgatttttacaaaaactttgtatatatcaatttcttagaaaactgcattaaatcaaaatttcaactttataatagtaaactcattcgtctatatcctcaaatagttatcacaaaatcattcgatcattcagccattcaactattaaggggagaaaaaacatgctattaccttcgattttgctccaagattcgtgtcatgcatgttaggctgtgttagctagaagaagttcccatcaggaacagtgatcatggaaaacggagcagtccattagcgtgtgattaattaagtatttgctaatttttttaaaaaatatggattaatttgatttttttaaaacaactttcgtatagaaacttttttgaaaaaagcacaccgtttagcagtttgaaaagcgtgcgcgcggaaaacgagagagaagttggaaaagggggcgtccgtacacagccttagatttcttctccagtgagttcgccgtcgttccttccctaccgtcacccatgttgttaaagttgtattggcttaccaggtaagaaactactccagcattgattgtttattacctgctttattcccacattgtggttgctcttagtgggctacttcttacgtacttgcgtccaaaataaattaatcctgggtttgaactggatacacgtatgaagctatgctcaaaagcgacctctcagctactcgacatttgcatgaaccataaaaccctagcaagctagatacctagctagctactcaagctcaatccatcgactggtcgtttccattattgaactactccaagtgatgatactactgcaagtagggtttgttgaagagttaacatgcatgcaaatccgggcaaaaagcaattaattaaatcagccggcgacggcaatagtactgagagatcgatgtgatcgatcgttaatataactagctgaaatcccgcgcattgctacgaaaatttagtatgataacaataaaaaaaatacgtgtaagatgataacatcagattaaataagttaatgtggttcatgataatttaaatttaaatagcatgtagaatgatgatttaaatataaaaaagtaaagtggtatgactttattaaagaagaaaagtagggagatagtttgaaccgtatattaatcatctaaagacaaaaacaattaaggtggtatggcttaattagagaaaaaagagaaagttaatttgaaccataaattaatcatttaagcactaagtaagtgatgatgaactatataagtatataggatatcataaaacataataaagatatacattgaaatattatgtaaattatgtgggatgataatttaacatgcttgcatttaaaaagctcttaaattacaaaaactataaaattatagataatatagcatgtttgcatgatgtttaaatgtgatgattgttagtggatgatgatgtggcatttttgcatgttaagtttaaggagttagtggtttataactttataataagataggatacaatgtttgatatctgcgatcgattgataggtaggatcagtctcgatagcaagttaatttttggttgatgaaacgtacatcgatttggtcgatcatgttggaaccaagtatataggagtacatatatagcttccaaactctaggttttagggcagggataggtagcactcactggtcgtttcaaagtaagtttggtgaagagtctcacctagaacaattttacctatttatgtttacattaaaaagtattttgtcaactaattggtttgttgccacatgttgccaaacactgtcaggcccttttttttttcttttcgaaaaaggttaccttactatcgtaagcttttttaaagccgttagatcaaatccaacatcacgcaccagccattcactgagcctattttgtaatagtgtaattcatgtagctttatagaaactcccctatattatatttctataaacccatataacccattgggtcaattgacaatgctttaagtttcgcaaagactacagtgtgctatatatatatatatatatatatatatatatatatatatatatatatatatatatatatcaatgtatttttaccgtaaactaaattcgatctgctgctaatatgtaagttgtgaaacatataaagctcaacactagagaaaatcttcgtagttgaatatatatgatttgtaatatagacaaacacggaaaattctcgaccatataacaatggccaaccatgcagaccctgctactatgggatgtatgagaagaacaaccatcactagtacttactccactctgttcatcctataaggtgtattttgaaattcttttaacggggacatatcttcattaatgttttcctcgtccctttgccctcttggtcaatatatacagccatgaacacagtcatgcaggcaaccaataaaaccacaaggccacattactccctccgtctcaaaatgtttgacaccgttgacttttttagtacgtatttgaccattcgtcttattaaaaaaattaattaattatttattcttttcatatatgttttatctacacattataactactcctacattgaaaagaaaaaaagacagaaacaaaattacaacaggtgcttgctatacattgggtatagtcaattgggacaccatcacaccattgcttccacctatttgtagctacctcattcactcactcactcactcccacacactgcagccagctgcagctgcagcatagcagccagactcactctcacacagtcacactactactagactactactactcccagcaatcacatcctctctctctatctctctctttcaaaagcgtgtgtgcctgtgagcctgtgactgacgacggactgtctgctggcacgcacgagcgggcgcctgtgcgtgtgtgctccgacctgcaaatcagagaccagatcgagccccctggccggctgcagctgcctccttgcttcctctagctcctggagtgaggagagctcgccattgctgtctgctcaagctctctagcgtagctagacttctccggcgtgtgcttggctgctgctagctgctagctggccagtcttcctctcttgtccgccggcgagatggtggtggtgggcgccgtgagctgctgccggagagggagttggcggcgacgcgccgccgccctcgccctcgccgtcgtcgtcgtcttcgccgcggcagctggtgagtgcagagatggcagaggcgagctagctctcttgccagctcttcttttcatgcgtgcactttttaatctgagcgtctagtcttttgatcttctgcatataatcagtgattacttgctctagctctctctttttccttcacctttttggtgcttttctttttgtctgaagaccaaattaaccggatctttgattaggttcatcagaagcttgttaactgcatgcaggttgattaattaatctagctacaatgttttactactttacatataacattagagtggtagctatctctggccaggtcttctctctcaaggaaactaccttaaacaatcttaaaaactgaaccttaattaaattaagtgttcttctctagtggttagttttttttcttagaaattcttgtggttgattagcatgccgtctctactctcttcatgtaccgaatacaaatatcgagaggcttatctctcaaatggtaacatttttatttgcttcccttctctcttgatgaaaagttttggtgtagttcttgcatgcttgcaaattaaggtccatatatacattctacacccttctctctgctaattacttttcgtcccatcacctagcaaatacactaatataaggcacctcctcagagactaaagtgtaattagcccaaaagctaattaaattgcaatataattaacaatttcaatttccttgttgcatgccattgatctttagtttcctcacacttgcaacatcctagctagctagtgaaagaaagccaccaaggtcaggatctcttaactttctcattaagctgtacactcaatcatatctccacacattttcaagatgcaaacctatattaatttgcttcttaacacacacacacactctctctctctctctctctctctctctctctctctctctctctctctctctctctctctctctctctctctcatagtctcatattctcatttggtcttcaccaactagagcctttttctcccagcagtgtagtgtgctggtgcccacacgatggcactgcacgctctggtccagaaaataatatataacacgatcgacctactaatataatacacgacatcagctttagtacagggagagaagaagaaagattctgcaagagaacagcccatgcaaggccaatacacgtacaatccacagcccaattaatcagctagctagccacaaatacatttttggtctcacctgcttaacgtttaggacgccgaccatatgctccaatctccttgagatcctagctagctaactacccattctaattagcaatggtcaccacgaatgattaatgtagagtatgtaattaggagatttttcaagggttctttttgctgtattgagaggcagatgtctcttgttgtattaattctgaagtatttattatttattaaatctggaaataacatatatatatacatcgatacatttatacatcctataaaaatactaaaacacaaagtctagagctttgctagttgagataagtgatatgaccggatatcattcatgccgtaaaaagagtcgtatttttaggcgtggagctaataattcgaggtaataatctggtggtgaagtagttgaaaagaacgtacttgcattatattagtaggtcgtgtattatattagtaggtactatttaaaaaatataactattttatatatggttatattttttatagattaaatagtacaaactgatcgagcaaaaaaaaattcataggttggttttctacgtacggattcatcgatgatccactgttcattgtaaaaaagaacattaaaaaaatatatcaatatagttatatatgctttcagtaaagtttatactaacaattaaccatatatacatgtatgcatgctacagttgccgctgctgcaaggaggccaatccgtgtactacggagaccagcagcagcagcggcgcacgtgaggagactagactcgtcgtcgtcgctgatgctagcgaggaggaccaacgcggcggccggcggcggcgacaacggcgacgtccggcggcggcggctgatcgggcccgggtcgtcgccgccgacgtgccgggcgcggtgcgggcggtgcgcgccgtgccggccggtgcacgtggcgatccagccgggcgtcggcgcccagtgggagtactacccggaggtgtggcgctgcaagtgcggcgataagctcttcatgccgtgaccgccgccgtctcgccgccggcgaaccacgtagcgcggcggcggcggcggcgccagccatggctgcgtggatcgatcgatcagtagcatagttttgaaaggggtgtagtagtgtgtaaaagagggggaggagaaagtaatttaagttaaaaggttattttgtggtgattataaactagttaattaatcaactaggtcgatcttaatcttaagatggtgtactgatcgagttgatgatgccggtaatgtctgtaaatgtgaaatttaagatctggattttaccgtgtatgttcttctttttgatttatctgatttccctttttcgactagttcttttgcttaggtaatttttcactttgcattcttcaggttgtaggggttatactgtgtcattgtaattgcaaattaagatggacaattatctgtcttgtgctcttacatcacgcgattttctcatgatattggactaggcaagagtttcctagccgtctaaaagtgggtgagaattgaagagagaataattaactaggggttcagcacgaatcttaaagcatataaggccatgtttagttctaaagtttttttttccaaactttcaactttccatcacattaaaccttttttacacacacacaacttttctatcacatcgtaccaatttcaaccaaacttccaaacttcaatgtgaactaaacacagcataagccgtcctaaattgacagttgtacttaaaaaaacagaatagttcgacgaataacaagtattacaaaatatatatacactgagattttactaataaataaaccaacctagctaaatttacagtatactccctccatttcatcatattataaatcactttgatttttttctagtaaaaaagattttagctaaaacaccaaattagttttagtagattattataggatgtctagattcgtaatgttaggatgtgtcacatcctatcgtgggtttgtttttttatggaacggagagagtattacattaacatgttgcaggagctcatcatagagctaaaataccaaattagttttattaaatctagcattcaatatattttaatattatgtttgttttgtttcgaaaaaactactatatttcttataactttgtcgaactcaaaaaggtttaattaaaaaaataataaaaaagacttataattaatataaaaaaggaggaagtagaatattatactatctacttcctccgtcccataatataagggattttaagtttttgtttgtactgtttgaccactcgtcttatttaaaaaatttgtgcaaatataaaaaatgagaagttgtgcttaaagtacttttaaataataaagtaagtaaaaaataaataataattctaaaatattttggataagacgagtggtcaaacagtgtaagtaaagataggaccgagggagtagttacaagtctatttggactgacaacgtgaaagcaattctcagctgttagaagtctggtgaggtcactcactctgatagatcacatcatcacatggatgcacggagtactaaaatgtcaggacgatgttatcctgaaacttcaggctacataaccccatgatactaggagtacagtgcctactacccgtacttcagcatcgatcatgcatagaactctctcatattcagattcattatattagaatgtgtcacatctaataaaaaaatttatatttagttgtggagaaagtatatgcatggactttctttttttcattttctatgcatagatcgatgcatggtcatatgaagttcagcttgcattagcggcgaatccaacagagtttcaggctatgtttagttggatctaaagtttggattttggttgaaattggagataatgtgattaaaaagttgtgtgtgtatgacaagttaatgtgatggaaaaggactgaagtttggatttaaactttgcatctaaacacagcctcagtctttcagagtctgagcaaatcttgttatgctccctccgtcccataatataagggattttgacttttttaacactgttttgcccactcatcttatttaaaaaatttgtacaaatataaaaaacgaaaagttgtgcaaagtactttggataataaagtaagtcacaaataaaataaataataattccaaatttttttaaataagacgaatggtcaaacattgtaagtaaaaagtcaaaatcccttatattataggacggagggagtatttgcaatgaaaattgtctccaaatcttccgaaaacattcaaattctattgtatactctttccatccctaaatataagggattttggttggatgtaatgtatcttagtactaggatacgttatatctaactaaaattctttatatttagggacggatggagtatctttctaacgagctcagacgacaatagggtcgctgggcggtggatccgccaatccaatgcatagtttggtcaaatacagtaccatgtacattctactttattgtacttgtctagttcttggtccaaatatatgaccagtatttcttatattttggtacgaatattctatattatatatgatagagagggcaataatatcaatggtttggttacaattgttaccccgcgctgtttgactggtaaatggagaaacaaccaagcaaggaaaatacaaaagcttgtctgtttgctcatgattaaaaattttggcttggaatgaactccatagtcttctccaggatttgacgtctatgcatggccaggaccgggacccgggttcaaagctggcccctgtaaccctgcaagagtactcctccccagtccaagccacatctctacactttattcctctcttccttttcttacttttctatcttctttcactactctcactcaccgaccaaatataatgttcaacacctgcttccttgcatccttgttattcaccggattaattttataaaatcacacagtaatgactctgattgattgagctaccgctaacgagacatgaaaaataagcaaagttatacaaaataattaacatgtactctctccgtacactattttttaatgtttcataatataaggtatgcatgaatgtatattattaactagaacttttttcccactaaatttattttttaaatcctccatacttaagatcgttaattctattgtgtatgcattatatttatttgggtgatcaaaattatgaggtgataataattatttgttgatatttgggttaagggtggttgagcgttatattttggaatggagggagtaaaacctttatactactactactagatatttaaaagacaaagctaaaaaatagactccaacaaacaaaccatcgctcccctcccatcgaaaaataagttttatgacttagatttctgcggccaatccatatcctatgaaattctgatgtctcaggcccgttcgatttcttacttgagagaggttttcaacgcacgtaaaacgagaaagcttattagcaaataatttaattacgtattaattattataaaatcaaaaaaaatgaatttatttgaattttttaaatggcttctacatagaaaccatttataaaaggatgaagaattacgtattaaaaaataatttaattacgtattaattattataaaatcaaaaaaatgaatttatttgaattttctgttaacagtttgaaaagcgtgctaacagaaaatgatgaagttaaaattgaagttatagagcacacaaactgcaagagtaaccacaatatggctaacaccttttggctataaaactaaggactttttttggatagcaggagattacataacaaattcaaaaacataattaaaatctaattaaaaaaaactatgtttcagaggactcttatgatgggtcgtatccaaattacacatttcaagacaaacatgatgaaagcagctgactatattacttagagccccactccggtgctttctactcgtagtagaaaataatctgaaccgttgatcttatttgatcggagggttcaaatctatttctactccaactacatttaacggtagtagaatcgtagaggggtatatttgtccaggaaaaaatatttacggatgggtattttcgtcctttttattctttaaccttagctgcactttctcctgtctcgttccagagccaacgccatccctaacctaagccgaggcgaagagaacctcgcagctccttcctccgccgtcatcgccgcctcggacgacctcgcctgctccgccgcatggtatatgttcagattgggaattcactggaattaataacattaattccatagcggtaaagaactcgatacgattaaaaatataaaccgcaccaattgtaaacgggatagtacgggaaagaaacagcaagtgcaaacggagaaaacaaatcacgttaaaacaggataaattgacgggataatagatggaaacggacggatcgataatgggtggaaacggggtaataggggaaagaaactgcagtggaaacggagaaaatggatctcgtacgaacgaaaaaagaaaatggatctcgtacgtacggaaaaaaaagagaaaatagagaaaacaacatagatgaaaaacggaaagtcccggttgacatacggatagattctgacaggaataatatggttggtccaaaaaacaaaaaccatgtactccttccgtttcaggttataagttgtggttgaagtcaaactgttttaagttggaccaactttatattcatagaaaaagtagcaacatttttaacccaagacaaaattattatgaaaatataaataatttagtattacaaatatctgtagctctctttagcaaaggctgggatgtttattccattatctaaaaaaaattattattattatatttatctataaacttagttaaacttaaaacaatttaactttgaccaaagtcaaaacgtcttgtaacctgaaacagagggagtatttttttaatccacccggtccggataggctggacggattctggtgtaaccagttttgtcataaaataatatttctgcgcacaagcaagaaaccacgtgtttttggtcaacccgtggatccggacaaactggacgaattccaagagttgtaaccattattgtgctaaaatagtatttcccctttgttctatgtttacaatacgtaaaaaccacgagttttattaatcgacccggttcggacagatcggaccgattccgagcgtaactaattttgtcctaaaataatatttctcctttattctatatacacacaagcaaaaaccacatgttttttaatcgactcgagggtccggacagaagcggacggattccgagcattgtgaccaattcctaaaatagtatttctcctttgttttatgtgcgcaaaactaaaaaacacttaatttttaatcgatccggtccggacataccagacagattccgagcgtaaccaattttatcctaaaataatatttctcctttattctatatgcgcacgagcgaaaaaccacgtgttttttaattgacccagtccggatagaccggatggatttcgcatgttgtaaccaaatttgtcctaaaatagcatttctcatttgttctttgtctacaagacagactggacggaaaaccacgtgttttttaatcgacccgatccagacagactggacggattccggacataaccaattttgttttaaaataatatttctcctttattctatgtgtatatgacaaaaaaaaccatgtgtttttttccaacttggttcggacattcccagatgaattccggatataaaatacgatgtgtcctaaaatatatagtagttctgttatagtataaatttcgtctcaaattgaaaccgagtttcattgagtttaaaaactttaaaccagttttcttgtcgttgtagcctaccttatcctacgccacagacacgttctttttattttttttaattcgacacattttttttattttttttaccggacgtgtagtcacgtacatgtgtgcgcccctcatcaacacgtccgtccggcccagaacgccacggcctaattgcgaagagaaggagcaggcttgactatgggacccacctgaagaaataagtgccaaatctaccccaaactaatttactccaactttactaatctacccttaaaaataaacggttcagattaattatacttgtagtatatactacaagtaaaaagcatcggagcgtcgccctattacttatcatgttgccatcccatgagtctctctgatctgtgcctagctgctccaatggctatatctttttggcctttctgttccatccatgtttgcacagatataaataatctcagagattttatatgcaagaggcttgttgtggcagctatagctatagctagctatatatccacagtgtcacacactatacacacccctgtagacgagtaaactgaaacaggagatgggtgtactgatcaaaaaaaaaaactctaaattcttgagcaaagaagagacaaggcgtgcagatcgatttctcctcccatttcatgcatgcgtgcatatgtatgatcggccgatgcaaacacaacacgctatccataaaaaccgtgcactcatgtgtggttgcttcgaatgtgaaagtgctataggtgtacaactttaggatatctcctgtgagattcatcaattatatgtgagcagtgcatatatagtatagtctcgctacgatactctctactggtagcataatataataggctatgtacgcatacacgcacaccaaataaattgtcgaaaattggctcttgggcgacactctagttggttgctataacacatagaattgtttaagtaaccgcacgaaaattcaacacatttgttacaatactatcgaagactcttgcatgacgctttaattggttgctagaacacagaaaaagagttaagtaacagtaacatatttgttattatatatagacgatagagaatttcatagaaggcacttgaatacaaaactaagctattttctagaggttgctgaatagtcatgtgtacaagattataagatagccgctagatattatatttggaattctgcacatattctaccatctgaattaatgcgaacactcgctatcaactgtaagtagggatggaatgatgctgcaggatgcacataataacaacctgtcaactgtacccctgcaatactcctccctaatagcaaggttaataatacagccgacctgttagctataaggttctttgtagcattctctcagcctaccatataatagttagctctttacaattaatatatggcccacttgcctctctcatagagttttttggttattgtgtctgagccggctgtaagtttacagcccgtttatcctctctctcctctcttctcttctccacatcagcatttagccggcttatagcctactattatacttgctctaacctgaaactgctgaactgcatgcagtgtcgaaaacttcaacatccttgaacagatatactaccagctagctttacaacatcccatttcaacctggtagactggctatgtctcacactgattccaaaatggtcactgccaaaacaggaggcaggagctgtccgatgatcagctgctccatgttactgcaatactagtagtagtataagatggcatgcatctgatcatcatcatggtactcctgtctttctgaatgaaagatcattcactattcagataggagtaatatcataaggagaggattagaggggttgaaaaatagtgttcgcccatggcatagcataggtcagcaacccaaccccacagactccaacaagatcgagggggttgtttggctagcagcatctttggaaaaaaaatatcaaaatagttttgtcatttctgaagtaccagtgtacttcctcagtttcacaatgtaagtcattttagaaatgacattttccacattcatattaatgttaataaatctagatatatatgtgtgtctagattcattaacatctatatgaatgtgggcaatgctagaatgacttacattgtgaaacggaggaaatatatttgtattctacattttcttctccatactactacaagtaaaggagtacagtatatctttttgttgtttgtcatgtgaggttcaagggtacagggtacttgccctgcagccgtaccgtccttgtgaaaaggaggcacacacatgcatattgatacttgtgagatactgtgcatattgatacttgtgagagatactgtgtgccactactaactttctcacagacacacgagacaaagagatacagatggataccgctggggatatattgggttgtcgcacctttttcgtgcagcttacaagaaatatatatcggagaaatctagccgtcctaataggcaattaatcctataatgcagagtcctattaaaaaactaatccgaatatattatgggccaaaattcagataacatatttaacaggcaaaatgggctgaaactaaaagatcaagacatatttttcggcacatgatgaaactgatgaagatgaaagattttttgcgcacgtaaacgagaaagctattagcacttgattaaatggatatattttatattttaaactaacttctatataaaaagttttcgtacaaacgctaaaactaacttctatataaaaagttttcgtacaaacgcaccgtttagtagtttgaaaaacttgctaacgaaaactgaggtaaagtttgtatcttaatgagaaaagaacggttaaatagactgaaaagatcaaaaccgaaaaattcggttaattagtagttcgatctcaactgctaactaattgaattttatttgatcagttcagtcaccaccatcgtttaaccgaattagatgcgctactgaacatgtaaatagagtagggctcgatacggagtggttcaatagattagctcaattcctgaacatgcgagtgataaataatgccaggattcaaagaaaaataagttcaatggctgcttgcatgtatggagatcaatcgatcatcacgtgccatcagctggtatctgtcgccaatccttacatataaactacggacgcggtgaacgccaattcgatcctatatatctaaattattggtgctagttaattagtcaatggcgcatctgtaagaaaaaaactttgttatctagctaaatttatgtttcctataaacatgctccatccatcctaataaaaatcaaatcataacatcacaatgagtatataagaaaataaataaaatacccttaagtaggaaagttgtattcatgaatgagtaggtgggggtattgaaggcataaaatttatcgatctgcaaaccaataatagatagaaaaggtagtatagtttggaggacaaaatttaaactctaaatgttaatttattttggaacggaaagagtagaatgtgaatgcacagtgaattttggcagtcaaatctctgatggtactgagaggagactgaagtttctggtaaacaaaaaagacgtgatgataatttgttatcctgactcacgtctcactaactgaaatgatctttggtgttatttctcatggggtggcaagggacgatctagggagtggcagatcgttaaattttctgtaaaataaagggcatatgtctccccgtctgaaacatcgaagattaactttctcgactttcagttttgaatatttggttggacaatttgccagaagtttaaagctgcagtggcaaggcaagcctacatcatagaaatggagagaggcctctgaaaactgtccttatttttgcacggtcaaatgggccaatctatgggctgtttcttgtaacagacgaacatgaatgggctggccggcccgacaaatgaataggcagtcccatattatttctatcgtctgtgcagtgtagagatgcctctgatcacgacgtcgccgacctccgcatacttctccttgccacgagtgtgtgtgatcatcatctggttcgttaattgtttttttttttgagaaccatctggttcgttaattgagaagttgaattccaattccttctccttaatttatccgctctcttttcagtatcagtatgtgttcgattgattcttttgtgtcaatgtttggttggttcttcgtgagatgaaattagtccaaacttgcaacatgtagaggtgagatgaatttagttcaaaattgtatcctgttttaaaagaacatacttcctccgtttcacaatgtaagtcattctaaaatttcccacatttatattgatgttaatgaatctaaatagatatatatgtctagattcattaacattaagaaatgctataatgacttacattgtaaaacggagggagtataaaaagagcttcatgggcttttgttttcttctctgaactccctcacgaaaagcccttgccacgtggcccagcatcgggacgtacgtggctggcttgcacggtggctgcggcggaggagtccaccatcgccagtgacatcgccgtcgccggaggagggtttacattacctctactaaatttcgagccctattagtattatgatttttgataaattttaactgaatttactgtttaaccttcgaaattttgatcaaaacttaatttcgagccatgttgaaacatcgaaatttcacgaaattcgaccggttttcgtcggaactgtgaacctgcaccggagtaccaaagtggcaagacgtgatctgcaaaggcagaggatgctgccgtgtgaagtggccaagctagctttcctggtcaaaacaaaaaagtgaacaaaagctagttacaacacctgcatgtatatttataccataaaaatgggaaaacgagttgaacgagattgcacgcagttacaccggagaggaagaaaaggttgcaaaattgttgcacccaaatttggggggagtgacatgacacggcaggggaaattccgtgaaatgttacacagcaatgtgcacggcaaaatttttgaacaagttaaaccaccctctgcctacctagatttagggttatggaaaatttaattcattttccttcttgttttcttgtaccagttcctttcaagtttgtgtgtgatctcagagtttttttttttggttgttgaatgatcattggatatgagtcagcggtgagagcgagaggttagttgggttcgccgcgtaaatcaggaaccatgtagctcaagactaggggaagatgttgaagaagaggtgattggaggtgggcagatggaaaaactttgagcaaatgaggaaaaagcataaatactacactttggtcttgcatggtgaggtcatggcaatgtggcatacaacaaggatgacacaaaacaaagttgttagtactgaggagtgaggatgcgtccgtttgaagcacaaaggataaatatagctcattttttatgcgtacgtttttcatagaaatgttaatttaaaaataattataccgatccatttacaagtttagaatgcttaatatcaattaatcatccgctaatggttacaccttatcttgcatatcttcataatattctctttttcacctcctttcaaaacacaccctaaatatctacacaatttgctattgttttatttcttacacctgcacatacttcctctattaaggccctctttgtttagatttataagccaacttataatccgaaaagtctaagcctaaacaaacaagtggcttttttcatttggcttttttgaagccataagacaatctaacacttttaagccaaaagctaggttggagaagcttttttgacttatttgacttaggacaataaatccaccggcataaatcatataagccaataagctgacttaaaagtttaatccaacaaacctataaacctaaacaaagagggcctaagtatagtatatataagtagcattagtcagtggcggattcatgcttaatctatgggatcggttgaccctagcttttccaaaaacaccccaacaaatcatgattctcgtgtataattttttttaaaaaaaatagagaaatgtcatcacttaaatataaaccagtagtaattgatctcacattgtaaaattccctggtactagtactacttattggtatcttgaacaaattattacctttccccaaacaatagaggcgttgtaggtctaaaattcttgatgaatgaattccaggctaaaatgttggctaagcatgtgaaatataagatgaattttgagctaaaatttgtcatgctaatcgtaacttaagatgcattggaaataggtgtaagagcggttcacaagagagcgtacaggttacttcctatgaggattcgctctaataactacataagttattgtagcggatcctctttacttgtggagtaataagtagttggtgatacgtgttagccacgaggcatatattctataataatacagtgtcttgtttcgattgtaaagtgaatttgaacaagcacaatttctaaggtgaatttggataaacacttgttcagatatatcctaaaaggttgatttttttatttcagagaaggagggtataaggatatttattagaggtatttcatcaacaaaattaacccacatacagcacagtaacaattttatattgagtttattattacaaagccaccaaccagcatatatgcccaacgatttcgctatatctcactcgaaagattttttcttatctctcactcaaatttacagtgtgttttcttgtaagttacagtgtaattttttaatcttcacatgtaagttttaaaatttatattggatatggtctttttcttgcagatatggtaatttagtgtctattatggtatttttttaattgcttttatattttactgtatttattagattttaattaaaaattaaaaatctgtgtaggtactccaactccgtgtgcccaaaaatgagcgtgagcccaactcgccacaatcctccaaccacccctagacacgtgtccagagaatctctaaccgatcagtcgaagacgctccattacactgacaaattggccccacatgtcagtgactgggccttgctcgatatatccgcgccatggcttccgctgtgcagttgcttttgcttcgtctacctctcgccgccgttttccccccaaaacccgcgacgacgaaaaccctagccgtcgccggaatgtcgaaggccgaggccgccgccgccggcgacgccgccaagcccgacccggagatgggagtcgcgggggagaaggaggtggttgcggagaaggcaccggcgaggaggaaggtagcggcggaggaggaggacccgcggctgcggtgggcgttcgtgcggaaggtgtactgtatcctggcgctgcagttcgccgtcacggcggcgatcgccgtcgtggcgtgggccgtccgccccatcccgcgcttcttcgcggcgggctccctcgcctcgtggctcgtctacctcgccatcctcctctgccccttcatcggtctctgcggcctcctcctcctcctcctcccttcccttgcttggttcctcgatctctctttctttcttccatggtggtatctgattggggttttggggtttgcgcagtgctgtggccgatgctcaagtacagggagaagcaccccgtgaacctgctgctgctgggcctcttcacgctctgcgagagcctcaccatcgccgtctgctcctcgaccttcctcggtatacacgccaaatgcgctctccatttctctcctccccaaaatgtctccatttttctttctccgaagaaaaaggtctccgtttttttttttttttgggggggggggaattgtgatgctctaaacgtgggtgattgactgatttgagatgcagttgggttcggatgggtaaattttatggctggttcttgggccaattgattgtctccgtgtgatttggttctggacttttggtgggattggcgattcccaggagttctttctttttctctctcagtagcattgttgcagggatgtagctgctcgtgcattattgaacagatcagatgtcgtgttttgtgattagatggaaaagttcgaggttgttttgctgtggagtgtatttggttgtagtgttgcgtactgttgtatgggtaggaccatcaggatctggaccacttgctgttcctattacctgggagattatgatatttgttgctatcaggtgtcagaattttaattatgaatgttggctgttgactactccagaatgttggctgtgcattatattgtggttgtttctgatcgagaccctgattagatttttatagtcttgacacatgttttataagtggggttagtggtgggggtggggatgatcttggtggtcaactttctttattataaaacgcacgcactgcttggaaacaccatacacgatgccttttcccatataaaatactaccttacaagatcaccattcttggatatctatagtgttcagtttgttaagaagaattttctatcttggtttttctggacaacctctacaagctgcccatctaactgcttgcaactacctgttgaattctaagtacattttcaattactgttttctttcttgtctgctgtatcacttaaccatcacattttcatacacactatgtattattaaaggttagtctgtaattctgtatgcactaaccagtttatacacttccatttcttagattctggctaatcagtgtactactgttcagtcaacaaatttgttgctctctctcttgcatggttgcagccttgcaggggatgtacttcctccgtcccaaaataagcgcaaccatgagtttccgtgtccaattttgaccgtccgtcttatttgaaattattttatgattagtatttttattgttattaggttataaaacatgaaaagtactttacgcgtgacttatgttttttagtttttttcaaacaaattcaaataagacgaacgattaaagttggacacggaaactcatggctgcgcttattttgggacggagggagtagttggtagtgcattattgaacaaagcagatttgtgttgtgttttctggtgggaaggaaacatttgacttttgaggttattctgatgtggagtatatattggttgtagtgttgcatattgttgtatgggtaggaccattatgacctggaccacttcctagttcctattacctgggagattatgatatatgactatgttgctgttaggtgtcaggaatcttaactatgttgcatattttggttgctgtgactgactgaccgaggtcctgattagataatgatagtgttggcggtggtggggatgatcttagggtcagctttttttgggataaaaaacaaaccctgatgtgccaacaccatacaagatgctttttccctcaaaaataccatacaaaagtgtttgttaagcggaattctcaatttgtttttttttttttggacaacctctataagttttgcatgtaactgttggaactacatattgtgtgctgaatttattttcaattactgttttctttcttgtctgttgtatcatttagccatcacatgtttcatattcatactatattattaaaggatggtctgtataccctgccctgtttaaatgcttccatgccttgaaaattctggctaattagtgtgctactattcagtcaacaaatttgttgtggtagcactagtaggatgctaagtttcctttgtcaagattaagtcccctgaccccttttgcatcatctctgttttttttttttactctgtgtttgtgatggagcaagtggctcctccagatctacttgcagaaacctccgctgggcttcactgcgttgagtgcttggtcgctatgttttatatcatatattgagattgaactgccaaccttttctatcttctgtctttattggcaattgaacaccatttttgttatggcacaaccagggtttcccaaaccgccggggccgaggttaccgcgccctgggcggtaagcacggttaccgcgcggtaaccgtgaaaaatcttacgaaaccgtgcaaaatttatcaaaaaatcaaattattttttaaatttaaggaggttaccgcggtttttctattaccgtacccccgtggtaaggccggtaaccacgcggttaccgacggtaatgtaaaccctgggcacaacacatggcttctcattttgagtgattgtagatttcaaagactgcaacccccaaaacacagaacttgttctttagatctgagctagattacatggatgatttccttgacacctcagagagtttcttgttacttcctgttacttgcaaacaagattcaaatactccttcagaatgatttgtgtatcctcaattgaagttcacatttctttgctcaatgctaacaggtaaagtggttctgcaagcagcaatcctaacggcggttgctgtcatcggcctcaccattttcacattctgggcagcccacaggggccatgatttcaccttcatgtatcccttcctggccgccagccttctggtgcttctggcatacctcatcattcaggttatcttcttcttccctgctcaacctgctccgtttttcttttcttctcaagtgctgtctaactcattgtgcaattcaccgtgacccggcagatctgtttccctctggggagggctggcatgacgatctacggctgcctcgccaccgtgctgttctccgccttcatcgtcttcgacaccaatcagctgatcaagcgccacacctacaacgagtacgtcatcgccgccatctcgctgtacctcgacgtcatcaacctcttcatggctcagctctcgttctccatctaagtggcacgcctgttcttacgcccttcaacggttgtccagtacatggtggttcttacagctgaagaaacttagttacatttaccttacctaccatatcctacactactatatatgcagcgagaagtcttgcagagctggagactctggacctgtaattacttaatcatctctagctatgttgcactgtcgttgcgctgatagcacgatagatatattctggtacctttgagacatgtttgcagtgatctgcactacatcggtttagatctaatcagtggagcgaaaaacttcaatggagatgttaatttctcacaaatcacttgatttaatctgggccatgatcaagcaagcatctatcatgttttgttggtgtgcttgttgctcttgcatcttgccaatcagtctttgcatgatgcatcactgtggtctgtggacagaacttctgaagctgttactggcttgctgctgctgatggtggtcagatcttttgaagagtatggctggtgcctggtgtgatagttagcgcagcattattatctactgatgtgcacaagatcttctactgctaagtattttatttctatgaaattattaacatacactgatgatcacatgaatgaaacaaaattcctactgaaaaaggggtgtaaataggaaaaagaaaacgtctcctcaatatgggaaaagaaatctctgcctgtctctctattattgctactagctgtgctctgctgttcatcctatcatgaaggaggagaccagcacgaggaggaggtggagcagcacgccgccgccggccggcagaagggaggaggcggcggcgccggacttcttgacggtgaacgagaacggcgccggcggcgccgtccccggctgcgacccgttgaacatgctgatccccaggccggagcagtccgacccaagcgaacctgccaccggagaagaagaaaaacatcagtcgccggcgacgagctaggcccggcattcatccagccggccggccgcaggataagatttataaaagtttttgaataaggcaaacaatcaaacatgtttaaaaagtaaacggcgttaaatacatgtttaaaaagtaaacggcgttaaatatttagagacgaagagagtactaaatatttgtgcaattagcatttatttcgttgcgaaatgttttattgttaaaattattttaagcatgatttatatcttatacatttacatcatttttttaaaataagatgaacgatgaaacgtgagtcaaaaatatatatcatctactcccaaaacgaaggaagtattgcaaattaaagctgatgcttacactgccggtagcaagggtaggaggtgtcgttgagaaggttctggaagccgtcgtggcaggcgcagcggtggccgaactccgacgacctctcgcagctgccgccgtcgccgcagtactggaggaggcaagctgcattcattcaggcaacaatcaacgacggcgagaattaattaacgccatgatcagctaaagctaagaacagtttaatttgacgacatgatggtggtgattaatcttgtgggttttgagtgcagtagttgagagattattacggtcgtagatggagaggttcgtcagcgacggcatcgccggcggcggaggaggtggcggtggcggcgacggcgacggcgacgacgacccgttctggcacgagtagttgatggtgcctgcgaggaggaagagtcaacggtcaaactcttctctgggtaatcactgttctgcctacgtggcactacaagtcagtccagcgtgcgtaactacgtacacgtggcaactctttgtgactttcactttgactttggggttaaccgagcagtaaagcaattaacagcttgtactctgcttctggaatttggacttcttgacacgataagattaccgtaggcacgtactataataacgttacaacttactacttcctccgttacacgatgtaagttattctactattagtcacattcatattgatgttaataaatctatatctagatttattaatatcaatataaatatgggcaatactagaatgacttacattgtgaaacggagggagtaactcgtttgttctttcaagaaaaaaggtgaaatttaactcatgtttcatgagcaacttaatccaaacatgtggtggcaaagtccacagatgcagtttggacctttgttgcacgccgtttgaccaataacaacacaagttgaagtgtccattcaatgggtttgactatggcctcgtttacttcccaaaatatttttcccaaaaacatcaaatcgaatctttaaacacatgcatagtgcattaaatataaattaaaaaaaattaattgcaagtttgaaaggaaatcgtgagacgaaccttttaagcctaattagttcataattagccataagtgatacgataactcacatttgctaataacggattaattaggcttaataaattcatctcgtggttttcagacgagttatgaaactagttttttcattcgtgactgcaaccccttccgacatccggtcaaacgttcgatgtgacacacacaaattttattttcgccaactaaacaagccgtatgttagaggaatcttcccacatactcctagtacttagcaagctaacatttttatatttgttttttaaaagccataagttaatcatacacatttaagctaaaagtttaagcatcttattatttcctatttgaagtacacgtagaactacaccattgaacttgaggcttaaagcgcacatcgagatctctaaacttggtttattgtatcatttcgatccaaagcgtcgtttgacagtggtcttacctacgtggcacgccacgtggacgatgacatggtgtttttttttctttctctttttctttttcctcctattcttttatcttcttcctccactagagctacctcgagctcccccgtgtcaaagaggccgaagaagagagaaatgaaagaggaagaagagagaaaaaaaggaataataataataatgtgccatgtcgtcatctacatgtcatgtcaaatggacaagaccacggtcaaatgagactttggaccgggataatataataaatcaagtttagggacctcgatacatgctttgtaagtttgtggatctaaatgaaacctgcttacaagtttaagaaccgcaagtgcaatttactttaaaaaaattaggtacattctattctgtcacttgggacataaaaaggtgctatgtctgaaacatcgatgcctataaaaggagcgttaattgtaaagctaggatagtcgatggtggagaagctaatgacaacgttaagctatgatgagcttttattagctatcagtaggtttttattaatttcagataatggattaattaaaaccacgtgacctctacgtccaaacaaaatgtaacttgacaaaacctagtattatatggacagtttttagtagccgatggccgtggtgtttgcattaaacctaagcgaacacctctgcacaatcgatgttcacgtggttaactattcaaatatgacctaaatcccgaaccaaccgttaccacgaaattcagttaattaaccaaatattttcctggttataatcttcagtgttataacatttttcccctgatataaaacttcgcactatggtgcgggtcgtttcggaaaaaaaataaaagaaactttttttcagcccaataccatcgcacacacaaatcatcaaagagattaattgggaaatcaacaaatataggtaagtaaatcttgagaagagatgaaatgaaattacagttgggtatgacacatgggaggaaggggaactgcaggttgccgaggtggtagcggctccacccggggttgcacctgcacgcgaacccgaacacgtagtcgctcgactcgctgcagctccccatcccgcacctcaccttgctgcacctactcccatctccatctgcaaccaaccatgcaaccaagcagcaattcaaccaccaaaaaattcagacaagaaaaggagagaggaacacccatcgatcatgcactcaattagctagcttgcagtactattcaggcattcagctgctcactttgtgctcctgctccatctggcagcatggcgatcatggcctgcagagaaaccatcacaagaactaatctgactctgctgcacttcatcgtctctaatttcagagagttcagagagagagagagagagagaaggaaggtaagctttgtttgcaggaagataggaggatgtagtggcgacttatatatttttggcgtgatgtcgatcgcaatggcgcttggaactaaattaagactaaaaaagaagactgcacctcaagttataccgtcagatttgacagagaaaaaaaatggtcatcaccctaattaattgggcaacatatgcgtcctctccttgcttgtttcttccagaacatggagacgtaggagcaataatctgtgtgaaatgtatggatgaaactgtcttaggtcaattgatgtccatacttgattaattattaattgctctagttttgcattcactccaggccagtgccggcctggaatttctttcttccgtgtggaaataatgaccgagaaatacagataactgaacttttctttttctggttcattgaatggaccaacatttggtggcttggtgcttgctgaaatataatacctggctgctgttgatgctgttgctggtgcaatgatgtggcgtgtgttctttgcttctcgaaggttgaaaggcttgaagcttagagtcaacctttgtgtagggactttttcatgcacctactaaatcatgtctaaaaaaactttaaatctttttttccgtattatgattgtacgagtatatgataaaacagtattttcagtgttgggcttttcaccgaggcttagcttcgaatttttatttatttttgaaatattttaatttttattttgaaaacaaacccttcaaaacctaattccaaaatctaaactcttttcttcaacaccacctgtgacgtgacagttttattttaccacccaaccaaaacaatgttatcgctactccctccgtctcataatataagatataagggattttgagtttttacttacaacgtttgatcactcgtcttattcaatattttctgaaattattaattattttatttgtgacttactttattatctacagttctttaaacacaacttttcgttttttagatttgcaaaaaaaaaattaaataagacgagtggccaaacgttacaagcaaaaactgaaaatcacttttattgtgggacggagggagtaaaagatttagatcgggaaatagtaaggtttagtagtttttttaaaataaataaattccttagattctctttctcacatgtcggcctcggctgtgtgtagtgtaccgaacagaacatttgggtgtagttattatgttctaaacttgtctaaaatttggctaacaaaattaataaagacttgcatgatgaacaaggaatcttgtcagttgccacaagtgtgactacagaccaagccataaccagatgaccaactacagaccaagcccaggctgcatagtctcaagtacaccaaaaaaatacattcagatgtgtcagttgtccggacccatctttcccttaaagttggaaaaaagaaacaatacctttttttttcaaaaccatatcatttgcaattgcattttatcaccaatcccctacaacaaacttcccaacatatttcagctcccgcagcccatataaacaaaccgggataaaacacacaatatcacagaacctaaaagaagagaaaactgaagaacaaaactttgtcatggtgtctatgtcagttcatgttctgctgaagacaatgaaaaccctttctttttgttcctttctttcggaaactgtgcagaggaagaagatgccaaatcttccagcaagctgatcaagctacaaagagggagtccaccgaagggacctgcgtcctgcagcaggggcagtctggttggatggccagccaggggaggacgcactccgagtggtacttgtgggagcagggtagcctggtgacccgctggtgtcgctcccgcacttcgtcgaggcacacagcgcagagatcggccttggaaagtgtcctcctcatctcgcggcggggggcttttcttgttgatggcgcctccagcatggtcatcgaatgtttgggagtaggcctgggttcagtgggcagctgaatctgctgctcttgctggttgttctgttgtctggaggttgtgctcccatctcgttcgcgaaatcgcctgccccacctgcgtacgtaactgattgttagctcacaggaatatcgatattcagtttttgtcgttttgctactccatatcgaagcaggaagatgtttatgaagagaacacattgatgatggatgagaaaatgccaaatctttcaaaaagaattcaggcaagtagtagaaaaaagggtattgcaaaaaaatccctgaaccctcctctggaaaatggagatgtctggttagtgttcttatttaggtaaaaagtatatgcggaattaaccaaatcaattgagaaccaatgctacccaaatctgataacagctatattattctatatgcattttcaatttcaaacatctgataacaaaagctacccaaatcaattaaccaaaaccaatcacttgtgacaggtttaccattcatgccagtggtaatcccaaaaactagtaacaagatagttactacattttatatgctgaattgattactataatttgtgactatacccataattggttgtttggttaatgaagaccaggtcggatctttcaccggtagttttgtcaattttaagccaagctgcacaagcaagaagccatgatgtactgaaggatgattctatttactgaacaatccagaacccatgcagacgctgtgacgtctaaatcacaaatacgcgggaaaaagggcacacgcctttcgcatgcgtgtgcagccgttggcctaatttctggatagtacccaaaacaatcaaactgaaacagtgatggcgtaaggcatacatcggcaaattccctgtgcatatcattgtgtggcttgatctaacatgtggtagttttcagaaagcagagacatcagatggtgccatccaactagtttggcttatggctatacaaaataagatcacccacatggattaatcataaaagacgtcgttatcagtgggtttgcaggaagcttaaaaaaactaggtgattctcaatagcctcgtatcttgtcttgggaaaaaaaaacaaaggtgttcctatatcttttttttaaggaactaaaagtattctatgtctgaattttgctagtacacatggaattaaaagtattctatgtctgaagtattgtggaatagctgaatgctgaaattaagcaaagcctgatacactgttcatatggaattactcctatgtgataatatatagcttctagttgaatccaagaaactggttgatgaaacaatcagatcttggctcccttcttgccatcgaattcaagaaccgaccgatcctctcccccaattcgagcagaagtaaaatatattagccatgtagaacgcgatctttttttccacgagtccatggctggatctcaacacaaagaaaaggggaacagaaatgaacagggaaaagagggcacggatgagggggattcattcacctcgagagagacgacgagggcgcggccgcggcgccccgcagcttctcctcgagccggatgcgcgccgccaccgcggggctcacctcgccccctgcgcccgcccccgcctccgcgctcgccaccgcctgacggtggtgctgctggtggaagtagttgtagtgcccgtggtggtgctccccaaaccctgcccccgccgccgccccgtcgccgtggtagtgcacccgccgccgcctcgccagctccacccccggaagcatctcctcctcgtcgtcgtctcctcgatggggggttggtgggtgggagagagctcggagaaatttctcccggcgatttataccgagggcgcgcgatggcggaggaaattccgcgacggcgacgagaaagacgacgacgacgtgacgtggggtcttggaagctgctaggaagcagcagggttacttggggaccttgaggttggggtggtgaaattaccttttcgcccttggcatgatatatcctccatgattatccatccatgcataggtttgttgctagtagcttatacatgttttttttttaatatcttgaatctatgtttggtgtcttaggtgagatggtgtttgtgttggtatggatgatcgggtgatataaattatatctggtgacgagaacgggttttggattggctggctggttacttgacgtatcagcgcatacaaatagagtagttaacggaaaactgtaggggtacggtaggtgcgtgcaaagttgctttttccgccaatattgaatgtacgtaggacaaaaccgttgcataacaatatagatctaagcggtcgtttgagtgattaaataagtgaacatatttagagtttttttttcttttgaaacgatgacatcatgaaattagaaccgtctgcgtcgagccatatagtagataagtttccctctagttaaaacaggttgtagtagtgtcattacttgcaagtaacaactattgaagaaggtagataaatcagggctagctttcttggttaaagagacaagtttcttatgactgaaaataaatgaaaaaaatatgttgagaagtcttcgcagttcacataatagaattaaccacaagctatcaaatctcactagatacggagatcgtttatgcttctggtgtaataataattgtaccctcatttccattgtgagtgaagaatcgtctttgtattaattagtttaccttaagaaacacttcaaaacatgtcttatattgtatttatatgagtcgataagttatgtatctacgtttctcagagcatatcttaacaccataccttcaaatttttatctaagatgtcaaccaacatctaaagggttattcggattaatgccattttaaaccataccattttttggtgaagttgtcaaatatatgcatctatttagttcctcaccgaactctaataaatacataagaaatcctacgaaagcttggtgataccgttaaattgtcaaaattttggctacaccaaaattatttgttaagatttattttagttataatttgaataggtcctaacaccgggagtaacactataaagagtttaagacattcggtttcaaaaaaaggaaaagaataaagagagattccgatatgcccagctaaagcaacggattccagaaaaccagcttcttttcatctagaagtatcacgagatacttggcaccctgtttccaaaggggcaaaacggtcaagccacatagtgtcacggatgcttcgcagcagcttctccagaaaattccgagagcgcatgaaaaaaaaaagaaaaagaaaaaagaaaggcgaaaccgatatatatgcacattggatggacatcgtcatggccttatcaatcgatgatatcgtgacgttgataataccgagtcagaggttcaggactttgaataataggaacgaaaaaaaaaagaataaaagaaacataagatttgtatagaaatataattgcaaacacaggagaaaaaatatataggaatgaccgtttgattgaaccacaagaaaaacaaaaggatttgaggagagataaagatttttaaataattattttcatgaggttctaacttatgttagtgtgtagccgccgggggtactatttggggacaacttgcatgaagaagcctccaaaacttatatgggaagagacattccataagaaatttataggttttattcctttgattcaaagggttatgtaaaaaaaattctatagaaataaaatcctctaaaatttataggttttattcctttgattcaaagggttatgtaaaaaaaattctatagaaataaaatcctctaaaattcttatgattttccattaaatcaatggggccttctcggttggcataactagttaaagtaaaagtataaaaaaaattcgaatgttgattctaagaaaattttaacgtaatttttttaacattaacttttgagttgttacgaacaaatacataaaagttttacctataaattgtactccctctgtttcaaaatatttgacaccgttgactttttagcacatgtttgaccgttcgtcttattaaaaaaatttgtgaaatatgtaaaattatatgtgtatataaaagtatatttaacaatgaatcaaatgatatgaaaataataaataattacttaaattttttgaataagacgaatggtcaaacacgtactaagaagtcaacggtgtcaaatattttgaagcggagggagtatttattagggaatacaggtagccggtgagactcttcttacttatgtatggtatcggctggttcccgattaatttcggttgttccaatcaagtctattgaccggaatggctgaaattgatgtcacttgatcgatctggtaccattcttctaaccaactaggtgaaaccccgcgcattgctgcggaaatttagtatgatagcaataaaaaaaataacgtgtaaaatagctagataacatcagattaagtaaattaatgtggtttatgataatttaaatttaaatagtatgtagaatggtgatttaaacgtaaaaagtaaggtggtatgactttatgaaagaagaaaagtagtgagatagtttggaccgtagattaatcatctaaaggctaaaaacaattaatgtgatatgacttaattagaggaaaaaatgataaagataatttggaccatagattaattatttaagcactaactgaggatgaaccatataagtatataggatattataaaacataataaagatatacattgaaacattatgtgaattatattggataataatttaacatgtttgtatttgaaaagctcttaaattataaaaactataaagatatagcatgtttgcatgatgtttaaatgtgatgattgttagtggatgatgatgtgtcatcttgttagtggatgatgatgtggtatctttacatgttgagcttaaggagttagtgagggataactttacagtaagataggattccgtcgtcgaatttggtttaatcagttttttagaactatggtttaatcaattccttaactatgtttagctacgaagttatttttgtctatgccatatattgggccggtactgaccggagtgagatcgaaattgacataccggtatacgacttgttgttctacaataagtgatccttctaccgaatatggctttagtcgatttgaattatgtttaagtgtttaactattaagtaacacatatatatgtttttggattaagtgtttctctcattactaccatcgttgtcaaatattattatttcgcatgaaattttgatgaattgatgttaataatagatttatgatgttgtacggccagtatagtgtcattcccgtgaaggcagtcgaaggggttactggtatgtcaagcggcgtgcacgtcagtagtagagccatgtggatgttgtcgttgtggcaatgccgtcgatctcatccattaatgttgtatgatttcatttgcaggattgtttttttagttctaccacccttactttcttctaaagggatggttttgttctgtaagcatgtgtttgttttcgggattaggtgggatgggataaaaccatccctgattttggggttgggatgattccatttacttgtttggtttgtaggataggacaatcctaatttttttgtttggttgaagggatgagcgagagatgggatgggcgccgtttgctatcaccatcagcgagaaagaggagagtgagcagagatgtgtgacgacagccttgtgggagctcagcgggtgggcggatgagtgcgacgatggctagcggcgagaaggagtggcgcaagattgcgagcaggcggacagacagaggaggagcacggatgggcgagcaggggtgcagttggaggagcacgacgatggccaagcaggcggaggagcgcgacggctgtcgcgcgggcgaaggagcaagctggcggcgagtaggtagaggacgcggatccgcctccaccgccatccccaccactaaatccgccgttgccaagccccccgcggtcgctgagcccctcgcggtcgccgtcatcaagcctcccgcggccgccgtcgccaagcccccgtggccgcagccgcggtcgccgtcgccgagcatgccgcggtcgccgtcgctgagcccgccggtgtctgccgctgctcctgagggcgagtagggcgagcgcgcaggccggccctgagctcgagcaacgcgtcgtcatgccgttcgctcgtcccaactgggacgagttcatccgccagattttcccggatcggttggtcctggatctgagagggatattcctctccagggaccaacccatcccactcacccctcaaccaaacaaccccaaaagtgggttcgtcccatctcatcctatcccatccttgcaaccaaacgcaccctaacatctttggttgtagacattgtatcggggatttcatatcctctgaaccctgtctttcatctatactccctccgtcccataatatagcaacctaggatgggacctcatatccagattcgtagtcctaggataggtctcatcccatcctaggttgctatattatgagacggagggagtaatataatataatataatataatgagttcttaaaaaaaaagacattccactccttagagccaaattcaaatggcctctaaaataaatttgacaagctcaaatggtctctaaaattttagatcactcaatgactcaatatgatatatctaatttgatcataggttgctatattttgagatgaagagaatatttttttttcttcatccatttgcagttgaccctatactcaatctgatatatctatcactctatgtgcctctatcctaaaataaattacttcggtagtaactcttatgcacgaacatggacatatcaactttcatacataaaaataaaaaagaaacaatttattttttaagacagagtgtgtacactaaaaaaaaaagctcacagagattggcattataggtgccggagcagttaaaaccggcacctataatacttttcccttccctacaagttaaaaacacataaaaccgacaccttgagtaattataggtgtcagttttaaagaaaaaccaacaccgtatcagttttttattcaaaatcgccacctagaatttattataatggcggttttgtataaaaaaccggcacctatatggagccgagccggcgagccggccttatccatccgcctgtccttttattagtcgctcggtcgctcctgtctctctctcgctcttgctctctcgcctccctccatcgctctctctctctctgtggcaccggcggcccgatggaggcagcaatggcggtggcccgtcgaggtaggcacggcggtggcccgggggaggcggcagccccatcgaggtaagcgcggcagtggctggcggcggcgcgccctcccctccgctggatccggttggaggggaggtggtggaccttggggacggccgggcggtggtccggtggaggcggtggcggtggccgcgccctcccctccgcgagatccagccggagaggaggcgacggaggcggcacagcggctggcagcggacctcagcggaggcggcagcagcggctggcggcggccgcgccctcccctccgctggatccggatggaagggaggcgatggacgtcggggacggtcgggcggcggtccggcggaggcggtggcgccagtagcgcccgatggatttttgaatgattttgtagttcttttagatgtttctgtgatctgtggatgattttgtttctgaatatgtttcgatctgtgatttgtgagggtttggggatggcgcaatgactacgattgtgagttccggcttgattcgagccggctctttttttttttttgctcgtgcaaacctataggtgccggctctattttggtataggtgccggttgtttttattggtgccaaccaataggtgtcggttggaaaaccggcacctatagtcggttcccaaccggcatctatcatggctcttgtactagtggtataggctaactgcagttaattactcggtggtttcgttatttgtcctaaccatggaccattgggtctccatcgccatgtcactgtctcatatctaattggcatcttatggatttatgatgctgagatatgtgaacttccgtgtaaactctcgatggatcgatgtgaaagcttcaaggttttgagcaatagattatctaagatataatggccgagctgattcattcagagtctcaaaattaaatgtttacttggcctattaggccaccacatcaatatgaaatgaatctatgcgtagacaatgcaagtcagtacaaaagcacatgaaaattttggacagaagttaaaattgtactacctctttctcaaaattaatataacaacttaagttatgattttggacataagatatacgatcaaaactcattatatttttgagatggaggtatagtatgatttattgttaaaccaagaattaattcattaaacacggtgcacagtgcacacagtcacacagataagagtacgtactgatatcgacttgattgtcatttaatttacataccgctgaaaagatcatttacgctgattaaacatgcacttcattgtgtaattaggggtcttattatattaattagagagtagaaattggcgagacctccttaattatggcgatccgtataacagcccatatatatggcacgatcgcaggccgtctgtcagagcccaaaattagtaatgggccgtaattttaaatggcgatatgctaattccctctcttcaataccgtacctacgtacacttcatcactgaagaaattaaggaaataaagaatgcttaccaaaacttaaaacggaaaattaaatgttgacctccgatgtttagatcatggtaacaagcgcgttatcttttcgcttatgtttatgcttattagctaaaatttaaatttttaacattaaatttggagctgattttgatttttttcatcaaagtttatttttcagcctttgcttttaagtcgctaaaaacacgtatatgaatgttttatttacaaattatgtttcgtttgcaaatatgttatttggtttattccttgtgtagtctgcgcatatgtgtgtgttatgtggaggattatggctgtgttcgctgtagcatgttcccaactagaacaatgcgcacggaaaacggaacggttcattagcagcacgtgattaattaagtattagctaattttttttaagaatggatcaatatgatttttttaaggaacttttgtacagaaactttttgcaaaaaaacgtatcgtatatcgtttaacagtttgaaaagcgtgcgggcaaaaaacgagggagatgagttggaaaacctaggtaagaacacagcctatatgtgctcgtgctccacgaaacacgaaaacgaaaacatgtccatgtatttccttgtaggattgcaatatgattttagtataaattaaaatactataaggttgttgcaaaactcatagatttcaaaattgattggtatcgtatccaagaaattaagtgtcctctctataattgtttttcgatcaatagttttggggacaaatgtgtggtgcggtaagtcagtagcaccattccttatttactccctccgtcttataatataagagattttgggtggatgtgatatatcctagacaacgaatttggatagaccgggacggagggagtagtatttacaccccctaaatctttaaaaaattaatccaagtatacaaaataaaccaagtatatgtggtcacctatttcacttacacgttaaacttattagataaaaggatttctgttgatttgataaacctatacaaccttcccaccgtctcatttctttattgggtaatttggaaccatgccattataattttgcaaagtttgagatatgccatcggtatctcaatgacatgtaggatccacatgagtcaatgacattgacatgtgggtcaggatggtatatctcaaattttataaaattataatggcatggttccaatttttcctttatttatccaccgtagcttaggctgctttcggcaatagcagattgatgctttctaatctaataaataatgtgtgttttttgcaaaaaggtttttatatagcattttttaaacaatcatattaatccatattttaagttcaatatgattaatacttaattaattatgtgcgctcatggatcacattgttttacctaactggtcaattttctccttttatctcctctcaagcatataacacaattaacatttaaagtcaaactagtaaaatacccaaaaccctctcaaccatccacgaggagacataaatagcacactccaaaccgcaataccttaggaagggaatgtttggtagagattgaactcctaaatttaggttgaagagttgggactagagtggagttgtggagcagcataaacccagcttcacctctctagatcattttgtgagagagctccacccaactcctccctcatttcaggtagagctaaggacctgtttagcacatagctggagctcagctaaacagtttcagctccacctaaaatggaagcggagctgagtggagcactcgcataaaataaactagagagatgtgaaggtggatttagacaactccacaacttcactacagacctaatttctgaagctaaagttagaagttagagctctattaaacagaccctaaaacacagttggactaagaaacgcttgaagaaaggaaaaaaactgcaatatcttatttctcttgtcaccttcaccaattttctttccccgttggtttgccacctcgccaaaaaaaaaaaaaaaaaaaaaaaaaacagaaccctctcacgtgtggatccaccgttggattggaatggaaccccctcgcgactccgccagccgttacctcgtcctcgacacgccatccttttcctcccccacgtacaaaaccccccctctccccctcgcgctgccacgtatcgctctccctcctctctctctctctctctctctctctctctctcttcgccgcgcggcggaggcgttcgtcgcgagctgtcggcttccctcctcgcgcccgcggcggctgtggccatggaggtccccatctccggcggcggcggaggggagaggttctgccacgcggcgcaggtggtgggggcggacggggagatggacggggaggcgatggcgcggttcgcggcgggggcggggctcctgggccgtggcctctcctacgccgtcgtctccatcgtcgggccccagggcagcggtgagagaaccttaccccctccctcctcctcctcccacgatcaccagttcaccacccctccatctccatgtagagagcagagtagtctgttagtacttgatgcttgttgtgtggttgatgggatatcgagattggatgacgctagtagcatattctgttgcggaagtgtttttaatttttttttgcaccgattttttactggacatgtttgttttggtgatttggataataatatggtagttgaaattgatgtcgggaacatctctgatgctgatgctttgccttgttactctggctagggaaaagcaccctgctcaaccaactcttcgggacaagcttcacggagatggatgccttgaaagggaggtaaacatttacattgctgctgcccaccgaaatgcatgcgcgctgcttttcttgtttgctcttcgattgcattcaatcggttgtctcacatttggagctaagatgatggattctgttcctgttttgtttgtttggttgttgtcaggagccagactaccaagggaatttggattgccaaggctgtaggcattgagccgtttactgttgtaatggatttggagggcacggacggcagggaaagaggagaggttgagtgttatgtgcttttattataataatgtttatacgaataaaaaaccttccataccatgtttccttttgtaagattctgagtacaactcttccatgccatttctaactgcgtaaaatatttgatgttttatcttgtggttaattagtagcagtagtcctgtgtacctgagtatttaggctgtggaaaacaaaaaggttgcttttctagtacttgctttatccacatgtggcgttgtctcccttaataagttttttgctaggaccttagggccttatttccaaaatagttgccatgtagtgggtgtcattagaactcggcctgcaatgagctgtaaatgctgttattgttgttgtagtacaattacttaatcaccctgtacagctgattcatgggagcatctattagaaatgcaaggaagtcatgcattcatactaattctctacgcattcctgttcaatacttttagctgtgatttctagcatcaactctgaatatctgccgctgtcatttttacagtaaattgtgacatctcttttgttaaagtgatgctctatatctttcactttcagtctatcaatctctgtgaaccgttcatttgtgaagctacatcgcattcggtcctcatccaaattccatctgttatgcttgcaggatgatacagccttcgagaagcagagtgccctttttgctctggcagtatcagatattgttatgataaatttgtaagtttctatatcgtttgatacttcattattggcgaatataacgttaatgagtcgggagaacttcattttgcttttctcaaccttcttatgtggcttggtgaatatgccttttataggtggtgtcatgatataggacgagaacatgcagctaataggcctctgttgaaaacaatatttgaggtagcatccgtctcagtgacactaatcatgacttttgtctcagttacatattttaatctattcgtttttctctttctatttgaggtattgatgcgtttattcagcccacgcaaaacaacgttgctacttgttattcgcgataaaaccaaggtttggacagtctcagagaaaaccaaataaaatttacaaaatatgttcctcccatttcttgggcagacatccttaactggtatgagttttttttttttattgtctctgcagactccactagagtatctaacccaagctctgaaggaggatatccagaaggtgtttatgtcttatgttttgctcagctgcctttcctcattgccacactaaaggttttaccacttcttctgttcttacagatatggaatgctgttcgcaaaccagaagtttacaaggaagctgcactaagtgaattcttcaatgtcagtgcttaggttttctgaagtggaagttgcatatataaactgatatatatatatattttgttatataaaggtggaggttactgctctgtcaagttacgaagagaaagaaaatctatttaaggagcaggtaaaatacttattttttatcctgtaccacagaatgttctttctactaattgcataatcacattcaccgcagaatgaaacttacaacttgcaagcgtgtcacttcaatggagacatattgtattgttacttacttctattgctacaggttgggcaactcaggcagagatttattcattcaatcgctccaggtggtctagcagctgatagaagaggtgtgattcctgcttcaggtttttgtcttagtgcactccagatctggaaagtaatacgggaaaacaaggatctcaaccttcccgctcacaaggttttttgtgcctttttggtgcttttgattgtgaacaactaaatacttgcattataatcattaccaattcaccactccatgaacttagttgcaaatcatatattatattttatctgttccatatattctgtagatcatggttgctactgttcggtgtgaagagattgcggatgaaaagctcagaagtttcatatctgataaggtagcgtgttctcattgttgtatctatacattattttatttaattggtaccatgagaattaactattcatctctgcagggctggttggagcta

SEQ ID NO: 58732 - DNA, 7153 bp, Oryza sativa
  unsure (1)..(7153): unsure at all n locations
ccatatattctgtagatcatggttgctactgttcggtgtgaagagattgcggatgaaaagctcagaagtttcatatctgataaggtagcgtgttctcattgttgtatctatacattattttatttaattggtaccatgagaattaactattcatctctgcagggctggttggagctannnnnnnnnnnnnnnnnnnnnnnagtaccaggctttggaaagaagcttaatgctattcttgatttttatctatctgagtgagtgatatgactaattatccttacaatgttttcaagtattaaagtgtttctgttcttgcttaacatgtccattgacctgttagttttattttctgctatctatgactaattatcctatctgcagcatgtccattgacaatgtatattttaatggtaatctgaaagaatggatattcctttgttgttcttatttatgtttcttcttccaatggttttggagttttctttttctagtaaatagactatgtttggggtcatggatgccacaaagtaaaaatatagagttcttagattgcacatgtaacaaatgttcatttatttttattcggagttctgacagtcttaacttaacattttcctgcaggtatgacacagaagccatgtactttgatgaggatgtgagaaccgctaaacgccaacagttagaatctgaaatcctaaaagtgagttactcatttctatgttactaattccagttatggcttagagaaagtagtttaaccagatgatggtgtttggttatgaagattacactagtcaatgtaggaaaatgtttgtttttcttaataattcttgcttgttcatgacatttcaaataatggattgctaatatgcacacatacattcgaagaaaggtcctataaatattttaggcactctggataattacagtgataattgcatatatgactattataatataaaaatttggctcttactaattagagaggatgacatctgtcagaaaaatgtaaatcgactgttttatttgtccttatttgatcaactggtctcataaatcttgggttttgcagcacacatatgatgctttcaagaaaatgttagaacacctgcatcatgtggttctgaacaaattcaaaagtgatctagaacaatcattaaggagcggtgagggatttgcagcatcagctcgtattgtgtgcagtcatcaatggcggaatttgatgctggattgagaggtaaacaaaccacggctaagatttattgggactaaaatatttagccatttgtcaaatgtgacatgcatgctgacctctttctgctgtcatttttttgtcctgcaaatccaatgctgcaaaagccaaatctccatagtttggtgctcatttgatagttttattgtcaatgaatgtctaaaccatacgtcgactagtactatgagcctttgcttcttgatcttgttttaagcctcttgtgcttgctcctgccaaccatattgtgtatgtttttcaaataatagtttattcattcagattatactagaaatacggcaatgttcaacataagtaaattcctagtagtttgaagtaatgtgatttgaaactcatcattccttaaatctttggtttacgatacatgacatcaagtccctccattgtcatgcagatgctttggttaagcatgcagagtgggacacgacaaaagttaggagcaaactggagcagcatatagaagctcatgcaacatctgttcggggtacaaaactggctgaactaaaggctaattatgaggttatttttcatactcagtgcacggtttattattgcaatttcagcatgttcctagaattccccatttcatgagttcttacggtggatttttaaaaaaaccatcctcatgcttggaccttttgttgccgcaatgttcagaaaaaactcttggatacacttgctggacctgtacagtcaatcttggaaactggtgaaaaggactcttgggcatgtattagaagactttacaggcatgcgactgaaagtgctattttggcattctcagcttccctctccgagtttgaactagaccagacaactatccgtaagatggtcatggaattaagagaacatgcaagaagtatagtagaagagaaagctagagaagaagctgggaacgttctgatgcgtatgaaagaaaggtagaatctgctactattatttttggaggaaaacttagcaaacatatcttgacttttcagggatcacacttaccatttttggaacatttatcttatctctacctgtttaattggactctaggttttccactgtgttgagccgtgataaggattccatgcctaggacatggaaaggaaatgaagatatacgtgcaatcactagagaagcacgcttagcggtatattctttcctgttgatcaatattgcactcatttatcctgatctatgctgtagaaacatgatctatgtatcaccttcccactgcaggctttaagacttatgtcggtaatggcagctgtacgtttggacgataaaccagataaaatagatcgggctctaacgactgctcttttagatggaggaccgctttcacagaaaaggagtattgaattcacatctgatcctcttgcttcaagcacatgggaggaggtgctgacacttagatttagaaatttatgatttagaagggcaaatgtgatgaataagtcgttaacatttttaagtctgtacaggtgtcagaaaagaatacgctgatcacaccagtgcagtgtaaatccatctggaggcaattcaatgcagagacagagtatgctgttgcacaagcaatttctatgcaggtatatttctgggccatttctgttcaagtgggccatttctgctcaagtgcttatccagtatattgcataacactgatttattttgatcaaatggataggtaaaacataactgaatttgttgttttcttattatgaagagtgaaccatgaaccctggcctgctaatttcagaggcgggtcttcaatgcccttaaaaaaatactaaaagaagtgataagcttttcatgaaatatgttctttttgtccattatgtgaaactccatttatgatatttctatctgattgttggtgctctgtgcttaccaaattttcttccaccaggaagcacacagacgtagcaataattggctgccacctgcatggactgttttgcttctcgcaattttaggttacaacgaatttatattccttctaaggtaatcatctcaatgaagtagctttcttatccttataaacgcataaactgagaaatccgaacttgacggttaacatatgtaaccactaaccagcatcttctctctgtttatgaactcttggacaggaaccctttatatctgctggggctcttcgtcgccttcgtagtatcctatgctgcatggttgcaatatgacatcacagcctattttcgccatggcacggtaatattctacagaacgcgtttcgcataaattacatcccagtgcttttttatcaaagtcgctgttgctagaaaggagnnnnnnnnnnnnnnnnnnnnnnntggtttcatcaggcagaattctgctcttaatttttattttagataatggataaaaatccggcctctatatccacaagtggatatacagagccaaactgctcttaaatttctatctagtgcatttcagttcaactgaattacacggcatgtattcaaactaaatctcaaggatgttctttcatatgcagctctcaggtcttctgactattacatctgggtttctccccacaataatggacatcataacagcagtcatcaacatgagtcacaaccagaagagctcctcgcacccgcctcgacatcgtcccccgcttcatcctcaaagcttcaggaaccaggcgcagcaacagtctcaggctcaggtgcagtatcaggctccaagttcactgtcatcatcctcttcggtgggctccaacagcgatgacgaatcctgaagcctcataaaacatccctgtagaagacacgttccagtctccaggaaggactttgtataaaagaaaaaggaaaaaaaaaagaagaaaacttgatgtgtaatgtactacatacactgtgtgcatagctgtgagcagagttggtgatagctgattagctgagcagcataagttcctggataaaccaactgtatgtcagtatgtgtagagatgatggatggaaatgaactagatgtcgaactaaataccggagtaatagtaaatttcttcttactggttacttaattacagccttgggtttgtctctgagttcatgcattctctttctgaaaataaaaatgtctgtccatgccatgacctgcatatacatcacaatgactccatagaaccaaactaactcgattcacaggagcatcttcttccaccacacgcaatgccgcatccctacatcattcagtcagttcagtttgataggagaaaacttcactactgttatactgaattactgatgcatgcaaggatctttactggtgtgttaaacggattgatacagtaacagaactggatagagttataaacttgctcgcttgtgcctgcagctatgcaccagcagcacaaattctgctgcagctgctgcagaagtcaacccttccaagcacccctctaattaatatagatacattggctaaatatgttcaatgaaatgtctcactttacccaaagttactgtaatttaatttctttgcattaagcagtaagaaactaccgcatcatatggcctgaaactgacactgacaaacctttcaaatgtattgttctgttctatgttaacattaacagaggcatagagctttcccaagataaattgctgacttgagatgccttctagttagcagacgagttaattagtactctaatactactaattatctacctgtacaatttcgttttcctggttacatggacatgtgtgccgttgcagttactgtaaaattgccgtcagtttcagcatgttgcagccttgcaggacaggaaattatcagaatcaacagagatcatgcaacatcttatgtctgctgctagccccaattaataatactgtacagtgatgttgtcacgctagcttgatctggacttctggaatgatcataattcaggattaacaggaacttggcggagaacaaagcaatgcattttctcaagcagagtaaaagtaatttctcacaacattggaaattccagattcattccgtcatctctccagcgctagcttacacatagccctatcatttttatacagcttatctaccattttcttaaaacaaattatttgctttacacggtataaaaaaagtacatattagggtggcatgattccaacaaacccttttttaaaactactttattccaccgcatcacttagaccactcttttttagctatatgttattttcaaaatatgtaataatttacgaaaataattcgctcaataatctaaagggaaactattttaatccctcgagaggatatcccctcgttcaaatttaacttctacatttcgtaatgaaaaaaaaacaaattgaaccgcagctagttaacgtatattcagagtcaaatttgtttttttcgttgcgagatgtgaaagttgaatttttacttgcatgtttatggagtgatatgttacatgttaatacattttctcgaattttttcaattttttttcataaccatttaagtgacatacaaacaacgagagtatatccactcgagggatcaaaatccacttcctaatctaaatcaaacaaataccttactcaaagggctctcactttatttatctcttctttttcgcgaacgccactttatttatctcatacatacacctcttccaagcacaagtgtactgcaacaaccggatacatagacatagtagacactagctagtatatatagcttccaagtctcccccagatatatagaagctctcctatcggagagagccatggccatctatctcctgctcaatttattcctctcccctccctcgcgtacacattcgtgtgtgcacgcgcgcgagcagcacagcactagctctaggtcgatcgaccatggaaaccctagctagctataccctacacccggcgaagcagtatcttaattacgttacctttaattacactgcctggaggatggcttcggcggccaccgtggcccatccatggcggcgctcgtggcagtctcgcatgcaccgctgcctctcgtgccactcgcggtggtgctggcattgcctccggcagtggtcgccgccatggccgccgccgccgccgtggtggttgtcatcgtcgacgacgtcgtcttcctcctggcgcctgtacctgcagtcctgcatgcattgctgcctcttccattggtcgtggtggtgctggcatcgcttgcggcagtgttgctctctctcgccgccgtagttgtggtcttcttcctcgtcgacggcggcctcttcctcctcctggcgccgccactgcctgcagtcttgcatgcattgttgcttcttccattggtcatggtggtgttggcactgcttgcggcattgctgatcgccatggccgtcttcttcctcgacgacgtcgtcttcttggcggtgatggtacctgcaatcttggatgcactgctgcttcttccactggtcatggtggtgctggcactgcttgcggcagcgatcgccgccgtggttgtcgtcttcctcgtcgacgtcgacggcggcgtcttgttggcgctggtggtatctgcactcctccatgcattgttgcttcttccactggtcgtggtggtggcggcactgcttgtagcaggggtctctgccatggtggttgtcgtcgtcggcgtcgacctcctgtcgccggtggcggcagtccatgaggcagcgctgcttctcccaccagtcctgctggtgctcgcactgctcacggcagtccggcctggatccgccatggccgccgccgtggtggtgctgctcgtggcggcgccactcgcactgcctcatgcactcctgcttccgccacggctcgtcgcggtagccacggcactcgcggcggcactccttgccgccgccgccgtgcgtgttctcgtcgtcgtcgtcgt

SEQ ID NO: 58733 - DNA, 15111 bp, Oryza sativa
  unsure (1)..(15111): unsure at all n locations
ggggagtaggtggagctcgtcggtttcttggccatgccatccatggcgaggggatggcgtgtacgaggatttggatgccggggaagggacgagctggcaagcatatatgcacgtggatatgggtgtggtggcagccatgggtctacgtggaagctgggggtgcatgcatgggccgggcaaaattgggctttatttcttgggtcaaaatgggccttatttgttggctggtaactgatctggtgtgctgcgctgggcttcgacgtgctccgttggatcagggctggtaacttgaagtggacacgccgtcttctacttcacctctcctcttttcttctcttccgttccctcatcttcgccatgtgggagatagccggcgacattgtcataggctcggtcgattcgagataggaggaggggggaaggggggggaggggggcagagcccacggggacccaaccggttgccgtggtcagcatgcactctggcacaatacctccatcgtccgattgctccttaaccgcgcaagcgcaaccccctcccttactcgtttccacctctcttgcacggaggccaagctagcacgagctcagacgagcttgctgaccgccttcccctccctcgactaccctctatggcagcctagcgtggtagtagctcgcgcctcgactacctctcacgctcctccgtccacctccctcgcatggaggccgggcgagcttgagcttggatgggctcgccgaccacctctccattcctctcccgcctccgactccctcagccacccctcagggcgacagcccgcaccttgaccgcctcatctgtccccgccttcgtgaatgcgctctccctacgtcttgcgcttcttcccgaccgcctccccatcaccagggtccaggagagaagaatgaagcaggcattgccacgtgggccccatggttttttatttatttttgctaactaggatgccacgtcagtaaaaccaaccacctatagtgtcataggacctaatttagtccagtttcgtaagttggggttaggattttagtattgtgtgtagggatatgatatttaaacttgatggaaagatgaggaaccttaagtatacttattacgattatcaacgatgagtcggcccttggattaggtgttctattttttggtttttgtgttgagaataatatggttgggttttcacgttggacacatctgggctttgaggttaaggttgcaatttcgagtaggaagttgaagcattttctgagttgaaaagtcaagtttgcaattttgagtagaaacgcgaatcatttgattcatttccgagttgaaaagttgagattgacaatctcaaagttcaaagtgaattcttttttttacacagttcaaagtgaattttggttaaaaccctcaggttgtatttggataatgggaaatatgtggtggaattgggattgggaaatgaacgaagggttaggattaaatggaagaaggagaataaatggttaaaatttaaagatgtcttttagtgggtgggaaatgatttccctttcccattagccaaacggggcctcagtatattttcaattaacagaagtttaatacttaataatttaaatgacagttcaatattttagccatgacacatggcatccaatgaaagggtcgtccactagaaataaaggtgacagacgatcactgaataggtacacccataccagccacctttctattgtctttgcacttggattgaaaagtggtcacaagggttaaaaccctgaatcattcggaaatgtttttgccacacaaatgagttccaaatacactgagtgacactacgggtcagtcactaaaatttctgaaatgttgttacctactcgtctctttgtccaaaaataaaccaaactcgtacggtgtgaatatatcttcaatgttacctacactgtacaaggttagcttattttgtaacggagggaacatacatctttcgataacattataattgttgtgccgccttggttcagttcaaatttctttttacaaaattccgcttgcatctttgtcccggcgcggcaaaaaaaaaatccacaataaaggtatcatataaaaacaatgatggcagttaatcagtttaggttggtcactatcttaatagatgcaaattaagttgggttgtagcgaaaccaacgaacggcatttgttttgtgctcccacgatacaatcccttaaatcagcacacacgcacaatgcatgcaccacattttagatcgatttcgtagagaatatttcgatcacatagccacaattaatctacattctagaagctccaacaaacttatttaattagttcctgcaaattaacatttacaaatatctcaaactgaagaaataactttaattgcaatgccggcagccaacccggcgtgtatgcttccatttgttcgatgtaaagtgctgtttatccataggaagagatgtaatattaataactactccatccgtttctaaatatttgacgtcattgactttttttaaatatgtttgaatgttcgtcttatttaaaaaaatttaagtaattattaattatttttctatcatttgatttattgttaaatatacttatatgtatacatatagttttacatatttcacaaaagtttttgaatatgacgaaaggttaaacatgtgctaaaaagtcaatggtatcaaatatttagaaacggagggagtatgtttgttgaaaatgttttaccttctctcaatcttaataaatttggtcagggcaggcacagaaaaaaaaaaacaggaagacataacagcaaaacaaaaacagtggaaattaagcattgctaattacaaacttttctgatcattcacaccattttcatgtttgatccagctcaaacttcactacaacagcttagaacactcttagctagcaaaagtcctaatcacagccattataaatagacacaagcaattagcctcatctacacacactcccatcactccaattaaccaaagctaattaagctagctcaagctctaatccacatttagctagaatggcgccgtccaagtccacagccgccgccggcgtcctcctcgtcctgctcgtcgcggcggcgggcggcggcgcagaggcggcggcgacgacgtgcgtggcgtcgctgctggagctgagcccgtgcctgccgttcttcaaggacaaggcggcgacggcggcgccggaggggtgctgcgcggggctgtcgtccatcgtgaagggggaggcggtgtgcctgtgccacatcgtgaaccacaccctggagcgcgccatcggcgtcgacatccccgtcgaccgcgccttcgccctcctccgcgacgtctgccgcctctcgccgccggcggacatcatctccacctgcgccaacgagaaaggtaaaatcaatcaacgcgccgcgccgtggcgtggcgtggcgtgtgcagaagtccaatgcagacggttttcgaatcatctaagttgactctacgtctgtaataatataacactcgtctccgtaaattaaattctcaatttctgaatttttgttttgccgcgcgctgggctccctctcttgtttaaaatccaagagataggcataggcccaatacagggtttaaaatttcggtccaaaacttccgaaaattccaaaatttgggaatttaggatcctcccctctcatgcaactatttcatccaaaatttttagatttttaaaaatatttatgaatctggttaaaattagttgaattcagtcaaaatgtgtttaaatttcaaaatgtttcgttcgaaatttctgaattttgatacacccgattttttttgtccattttggaagtacaaagcccggggccaaacgaatgtccaaatgatcaagtttaaaatctcagttctaactaggactttgtttatttatagatttatatgttttaaaagtgcaacgttgagtagtgctaattaactaatgtacatatcatgattgacttgtgtgtaggtggtgtgccgcctctctactcttgcccggctccatctgcctgaggtaaaccgtcgtcaaccacaaaattatttccacaaaagagcctataaccatgctaaatttctacagtaactactcatataattcagctgttttgtttatattttttttaggggagctgttttgtttataatgacaagtgctttttaattcatgcagtatatatgagaaaagaataaatgttaccaaaggagggatttcaacatatctaaaagtcaagatggagtaactttggtatacaagaccaacatatatatcacgttgttaaaggacaagtagatattggattattggcatatactgatatatccatgctaatattagtatatgtatattctgcaacatgcatggacatacacattgtcaaatgaagtactaagtaacacggaacgtgtactagctcgtgctactgtcgtgctatgcgctgtcaatagaaataaaatattttacattgtggtattaagcattaaagccatattgtattctaatattatcgggcggagattgcggattattcctaccacacttttaaataattacaatttctctaaaaaaaagttgctatgtcagtattttttacagcacttgtttatctctactattataaaaatttaagatgtttttgtcgaggcttttcgtacgtcaccgcgagatcgtgtcggacacaaaaaatcgcaaacttgccgatatagtttaatttttttccatctatcggaataaatcacgtcagaccctaagcccacttggtcgcgttctcccctttctttcaacagcctgtataggtgaggcttacagccgatacgagcagcggttcccgatttcccgcgagccacgcgctctcacacatcgattgtgattctaggacgagcctgacacagatcgttttttcttccaactccacctccaccaacaatatctcctttgtatgtacgtacgtatgcacccgctgccacgaatagatctatatagatcgagaagcagagagaattaaggtcttgatgggtgtggtaagaaggcaacggcagcgatggctggttgatggtgatggtgttcatgtcggtgaaggcgtggtaggatgtacgctgacgctctgcggttgcgatcgcatatattaacagggcggagctagaacgaaatggatggtggtgccacttacttaaattattctactctagatcgaatttaagctgatgcgggtgcctaagtttgtattgagaggatacatacatggtgaaaatagatgatctatagctaaaaaattttcttgaccgggttcctggacaccccctagtatactctagctccgcccctatatatatatatatatatatatatatatatatatatatatatatatatatatatatatatatatatatatatatatatatatatatatgaaggctagcatctggtgggtagagacaatggctgtgggctagcggcatcgatcaaaattaagatagtcgagcgcgtcatcacagccagtgccggcgcgacgcgacgcgaccgatcgacacgcctcatacgtcatcatcgccgtccgtcctcgatcgatgtcacccaggccacatcgtacgacggccactatacggtggcgggggccggcgaacacgacggagatgctttccatgcagtacggcttcgacgacccgctggagcggtttgatgatcgacctctctccttcacgtccgcgcgcgctgcttcaactcccgctgtcccgcaggccgcatatactccctctgttttaaaatatttgacaccattaaatttttaagtatgtgtttagctattcgtcttattcaaaaaatttaagaaattatttattcttttcatatcatttgattctcatgtacatatatagttttacatatttcataatttttttaataagacgaacggtcaaacatgtgctagaaagtcaacggtgtcaaacattttaaaacggagggagtaggatatatctacgtccgcgcgcttgtttcctgctcaacttccgcatgttatgttaggaccaggcctcgatcgccaagctccggctgcaggtccagcatggggccgcgtgcgttagtgtacaaccatatatcaattgtatttatcgacctttaccaaccatatatcaatttttattgggtgtagctatatttatggtgctatattttttataaaaaaatagtcggcatgtatttacattgtaagtccctaaattacatatgtaattttagtgtatttacaatgtaagtcttaaaattacatatgtaatgtaaatttgaaaattacatactaattacatatataagtgaggtgtaaatgaggtgtaactactgcgtaagtggctgaaaaaaagtcgactgtagcatatggcgccatatttctagcaactccgtataatatatagctcatgcatggaacccaatatatcttactactcatctgtgttgacagtacgtatttgccaaagtatcttttgtcggtcctgttttatcatgtgtttactagctgtttaattctttgacgggcacaaaactttaaaaacggaccatttaatatgcacaattaaaattgttttcacccgttgcaacgcacgagcatttatgctagtaatatataaaaatttaattcttccttataaactaaacgtcgggattttattttattatctaacaaactgatcgatccattcatcaagttttatctgtatttcatataagaagcaatccataattatcatattagattcccttctatcaactcagcatattgaagatctaatgtgaccatgcctacgacggatataaccattgatcatatcatatacccacaggtggtctcgtttcataacaagtgccaaattaatctaatcaagaatacgacactacctcataatgtatgcgtttatatgttcatgaccaatccacttatttggggctacatatggaagataaacacgatggccatggtgcatgcagagatggagatgaattgttgtttaattggaattattagaaatgattttaaaagcctagaagagaagatctaattttaaataataaattccaatataaaatggggccagataaaatttcattaaatactttgcttgattctatagttcctagagttttctgggatttatttgagccaaggaagtatttttaataaatggaattgcatttcatgaataatttaaattggaaaatattttaaaagtcctcttttggctttgggccgaaagtcggcccaaaaccttccctctctctcctctttggcctagtcagcccgcagccgcccgcgcgcgcgcgctcggtcgctgacaggtgggtcccacctgtcggactcgtcgtcctcctcgcaccgaaaccctagccgcgccgcgccgccgccacctttccaattcggccgcatctttcccgatccggtgaaatcgtttgaggggaaatgctccccggaatcttctctaccttttttccttttggaatcgatcgccaattcggtttggaaatccgtgaattcgagttcgattcggatcgatctctctcctccgaaccctaaaccttccatcgcgtcgccggtcgccgtgggccttcgccgccgcctccttgcccctataaaaggacccccggtgtctccgctatccgtcgccaccctcgccattgcccgccgccgtctgtagcgccctagcaccgtgcagctgtgcgctgccgtcgccgccgcagctccagccgtgcgcggccgtcgctccggtcgtcgtcgctgctcggggaggtcaccgtcgtggtcaccaagccgtcgccgatctcgtccacccctccgtcgtcgccgtaggttgccgtcgtcgtcaagccgaaggtcgccgccgcttcttcctcgacgccgtcgccgtccgttgatcttctgccgctgttttggtcaccggtgagttcgccacgtcgccctctacgtgttggtgtcctccattcgcggcgtcgcgtcgtcgttcgccggcgagcttgcgcgcccgagccgccgccggtgatgacgtcatcaccgatgtcatcggtgccgtccgtcgtagaccggtcgtagaccgttaaatcttggccgttcgttgtggataggatcgatctcggccgttcgtttccgtgagccgccgccgtgcacccggtccaccgcgaaccctaaccgctgacgcaataatttccttttccttttaaaaaataattcattattgcgtcatcattcaattaaaacccatataagtgttttaatccgatttaatctataaaaattcataactaattcatcttagctcggatttagttggttcaagtctctaattttttctaaaattgagatctacatgttaaaaatatccacatgtactgttcatgcttgtttatgtgctgttttggtgattttgctcttttctctttagattccgacgtttccggagagtctgagtttgcaggagaagattttgaagagttccaaggccagcaaggcaagtcacacagatcccaaacaaccctttgagcatgttgatcccgtttaaagctattgtttctattcaactattgcatttattttcgaatgtcgttgggtggaattaacctattgtttgttatagcctttttgttcttgattactttattccttgataccttgggttattataacttgactagttgggctttatatattggttcagctagatattagatatgattgcttagccatgcttagaaacattagcacactattgggataacttatgactcactattatttaatgatggcttaatgatagctcatgatggttaatcatgattggttaattaattaatttgccaactaaaacctgataatggtgggttgtgagcacatggttttgatggtcgtgctcatgacaattaaggaccggttcatgagtttcggttgtgagatattaaccgtgccaaccacaagccagcgtgggcaacagctttaccttttgtatagcatggttcattgcggggcaccagactgagaagtggcggagataagcccacgggggtcgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctgaccagagtaaaactattcgaatagccgtgcccgcggttatgggcgggtctaacaatgtctttcgtgattagtttcacacttctcaccataataaaagatgctataactggtaataatttgattagctcctggtttggaatggtatattcctggtttggagatagaactgtgcagccgggatagttgttcagaatggttgggcctatgcaacagggtatgttgtatagcgttggattaatattgtttaattactacttaactattttattaaattctgaaatgtttattaaatgctgtttatgcaaatgaaaccctactatgccatcctttgttatcctgtgcacttgcatatttgctgcatggcttgctgagtatgtcatatactcaccttgcaatcattcatcagaggaggagttctacagtgatgctgatggtgtggaggattaggtgtagccctggtcaagctgcctgtggagtggagtcgtctgcgccgtttatcttatttttccgctgcttagatctttattgattgagaggaactatctacctctgtaatgacattttattcgcttattaattagagtaataattgtactctattatcaatttgttattgtgtgcctcggctgattcctaaacgagggttcacacacatgtaagcgtttagaattttggatagaaattccgggcgtgacagcgttctggaatccaattcggcctcctaagatagtgctgaattcaaacggtcgccaaatctccatatggcctacgttttgggcccacgagtactttatggaaagctctcggaatcctctttccaacgaatccaacctcattgtcaaattccatccgagtcatcggcaattgaaaaaacaaggggctgcattgtctgtaatgggcctataggtctgtaacttcgtctgggaccctggtccaaggggggctgtgccctaaacagagggaggacgcccttatgacctcctctatcctttaaatagctagtaaccccttcagggttagttgggttttgattaattgtaagtttagctattgctacttcgcttgtagcacgcgtgtcggctagaccgtccgtctgcttgttcggaaccccactttatcgtatatcaattcatctttgtgcgtcttgtctatctagcaattcagttgctttctatcttgttcttacttgttctcgattgcttgcaggaatagggttgatctgcaccagcaagatcaacaaactctcggagatgtgtattgatcgctaaggcacaacataacaacgtctcgtacggttgtagtcggatcgtcaatatttctcctaaatcgtagttatctcaactcaccgaaagatcaagccaccccatacatatcaagatcttaggccccctataatttttccgattcatttttggaaacaaatgcatttggatgccaccgaagagccgtgtttgtacttgaaaaaaactgatcaaacaactttgaattattctcgattctggaccgttcaaaactgattggacggcttagatcgctcaactacaccatacatacaaccactcgacctgtttggctaggaaacattcaagagtgccttctccagccaactcgacgagctccccgtccacctctttcgcgaatcgcgatggccacccctaactatacatcactctttctgttctaatataagtgtaacctagaccctttttagatcccatttcaaaatttttcaccctgtcacatcgaatgtttgaatacatgcatgaagtattaaatataggctaaaaaataactaattgcacagattgcgactaatttacgagacgaatcttttaagcataattgctcctgatttaacaatatggtgctacagtaaatatttgctaatgatggattaattagacttaataaatttttctcacggtttactaacggattctgtaatttttttttattagcgtcctaacaccccatatgtaatacaagtacctgagaagacagactaactacgattcggcaaggaaacctatgccgaattgcatctgaatacacacattttaacagaaggcaaaatgtggagcaatgcaagcccacgggttaacgggcctgccaaaatacaaccaagttaccagaatgtgcatccaccagccaagcaaatccaacggctgacaaaatcgactgatggattaaaatttgggatcacctgtatattttatcgacaaattttcttctaaaaatttaatagatataattataatataatcgtagtgtaattatattataacttaaatgtgaataccgtgtaacttgtatataagtttcacgtaattttgaatcgttagatcttttacaagatttgttctggtaagaaagaaaaaaaattacagtagagatatgtgagaggatttgttctcatgacctttattttaccgaaataacatgttacggagattacgaagagatatttaaaagttacatacaagttatattataattacactacgattatactttaatttacatatgtcaatttttttgagaaaatttatcgcaaaatatatagcaaaattgttaaaattttgcaggcgcttgcaaaatagaaaacctgagaaaaaaagaaagaaggaaacactcgcgtggctgcccacccgccgccgtcgccgacaacggcggcgcgaagccgcatcctctccgccgacgagcacgctggcccggagtcgtcgccgcttcaaccgccggccgtcctgtcctcggagatacggcagcgcgtggcggcccccggtggctgtgctacggcggccaaaatcgaccgccggatttcctgtgctccaccgcacggcggcctgacggtggctgcttctcctccgcgcacaaatccactcccgccccccaccatgcacggcggcagcgcttgacggtgagttctccacatgttttccttgctgacctcgattcggaatatggatccgtgtgagccagtatgattcagagtggattcccgggaacaagtctgatccggagtcggatttctcttttgaggacaacaaattccgtttcagttttccttgggtaacttcaggtatataccttgcgtctcttgcttcatcacatgttccaactctgcaagtattcaagcaggcgacgaatttcaccttgcaagaggggctcgatctgctccaattatccaatggcgccctgtagtactatagccaggattatgaacttaggggatctagcgagatgtcccaagaatttgtgcaacctactcttcagagtagtacaatccaagctcctagcgccccttcacagtagtttactgaaggaagtgcaaaaagatgatggtgatcagccatcaatggcagagagtgttgtggcaaatttaccagagctgtctcaggacatcttaatggagatatttgccctcctggagatccctgacctcgtgcgtgcaggatcggtctgtaactcctggctctcggcctacaacgaattgcgcagcctaggtatctataaactgtcccagacgccgtgcctgctatacacctctgaatctgctggcgatagcgtcgtgtgtctctatagtcttgtcgagaagagggagtacaagattactctcccggagccacccatacgcagtaggtttctgattgggtcctcacttggttggttgattacagctgatgacttatccgagatgcacctggtcaatccgatcacaggggaacagatagctctcccttctgttaccacaatggagcatgtgaatcccatcttcaatgagtctggtgctctccacaagtatgagttctcactgcacactgcaacgagggttagttatgcagagccatcaatttttgcccttggcgagctgcgggattacatatatagtaaggcttttgtgtttactgatactttcacagggggatgcattgtggttctgatccacgagccagctggtcaaatttcatttgcaagggttggggatgataagtggacatggcatccatcacactctcactattctgactgcatctacattgatggtctactgtatgcactgactgcacagggagaaatccatacacttgatctcagtggccccacgatcacgatgaagatgataattggaagtttgtcttacagtaggtacattgtgcaagctccatggggtggtcttctgctagtttggaggtcagttgaggacattgaggaggattacgaggctgacttgcctgctgaccatgcaacatttgtgcggtatactagggaaattaaaatatatagtgttgatactatggggaaaaaacatgtagagatcaataacctggatggtcatgtgttgtttcttggtcataaccaatcactttgtctcagcacggaacaatatccacatctcaaggaaaattatacctattttactgatgatgacgaagcttggttatttggattcaagaataagcgtcgtgatattggattatttgatttgaaacataacagcagagaggaactcgtgtctcctcagctttggtccaactttcccgctcctgtttggattacacctagtttcacaaagttgaacttcgcctagaagaagcacttttaagttttcttgtttatggatataatagttgtgtatatttcttcttgttctgtacaatttatatgtaaaattatgattggagaactgaaaggtgaatgagaaggttaggttgctccatatttgtttatttgtaccgacctttcttatgtttatttaaatttctaccgtcttaagggcaaacagcaggtcttgtgtgatagccactttctagggaattagtggaatatacaaggctaatgtgaccaatgttattagaaaatggcaaagctgtaagtgcttcttagagtctaaaataacttaactctgagactctgactgcaatcggcaggatgcctgggctaatttggagaagccttgtggaagcatgttttttagtatcttgaaggacaccatgtacttcatattttacaactacagggatagaagattgagaggtatggactgtgttctagctgccatctatttttattttgaattatgagagaccaagccttctgttccaacgtacttaattcattctagataacaatcgcagggtctgtctaggaaggattatgagaaggaattggagcttgcggacagtgagaaaacaaaaaagcttgaacagaagttgtttcgtggtctttaagattcactagtcctcaaggaggtaggttctcatagtctttccacgtcaagatccagtttgtgttcttttcaccatttgatcttgactaaattacgttttaactttacatgctgctaacgggcaaaaatctgtaatggggctagttttgattcctagcactaatacacttccgatttacttgcaatgatgttcaggtgcaaacactaactcatctcatgtacacatatgcaatcgatgtattagtttagtgctacgcatcatatctgcttgtgctagtgtgtgcccttgctaactgtagatggacccattccttaactgagaattagggcctgcataagatattatccattggctaaaccttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58734 - DNA, 927 bp, Oryza sativa
aaaaataaagactattgaaagaaaagaccatctaaaacacatgacgagattaattaagtaataagcatataaatgagtatagtggtggcggttgatgggacatgtaaaaattattaataaaacaccaaatataatcttaatgacgattaaaatgaatgatgatggataggtcgtaaagcaaccggttaaggcggttggcgggacttatagaaagtcgaaaaataaaccccaatgataattatatttaatttttaaaatctcaatgacaataaaaatgataggcaacgggcgggtcgtacagtagtacaatggcagagccggcaatagttgatgggacttctagaaagtaaaaaaatgaattccaacgatagttatgttcgattttacgaatcccaacaacaataaaaaataagcggcggatgggtatagtggcaacgtttaacgatatttctaaaaattataaaaaataaaatccaacgagtcaataaaccctaaaaactataaggtccaattttaaaaggttcgggcttctaaaaagttttaaaaaataaactccaatgataattatgtttgattttaaaatctcaatgacaataaagaagggaggcagcgggcgagccgtagaggagtacagcgacaaatccacgaacattttggcggaacttctataaagtagaaagaacctaaacgataattatattcgattttgaaaataccgaagatgcagcagactggccgtagaggagtataatgacaacgtttgacagaacttataaaaaaaatctaaatacgaaacccaacgagacaataaactctaaaaactataagatccaatttttaaaggttacaaggagaatgaataggaacagtggaagaccgagcaagcaaataaaaaaggatatgacagaagtaagggatagtaagtgg

SEQ ID NO: 58735 - DNA, 5243 bp, Oryza sativa
acggcggttaacacagcgaacagctcctcgccatcgcgatgatcctcatcggtgcggaagaacctggcaatgcagaacttgccggagcccaggttcacgaggtccgagctgacaagattgagggcgtctggcggtgtgaactccataggaaagctgcgaagcagcggcagctcgccgccatcaaggtccagagcggagagcaccaagctcctcttcctcctgtctctggtgctgtgtgagaggccaaaccaaaggccgtgctcatggcaatactcggcgagaccaacaaatggcagcgtccatcttgtggccactgtgctccacgcatggcgcaccgtgtcgaagcagtagatgccgccattgtcgtgcgtggataaccagatgtccgtgccaccgatcacagcgtaggagtcgacttcgaagtcggacagcggcggcggcgggagcgcgcagcagcgccaatcctcgttcaatccatcctcatagatgagcccatggaagcttccaccgtcgtcgacatcgaggatgtagaggtcgtcgccgacggtgacagaggtggcaggcaatgtcacctggtaggggagggcgggcatggtgcggacggcgtgctcgccggggtcgtagaggacggtgcggcagctctggtcggcggcgaccaccatgttgtggttgcctccaaggaggaagaactccatgttctggttcccggacaagctggaggagggagggtagaaggtcatggccgggcatggcaggctgccgtactccaccgcgtcggcggcggcggcggcggatggcaccggagatggacgtgggaggaagaagcggtccatgtctatgttccgcagcgtgtagttgctgcggcgtggggcgaactcctccagcaccagatgaacaaaccgacgaacactcatcgtcgatcgatcggatgaatcgatgatcgtccccaaaatgaagtaatcttactaaagattgattggattgattggattggattgctctggatcttcttctcccccaccacgaataactagggttttcacgaagccaaacgatctttctcgttgcaaagcgacttatccgattcggttacgcggagtggagatcatgcgggcgccctgatcatacgatctatctctatataaaccgagctgccgccttcacgcaacacacgcgaaatcaatctagggtttgcctcctactctgtgctgcacctgatcaagcgatctatctctatataaaccgagccgccgccttcacgcaacacacgcaaaatcaatctagggtttgcctcctactctgtgctgcgccatcgctcgtagactactccatcccactcgccggtgtgcaccggcgatcgggagagtagatctccggaacaatctacggtttgcctcctactctgtgctgcgccatcgctcatagactactccatcccgctcgccggtgtgcaccggcgatcgggagagcagatctccggaacctctgccttcgacgtcatgcaccgggagaaggcggaaataaggtttttgggaagcgcttcgcgcgactgctccctgttcgtccgcgatggctcgccttcctcttcgctcgcgtgctgcgcaccttcgtcgacgcctgcaaccgcgagtagtccctgccgagcaaccggtctttccgccacctcggtacgtgttcgacatgttgcgcatatttgatctgttcatattttactgtttagtttacatatgtagacctaatgatgcgttcatgctagtttatatctgcaatgtcatgatttatttatggaataaattaaatcattatgtgcttataatttcaacataagcgaatcggatagtcaccggcggcggacagatgatgggaagggaatggcggaggaagatggagtggagagaggggaggaggagttggccaccgacgaggtccactctggtggcggcggagaagaggggtgagtgcgggggcgtccgggggacgcggcgggtgggaagggaggaaggcgagggcgtgtgatctggacgtgaataatatttaaagctatgtgtgaactgtagataattataactagaggactgctacaccacggactcccgtcctaacgggataacttaatgaggattattgtttgaccaatcaaccacttctgtcaatctatccacttcacgtaattccatacaagggtcaaagcgtcagtgtatgttcacataatcacgtgagagtctacaggcttatggttgtctttcagtctttcactagagacacaacacactaggtactcgatacttaggtggtaccaggtaccggataccccatatatcataatatctagtactgggtatggtacctttaggtatcaggctggtctaggtaccaggtatatgatacctaggtacccaacgtactcagatggtaccaggtaccgaataccccatgtaccatgatatcttagtactaggtatggtacctttagatatcaggctggtctaggtaccaggtatctgataccccaggtactcgatgccctataccagatctggtacctatgggattcatgccgatctaggtaccaggtaccttgctaccccaggtatcaggctggtctagataccagatatctgataccctaggtacccaatgcccagtaccaaatatggcacctatgggattcatgccgatctaggtaccaggtaccttgctaccccaggtatcaggctggtttaggtaccaggtatatgataccccaggtacccgatgcccagtaccagatctggtacctatgggattcatgccgatctaggtaccaggtaccttgctaccctaggtatcaggcctgatacctatgatatcagtcgaaacaatctgggtaccagttacatgatacctatgtattagaaactcgatacctaagcattaggtatcttgtgggtatcaagcatgtttcatggatattaggccctcatgccgatgggagctatgagaaaaagggaaaagagacgaggcaagcacaaaaataagatggctatcttccttggaggtggaagaacactattccttcttgttgccatccttgattcggatcgccgctgctacatcctcgacacgcatgtgaccatgatggttatggacatcgcctgtgacagtaggacggacacctcaatctctcctcctagctcgaactcattgaagctcttcctaagcacctagtacacgagagttcccatgaccaccatcaacgatgtgatgttccgcacaacgagagctaacaccgctctggtcttgtcgcagggcttgcagtgagtacttgcccagccacattaattaggaatgaagagaggagttagagagggagagaggcgtagaggaggagaggcgaaggaggaggacgaccaagcaaagctccgggagagagaggtagaaagggaacagataagattggatatcgtttcacttctcccgttcctacggcattccgttggctagtttttctgttataactatttttagacgacatacggtgctcagtgaaaatatacggtgcttctctaaacttgctttccgatgattaataatcagctgtaatcaaagctgttagcacccaatggagtacaatatattgctgatgagcttatacatcagagacctgtgcatcgccgtcgtcgcagagctccacctcgacggcggtgaacaccacgaacagctccgggccatcacggtgttcgtcgtcggtctccaagaacctggcgatgcaggaacctgccgacgaggtctgagccgacgggattgagcgcgccgggcagcgtgtaatcccgaggaagaaggctgcgaccacaccggcggcttgccggcgtcaaggtccgtggcagagagaggaccatgccactgccatcactagccggtgagaggccgtgctccgggacgtactcggcgaggccgccgatcgaacggcagcgtccagtcgtcggcggcgcgccgtgtcgaagcggtaggtgccgtctccgccgccgaccaggagtcgggttggaagggaggcggcgggagagcacggtagcgctagtcctcgccgccgtggtcatcgtaggcgtagatgagcccatggaagcaaccaccggcgaccggcgaatccgaggcgttgaggcaggtcgggaaggcagaatccgaatccgaatgaggacggtgtgctcgccggtgtcgacggcgcggcgagtctggtcgactcatcgccgatcgattgaccatttgacctccaagattgtttatctggcatcctggccccgcctgccatagactcatcggtctctggccccacctgtcatagactcatccgcttctctctgctcgttagttgccttcgtcctcctgccgcctcgggtgttcttccttcctccatcgccatggcggcggcggcggcttcccaccgcgtgttcgtctacgggacgctaatggcggaggaggtggtgcgcgtcctcatcggccgctcgccgtcctcctccccggccgtcctcccaaaccagtccgtccacgagacatctgtttcttcttcttcttcttgccaagaatcccctcctctctgctgcgaaattctgatcggccaccgtctcctgcagccagaggttcagcatcaaggggcgcgtttacccggcgattcttcccgtcgacggcaaggaggtctcagggaaggtaagcccctcttgcttcctctctcggttaggcaatcaaagattcaagaaagctgaagagtcaagtgaagagaaaaatcacaagtgcttgttgctaaatcagcatgtggagaaaattaaggccagttaatctgtactcttcttttatgtatgttgtgcaggttttcaagggcatcactgacagggagctcaatgtgctggatatatttgaagatgaggagtatgtcaagagaaccgttgagatatcactaactgtaagcctatctctactatgtacttagcaaattccgattgtttagattgcctgaaattgctgcttcagcagtctgtcatgctgtactgaaattctgaatgttcagcaagattggaccctgtgtcttgaaggagaaatgttttgattagcttcttcttttcatcatatggcttcagtaagatgggatggtttggattttcaggacacatcggagaaattgcttgcttatgcatacatttggggcaatcaggatgatcctgacctctatggtgaatgggactttgaggtgaggatgtttcctttttttaaaa

SEQ ID NO: 58736 - DNA, 2132 bp, Oryza sativa
caatcagtcatcaatcatttaacatagacgtgaatcagttggtcaaattcgaacctgaatagaaatggcatgtcagatcttttggttaattatagagcacacactcaagaactggtagacttatactccatggtcaattagctgtgtagaatgtttactgacttttgagccctgctcattcattgctcttctctcttctgctgtcaacttctttgaatcttctgttgtcgaattgtgatgtcctcggtacctttaattcctgtgcaatgtgttatctgtaggaatggaaaagggtgcacttggaggattatgtcaagatgacacaagagttcatggaggaactggaacagctcgaaccaaagaccgagacctgaagctcaacactcattcgtccagaaggattcactcaacaatgaattgtatgtgcattgtcaaatggttctcctcttgtttgtaaataagatgtttacaccattaattgatagacaacagttacagaattcgcagtggtttcaattttagtgcttataagcttgagtgcaaatacatataatttctgtgcttttgaatcagtccatattttacatgtgatgatgtgaaacaaactatcttcaattcagaaattgattgattggcagagaagatgacaggataaagaaggaaaggtgcagaatatttgctatagtggtttctaatctgggtctgatcttaatagaggcttgaacaaccccaagaacagttagggcaaatgttttctctaaaatacactatcttaaatttcgcctaaaccctgtctcaactcgttaacagctctaggtaagttccattcttatctctaactttttgcaaatgcaaaaactacacaatatatcaaaagaggaaaagaaatattctgaggagcatttgccctcccagctataagctgacactctacactgaattcggcgcatagccttttaggccacggatttgatgatagttatgctgggtttttgtagccattgcatctcttctgatcccattctgaattcataatggacgcaaaataagacagggatgtcaaatatttcatatgtgaatgaacctctaagtcaggtcattcgaattgatcatacgggccgatggaagggttcccggggttctggtcacagcgaggcctccaaccattcaccccatctgagctgctgcaagcctggttggggaggacattgctccccagatcaccatccaagctcatctgttgcacttcttgaggtgatagaatcctaatgcatcttacacagttcacaaactccctacataatccgcaacagctcatattagaataactaaccagtaaaatctttcatcgaatagttcacttgcacatcttgtacacgcattgtttttcagtttatgaataaacatatttttctgtcatattatcatgctggattaaccatatttcactctggtaaacatatctttagctgtcaattttagcaatctttattatcttggggcctattttagagcaggaaattaaaggttcacataaggagaaagatagatatacttactcccatgggtcatcaccaagaagcaggatgtcatcctcgtgatccttgtagaccagtttccagcctattctctgtcgatcttcaagttgaccctctataccaaacatgcgagccaaagcatgcttcaactcttcatatccagagtacctgccgatgtcaatagaccggcctacagctcctcgtttgtacacctataattcttagattaggcttactagcatacgagccacaaaaacacacatcttgaatgctacaccatcataacctaagctaaggaaaagccaataccttggtgaatgtccgcattctctgcagcagaggggcagcgggccaggaatttttgttcaagaaggcaccatcattgatcgcagaatcaatggaattaaaagccatatccgactgaccaaatgactgggaaaccatggaggttgatatttcttgcagagcatccttttgcatcgggtagttgttttcaacatcagttgatatgtgattctgatacttgacagaatcaagtgcatttatcagcaagtcctctgtttctattgggaatcctaacaggttatcattgtt

SEQ ID NO: 58737 - DNA, 1595 bp, Oryza sativa
tgcatggtttatacaattttgggggccaggagcaacatttggtaattttgagttgacaacactttgcttcacattattattcggctttggcaattccttggtcattagtggagttgctgttacagcgtcaatggaggttgggatcaacattggagcagtggacggtggcagcctttctgtgttgatgcaatgtctgtttttggttgattgtgtaaagtggtttccattagctgtggatggagatgttgaacaagagggcatttcctctgtaactacagattgtgtagcacccgaaatgatcatagcacctccagttttggggatcacattggttgatgaaattggttgaaaagcaactcctgacacatctgcaagtgagacttgtttctgtaaaagcttctgctgttgctcttgctggaccgtgggtagcaatggtgttgcttgcaatgaaggcttgatttcttgttggggcatcatttgttgctgagcaagtgaatgtgaatttgacaactgcttttgcatgtccgtgattaacttttgctgttcttggatcagaggtggctgtgagagtgttgatgtggattgtgacatcagtgattgctgctgcagtttctgtaatatctgcaactgaagctcctcatcaaacaacttagactgctgacttgccagatttaccaactgtccaagggacttatttagctgctgctgattctgttgttgctgctgctgctgctgctgtaactgttgtttttgctgaagtaaaagctgctgttgcagctgtaaattttgatccttctgttgatgagacaaaagcagccgctggccattaatcctttgcgggttttgagttggagatggcttctgctgttgcatctgattctgaacaatcacctgagcctggacgagattagattgagcttggctcaggggaatcacttgtatggagttctgctgtctctgatggttgacagcatcttgtttctgatcttgaggattgatgatagcaccaagctgattcaacggaattgccgccttggacagatcgttcatggtttgcatttgctgagggagcttgggagaattaaactgtatgcagttctgttgaaggagattgttctggacatatagttgccttgcaagttcatcagcagcaaggttttgcatggcagggttacctagagcttgcaggtactcagactgcgcagcggtgttagccaatgatgagctctgctgcctgttcatgttcatccactgaaccaaacttagaccaggtgctgtactgttctggttttgagtatcctttatgcatacctcctcaccaagccaaggcattgccctcttgaaaaggttttccatctctgactcgtcatctgttaattcagataaaagaatatgaaatatactaccataaaaaaaacatatgctaatgcgataatgtaattagcctatagcaatcctggtttcgaaatttatacacttgttatcctgttcagtctactataaccatacacaataacccattaagtaattccgcatcgatgtctaatgtttaacaaatatgcagaccaattgtttccagcacacatagaataagt

SEQ ID NO: 58738 - DNA, 1109 bp, Oryza sativa
agcaaacgtggtgcctcctttcaaaactgtatggcacagtaatataataaaatggttttagagggaaccatttgaatatgtgtccgatcttttgagttgtgtcattgttgttatttgtaatcgttttgtgatcagatatggcggtaaattttattttgtttcagtcaatttttttatcgttagagttatcctgggattcatgctatttgggggttctcaaaggagaggacagctctcagagcggagtgcttgatgtagttaattgcatgtgttaccagtcatgatgcatggatacgtgatattggtacggtgatacgggaattttgaaaaacatcaacatgacgatacggtgagtatataaaaaatatttttaaaaaactaaaatatagagaaggtaaaacaataagattaccttaacaaaacaaaattctatgcattgttgcctcttacaaacaagtaacaagcttaacaccttgtaaccttaaataataaatatggtcagtactaaacttataaaatatattagtagtgtagcattggggttttaatgggctattgaacaagtggttatagggctaggtatcagagaagtatccaataagtatggtacgagtatcgttaattattttttattttttcactgtttagtgtccgtgtccgatactccttcgataccgtatcgatggagtatccgatacacgtacggcaagaaaataaagtatcggtgtttcacactcagtggtgagtatgggtgttcttttagtatttggtgaggcttccatgtcttctcccactcgttgtagccttctgccagcagtgagtgatgatgagtctgcatcttcttgctctttgaccagtgtggtcacgctgtgtgcgcttttgggttggtttgccctctacggttatggggtagggatgtagggtgttgattttgaagtcatgctgggagagagtgacggaggaaggtggtttcagggcttagtgaaatgaaaatttttgggtgtcacatcagacgtttaaccggatgtcagaaggggttttcggacacgaataagaaaactaatttcataactcgcctagaaatcgcgagacgaatcttttgagcctaa

SEQ ID NO: 58739 - DNA, 781 bp, Oryza sativa
tcttagtcgacggcaatcgcagaaacaagatgttgcgtcacctgtaatgggcctatgggcttgtaacttcgtctgggaccccggcccaagtggggcccatgtggggtgcgccccaacctggtggagaacgaccctacggcaccgttggtcgtcctcccacatccttaaatagctaggtaccccttcagggtttctcgggttttgatgatagagatagctacttgctaccggctcgcagcgcgcgtgttggctaaaccgctcgtcttcctgtaatcagaacccccaccatattgtgttttgatagtgaaattttcatctttatctagcaatttcagtgcttgttctacttgttcttgcttgttcttcgattgcttgcaggacgagtgccctcgtggccgggttgacgcgcaccacaagttcgcggcgaccattggagacagtgtatcggttgctaaggcgcagcgtctttggacggttgtagtcgggccgtgaacgtcgtctttatccaatcgagttatcccctacctctcatcgaaagatcgggccacaaaccctagcgggttcgcatcaggtggtatcagagctttcgttgctcggtgagtttttatctacccataaccagaaaatagcccgacaaaaagaaactgcatcatttacctagccatattgtgccattgcatagttcttttcagtttttgctttgccgaattttgtgttgcatcgtcacgtcatcttgctggtcttaacgtctagttagtttagagtatcgagttctggtcac

SEQ ID NO: 58740 - DNA, 741 bp, Oryza sativa
tacctctcatcgaaagatcgggccacaaaccctagcgggttcgcattagtataagagtatgctaacattcaaaatttatcctaaacaaacttgcccacttattttctcatctcaatcaaattacaaccatcactcacttaattccacatctctccttaatttcataaaaaaagaacttttaaaacacataggagtagtagaccttttataaacatctacgctaataaaactaagatgaagtaagatcacttcataagcaattccgtttactattttgtgaattactccctccatcccaaaataaacataaccatgagttttcgtaccaaactttgatcatccgtcttatttaaattttttaatgattagtatttttagtgttattagattataaaacataaatagtactttatgcgtgatttatgttttttagctttttcaaaaaaaaattaaataagacgaacgattaaagttgggtacgaaagcttatagctgtgtttattttgggacggagggtgtatatcctataataacctcatagttacagttaatacataattacagcatcgtgaatctttgctgatggtggtggttgctgatggtggtgcggcccgtgacgagagagagatggaatttagagctgaccaggtgatgttaggtcgtacaaagctgtcttgggcgtgatccatgtaagaggagaccagagaataagctttgcctcactgccaggagacaaggcaa

SEQ ID NO: 58741 - DNA, 1315 bp, Oryza sativa
tatacatgcaatatttaagtaggaataccaaaaaataatgtgttgaactgttgagggagcgtcagatctccatcgatctgcctcgaatgataaggggtttagtatataaatttgatctagaattaaaatcggttggcctttccttgggactttggccgacccagtttgctaaaaaatcatttgtccagtatttcctctgttgtataatataagacacaactactttttttttatgtttcatgatataaggcatacatacaattaattaggacatcttctccattaaattattacttttttaaatcatccaccttaagatctctaatttcattggatgcatgcattatatttattagggtgatccaaactaggagatgataataattatttcttgtttttttaggttaagggtggttgtgccttatattttagaacggagtattactcaagcttatcagaaagaagaagctccccgaaaaacaaaaaggaaagaagaagctcccctacgtaattgcagcaggagaagatcacacccctgttctttgtccagctggtaactaaccagtatgagagtagtaagcatgtttctcaagctggtaactaaccttgtaatttttagaaaactttatacacataaatctattaaaatattatcttaaatctatttttcaatctcgtaacagttaattaattcatttgcttgtaatatcgaattattcatctatttagaagtccattttattccattattcagctcagaacaacacatccggagttagcgagcaagcgagctacctatactttattattatcatctttgctaattaattaattgcagctagatcgctcgtttccgtcgtttggttgagtgtatatatatggatgaatatatagtgtgtatgtacatatatagatactgtcatatatacataatgtggcggctaagagtcgcggaggaggccggcgccggcggcgaggggtggctgagctccaccaacgcgcacgtcggccggcaggtctgggagttcgacgccgccgctgctgatgacgatgacgccgccgccgcggcggaggaggtcgaggcggcgcgccgcgagttcacccgccggcgacaccagatcaagcacagcgccgaccttctcctgctcctgcaggttgtatacatatacaccttggcatttcaaaataactcaatttagaatgtgacagaatctggacgtagacatatccagattcgttggctaaagatatgggtcatatttcatcgtaagtttagttattttgatacggaaagagtgtacatgtaatggattgc

SEQ ID NO: 58742 - DNA, 3572 bp, Oryza sativa
  unsure (1)..(3572): unsure at all n locations
aaatctcccttcccatcaccgcggaggcgcagatacattcgccgccgtcgcgccaccaccggcggcggcggtatggcggccgcaccgccgccacggaggcttggcgcgctcgccagcgccggcctcctccacgggatcgacgcccagctccgacgcgtagctgagtacgtctctctccgcacttcaaattttcacgcatcgacgggtggatcgagccactgaggtgtggcgacgaacgccacgcatgtctgggctgtgggattggggtgacggggattcggtagctgtgcggagacgcacggcactgagatctgggcttgttaatcatctaggttttgatcgatgatgacagtcactctgtcactagtacaataaaatcgcaaaagttactactactacttagataaactattggagtactttgtttcaattattcatggaattgaactgccgtcacaatcgtggtcgtcattttgtggaagaatttctctgggttactatgcaatatatatagtggtaacttgttaataccattttgcaaattgcagttcactagatcgaatccctctaagctggagattcctggtatcaagctgggcgaggatgaagatgtcacagaagaagcggtgctgacctctttgaaaagggcgattcggcgttattctactcttcaggcacatgatggacactggcctggggattatgctggtcccatgttccttcttccaggcttggtacttccttttcactgctgtgggaaaatggatctgttgaaattcatccacatcgttattagctaaattcacaatttctttcatgaggtaaaacattccaaagcactgctcggagctagtatgttgctgttagcatccttgctttgatgttggttggtacttgctagagtactgcccaaagattcatgcttggctaaccattttttaattttgtagtcccttggttgtttcacttgcaatggctggccttttgtttgtgtttttcccttagaagagaacctgcatttctgtttaaaagcagttcacatcagacaagcatcaattttatcgccaagtgccagcatgcaatcgttgcatgtaatttgtacattttgtaaagaaaatatggatcacatacatttgtcttccttttgtctatataagattatctgtacattttacttctccattcctaactcagttttacccaggttatagtactgcatgtgactggtgcactaaatactgtgctatcaacagaacatcaaaaggagattcgccggtatctctataatcatcaggcaaggacataaaacttgcccaaataactctgaaaaacttacttagataaatctgtcatttcaatacacatgtgtgcttcggtcgtgataaaatcgtaaaatctgtttcaaaaatcatgagagatttgcatttgctgaagctgataatcggctgctgaactaatttgctcgtgcatttacttccctttgctgtcagactttggagaggttcagatgtgagaacatgttctcagtttctgttatcaagcccctaacgagaaattcattcctttttggcccttaaaaaaaatccatgtagaacatctttaaaagaatggaaagagagggcaacctttgaattcaaaagggcatacagtgcgtgtgtttcatgtccttctccatattgtatagctcattatgttgtgtaaagaaagtaacaaaaactttttaagtgcagaatgaagatggaggctgggggctgcacattgagggcacaagcaccatgttctgtactgtcttgacttatgttaccttgagattacttggagacgaatcagatggtggagatggagccatggtgatagctcgaaattggattttagatcatggaggagcaactttcacaacatcatggggaaaattttggctttcagtagggaacctacgcattttaatttccttttgtgtttttgctctggtccctatacaattctaccttgttttacaatcctagagaggtcctgctaatgtcttaattaactttcttaaggtacttggtgtctttgactggtctggtaacaacccattgcttccagaattgtggatgctaccttatttcctcccatttcatccaggtttgccttctccttacgttttatttctttttactctttaatcttaatttggtagagtgtaagttcatcatacaataatagagaaaattatcgtaggtactggctggagtgcatgctagtgcaggtattcactatatacaaacatggttctttggcagcttactttgaataagtgtgtaccgggttgctgccacgtacgtatattgcactagaatccatgttgtgggttgataaagtgttagtacaataggctatgtctccctttataaaagaaacaggggaaattagccccatttggaaagaatggatttatataattgcagaaacataaatacagaatatttttactctaatgatatgatagaaaatttatgaatatgctgacatggaattttcataaaacaaaaggaagaaggttcaggaatatgtatagattggttaaattcttcaaggtacgtgcctattctgaacatcataagcatatatttggtttaggaatgagttgggatgggttggactcatccttgtgtttttggatgggatggccctatctatctgtttggcatgagggatgaaatggtcccagttttaaggggatggctcacatgtcagcgagaccaaagaagtgggnttggattggtctgcccaattttcaaggggaccatgccaaccgcggatcttagaaaaatattccctttcaggttcatcccatcccatctatctccaaaccaaataccttgaaaagtgagttcaatccaatccgacccattccatcccttgaaccaaacgcatgcagcatgcttaatctctaataattttttaagtgtatcaatccctatattactagattcatgcattgctcctccagccaatttgtgtgagatagatcagcgaccatgttcttagggtgcctttacaacattctttttagtgttctgtagtctgtacaagattttatctgtcaatcagtatattttgtttgcgtatgtccagtacgtatatggtccccctcccgaatggtatacttgcctatgtcttatatttgcggaaagaagtttgtcggcccaattacaccaatagtgctgaccgtacgaaaggagctctacaatataccctatgatgatattaattgggacaaggctcgtaaccaatgcgctaaggtttatgagctttatactttctttgtctttcagattgtgcacgggtcaaacagcaaggacataaaaaacaactttatcgtgcaataccatagtgtctgttgctactcagttcttgttacttcaggtagacatgtctgtgtaggataagtttcttatttaataaagaaaaaagaattatgtattgcaggaggatctgtactaccgtcatccattagggcaagatatcctatgggccactctttacaaatttgttgaaccagttctatcgcattggcctggcagcaa

SEQ ID NO: 58743 - DNA, 1098 bp, Oryza sativa
tacataaaaaactcacaggtaaatgcttgatgtcagcttgtgcaaataggttaattcatcatttaattacttacatgttactccttgctgaaagcttcttcatgactgccccggagatttgagttaccggtatcgccatatatataaaggtgcatggaccttttctactgctgatcaaggttgggctgtatcagatagcactgcagaaggattaaaggtagttaatatgtgaatgaggttgtcagtattaacaacaacgatattttctttaagaaaccaactttgttcttgcagggtttatgaagtagaaattatcctatagtattaggcatcatagtattaccattatagccttcacatgtcacgtctaagtctaaccattatgttcttttgtggcattgatggcatcatttgaattatattttactaaatgtttgaatttctatctgatgtgattcctgttaattaccttcaggcctcattgttgttatcaaaaatttctctggaaattgttggtgaaccattaaaagtcaatagactttatgatgctgtcaattgtctgctgtcttggatggtacagatatcctaacttttgttttctttaatttcttatttaataatatccccagggtatttctgttccccttgtgacatgtcaaaagtctccgtataagctggaatagcaacttttttttattagagaaagtaaattggagaagtacgtagagtttatgaattgcgataacttatagagtaccaattaggtatttatcaaattttgcttcaaatcttgtacctcttgtctctaggtgccttaatcagtataataacttctgaattgtcaagttattttaatcaaactggctaataaattttctcatgctacatatttaatgcttctatgctcaatgttgtatatccattctgtggaatgatcaaagcctccagctgttgatttatgttatgatgggtctatcagtatgcttattgtctgtaattcttttggtacagaataacaatggtggttttgcgacatatgcactcaccaggtattatgcctggctggaggtgagtggttgaattatattgtctttggtt

SEQ ID NO: 58744 - DNA, 7074 bp, Oryza sativa
  unsure (1)..(7074): unsure at all n locations
accaaaactctgctttgttttaatatactgacgtactttttttttgcgtgttcacgaaaaaatatgcagtaacagattgtgtgtgtcgtttcccatttgacaataacatcttgattctcatcggagcagggtgagagagatccagcgccgttgcaccgagcagctaggattcttatcaacctacaattagaggatggggagttccctcagcaagtaagtcataactgctcttctcttatagcaaagtagtgagttttttgcttttggaccatttctcgatttgtgcgtgaaaaatgtacacagaaattcaggtgcagagtgttggccaatggctgggagggttttttttttgtttttaccctttcgaatgatagcttttcttatgcttaataatgttaagtgctgtccctgtctccggtagcttctgaatctgaatgaatttttgtgtgacttgaaaaaaacaacaggagatcatcggagcattcagcaaaaactgcgccatcagctactctcagtacaggaacatattccctatttgggctctcggagagtaccgctgccgagtcttgttaggcaggcaggatgcatcggtgaccggcaacactgctagctgatgatactgatgaagttattttctttttaaaaacaaaaaaaaaagaagtcaagagtgcaggtgttgcgtggctttctgtacctgaaacttactattaccataatagcagcattatggtttatttacagctgaaagtgcactgtgatatcgaaaacaatatgtgctgatcatcgtgaaataatgtcgtatttaagggatgtatgtgtaaaagttcacctcgcgttgcgaattgtgatcgttccaggggtatcttagaaaactgacgttctaatggggtcctttgtgaaaaatgccacctcttgaatcttgactctgagcagcatagatccgatcggacggttcacgtggaccccagtcataggatcggcaatgcttttaacggatgatgattaaattttgggtaattttagggtctcttttgaacaaatgcttgtgcaaactcaccacccaaaataggttcgctaccatttggtgccagcaatcactgccacagtgcagggcttggttgcgtagagatattgatcagtgttccatgatcatagatgcccacaagaaatcaagaatctgaaaccatgatcacttgctgaagcaattctgatacaaagtatcaccagaatgaaattattcaagcacacgattagtgacagcgactaaaggaaagcaaaagttaagtttatgtttcatggcagcgctacaaccagagtacaacacaaccagatcaattcaagttcaagtttctcgcacacctttattcttcagaacaccaagaatgcagttccagatttcagaaatttcagataagagcagaagccatgtcgattgcgcgacatctgaaacatcgtcagttcatctgatcatagtgggagttgtcataggaaggctttgggagctggagatgatcttcgtcgtcgtcgttgccaaggcggtcgaaagcctgaaactgcgcctgctgatcaagggacaagcctccttgccagattgctggagatggcatcatgacagggttggaggtgccggcaatggcggtgacaccagggtgaatctgagaacctggctgaaggtttgcagcacccactgaatcgattgacagaagagagagagcatgctcaaagtctgggcctctagcggagccggaagcgacagcagaagcttccatgcctgaaaaattagtgagtagaactgtaagttttatgcggataaataaccgaaaaaagatcgtannnnnnnnnnnnnnnnnnnnnnnngtcatatatatcatggtaactatgaacagattgcaacaaaaatctcagtgaagataattcctctcttctagtagtatatatgagcccaggttttccatgtagaggatcttggtcctactagaagtaatgatgattagattatccaacagattgcgactccctccattttggtcaaaagcttaaagctttcctgcatgcacattattacactcaactaagctgttgaagcagaatcatgcttgatcaggacattctggtgctagtcattgtacaagagttgggccaaatgaagaaacaccaaaggtgggtggttaccggccacaaatgaagctccaataacatgcgaaaacgcaaaggttttcagtgattgcagtctacttcacagaacataacagagcttcaaaccaatctatgatatcgatatataccactcaccttacacacgtcactacaagctgtcctagattgcaaggagtggggtccggaaatttgtttcacatgttgtagctttgtgcctacattattgtgagctgactcaatgttaaggtgtcagcaactggaggatggtgacagctctgctaaaaaggatgagtttcatgggaaagattgtggtatgtggacacttgctgcggcacaatgcaatagtacttttaaaatcaagcaagaagctaatgtagttttctttcagtcttagtctgtaatgtctgtaagacttttctccggcttttatataaagctggatcaatctttggtaagaaaaagaagctgatgtagacaaaggatgagtttaatcagaagtcagtagcaaagaaaagaacatggagaagaacgtagcccaacaatcaggttctcgtgttgtaaaaataaataaccagacatgtagtcatgggaaaaacttatctaatgaaatgatacgaccatacgtcctaagtgcatagagttccataccatctaataacttcacagaaacaccaatgatcagctagaatcaagaagaagcatcccaagaggcaccatcatataaaatagcttctaggactacataggcgcatccgtctatgctctttttcctcataaggagttgtgagaacaatttttatgcgggtgaaagacccaacattattattattttctcatcttttgctttcagaatgttaacctctcacctttttcttttggaaagttcatctataaatagctagagaaacaaaataccttggttaaggaccttcgcgttggtttctttgaacgccatgagaccatcaaaactatgatgtgctccatgtggcagtacattgcccgatgcctgctgattagatacatgcgtcccatcaacaccggcagctattgttggccttgaccaaggagcttttgttgctgtaaatttgaagcctcctggtactgggttatcccaagaacttgcacagcttcccatctgaccataaggagcttgaccaaatagaaaacttgcctgttgccttgcatctgcttaggacggtcacaagtcacaacaatttcagcgctaagctaaacagatgtaacgactaacgagaagaaataggttgcttattactattgtactattgcctattatggaagttaaagccacttttgtacaacttacgggtacactaaattcaatgtgcacttcttgaaattttagttaatgcttactcagatactcaacaacttctgtgctccaattcgttaatttttcagagtgatttttctttctgaagtattatgtgcagaaataacaatacaaagagatggcacagttgaaacttcccatgttttagtaccgatcagttcggtgacaatatttatggtattgggggggggggggtgagatttaaactgggtagatgacaaaataagcttcaatttcacagaactataatgcaaatagaatcttaataccaccatagagtaatgtagagagcctcgacgaacttaaggaaattgcttctggttgtggcttccgtctgcgggcattgtgatcatggaggcgcctgcgacagcttcgttttttctggtcgaactcagctaaaccgtgaaacctacaaaaacagcagaagttcaaagaaaagaatgaaacaagaacaattttactttaccttaatcaagggtgctaagatcggattcaagataacaagcagacaacatatttagtacccaagaagaaaatctcaccgactacactgttggcaaaagcgtcgctcaagacccgcaacgatgactttaagagtcttgctgtgaggttcacagactcggtgctttcgatggtaaggtttagcagaagagagatcaacattgcagccttcaacttgacagtgtgggttctgagtgttctgctgagccaccttcaccttcttggccagaccaggagatggggtagccacactcacaccagatggagaactcttgacattctgccctccacagacatcttcaaaataggttctcttgccaagcttcaggccaatcaagggctctacacgattggctgctaccaccggtgatcgagaagttccggtgtcatcaactttactcttacccttgtccatgttcttatcatgctcttccgcagatgcaaaattgagctctatggtgttccccactttggacggagaatcgatcgacgcggatatggaactcttggatgaaccatacccaatctctgagctagaagagaaagtaccaccagaagaatggcctgattcatggcctatgtcaaccccaacacctgcaagttttgattcagccagcatcacattcttgggattctcgttcgcgctatttcctatcggcggcatattctcccaatcccacaacaccgagctcttctgattccagtccatcccaaaagaacccatgccagttacagatcccagctgctgctgctccaacctttaaatcaacaaaatgaaatatgagaaggacagatactcaaaaagaaaatataactcaattagaagttgcagaaatcaggacagatttatggcatagctgacacttgactcaactgtgcatcattgaagtttgagagagaagtacaaccaccacaagatgtgctaccaagagtatcaatgaatgcccatatatgcagactctagcttagctttatcaggggaatcatcaatcatggcaagaacagcaacatcatcatttcagatgcaagaaaggcaaagcacaactacctcaacagtggggggagggggtagtgaagtacctgctctttgcttctctcccagagaaaaggagcacagcagattcctgatgaattcctcctgaaaaaaaaaaactgtttctctctctctctctctctctctctctctctctctctcaatcagcatcaccctggagaagcatgggagctccactgatcgcggcgagccgatctggcgatggcggcgccgtccatcagacttggcagccagagaagcagcctcactggagcattcaagcttggccacaccactgccttctcctcactctcatctctggctttctcagatcttatatcctactacacctctcctcttcaggctttctctatccctaacctttgaagccaacaacatcaaccagtccagtgctggaccctactatacatcatgacaagagaaccacccccaaaatttcacaatctcaaatcttatcacagtttcacactttcacttctcaccaccatgaaagattttacaagctcagatctttcacagttccacaccaccaagaactactactacctgacctcaaggctgctgcattatttcttccatgttagcagcactgcaatggtggcagcagcatatgcaaatcaaatcagaggggcaggaaaagaacctataccaagtcaagtcaagtagcttctttctttcttttctgtggggcacctatacaaagaaacctatagcaattagcaaaggaagctttttttcacctacctagggctaggggacaaagaaccactctactcctcttgtatctgaaatcaagaatctcacctcttttccctcaagaatctgtgtcttcctccagaattactttccctggcaagcgctggtggaaaatgaggaccttaaaccaaaagacaatgaagaaaagcaactatagataagaaagacaagactcacaataatccaacacacacaagatggcctctctctctctctctctctctctctctctctttctcactgtgccccacctgagcctcaaatgaacaggaggaatcaaagagggatgccaagtgggtggcctgcctccttgcactgtcacacacacagcaactagccacatgtgcttcactggcacaaaccaacagtgctcaatgtatcaagctatactcaccagtttactgttactgctgcaccaacagctctgcttactgttggtatgctgcctcttccagcccaatatggccactacacttcaagtactcacacaaaagaagcaaatcccctgtaagaaaggcacaaccttttgtatgatgaattcagaattcagatcaccttctcagggaaagagtaggacattcctgtagcctgcagtctgcacacctcaacaagttagtgccaagtataagtgatgatacacatttgcccatgcctaccttggaattgcatttcataattggtgcatgcaaatgaatgcttatctctttctcgtcttgctctggtgtgagtgtgacactcagcttctgttcttctaggccatctttacataggaccaaaagttgcagtagctgccttttgtcggttgtgcttaggtggtgctcctctttgcttagcacttttgatgtgacactgatggctgcaactgcaaaatataattactccataggaacaataggcagttgtgtaatgagatgcaagccttttgcgtattcccgaaaataagaaacgggcggttgttaaatcagctaaggcatgtgttaaaatcagctactatatcaagtggatcttgatcatgttggctacttgcaattgaagaaggcgacgtagatttggttccccaatggttcctgcttaaaaacaaagatcaatcagcacagataccacttgaaagtagcaaaaaatgattagtttaattaacaaccattgggactgtaaaaattggtttgcgtgatcccctcccccatcagcggtagggaagtagggagtcgtggatgcaatctacaccacgtctttctacaaaataaaatgggcctgg

SEQ ID NO: 58745 - DNA, 2629 bp, Oryza sativa
ttttttcttatctctcactcgattttctcactcaaatttacaatgcattttcttgtaagtacagtgtaatttatgaaacttacactataacttttgtaagttacactataatttttgaatcttcgcatgtaaattttaaattttgtattggatttggtctttttcttgaggatatggtaatttagtgtccattatggtgtttcttaattgctttttgctttttattatatctatcggattttaatccaaagattaaaaatctgtgtgatacgatcataaaaatctttcgaaagatgtataggtactccctagatcaaaaccgtaattaattaagatggaacaataatcttcatgaggagccagcaatttcctactccaagttatctagatcgttgggtttggatatactccgccatgagatctagtccaggtgcgtggatctagaggtagacaaggcgtagcgcgccactgtcgagccccgattccggcgatggcgagcgagaggatcccgctccccgccgtcaaaggcaggaggcagaggcactcgccgagaataccatggagatcgctgcctcgagcgacggcgagcgcccgccgcaacgaggcgggatctcgccgccggcgggagcggcggcgatctcggagggaggagagggaagagcaccgcgatcagccgatcaggggctaatctgcataatgcattccaaaacaggggctcatttgcaaagtttacgactcttggagtggtattgatcataaccataaggtccttttcgaaaaaaatgatgatagatactcctatctaaacggtatatttgaaaaaaaaaatgtgaacaaaacttttatatatgtgttcttagctatcgaaaagaaagcgctgaagaataaattttgatgaaaatccccaaaatcaactccaaatttaaggttgcaaattcaaattttagctgacgaaaaataacttatgaatagaacttttatatatgcgttcttagagcatgttcagtaaagctcctaaacacagaccttaaacaactttgagaggttgagactaaaaaataaagtccaacaggcccctacttaaggccccaaagtaggaagcctcccaaattccctcctacagcccctaggcctgggggctctatccccagcccctatccaattttctttggcgcgggggaatgcttccacgacgcgtgctccttcccgcgcgattgcttgcacgccgccggccgtcttgttgcgggtgattctgctctaatccggccatcgccctgctatagtattggtcacctgcatggatgcacgtatgcatggatttttctgcatatcgatgagacgtggtttggttcctgttaagtgtgaacagccatctgccgccagtggccaactgagatttgatgctgatctagaaggagctactactatatctccttgcatatattcatgcagtttcgtgtatgcactggatataatatatcttaatattgaccagctcatatatgattatatgcatccatatatgcatgtatatcattggatattgagtgtaggatggatgaactgctactgctactagccgcaacagatggactgattgagcattctagtgagtcatccatgcactcacactagtgtacgtatatgcacatatcagtgtgatattataaaaaaaaatcaaatttcaatttaattgtgttgtttgaaattattaatttaaatttgattaaattctatgcgttggaaatattaatatttacattattgtgatattaaactaaacataaaagatggattataagataaaatagaggagaaaaagaaataggggctaagaaatagatgttgttgctggagttagaaccattcttagagtcctgaggaaattggggcagcccccatttaacctttagggactctaaaatagtagctattgttggagatgctcttagctatcgaaaagaaaacaccgaagaataaacttcgatgaaaatccccaaaatcaactctaaatttaaagagaaaatcccttatatacccctgaaatttttcctaatcccttctatacccctgaattttgcttacttccttatatacccccaaaatttgattttgatcccttgcatacccctcccgtcagttgaccattagttgaccgtgtattttctataaaaatgaccattttacccttggatgaacaaagaaattcatgaattacattattaaaaatataaaagcttctcgcatgagactattatagttatgagtttgttgtgcgatgcattatttatcccaaaaaaatatttttagataatgaaataaaaaaaatacgtatttattttttaaaaaaaaggtcataaaaatgaggagcattcatataaagataggtataccaatgttcataatattttttttatgaatgctcctgataaaaaaaatccattgtcctattaaaatttcaaataaaaattttattttttttacatttattttattttcaaaatttatgtcaaaattttctgcactaattatttagtctcattagttttataaaatgcacacgatgtgcacttcaaacaaaatttcaattattttgaagcttatattaaacctaaagcataagggcaaa

SEQ ID NO: 58746 - DNA, 5093 bp, Oryza sativa
  unsure (1)..(5093): unsure at all n locations
cacagggaattcactcaaatttaaagctgcaaatttaaaatttagctgatatgagtataagtgtaagcggaaagatgaggttgttcagttggcagtgatccaaagaagggggcttatttgaaaaaaataatatcattggacttgtgttaagtgttaaccgttggatgggaatctaagatcgagttacatttacataaaaatccctctcattttcatgtttgtaattaggctccttctcggtttctcgctctccgatcccccgacgaggcggcggagctccggcgaacctgggaggggatcggagcagggttcgtcaggccgcgacggagggtgagatttcgcgcggatcgcatgccggagacggaggctccaaccgcttggccgttgtcggggattggagatgcagttctgagaggccgcaggctgcggcgagctttctctgaacttttctcatcctgatatcagctaaaatcaatcgaggtaatcaagaacctctcgaattgtttgcttcagatcagtagtgtggtttctgacttctgatatgcagtgtgcagggatcgatgcagcttagtatactcacattttgttgattctgccctggtaaatttggagagattttttttttttttgacgccattgccatctgatctgagtggtcatagctatataacctctcttctgaagtattggagcagaaaatgcagaatcaaactgaaaaggaatatcaaggcataatgcgacatggaagaatctgaagtctgaactcgcctgattgcatgcaggttcggcaacatcgcccaacatctctgattgtcaatcaatggttcaaggcatgatcctcatcacaatggcactggtagatcaaaggctacactaacaagaatccaagcatgatcgcgatagcgggttcgcggcatccaccagggaaaaataaagagggaaaaaagagcaaaaaaagaaaaggttcctacatgaatgaacatactgacagcagacatcaaatatccttatcctcctgccagatggctgatgctcttactacagccatatctcttgtgaaacaagcatctatgagaatgacaggcaaagctggagaagcactagcagaagcatcaagaggttgctgcttctaacatgctgcagcttccacgagaaggccgagtcaacctcgatcatgataccgaatctgcatgttccggtgctggggtcttggccagtgatcgttgcgaggttcgagaacccacaggcgacatcgtcttgatcgttcttctggtagtagctgttgaacgcgtacgagatgttgcttctggtgtccagtcccccacaagatgtcttgtaaccaaggctggtgcaatctgccagggagcaggcatagctgatgctatctgaaagccttggatcagtaaggcctatagaaggcttcagcacgcaccacttcctctcaaggtacttcacgttcttcgctttgagaaggccatgtgattgcccaagattcagttgatactttggcaagccatcataggtgaatatcccccagtgacgctcaaaattacctggctgtatgctcttctcatcctcatcgattagactgaacaagtaagcatcaactggtccaggcctcatcggcgttcctcgccctgtggcaatatgtgttaggaagccttggttgaagtgctgcgccatctgaatatttgcattcatgtccccgtcagttggccatccaatctccccaacaatgactgggagatttccaaagccattcttcttcaaagcccatataagtgtgtcatagtttgcatcaaacatgtttgtgtatgtcgcagagccatcaacaatgggtgatgcggcaccatcaaagaaggcgtagtcgacagggaagtttgaatcagaatagaggcttatgaaagggtagatgttgacagtgaaagctccaccagtatcgctcaggaattttacgatggtgagcatcagatcatgaatatctgtgcggaagtccccatcagaaggcttgctagtcgatgattgataaacatcagcattgagagggcatgtcactctaacttgactacccaagccagccttcacaagcgcactttgtatgtttctgatggcaggaaaagtagtttgcagaaagcttccattgtatgtctccaggaaaggctcgttaccaacagcaacatacctgatattacaataggaaaaccaagatgtgagatcagatggttcagtgagtaaacatcacagaggaacgaacttgcaggataaagttggtgggatatagaacatgagttatatgatgtgttgtcaatcatcttttcttaagagtgcggaacaattggatgattcaattatattgaggctccaaaccataggtcactgattcaaatccaggaaagtcagagtggaactaatgcacacacccaacatctcattagtggtaaccaaacttggccaccagcttggaggtggcacactagtaagaaatgatatggttgcgtttcatacaaacacacagaggtcagcatgagtattcagtgaacttcagttgttatgctctataatgttagtccaggtcatgttacttagcagtttagtatatatttataaagttgctgttttgatatatgtataataagggatactccatgtgtgaataacatgtaggaaaatttcttaccaacacaaacacaacacagcattgtttagttagaaaatctagtcttgttcagttcgcaatgatgaaaagcaacagatccactcatacttcaaataagtgtgtgatactttttggtagtaaacacagttcccttgtgtacaattagacatgacaagcaaaaggaatgggaggttttataagccatctacataaggggatccagtgatccacaaaatcctataagtgaaagaagaggcattagcatagtgacagaacaaagagcttatgtaaggtctagatgcgggcatgcagcaattcagagtggggacaattattattctctttcaacgaataaagaggacatgtcaaaaaaaagggttatcctccgcacagcaatgtccataccttccaccttatatagcatactactgaatgctactggtcatatcgatagctcagtttcagttgaaaaaacagtactacccagaagcagttgtttgtgaacatattcaaaacaaaaaactggtaaacttcacccaaatgatatgactaccatagtgtcacttgagtgcaaaaacctcatattcttgctacaattccatagaggagcaaaattctttactaacagtataatgatagcaagaaagtctcccaacatggtgtatgcattaatcaggagtacaagcacagatggataaaacacaactgtactttgtggtaattttgcctccagagacaaacatgctcaactgactcatcccagcaagggtgcaaatcgcgtgagccacgaaaaatgcaatgctatagactacagggggtttctaactcaaccactctaccaaatatgagctgcagttggtaggaaccaatcaacacagattgaatgcaacgctaaccactctacataaaaactctagacttaaccagtatgctcaaaaggccatatcacactagaacaaccaggttgaacgtaatgccaaccctctaccaaaagctctagacttaaccagtactgcttaaaaagcaaaatcacacaagagctactagagtgaactgaagaatcttcagtgagtgaactgaagaatcttcagtgagtgagtgagtgagtatactatacctgatgctttctagacttaaccagtatgcttaaaaggccatatgaaactagaactactagagtaagctgattagctccccagcaaaaactgcttgagagtgaactgaagaatcttcagggagtgagtgagtgagtgagacctgatcttgacgccgtcgttgaggtagttggagacgttctggtcgacccacttgttggcggccgccatgctgctggccatggcggcgagcatgtcgttggggatgccgaccatcacctccagcccgctcttcctcagggcgctcatggtgtcctccccggcgtcgaacagcttcaccttgtcgaacccgttgtccttgagcatctgcaccaccgtgtccggcgccagcgggtggctcgcctgcgtcccccagttcgcccctatcgcctccacccccaccgccgccgtcgncgtcagccacacccaacacgccaccgtcgtcgccgcccttccatgccaccaccaagaagaacccattctgctcagatcttgggatgattgatcaggcaagctaaagaaaccagcaaaaaagggggattttgggatcgatgaacacgaagagcaaagctccaagaaacactagaagctcaaagatcgaatcctttcttgagctgcaagaagtgaaggacgctggaatctctgaactattaaagcagcatcaagagctcaaatctttgggaataaatgaagcccagccgaactcatcaaactccacctaaagcttgaccacgaaaggagatttcctttgatagctaaatgcaaggactcacatcacacatcagtccaggggagagcattaatggctagcataccaagctcaggtagggagtaaatttgctgatgaggacagcacaggggacagatactagattagatgagagtgataataaagggctttgccaaagctggcaccaaacgaagagatgggcacagacagcacacaagagaaaaacttttctagtattgctcccaggatttgcaggaggggaaagtagaacaagatatttttcaggaaaaaggagaaggagaagaaaagatttgacagtgtgaaccaagaactgaacagaaaaaggagaagatgatcacctagacaacactctcacactcttgagctgcaagctgaagagaggatatatgctccataacagtgattagcacacagagtggtagtaactgaggtttttcagctcaaaaaaaaaaggtactagaaagattcctcaccatacatgccaatccaagatacatctagtactgttgagcagaggggctgagattaaaaggccaaagaaaagcaagcataa

SEQ ID NO: 58747 - DNA, 3757 bp, Oryza sativa
tactaaagaaaagatatcatgatgtttattttaagttggaaccatcagcacagtactacttttctaaactttttaaaaataaacattcgacccttgattctcaagatcaggagggcaaccttgccatgacagaaaaaacactgtagtgtaacaaaggattggcagaatgcctaaaaggttcttttgaaggaaaaaaaaaagtactttggtgggactattttgtttttcttgtttaaaaaaatcaaaaaaattaatatgaagtataatactctactttcttctttatcaatcattgttatacatgataatatcatattgataacacttcccacattttttctagcaaaagaatgtgataacaatatgtgatgttggtaaatctatgtatttatgagaatgtgataatctaattcttctggtttcaaagttgatgagaacggtaaatggtcttatagttctgaatttcctcctaaaacacgaaaatatgaagtcatttctacattgtaactctaattggcatttttcagtagttagttgctcataatttaattgaaatcagtacccaatctattgcctgattgctacaacggttacaaatttaaggttgctttaagttctgaaacacttgagtatttgtacaaagcatgatgtttaacatcagtacttaattatggctagtatttgtacagtaagctctagttctctattttaagctccagttttgaatttcgtctgtagttctgaaattcagctcttgttctgaattttgacttcgttctcaatgtaagctcttgtcctgaattttgtctgtagttctcaaattaagctctagttctgatatttatctatatttctgaaatctacctctagttttgaattttgactctagtcctcaatttaacccctagttatgtattttatctataattctgaaatttacctctagttttgaatattgactctagatttgattttcaatagtcatttaatttgtaggttattaatctgctttgatttgtgcaggtccaagtgtgaagaaatggagatactacccggatgatttgaagatcgccatctatctacaattgttggcaaagacagatcctcttgtgctgcaacgtggagttaccaaggcagttgcattgaattttgatttgccagttagagctgtgcagcaagtatgacgcagtggacaggattatggtgggatagaaggtgtgataaacaagttgctcacaagttgtggttgcaaaagagtacaaatagatatggaatctatcagagacgtgcctttgagagatcgcacaaccattcaggatcttgccaatgcgctcggtgtgaagtagtccacacttcataggcattttaaggaaggccagtttcgttgcctacacgcattaattccatacatgcatgcatgcgttacgaggaggcgtcagcgagattaccaatggcactagctctatgtgatgattaatatggcatttttggtttttgctagtgggatgatcaatttgggaaggagggagtatttctttagttagcaattattaatcattaattcaggattaggcagcaagctcgctgcgcaaccccacgagctcgtgcgttgccacgagtttgcttctttgatatgcggcagtagtatattttttccagtatattttcaaatatcactttgtgtcttttgtccacggcaaaacgaggttactagagcacacataaaaatggaagataggtgaattttaatactcttatctggtacattagtgagcacacttggtttatgagcttaatggttatgaactcaccagattcaaatgtcgccttctttagcgtgttaggggaaatgcatcttgcccctctctaataatgtattttgtattatctagttataataaaacctcacagggcatattcttttaaatatgttatttctttcacaatggctcgtacaatgtaagttattgcataatgcaaatattccattttaaaaatagttttggttgcctttggtgattggagtagctagttttattttctttctaaagtttcgaaagtacttacaattagcatctccatgaaatgccacaaagcactcaaatacttccttcaatcataaatatttgatatttatgacaagatttggttttaaaactcttttaatcaatcttatattagaataagtttacaatatcatgggatggtattttccaaggcaagactagtatttgtgcatacattttcatttgagaaataattgattatcaaagttttaaaagtctgaacaaatcttaccccaaaacatcaaatatctaggacaagattttgtcggacctctaacacttcaaccatcaataatatcttgaatgtgtgggttagagaaaaaatacggtatacccatatttaccttgaaaagcactattaaaatatcatagattttataaacttaatataatataaaaatgttgatcaaagttttaaattttaaccaaatgttgtcataacatttataaccaaagtgagtagtttattacaaatctaccaaaacgattggtcgaatatattcgaagtactgaaatcactacaataaatactaaaaagatttatacaagataactaagtaatggatagaagcaacttttttattttgcttaacttgcaagggaaacactgaaacatccataattacaacaattgcaaatttgccacttgtttaaatcgttattgtaaaactaccactagaaatatgtaaaattaccactagaacgatcattcgatggtatccttacaaaattaaaaaaaacagtagcaaatttacaaatgtcaataaataattctccacttgaatatttgaataggaaacataaataattttgcttgaataatatttgaagggagagagaggctgaagccctaaattcccctcctccgccgaccaaaagccctaaaccctaaccccagccaacgcgtcttcctgcccatccccggcggcggcggcggcgtcagcggcggaggtcggcgactagtaccagcgaggaggaggagaagaaggcaaccggagatgccgctggggcaacgcgcgggggacaagagcgagtcccgctactgcggggtggaggtgctcgacttccccgccggcgaggagctccccgccgtcctctcccactccctctcctcctccttcgacttcctcctcgcccccctcgtgagtactactccactagcgcctccgcccttactcgattccgcctcctctctgagactactagctcacttggtggtggtggcgctgctgcaggttgatcccgactaccggccgacgcccgggtccgtcctccccgtggcggcgtcggacctcgtcctcggcccggcccagtggagcagccacatcgtcgggaagatcagtgagtggattgatttggatgcggaggacgagcaactccggttggactccgagatcactctgaagcaggagattgcgtgggcgtctcatctctcgttgcaggtccgttggattcagtgaatttcacaaaattattaaatgtttaatgggagtttctaattgcgcatcaaggaaatcgctctggagagttcatcacttttgcaattttgcaaccaggaagtgctagagataattttgatagtgttgatgggcgattgtcatgtataagagttctccaccatttatgcatattttcaagcttgtcagtgtgtaaattagttatgcttccgaagtccataactagaaactaga

SEQ ID NO: 58748 - DNA, 6786 bp, Oryza sativa
tcacaatgtaagtcattctagcaattcccacattcatattgatgctaatgaatctagatagatatacatgtttagattcattagcatcaatatgaatgtgggaaatgctagaatgacttacattgtgaaacggagggagtataagatttccttacttggcgtgtttgggagctagactgacccatatgcattcttgaaaacatggtctgaatcctagaaattgcatgcattttctttcaggcgtgcgttcttcctcctcccaagagatcttcttgtgccaactatgctagagttgtgaatcatattttgcaaggcctgaccaatttgcaggtatcttcctccattttcaattacatatgttgtgtattgtgcatgtcataaatgtttcaatttgatgaacatttagcttttgtttgttctgtctctttcttaagttgtggcttaggatacctctggagaagtctgaacctatggatgaagaccatgatggagcaaaagataatagcgacatggtaaatttctgataattctagactggcctggactgttaagcagcagactgttatatatctgcatgtgcggggtaaatctcactcttgagtgcccttttaaattgcagagtgataccgtagactcttgggaatggtggaattcatttagactattatgtgagcatagcagtcaactgtgtgtggcgcttgatgttttgtaagtgatgttcttgcattgttgcaccaagtgctttcttccaagtgaagatgtcactgataataaatctatcatgttatagttttggttttcattacaaaggttggctattcacttatcaggagcacactgccatctatgaattcactagggcggtggtttggggagcctgtaagagctgcaattcttcaaacaaatgtaactgtactacttattcaattaaagatgacatgcgatctcctttctttggagataagaataacccttcatggttctgatcactaaacgatttttcgtctcccaggcttttctgacaaatgccagaggttatccttgcctgtcaaagcgccaccagaagctgcttactggattttttaaccattcggttcaggtgtgttccttgtgcttccttctatcaagcctttcctctcttatcttttctgctaagaacccaatgcacagggtgcctccatttccattccaaatttcaaagggcatcttactgtaccttttctctcggatttttcaccctctgtttttctttaggttataatatctgggagatcaaatcataacgtatcccaaggaggagtgctctcaggtgatgaaaaccacactgaaggtaattcttgcaaaatttgagatttataatttattggttttgttatgtatttcaaccacacatgaactggatttatacatgaactgaaaatttcttttcaatatgttttaagtaatagtggtgctctacaaacttaactttgaaacaaattcagagagcaaaagtcaggacttgaaatgaaattagctgcttgaatttctgaggcgcactgcaaaatgtatattttttctttagcacatgacttatctgttgcctaaactgttgttttagatactgctgttcggcatgcattgagcccataccttgactacattgcttacatatatcagaggatggacccacttcctgaacaggaacgctttgaggtatttagtttatcagactatctctctgatttggcccatgagctgattcatttaagcgagagctttcttgaccttgaatttatttgctttattcagatcaattatagggattttctgcaatctcctctccaggtaattcctattctgtagcccccccttctttctcctcccctcatcattttgttttaatctttcctcacaacattacattttcttgcagcctctaatggacaatttggaagctcagacatacgagacttttgagaaagataccgtgaaatatacccaggtttctgctagatgttttgaatatctttaaatgttactgtgaaaatcactaatttaaagcgacagcaaatttatctttcgaatcgggcattctgattatcgcttctcatttttttttagagaaaatcgagcaattcccattccaaacattgccactaagaaaaaaatgacactttaaaggctgtaattgttccggtgcatctccaaagaccgtttttttttttttttgccaatatggccatagaaataatttacagctaggtccaccacatcacttgacattttcccctgtctgcatggtataagccatcttgggtttccccaggttatcttgagcaaagaaaccacaatgcaggcatgttccattcatactagcttgcaggtcttgagacttgactctgtccttaagatcagcaaagtgctggtttgtcatgacacagaaatagtagtcgcagtatgcttgtagccccgttatctgtgtaggccagcaccagtcatggggctgtatgcatctgcactggatcacactgatagtaactagactccgtgcttatcgtggtttcccggcaatgatttaactatgaattagaggcaatgctacctagagacatgagtgtgggtaaaactcgttcttttttttttttgtgcgtgcgtgtgtgtgtgtgtgtgtgtgtgcatgtgtgtgtgtttggggggggggggtacttgggttccccttaatttttttcctgttcaacataaactctaataccagtgttggctgtattaatgtttttctgtttttcatcatatgaacagtatcaaagagcaattgctaaggcattggttgatagagtttccgatgatgatgtctcaacaacaaaaacagtaagattggacctgccatattttatcttcctcgccaaatcatgtcttgtttctgtattgcctattgttacttgttactctattttcttattatcttacctttagaattctatgatttaacttcatttactgttccataaaggtgctgatggttgttggagcaggccgggggccactagtgagagcgtcgttacaggtggctaccttttctaatgaagcttctgaactcactaaaaatcttgacgaatgttcttgtgcttaaataatgcaattgcaatgcatgccattttttttccgtatacatgcttcactatctgaatatgctttcatattcaatgcaggctgctgaggaaactggccgcaagctaaaagtatacgccgtcgagaaaaatcctaatgctgttatcacccttcacgtgagttattcaacgaatacagcatttgtcattttcgttctcagatagttgattggatgtggaaagcttgtcagtgtaatcattgttgcaatcctttgtccttatgttttgttgatagtcgggtttttctcctgtttatcctgtacgtgtgcaaatatgattacatgatgactatctgatgtgctttggggcggtgaaacagagtttgatcaaattggaaggatgggaaagcttggttactataatttcaagtgacatgcggtgctgggaagcccctgagaaagcagatattttggtatgttgatccctgctataaatggacatttcatatcttttcaaagtggttaaatcaatggcttatatgcaaatatggtacaggtcagtgagttgcttggttcctttggtgataatgaactttctcccgagtgtctagatggtgctcagagattcttgaagccagatgggatttctattccttcatcgtactgaccttttctgtccttagtctatattttcatctttcttggatcaattaaatcccagatatccttttgttcttatatcatttgataacttatgttcctttgcagatacactagctttattgaacctataacagcatcaaaactacacaacgatgtaagtgcctctactatatcaatgataaccgtaagatatttatggagtttgaagtgaattggtttatacagatcaaagcacataaagatattgcacattttgaaactgcatatgttgtcaaactacaccgaatagcaagacttgcaccaacacaatcggtgagcgaccacagtttctgctgtatttatccctcatcaatagtgtatcctatcacattttgtgatatgttatcttttccaaagaactatttcatttgattatcaccattttaaaacatgtaggtttttacttttgatcatccaaatccctcaccaaatgctagtaaccaaaggtataccaagttgaaatttgagataccacaagagacgggatcatgcctcgtgcacggtatgtagctattgagttatacttgtgattatactttgctatgttacaaggtagaaacatctatatatttggcagaatttgactctactcattcccatcattttggcaggatttgctggatattttgatgccgtattgtataaagatgttcatcttggaattgaaccaaacacggctacaccaaacatgtttagctggtacactaaatggcaaaacctgatttttatgtgctggcaataactgttcttgaatagtgccttcaatattatcttttatgtatctcatcaggttcccgatcttcttcccattgagaaagcccatctacgtaccgtcgaagacgcctatagaagtgcacttttggcgatgctgcggtgcaacaaaggtattgtggtttatcgcactgcttttgattatgagatgtttgaataccccttacctgaaatctcatctcccgcattgctacaggtgtggtacgagtgggctgtgacggcaccttctccatcaccaatccataacagcaatggtcgatcatattgggtcggcctataagtaaagccatgaagccagttttgttttgttccgattttctttttagggattctttttgttgtcttttgaaagagaggagagaacagattccattgtatggtttcttgtgtggagtgactctttatcagatatgctgcgtgggagattgattcttcagccttaaagcaagtgataactgacagtggaagaaacgcatcttggatgcacaggaccagagcaacccagtaaaaaacaaatgatatatcttgatgggttgatgtgtaacatcagagcaggtacaataattggcggtagtagttccatgtaggattttgtgatgatctgtaggagaaaggggaagagagagagagtaagctggtgactaatttgttgtcgggctgcacgcgccgctcgaggagactgtggggcctgccttgcgcggcctcttctcctcgccaactcccgcatcagccatgcctttcgctgcgatgttgcctgcctccgtcgctaactgccgccgctgcccttgttgcctgccgtatggccgccgctgtcttccgacgtccgccgcacggtcaccaccgtctttcgcatgagccgtcgctaccccggtcgctcgccgcacaaccaccgccgtcttttgcctccgccgcgcggcctggctgccaccgtcttccgcatcagccacgcgacccggtcgccgctaccctcgtcgcccgtcgtacaactgccgccgtcttccgcctcaattgtgcggcctagccgccgctgccccccatcgcccgccgcacggtcgccgccatcttccgccttagccttgcgacccggctgccgttgcccccgtcgcccgccgcacagccgctgttgttttctgcctccgccatgctgcccggccgtcgccatcttccacctcaattgcacggcctagccgctgccatctcctgtgtccgccgccgctgtctttcgttgtcggtgacaggaatcgagggaataggagaagaagacatgacctgtgaggggatagaagaagaagacatgacctgtgaggggatagaaggagaaagagaatgtgaggtatgagaagatggtgggttccacgaatcaataaaatattcgtgttatagtatttctattatatatacattagctacactgcttattatagatgatatgggtatttttttggagccaacagtaggctatattattgaccttgctctcatctttcatgagctagatttgtttggagttgaattccacaatttccagttttttctttacaatgcttttggtacttgtggtgcatagtcatgagtaagacagaggggctgtttagattgtagataaaataagtaagttggtaatattagcaaaattttggtaggatttcttatgtatttatcaaagttgtcaaaaaaaaaaactaaatgtagacacatcgtcagcaactttgaaaaaaaggtataattgaaaatgacattattatgatataaaaaaaagatagcaaacaaattcagtgactggctaaggcatgcaaaagggtgaatttgtggcacgcaaaaagacacataattaattaagttttaccttctctacaaaaaatagattgatatgattttttaaagatacttttgtatatttttttcaaaaacacactatttaataatttaaaaagtgtgcgtgtgaaaaacgagagagatgatttccagaaatgacggataaaaaaggttcccgtttcttgtgagaattcaattatttactccaaaatttatactactagaaccacatgaaatttcaaaagcctaaaacctttggacatgtcattttggacctaaccacatccttgaccgtcgatttgtaccccaaatcatttaaacgtgatcaaaattataatatacacataaatttaatattaaacttcttgaacatgaaaaaccaatgtatttttttgcctttttgtttcaaa

SEQ ID NO: 58749 - DNA, 2749 bp, Oryza sativa
cttctattaacagatgttagccgattgtaagttagatgacgatattgccaaggattatgtaagatatatgataacttgatgaattatatagacaagattagagtgtcataaagatggaagcactaatctcgagaacacaagtcgtcataacaagttttacctcttgttgaagatcgaaaccgatgcagctcaacccgaaagcaagaactcgtcgaaacaaaactaaagtaaaaaggtggcgatgcgccgaaattgtattgaacgtgtgtgttaaaaattacatagggctcggggtctatttatacccgagaattacaagatatgtccataccggacacgaccactatctctaacaaactctaagataccataagtctttgcggcagatttttggccaaacatatctctaaggaagttacataaaacatcctaattaataaatacaattgccttctcaggactctatccatgtgcggcaatcatcttgaagcacctcaattcaacccaatgtcatacaccaaattatactgtcagaatcggctgcatcggctcacctagtccgactcagacccagccgaccctaatcgtagccgatctggacttcagtcgattcttactctgttctcggatcaatctccgccttcgactctaccttgatctaatctccttttccgatgcggatattaccaaatttggtcgttaacagtagtatacgacaaattatatactacatttttttcaaagaaatgtcgatagaaattggagtaggtggcggtggcggcagttttgcatatggaacccttgggcctggaacccatctcaacaccctctttccccaccggttgccggcgacgtcgccgagggtttctctaccaacaggaacacgtgtacgcgccacagtggcccgcgtccagcgccgctctcctcggccaccaactccccagtcgcctcccgccccaacgaccgagagctgcctctacggcggcagcggcggcgccggcgacgatcagctcagctcaccaaccccgaagcttcctccgcttcttccggtgtctacaaccatgtggatgacgtatgcaaacgcacaaacattttgcattagcagccggaattttttactgttcatcgccgcatcatcggaattttttattgcgacttttcatggacaaagcgggattagttgggagcatttcaatcaatcaatcaatccaaccaagtcctagttaattcgcctcgggatccgccatgtccaccggcgacgacgacaaccacggcgatccgctgcagcagcagccggaggaggaggacggcggcggctatggcgatgtcgccgtcggcggggggttgtttagtgtccccggttacgagtgggcggacgtggcggcgctggggccggacgtggccggccgcgccgtgcgcgtgcggggcgcggcccacgcggtgcgcgccgtggggcggcgcgtcgcgttcctcgtgctgcggcaggggtcgtccaccgtgcagtgcgtcgtgggtggcggcggcggcggcggcggaggaggagacgccggggtggcgcggttcgccgccgggctgagccgggagtcggtggtggacgtcgccggcgtcgtctcgttgccgcgggagcccgtccgcggcaccacgcagcaggtgttcgacgttttgccgctcccacccatcaccaccatcccgatcacctctgcagtctgctcatggctactcttctgcaggaagtggagatccaggtgaagaagctgtactgcatcagcaaagcgactccgaatctccccatcagcgtcgacgacgcggcgcgaagcgaggaagacgtcgtgaaggccaaggctgtaagcttttttttgtcaatccatacactgccattgatcacagcaaacaatcatgtttcgttggagctatcattgtgaacttaattgtttcgttgcatgcacaggccggcgagcagctcgttcatgtcgggcaggacaagcgcttggacttcagagtgatcgacctgcgcacacctgcaaaccaggcgatttttcgtgtccaatgcgaaatcgaaaacgtaagatttgcacattgaacacgggatgatctcacggaattacccagaaacaaatttggcaaaagaattattcaggaaccgaatttgcgaaagaaaaatcttcagaaaccgttggtgtcacaagaatttgtgatctgatgagcgttgttgtcacactcttggacggtgcagatcttcagacaagtgctgctgtcagaaggtttcgttggcatccacacgccgaagctgatcggcgggtccagtgaaggcggcgcggcggtgttcaagctggactacaacggccagccggcctgcctggcgcagtcgcctcagctccacaagcaaatggcaatttgtggtggattcgagcgtgtgttcgaggttggccccgtgttcagggcagaagactccaacacgcaccggcatttgtgtgagttcgttggacttgacatggaaatggcaatcaaaggccactactctgaggtaatttagctccgttgtttgtgaattcagctgtgtaagtgatgtagctgcatgaacagtgacacaattttcttttgcttctcttgtgagaaacaggtttgtgatgttgtggataggctgtttgttgctatgtttgatcatctgaacaagaactgcgccaaggaacttgaggccattaacaggcagtatccgttcaaacctttgaaggtaagcaagtttatggat

SEQ ID NO: 58750 - DNA, 1869 bp, Oryza sativa
gcgagctggttcataccaagtaacctttccatcatctcatctcactcccacatgatggagaactactagcttgctgttgagtgttgaccactggaattgttatattagaaaatcttacttagacctggtttggttcccaacttttttttcaaacttccaacttttttatcacatcaaaacttttctacacacaaacttccaacttttccatcacatcattctaatttcgatcaaattttcaattttggcgtgaactaaacgcacccttactagtacttggtattcttcaactgcaggtatgacactgatttctacatgctctgccggtacccgtcggcggtgaggccattctacaccatgccctgctccgacgacccacgctacagcaactccttcgacgtgttcgtccgaggtaattgacaaaactcatctcaagataccaccgatcttctcctgagactagatcattctctcgcaatttggagggaaaaaaatgaaataagattttctggccatggaatacaggggaggagatcatctcgggagcgcagagggtgcacgtcccggaggtcctggcacgacaggcggaggagcgggggatcgacgtcggcagcatcgccgcctacgtcgacgcgttcaggtacggcgcgccgccgcacggcgggttcggcgtcgggctggagagggtggtgatgctcttctgcggcctcggcaacatcaggaaggcttctctcttcccacgcgaccccaggaggctgaacccctgaaaacaaaaaaacacaaccaactatccaccccaaaaccaactggtttctttcatgtttgtattttgcgtggcaagaattctatctgaacacaaacattcgattcaggaatccattcatctcgaacttgtgtcaaaatgcgtttctatttgactacgctcgcgtggcatcactaacgggagaatacatatagccacattattacaactgaaacatagctacattatttcacgtataaatacatgcacattgttggtgctgctgctctgctcgtgctgaactacttgtctgcggccaagacgcggcgacggtactccccaagggcccaaatagggaagatgtttctatactcggagtagctgatcatgcagtttttgttgaagactccaatgatctcctgttatatggttggggggggggggggtaaaaaatgttatttagcatctcggatgatggtaaataatacatagtgaaaggaaaaggataactcatgtcagcaatttagttttcctcgttcaatatcgagtgaagcaatgcgtgttcccctagcatcaaagatcttttaacaacattgcgcaatgatacttcaggataatttccaagcaactttggatctatggtcgaccggttagataacatgcctagaatagtctaatgattagaaacacgcaactaagggacaaccctcagtcaattagtttagattatattgcttgtcaatacctaaaccctatatttctgtgcttctacttatgcccattggaacttctatgaaatgctctatttttaaaaacagaagtttgaatcaccacaagattattacaggctgaagtaaatgcatcactttcttttctagagcaacgtttcatgtcatgaacccatgggatggattagaacttacttgctggggaaattcaccatcttccgattgtaagttgatcaaaaccttcgctgctcgatgcaaaggaattggatctctctcagcctgcaagaggaaagtactatcacgaataagcatatgtatcattttacgataactgaaaagtcaaccatacacaaaaatatatttaacaaaagacaaacctgccctgcatcgattagggct

SEQ ID NO: 58751 - DNA, 2489 bp, Oryza sativa
atgcccggtacaacaaagtaaggctgcatgcattagtaactcttccttcagccattaaactgctatattagagacactttatagccatgacaaattagacgtcttatgataattgataagcacaaaattataatgtgacggatgccttttcatacataagggtacttgcagattcaattgttaaacaggagtccatttaccacatcccaaattttaattatcaactgaaaagcagatctccaatattctaagtttctaatgcatattaatcagggttgagaagcaaaaaaaatcgtttcggtatcctacagaaatacgaggtgcttaaaaaagggacaagacaaacatcttctctgtccttgttctgaatgcaaaaggagcacttgaatataggcatacactatatgatgcttactgaactgctgctccaaagcttcattttttttatatattattcatgttacatatgaaatgttaaaatgacatgagaggtttacaatcacccttaaatatgaagactgattaaaacttaccatgtatgacatcaaacaattgacagaatcatacagtctattaacttccactgcttcgccaacaatatctggagaaatcttcgatagcaataatgccgcctaataataaaacaaaacgagaacagttcaaactattacaatgtcaagaataccagcagacaattgctatggaacagactaaactttacagataagatcataagagaatctacaatggttcttaataactatttctcatgcataccagagagtttatatatgctagaagagtagaagaacaatattttctcaagcttgaaagataaaatttaccttaagtccttctgcagtgcatctgatataggccaccatgatcagcagtagaaaagggccatgcacctttagatatgtggcggtaccactgactaagatctccagggcagtcatcgataacctttcaggataaaagcacaggtaagtaatgagatggcttgaaatgttgattagtataatcgtataagggaacatgcatgaggcatgcacctgcgttttctttatgtagccatgtgctagtttaagagtaggaccaaattcttcaatgaggccagtagccactatagcttgaactgtgaaagctgtgtcccacagctggcttccattataaccctacagcggtcacaaaaagaatctatagttaaagtaaacagaacacacttgatgcaatgcttctctaaaattatgctatgttaaaaacttcattggcagaaattatgccaaaacaattttccaatggcatcaatagacagtaaatcacacttgttcaataggtgtcttgtgccaaagttaccaactttcttgttggaagttagagtaaagaaaaaaggtgacctgcattttcatgccatcttctgcaatccataggtaatcgtggactcttggaatgtggagtttgaatgcctctgagtttggatcttcaatccagcaagcaagcatatttaatacctgaatagagagaatagatttgaatgacaagaacacaatgtattgcctgacatgactgagcagtttaattcatcaggtattaaagcatcaagagtagttacatcttatagctacgggaggaagaaacaaaaagaaactccataatctgaagtttaatgaaccattcaaaaataaattgcttctttgctacctatatatgtcttcacaggactataataggcttattttggcagaaatgttcatgttttaaaacaaaagaaacatagaaggggaagaagaatgacagtgaacttgccgcttgagagaaggtagtgcaactaaaacatttttaatctatataggccgcttggtggccacccaaaaaaagggtggtgcgaggagccatcgtcgctacaataaaatagtaaaccaagataaaaaaaaaatgggtgaaaatttaaaggggaatactgtaaaacacagtaattatgacagtttccctctaattgcagctgcacatgtattccattcaaagttgaaaattgtaagtgtgtacccatataatggaatggtttcccttttatgcctgcagcaagaaaagaaagaacgacccactttcttttgtaatgaaccaataagcaatcatagtcttcaaattaccttgtttactggaccaatgcaaatatatcgggtgttctcatcttcataatgaatatgctgcatgacagtgtccaaagctttctccctcaatttgttcccaggccaacgcaacatagctggttcaacaaatttgtggagagtggcccataatacatcctgcacgaatggatgtggatagtacagatcttcctgcaatacaatacccaaaaaaaaaaactttcagaaagaaaaatccagatcttattaaacacaaagtgataaaagcaagatacataggataaattatgtaaaattttgggcttactacaataacttttcaagccatgcacgataaca

SEQ ID NO: 58752 - DNA, 2764 bp, Oryza sativa
aagaaattccatagttcaaattttagtgagtaaccaaattggaaacgacttgtggtgagttagaagagtaccaagcctggcataaggaacatgggaccaccataatccccaggccagtgtccatcatgtgcttgaaaagtagaataacgagcaattgccctttttagagaggataatacagcttcgcctgtaacagcttcatgctcctctagcttgatagctggaatgtccagcttaagaggatttgctttagcaaactgcagaatatacaaaataaatgcttaaatatcagggatgacatgtgcattgactagtgaaaaagacactaatttcatggctaatacatagaattcagggcaagccaaacagaagtaaataaatgaaaaatattcagcacaaaattgcacgtttaagatattaccggacagtctataaaatcgtgacgtcagaaagttacctccaagtataatcacatttgtctcacttttttactgtttgcacatgtaattggtattagacattttgaagtaaaaagtacctgagttctctgcatcctacagtcctcataagaggctaaaaacatgctaacccagtttgatttgcccaccggccactgcacattaaaagctactttgagttaaggcatatccctatccagccagctcttcccattgccgtccccacaagaacccaaatttttaggtaatgaactggatggaggccccccacatggtacttcaccagatccccaaatttaattccaagctactcggtgcacaagcaacccggaatcaccaaacaatttggatgcagagctctcagggaacactgaaacacagacaagacaatgataataaaaaaacaagaattcactagtgcagggcatcctactactgctaattaacatggatagcgaaacatctctatattgtcaatgggcaactctgcgccgcaacctcgaatcgtatggggcgtatggctggaattgaatgcagcatccacatcaaaatccaccactggaacatgcaaacggatgaggcatagcgaaaagggaagagatcgatcgccggcttgcatcgcatccaccacgaattctagcacgaataaggaaaaaagaaggcgcgtgcaagttgcgagagcccatctccgctcacccacccatccacccgatgcgcattaaaccgaaatacactgtatctgaaacagcaatcacatcatcaccgcattgaacgcttccagcgacagcgtcgcgctcgatcggtgacgccgcctcccgcgagagaacaccgcgcgcagatgtgcgcctcgccgcctccggccacgagcaattcagacgagctaagcaaagggggtagtatatagtacagtagtaggagcgagagggtggcggcgcggggagaggcattttacctgcatgcgcatgaggaggtcggagctgtgcttgagctcgtggcggcgggcggcgaaaccgcggcgggcggcctcgacggcggcgagctcgtcggggtcgcccgcggcggggtcgaactcccagacctggcgccccacgtggccgttcttcgtgcgcagccacgggtcccccccgccctccgccaccctcagccgccacatcctccccccccccctccccctcctcgccgccgatcaaccaaccaaccaaatcgacggcgtcagctgcggcggcggcggcgagagagcgaatcgatcgggagcgcggggcggcgcacgagcacgagataccgccgcgttataatacggaggagcggcacaggctggaactagtggtgatctggattctggcctgctgggttttttttttggctcggcttgggccttggggcccactctttctttgcggttgtgtggtggtgatgtggcactgacagattgggcccacaaatgccacgccggctgtatgaaaaggaggtctcgtgggctgtgtccggatccggaatgtctgtttttcttttcaaaaaataatactattacttccatcccatattacttatttatcgctttgattttttatttataatatctgatcattcgtcttattaaaaaatttagaattattatttattttgtttgtgacttgtttggttatcaaatgtacttcaagtataacttatcttttttatatttacactaatttttcaaataaaacgaatggtcaaacattttaagcaaaaagtcaaagcgacaagtaatatgggacgtgaatagtactatatatagtctcttcgtttttaaatatacgacaatgttaattttactcaaaaattttaagcaagatcaaatataagttcatgcttaaaacctttaataaatcaagtcgcataatacgtaatttttttaataaatattaatggttaaacgtatccaaaaagttaatagcgtcgtatattaaaaatagaggttgtattatctcaagtggttggtgcgtactatctctattctaaatatagtaacctatattagacacatcataatacaacgaatttatagtatcttaaaccctgggtttgaaaagctcaaatgtttttcacatatttcaaatgaaatttgtatgaacagggaaagatatttcatgctcgatagatttcattatacaccactcaatttgcaaaccttttcaaatttgaaattcaatgtgcacgcctttttaaattttgccattgaggatgtgaattctttcattccgtgccgctttatccatttgacgtctgtccactaccactgcatgataccatgacgctaggcaccc

SEQ ID NO: 58753 - DNA, 4338 bp, Oryza sativa
tgccatcaaagaatggttgctgcttttcattttttatgtacaatttatactggtttacttgtacatggagtagatggatataagaaagcacagggattaggttatgccatggggatggcatttgaaaaaaaaaattactcgcatataaaatgcgcatatagaagtagtatgtgtacatgaagtttgaaacaatacttactgaatcttttatcatgtaattttgttattgatcagtccggtaatgtgcaagttaccatgagtaatttcttacatgaagcttgttaatttgaagtttggcgtcactcgaattacaaaacaaaacttccagattggtatttactgatatttttgcttaaacacaatttgcgtgcacagctgcagagaacaaaaatgctgctgaagcatcaaatcaatgatctttacatgacctttgataataatctttacatgacctttgattcaggaagggaagacaaattgagagcaagaggtatggtaggactggagaggagagagccaattgtttgtcatgtacatatgattcttttctcggtaattaactccgaaagaaattatcaattaataaaagccctaaagctaccgattctctcttttttttgaaatattatttttttttgctcctcgttaggagctcctcgattgggtgagctgtggagcctttccttttctctctcttcgggttccccatcggttctgccggtcacgcgctgcatgtgcgtcacgttttgcctccttggagcaaatgacgcgtgctgatatttatgcaaaaaaatcctcgtgtttgaacggaatagcgtgcactgcctcccaccgactaacatcacgttccattttatacgaaacaaccctcgtattttatagaaatacaacacgaagaagatagagttctactcttagggggtagcgatgtaaacataaaaaacaagaggttttttccaaaaaaaaacatatcatacctatcccctcccctcccagctcccacccccaaactctatcctcacatcccctccccacgacgcttcgccgccgcccctcccccttgctctctcccctatcccgccgccggccggcaatggggcatgcggcggcggctgacccagccgcgagcgccagccgtccccatcaggaagccgcggcgggcgaacagggcaagcagggagccggggagcaagaaatcgtcagcgtggaggagcttgcggaactcgacagcggcgaccacaacaggagcttggcggcgatgccggtttcgaccgcgagttcgccacccctccccacctcacgcagatcgaaagacgtggagctccaccacccctcctcgcgcatcgccgcccggccgcctcccaactcctcccgtgctgcgccgcggccctctccccgcgcgccgccgcccggccgcctcccacctcctccccgctgtgctacgccgctaccccctccctcgcgtgttgtcgccgtccttccgcgcgccgcctcccacctcctctccattgtgctgcgccgccgcccccttcctgtgcgccgtcaccactgcaggttcgtatgaaggccgagaaggagaaagagaaggaggattttccggtgatggcgatggtggcagggctgccgatgaggatggggccgaggggtagtacgaggcgtgggacctctccgacaatgaggcggtgctgggcagatcttgggggtggaactccgcggggaggcattaagtaggtcagcggcgcggaggagctctctgccctcgagtcggcgcggggacggtacagactttgttggcggcggcgaggaggagcaaggcggagctgccgccgtgcgggcggcattcggtggcccgtgcgacccccccccttccccaagtgacggcaacgggggtcctccggcggatccgtcgccacacgaccggccttcggcagcggcggatccggacgtgcgcgccctatgcatatgttagcgtgcgcggcgtggcgccgcgcttatacttctagtggatttgatttgcataacaatacaagtcctcggactgtccagctgaaattagccatgaagatataaacatgcactttaagtttagttcacaacccaacagcaaaaatgaaataataataataaagctgaaactacgacttacatgcaaaaaccactacatagaacggaatcatatgcaaaacctgctttcttgtatagagcttgcaatcgtaatcaataaacaaatatggttaaattcaatcaagtggtcttcttctttttctttgacttgagcataacaagacccatgaacacgcttaagaaagataggagaatcacgccagcaagcactgggatcaaaatagcatactcttgaggcagaaagtacttgtggacgaagtgatcactgtcaacaaatggctatattgaaaaaaagaggaacagcttatcatccagaaataaaatcatagatgttatatttgaaatgaaaaacgcctagatgttactaaccaggatgatgacccagaaagtatagtatgtaaagatggatagacttgtcaaggttaaaataaagcctactgccttgtcccccaattccatttgtgcagatattgtacaaatctaaacttgattcagatgataaaatctacttcctacatgcacacaaaaacagtctgcattagaaagcacaccaaatatcgaattgcatagaagtaaaatctcatgaaagttagtcctatttggggaaataaaacaagatataataaacccaaagtatttatacagcacaaaggtggcagaggtggcaacgagatggagacggagagacagtgacaggacctcagcagctgcagcgtcgtccctcacacagtggccttaataggaatacaacagtttgcatgttagttttaaccattcctcataaaataaattatctgaggaagataataagataaaattcagaaacaatattcaggtaagtaagtcagtgtgttatcataaaccctataaatcagagtgttcagagccacatggtattctgaccagttcccaggcattttcctagacaagtttatactcccaaaactttgctagtgaattaccacatttatagagtgcaatgaacttacccatgtgcatatctcaaaaatcgaatgcagtaagcacaataaagaatgtaattaaatatgataaaataaaatccatttctattagggtaatgttataaaattcatgacccacataattttagtagccgttccatggtaaaataaataagagcattaggattccagtggcagttgtaaataaaatccatttctattagggtactgttataaaattcatgacccacataattttagtggcagttccatggtaaaataaataagagcattaggattccagtggcagttgtagaagccccatcactgcttgtactcataattcttctgaagcctagcttcctattgctttgcactaaggtaagaatactctccttatcacgctttctccagaccttgactatagtaatgtgcagcacagcagtgcagataattttagaaaaagattatcctggaagcaataaacacaactattccccaagaaaacctgctgtacatgctacataatttcttgcctcaatcaccgtgtatgtgagttgttagattcaagaattttgggtcattggatttgatgaatgaggtatgtaggagtgaagttggtgaattatagggtagataatcaaggttagcagtgacctgatagagaaataaattaaaatgataaaatttgtcaatagcaatgctatgtcattgttacattttaaaaaaccctcagtgaaattagagccatttcttttcccattttagacggcacaagagaatgcattctgcaggtagtagctgaatatatatcatgttataaaatcccactcaatatctctagcatcatctcacaattaaaggaaaggagtaatgtaagatactaagattgcttaacaatttactcagatttattatgtattgtcaattctgaatcgaaccaaataaaagaagggataatttgcttgctttcgttcaaagtgcagaaaacaaccaaataaaagaaagccaatccaatcacctacttgtttaccgctgatccagatggggatcctgctcccgtcgccgatggcgatgctgctgttccggttggaggggagcggtccgcagtggccgtgaatagaggcgcgaccagtgagatcgcaagcgaagatggtgaggggaccgcgggatccggtgctagatgctccgagacgaccagggttggggttagggttagggtttggagagcgagagcgaggaagggggcggg

SEQ ID NO: 58754 - DNA, 1687 bp, Oryza sativa
tcatattaatttttaaattttaggtatatgttaattttgactaatatttttctcataaataaatagacaataaatcattattttatatttctcctataaaatgtgaatagtgaattatataatttgaaaattatattataagtgtatataatttaatgtttgacttatctctactattataaaaattgaagatgtttttgccggtattttggtacatcatctgtgtatgagtcagtttttaagtttgtttgcttttggaaatacatattcgtatttaagtcggttttcaagatcgttcacttttggtaatccataaggaattatgtaagaaatttgtttaaaaaactcgcatgctaacttgagatgatctactcctaactgcatcatgattttctaaaaaaatatatatccaagcgaaatcccacagtgaattttatcttaactaaaccatataacaataatgagattaaaatatacttcacccgttacaacgcacgggcattttttttctagtagataatcatgcaactgtaaaacgaaactctctcatgccagcaatgaccacgcgttccttctcccttgaaagccgtggaataccaagcgatagttcgaactgaaacattcattcgctatttgctgaaacattgtttttatataaggtgaaacaacacccgatttaaacgagtgaaacattttcgatctacttagtgaaacaattccgatatatctggtggaacatcgtgcaatatttaaaaataattcaataataagctaaaattttttttcgtcggaatatatccatgtgtggtcttgttttgaagatttaattgcaacgaatttaatggtgtaatcagatcataatttggataagtactttaagagataaatcagtttaaagtaattttatacgtaaatcgagcgctgacgtcagcacctgattttaccatctcccgattgggcgcccgacccagagtcatctccctaagaaaataccgtctcccccaaaaaaaaaaaagttctccaagaaaaaaaaaacctaacccatcataagaaaccggtaccggaaaaaatcgactcatcataatttatgttccattcatgttacaaagcacggacacctaactcgtcatttagaaagcgatgtagagatgcatcgtactaattaagttgccatgataaagaaaacggtccattaactagaaatagttgcacaaaatggatacaatttactcccagtatttcataaactacctttaaatatatatttatctcgagacaaaacgctgaattatttgtcagagaactattctggtttccatcaatcaatgtcataataacccccaaaacaatttttgccacatgggctgcgaatgtaacggagtacttaggcaattgacaggcctacatgcttttagggcatgtttagttggtgaaataaaaacttttggatgttacattggacgtgtttgatcgaatgttggaaggggttttcggacacgaatgaaaaaactaatttcataactcgcctagaaaccgcgagacgaatcttttgagcctaattagtctgtcattagcatatatgggttactgtagcacttatggctaatcatggactaattaggcttaaaaaattcgtctcgcgattttacatgcaaactgtgcaattaatttttctttttatcaatat

SEQ ID NO: 58755 - DNA, 990 bp, Oryza sativa
aaccgcactttctggactggacactacgaaacttcatttttttattgaaatttgttgacaggtgtacaaaagtaacatagtatgtttgaaaggttgtactttcttaaatttttatgagatggttatcgagtgctagtttacagagtagtgcagtagtacttttctttttccacttccatgttcttgagcacaaaaccttttttttcagtttgaaaaaagtggatgttgatccacatatactggctacttggttcagctgactgcatttttcattgtttcagatattaagaaatgctttctccatgctattggaaacagcagaatatctacttaatctaagctttttgtttcaggttgcagcttctatgcaaaaggatgtggatgcacatgttccaagctacccaaatcttccctccaagttgatatgtcttcttcacggtgtcaatttgcatgtacctaaagctacttgccttccattttctctttgctttaagaactagcaatcagcaatactaaaatcattatctttacctatcaggcagacccagatactgatgaagtttatgcacagatgactcttcaaccagtgaatacagtgagcaaacaaaaaattgtggtttccgcaaaagttcctagtctgttcaaatgcactcatcaattgcttttatcagtatggaaaagaggcgttgcaaatatcagagcttgcactaaaacaagcaaggccacaaatggaattcttctgtaagacactcaccgcaagtgatacaagtacacatggaggattctctgtgcctcgccgtgccgcagagaagatattccctcccctggtatgtaggcttcatatcttctgattttctgcaacaaaagatctgttcttagcaccattgtaattttgccactctgcactgtaggacttctctatgcaacctccagctcaagaactgcaagctagagatatacatgacaatgtgtggacatttcgtcatatat

SEQ ID NO: 58756 - DNA, 2820 bp, Oryza sativa
cttctattggagaaaaaaaaatactagtagaatattgttttttttaacagtggcagggtttagttcccttcaaacttcaaaaaattccgtcacattaaatgtttgacacatatatggagcattaaatatggacgaaaaaaaatcaattgcacagtttacatgtaaattgggagacgaatcttttgagcctaattacgccatgatttgataatgtgatgctacagtaaacatttgctaatgacaaattaattaggcttaataaatttgtctcgcagtttacaggtggaatctgtaacttgttttgttattagtctacatttaatacttcaaatgtgtgtccatatatttaaaaagaattggcacacgaactaaacatacggctagtgtaaaaaaaattgtttccttgcgaagagtaataacttttgtgtgggcatgcaaatatgcaatcggccgtttgggaaaatgtcgggaagatatacgttggtcctccgtgctctccctcttatcataaaaccatgaatatataggtggaaatagtatgacagtcttgagttagcatatatatttggtagagtttcaaatctctgtgtttggcagagttttaatgtctgaaatagcttagttgtggagctgacaaaaagcaatctcacccttcttatgtttttccaatagtggatccttctaaattgctcttaaaaattaagaatctagtattatttaattcgggcgactgtatactaaacagatatccgaaactgataatagtattaagtatctagggaagtccatcatactacaactactccctccgttccaaaatataagtattttttatcctgacatatggtctccgagatgctactttgatcaacaatatctataaaagtaagatattttaaataaaaaagttgcatattagaatagtttgttcaataataaatctagtaacatcaattttacatgattgattttttttccctattaatggttaaaataaaaaatgtttgacttgttacttttctaaaaatgtttatattttagaacggaggaattactatgttactatctccatttgaaaaagaatcaatttctaaggataaatttggatctagaatcatacctaaagttgattctttgaatgaggatgtaccactcggcaaagactttttttttccgaaagaccctaggcaaagactcaacaagacgagtggacgatgttagtcacgatcgagtagctaggatatatggtacgattagttgggatgttcaaggaaatcccgcgatttgtccagctaattataaatcgatcctggagcatgtcttctgtaagctagcttgttcgatcgacgtcctcatcatcaaacgccatttgtgtgttttgtactactagtacgtgtgtgttgcgtccacttgacacattggtgataatttgctaatcattttgtcagctctgcatcgtggaaacacaatgctcactactagtagtatactagcatgtagcgtgctcgtccgttcatcctagtattttcataaaaataaacgtttcagagcaggtacaatagtaggctataaaccagctgtaaatataatttaagaagataaataagaagagaaaagagcagcgggctatatatttatagccagctgtagcacagatttcaagacgcagtgtgtgtatgacaggtgggaccaggtattaatagtgtagtatgtaactattgtatggataagctattagattggttatagataaattaaagctagtagttggcttggataagctattagattggttatagataaattaaagctagtagttggctatactattaaacttgctcttagagtatatccatacaaacatgccaaacttaccgtcttggcactaacatatttatatggtctgctcatggtgtgttttgtagtacacgctccttaatttctactccctcgtctttcgcacgtacgttttccgaacatctaagcattgtatattaaaaaaggttatatagaaattatttttagaaaaacatattaaaccggccatttttcaaggtttttatagctaatacttagttgatcgtgtgctaatgagtcaccctgtttgcatgcaccctcaatagcctcatggcatgatcataccaatgcacagaatttaaacgatttttgcgagagttttagccatttagtcctataagaaacattctaaaattctgttgtttcaaaggagaaatcagttgcttaacctttaaaaaaagagcgggtacaataagctgatactataagtataaatgaggcgtacaagttatcacatcatacttgtatttatgtggaggagagagaagaaaaacgagctctaaatttatagtcaaccgtacagcacaaacttcaatatactgtgtgagagagataagtgtgttagatattaatgatacaatatgtctatatctatatattacttagtattccatgagtaaactattaggttggtcatatataatgccttaattttttaagctagtagttattatattattaaacttgttctatgattttttttatagtatgttaagagggttgggattgtgattagcaaaatgagtgcagggttacgataaaatattaaaatgagtgagagggagatgataatggaaggcagaagaaatcgactaacctctaatatccaaaagagaatcatgttgataggtgatttttttttctcttaatccattatccaaactggctcaaacaccacctaagatggtatttgaatcttctgaagatggagatgaagatgaatattaagttttttacgtaaaa

SEQ ID NO: 58757 - DNA, 3915 bp, Oryza sativa
caagactcatgtccaagcccaaccctgacccatctgccttacgacagtgtacggcttcgactgcgaggggtcgatccgacatgggcagggagggagggcagcaaggggttgcgatgcgtcgtcgtgctcgtcgttgccgacgcccgcggcacggcgacacgtccggcggtcgccgtgcgtcgtgccggccggcgaggggacctttttattactatatcccctttccagcatggactactactaccactctttttcactcctctagctgctgctctgctcagaggctcgtgagctattcgtagctaggctttcgccagccggcggcgaggagttggatgacactgacgcacgtactgtcgctgcacagcggttagagcaagtttaagagcacccgcaatggtaaagtaagttgctatctataaaacatgtacatctcagcaatagactcaattaatagtaaaccaccttaatagtatgtctacattggtatctataattctctcatgcattgcctcgtttttctctatagactatctctaagttagtagatagctttgctctctctcttcatttaataccttccaagtagaaaaatatgctgacatggatctcttgtagagagcctatagataaccattgtgggtgccctaatagtatagctaattattaattccaatttatctatagccaatctaatagtttattcatataatagttatatactacactattaatatatggtcccatctgttatacacactgcatcttggagtccatgctatagctggctacaaatctgtagcccgctactcttctctctccttattatctacttaaaatatgtttataagccaggcttatagcttacgcaattgtacctgttcttaacggtggccggcgcggtgacgcatgcagtactagtgcagagaggtggtcggattccgaggagctctcctgttctgttattgtcctttcaaacttctaaaaattttatggaacattaaatatagataaatgttgtatttagattgatccaaagtttaaaatttggttgaaattggagacgatgtgactgaaaagttgtgtgtatgaaaggtttgatggaatggaaagttggaagtctagaaaaaaaaactttggaactaaacacacccaaaataactaattatgagacaaatcttttaagctaaattacgctatgatttaacaatatgatgctacagtaaacatttgttaatgatggaataattagacttaataaatttgtctcacaatttacagacggaatttgtaatttattttattattagtctatatttaatactatatttttatatattgtccatatacttgaaaatattttggtcagacaactaaaccgtactacatcggttgtgtagttggcacgcttcttcatcagtgtggcctcggtgcccgcgccgccgcgtgcgccgctctttcatcggtgcccgagctcaacacacacacacacacacagccctgccctgccttctctcatgcgagacccctccaccgaatgtagtttcggcttggctagctccagagaaaaccatagaaaaaaattccattttggttatttgagacacaggattataaaaacgtaaaagtagaataaaaaatacatgaatgaatataagtagaaagtcatgtgtagaatagagtatcgaaaaatggtcgttgtttcaaaataaatcaacttttgtgttgattgagagatacgtaaaacgagatgagccattaacgtatgattaattaagtattaactatttttaaacttcaaaaatggattaatatgattttttaaagcaactttcctatagaatttttttttaaaaaaacacaccgtttaatacttcggaaagcgtgcgtgtggaatacgaaacaaactcaaagaacacaccgttttatcatatcgtaggttgtttaattttggactgaaggagtatgcattagatggagcatatgaaaaacataatgaagggccccctttaaaatgtaagattgtcaaaaacacgagaatagaaaaaacatagaaatatgatgttatgtccgttggatttctaagagatttgaaaacacaagaaagtttcaaaactaccgtttgatagccatacaggaaaaacgtaggaattcaagacacggaaagaagaaaatgtgaggtaagacctcaatgatatttcttgaattttctcaaaacaatggtacttccttcattttattctctccatatcaatgaggggtacagtgatattttaatcacctacctaatttgtttttaactagctataactatgtcttgttccatagtaagattaatacgacctcatacctcatactctttatttcattctatgtggtctccctagtttcatgtgtttctttctatacaagttatccaaaggcataattttctaaattcttatgttttgggttcctataaggttctatagcttacaacatttattcatgtatttttcttgttcccgcatttcaaaggaggccatagactcgtgaagtgagcgtaactcaactggttaggttccttgtggtggaaccacccggttttaaatcctaaatttgatacgagtgctcgcatttacggctaattattatttcagtggtagacgatgtacccgtgaatagcaaggcgccagtagtgacttcgtcaatctcaagatatacccgtccagttcggaggtgctcataggggtagggtcaacagcgaagctagtggtgactttgtcaatctctagatatgccggttcagtcttccggaagtgcttataggggtagggctaacagcgagacgctagtggtgacttcgtcaatctctagatatgccggtccagttttccggaggtgctcgtagagtgtgcgtatgtacgtttatagggatgagtgtacgtgtgttgtgagcgcctgcgtttatacatgtttctaagaaaagaggccatagactcaaagcccgaattaaactggctccaactaatttagaaaaatcggtttcactttagtaaacatgattaattattagagtggtagattagcagtaattgtactaccatacacgtcacatgagtacatgatggtgctccgtacttgtatatgtaagcacccatacttctacttgaaacctcgacagcgacaagtgccaagcactagctagagaaccgaagaaaagacatggcaaggtcaaatggccacgtagcaactcatcaccaaaaagatagtactactacaaattatttttcttttttttaaaaaaaaactcaacagcaagaagccaagatacccggtacttgtagtggtacaacatgtgtaggcaggtcaggtcaggtcatgtggtcaaccagccaatggaaagcaaccgagagatgccttccatggattaatgtgcatggtagtagcaaatggtggccagcatatcgttcgatttttcagacacgggacaaaaatcgtagggactcaatcttttcgctttatacttatccgttaaaatttaaattttcaatcttaatttaaagctgattttaatttttttttattttttagcattttacttttagatttctagtaacacgtatataaaagttttatttaccaattacttctcgtttgtgaatatacgtttggcttattccacgaataaaccaaacaatgagaccggtactcgattcaccttttaaacctctcccttgtcttatgaagtataatgaactaaaaggacaagtaatttactcctttcatcttaaaaatacaaaatttgaaaataaatttggacagtgatagaaaagttagaagtttgaagaaaaagtttggaagtaacacaaaggctaattcacctccaggtggagttaccgtccgtactgaaaacattcatacggcagacatatt

SEQ ID NO: 58758 - DNA, 2321 bp, Oryza sativa
agtcagcaatgtagcaggtgccgaatcgaattccagcttatggaggacttgatcttgatgtcttcttgttgatccatgatgtgagcaatggttgtatccatagtagccatgttcacatcattctccccttcttcactgaaaaccgtcctcggtttttccatatggtgctcttcacacagtccattcaaaataacctgtttcatcaaatcaaaacaaggcaaactcgaaataattttgttagcaataacatttctctctagcttgcatgttttatccacatgtataggagattctaaatctgaacatatgtaaactctatgcaccaaatatagtcctctatcatcagattcgccaaatatatgaaaaatagcactagttggacaaggcaaatcaaacttagcaaataatttcttcttcaaattattgagctcacaaaaatcatcaaactgaacatagcccaaaatatttaaagaagatagcaattcacgttcctgtacttcattagcaatgtgaacaacatgcttaaaattggcacacaaagaaacactagaaatagcatgttcattcactagttgtgttagggatataagtgaagcattatcacacaactcttctttatcacaaggaatagtaagtaaatcaacttgtgacaaaggcaaatcagaagtagtttccaccaaaatttgttctagattagcatggatagtggacaaatgtgactcattagaagcacactcaccttgagtaatatcagcaccatttaatttaccttttatgccctcttcagataatgtaggtgcatcagtcttctcttcttccttcgtgagtgatggagatgacatctcgagcatattgctcttctcctcatggtgaatgttctgagctccctgcaaaatgtcagtaataggaggcacaagcatagattgtttctcccttgggtttattaaaatattgctctcaacactgcaagcaagcatgaacaagttgcctatatgattatatgtcacgttaataagcccagcctgaatattggaattaagccctctgaaaaatctagtcattgtgttctcattagattcttgtaaatcactataagtaatacaaattttaaaatcatgaaagtactccctaacagttttgtcaccttgttttagatgttcaaatttctcaaggaaagcacgtctatagtatgaaaacacaaatatttttctcatcagtattttgcattcatcccaagtttcaagcttatttcccacagtatgccaccaaaaagatgcagaaccggtacacttattactagcagccttaatcatttgagcattagaaaaatcatactcatcaaattgtttttctactgctagctcccaattaacataagcggcggaatcatacttaccatcaaaaccaggcaatttagattctacccttgcaagatcactatcatgtacctcatatgtgatgcgtgaagaagtcgctatatctcgttgatggtgaagatgttgacgttgagcatgaccatctcgtttccccatgcgcaatcctgccatggttagtagcaaataagaaacatacacaaaaatatgcgcgttcctattaactactaggtagtggcagctcaaaaatcacacacactcaagcttttaaccaagctcttacaagatcttaccaatgcaagcggaatggtgacatacaccgactcaaccaagcaccccaatggaggttggatgtatcgatgccttggcaaatacttgctgtacggctgcaatcaaatctgtggagctctaggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaaacataacagtattttctcttttctttctttcttctttcttcttttcttttttttctttccttttcttttctgtttttttggtgcatcttttttttcttttcttttttttatgcacctttctgccttttttttctctcacttttttcttgattttttttaacaaaaactgactcaaggaccttaatgtaaggttacagggactcaaacgtaaatataaaatttatagggactcaaatgtaaaagttcaaaccaaaattaaaaattatacaaaaatggaatgctgaatttatactgattctgtttttctgaacggatcttgaaacggacaccaaacaaaaat

SEQ ID NO: 58759 - DNA, 1267 bp, Oryza sativa
  unsure (1)..(1267): unsure at all n locations
atcccccatccgttgaaaagaggacttggagggctttccatcaagtactcatggacccaaaacggagctcgtatgaaaatttggcggccgtttgaagtcagcaatgtagcaggtggccgaatcgaattccagcttttggaggacttgatcttgatgtcttcttgttgatccatgatgtgagcaatggttgtatccatagtagccatggtcacatcatatacggagggagttaatctacacagagttgctaaaccagaaatataattatgacagcttaggttgtttgactacgaccttattgttaagcttttgtttatacttatgtgaatcgcttatcaacagtttttaaataacttatgagtagaaattttatactgtatactactccctccatttcaaattgatctacatatatatttttaaggttattcctaaacgatatacatatttgtgttcattcattaagtctattcgttatctgtgcttggagtaaatggacattgatgcatgcatccatgcacacaagtatttataacccatatgcaatatctttatttgctattggctaggaaataatggggatggtgcatacattaagtctattcgttatctgtgcattggagtaaatagacattgatgcatgtatctatgcacacaagtatttataacccacatgcaatatatttatttgctatttgctaggaaataatgagtatggtgcatacatcgagtttgttgctagagtaaatatagtaggagagagttattattttttcttggtcttgatgtacttatgaaatatgtaaatcaatttggaatgcaggaaatatatctttagcgattcaaaagtttttaaataaactacaatgaaaacctataaaaccaattccaaaattaaattttacaattcaaaagttaatttataaatataagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58760 - DNA, 1263 bp, Oryza sativa
acgggggtttgggcgtaggtcggggttggggaggggcggcggcgcgtgagagcgagagagagggggcggagaagagggcgcggtggagacgatcctcagcgttggattttaagcagagatgatcctgaccgttctacgaggaataaaagaatgagtgatgagtaaaatcatttgttgaattataaggtatatagatagaagaagaagaggatgtggatgctcaccaggatcccctcctgtgctcgccagatggagaccggcgcccctctcctgttcagccacgagatggcgcaaccgtgcaaggagcggaggagacgagtcaggggatttttcttttacgcaaagggaagagggaagatacttgagtgcctcacctttatctcaaatttagtgatgttatccattttatttatcatgactgatggtggttcacagagaaaaaacgcaacaaatttggttgaggatttatatcagtgccgctccatctaccaccaccgctctttctccatgaggcaccatcgttcctcctgctccatctaccaccactgctctttcttcatgaggcaccatcgttcctcctcttcactttcacatgtgcaattgcactctctagtcactgatttgtctttccgcctcccgtattttcatgcacgctattgtcatggtcgtcgttgaggccagggtatcggccttgcaaggactcaggacgataggagctgacctgaccgagagcgaatacgctagatctaggctcctccttgttggatctggcggttcctagctattagagggaaaaagaaaaaggagagagagtgtgtgtatggagtggttgtagagtcactggatttggaggtgaagcaacggtgattccaccggacttgaagatggatagaatggggttgtctaaattgaaacaaaaatataaagttagctattttataaatgaaaataatgattaaagaatgatataatatgaaaatttttaaaaatacgttgtacaaaatgaatttactatttttgtccattagccgtagtctcatgctatcctaagtcactacagatttatcgttactatatggtatggttgggcggtctacttaactattactaataatctcatgatatgttaaaacataacaatacagagttctacttaaaaaaagataaaaaaaataataccctcgattttgctcaataataaagtattcgattgtggtcccttttctcactgccgaataactcatgactatctcttatatgtat

SEQ ID NO: 58761 - DNA, 2542 bp, Oryza sativa
  unsure (1)..(2542): unsure at all n locations
atgtgtggtctagtttaaagatttaattgcaactaattcaatggtacaatcaaattttaatcagataagcaatttaagagaaaatatagtttatagtttattaaagaggtggctatatgtgtacctagaagagaggagagagaagctattggcttaacactagaggctaaggggacaacggaagggtgtgagggtgcccgatatatttttacccgaatcgggcgtccggcccagagcaatcgcgacagacatgtgtcatataaaatcagatctcctaccgtagatgccaaccacgggtgtgtttaattcacgccaaaattaaaagtttggttgaaattggaacgatgtgacggaaaaattggatgtttgtgtgtgtatgaaagtttggatgtgatggaaaagttggaagtttgaaaaaaaaatttgcaactaaacacggcccacgtgactttctttagacagttcagagttccggatcgtcaggttcaacaagatttgcagcattgaaattgaaattcaggggatttaacattttaacactttttaatagatcagtttaatccctctcacaatcgcatctctcacaaaacggcaaatctattgacactacccatccagagtggcaaaacattaattattccaaaattcagtggtagaagcaacaagttcaggttctaatatcttgattctctttagatagataaagaaaatggtcatattgatgtatgaagaaatattctttggttcgggttcagttgctagtaaaaaaatacaaaaggttaagcagaaaataaaatgaagaaaatcaacgggttaaaaaaaatttaggagaaggttaaaaaaaatgaagaaacattaagggtgtgtttggataatgggataagagtagtgggattgagatagggaaatggatgaaggctaggatgaaatgagggagggataatggatggctaggatttgaagaaactctttggtgggtggaaaattattttcctaatcattagctaaacatgacctaaggagtaatagcgactagcgaccaccatgggtttacgtcagtgtagagtgattcgatcaacttcaaatccatagtaacatcctgctctttaaggtcggttttagtgtagcttgaggggacatttgcgtccaaacaaaagacggatcgatgaaaatatgtcaatgccgccgggagttctctttttcagtagctaaccgtttccgtatttgtttttttttcttttttntcccttcttntgngncncngcccntgnggcaacggccnccttntnctgaatgtttgttgtgtaactaaactctgctatcttcttctaatatattaacgtgcgatttttttgagcgttcgcgaaaaaaaaaatatgtcaatgccgccagacgacgacgaccacaaatggcacgaatcagatttgacaagaatacctgtaacatgattacgaatagatgattattaaatgcatttatctaaaatggtaattttttaagggttaattggatccatgccactgtaaatatgccaattcgaaaaaatactactactattcgcgatatcggctacgtgccactgaaatttagggaaattggaatcatgtcacttccgtccagttttatgtcaaccgccgttatctgtctccttcttcttttcttcgcttctccgccatagacaccggtgagcactccacctcagactcgctggtccttgccactgcctactgcagctagtcaggggtcccctctctatctctcgctacttctccgccaacagccgccgcgacctgtccattcctcatcgtccccgccggcggacgtggcaccctcgctgccgtcgtcaagggaatcagcggccaggaagcttctccggcatggacgacggtgagcccaggaggacgaccgctgaggggaatcggcgaccggggagccgagggcgaagcccggcaggacgagcggcacgggggaaggagatcggtgacggcagcggcgagggttggggacggcgacatggcggtggacggggtggcaatcggcacatgggcagtggccggggccctcgccgggggagtagatgatgacaacgcaggcgcagcccggcccgccgactccgagacgaggcgctcgacaacgacgacaaagtgcagcccggcttcgagatgaagcgcttgacgacgacgacgacgcaggcgcagcccggcccgacccccatctctgagacgacgacggcgacgacacctcctactgcatctatggtggtggagagagaggaaaaggaaagagaagagaggggagggaggtggggcccacgtgcagttgggggctaacagggatttttgacggaaaatgtgatggagtggcacggttccaatttctccaattttcagtggcatatgtagccgatattctgaatattagtggcattttttaattggcatatttgcagtggcatggatccaattaacccttttttaatggcaccatcaatttaaccttaacattgtgggctaccgggggagcataccaattaccactacat

SEQ ID NO: 58762 - DNA, 10048 bp, Oryza sativa
  unsure (1)..(10048): unsure at all n locations
tttgaaatgacccagttaatgatcacttgatggcatatttcttctgttatagaaaaacccaactgcttatgtctaactcacggtttcccttatcgccggtaaccacgtggttactgcggttatcgtcctaaccgtgggggggggggggtataccataggggttaccggtgatagggtttgatgaaatttgtccaaattcaaaattctgaaaaaaattgaaaaaaattcatggaagtagttcttggtttgtagtggcagatggtgaagaattttttttgaaaaagaataagataaattcaaatttgagggcaaaaccaaaagtcaattagaaaatgaaaagaaatggaatgggccttgtttggcactgttacagatagcgcattaaggctcataagagaagaaaatatctcctgggttgttgggggctctcctcacgctcttcctccgcagaaaaactaattcgcgcagacgcgtcagttggttatctcgcgcacgttgcccacacatgcccacatgcgacttttaggtttttttttcgattttttccatatacgcatgatttcctcttttccggatattttttttgtgatttttttcatgaacttcttttaatctaagcgcatgattcaactcaaatttggagtcaaaagttttcaaaattgtagttagaagttttaaatttttagtttgaatatttttaaatgtaagataaatgtttttaattttgagatgaaagttttcaaattcgagttgaaagtttcaaattctgagtagaatgttttcaaatccgaattgaaagtttttaaatctaagttgaaagattttaaatctcgacttaaaatttttcaaatttgatttgaaagttttcaactctcgatttaaagttttcaaatctcgatttgaaagttttcaaatctcgagttgaaaagttttaaaatatgagttgaaagttttcaaatctggactgaaagtttttaaatctgggttgaaagtttcaaagttgagttgaatgtttttcaaatttgagatgaaaagttgaaagttttcaaaatttgacttaaaaattcaaatttcgagtgaaaattttcaaatctagatttaaaattttgaaaatttgacttcagatatagatttcttttcaatttgttagtttaaaaaaatcctaactactaccgtcattatctcaaactgtaattatctaaaactaattgaatagttaactaccttttagtcccggaaaacggggacatctaactccatgccacttttaagatgtggcaattaattattcgccactcgctgtctatgacatgtgggccctcatgtgtctatgatatgtgggtccagtggcaaataattaattgcaccactcgtaagtggcaaatagttaattattcccggaaaacgtgcatcgggggcgcacacgcgccaactaggcgcccccctttctctgttggcagacttggcacagggtgagggaggcagcagcggcgcctaatccgccgcatacgagccggcgagcatgaaaatcgcgcggtttctgaggtaaccgcaactagggaggaggttatcgcctaggagaagtgcctcgaggtaaccctcatcctcctcgcggttaccgctggcagtggatctgtgttttatgcaaggaagtggtgataatcgtcccaaattgcacggtaaccgtggttcctatagcagttatcgcgtggaaaccgtggtttacatagttgaatgttgtgtctttagttcaatgttgaatgtttctagggttcgggtatagtaagtgcaaatgtggaatgttgaatgaaattatgtagtgcaaatgttgaatgttgtggaagatttagtttggtaagttgttgagtacttctgtttgaaaagactgttggaaatattggtaattaagcagtagtgaattcagtgcatccggtgtccttttttatatcattcgtttcgaactacaactttctatattcttgatgcttgcttatcctatgaacaatcatatttgtagtcgtggataatatattgtggactgtattatttcagctttatgtggacttcataatgctttgaaatatgaggtcgttgaattgttgttgttgaattattgtgctataaaatgtttcagctgtttggtagccagcttctgaaaatctggaaaagctctgaaacccagcttctccagcttctggcttcttagttcatttttcagaatctgtaactacagattcttagaagctgtggactgtttgggacagtttctagcagaagcagcttttgggaaaagctgcagctgggacaagctcccccaaacaggaccgttgagttgcttcaatatccacaataaagaaagatcatgccgattttttgtattttacacccaaaagttatacttggaagtatcctatatattcttccaattatccccaatttctacacacatccggcgataactgcacgaatatcacgattatccttccaaaccgtgcggtaactgcgaaaccactgatttttttgaattcaaatttttggagatgaattttgcgcggtggcgctgtgtcgcagcgtaggattatcctggccatcaatcttgtgcatgcgcgtctgcgtcgcgccaatgaatcggtcgcacgcacctgccccgtggtatgtgtatatttccataaatctttcaaaaacacgtgcataattgcaaaaagttcaaaaataacgtatattttcaaatctttttacgctccaatttgccgccttgtagttcaccacaatgacgttattgtcctgtgcatgcatcagcagcagcgagacagcatgctagtgatgatagaggtactccctctacttctatattaattgacgttttgaacaaggttaaagttaaacttttataactttgaccatcaataactttaaaaatatttaaaaatatttagtttaaagaaactagaaaaacataaaattagaaactagagcgtgttattgtccaaagcgtcaattaaaatgaaaccggaggaagtatatggataaccaaacaacctcgcctgtcgacagatccatagatgtaaaacataattagtttctgttagagtataatctcatcggtgtcgaataacgggttcctattgtcatctctagttgttggtacaaaaaggatttttcttagtagccaaatgcttgtcatttgatatagataaaatggccacgcttattaaatagtatatgttattcaaatattaaactattgtataatgttaaaaaatattgggactaatttataaaacatgtaaaagcaaatgtggtggacttatttgcagaatcacaatcatcactattgcaagaccaataaatatgtgggggtttacagttaattaagtgcataaataacaacagctaccagctgattccgttactgaaaattcagtacatgctgaccgctttcaattgatttgctttattcacattctttttgaacgaatattgagcgttcctatactaatagatttgggccatttggcactcattttggaagggcccacacttgatggtaatgcattatgattagttatttttattgttattagatgataaaacataaatagtattttatatgtgactattttttttaattttttcataataagacagatagtcaaacgttgtactacatgaaaaatccaaaactgcgttatttttgggatggggggagtatcatcatcatcaactactctctccgggctgataatatttgtcgttttggataagagtaaggtcaaactttaaaatctttgattatgaataatttctaaaatatttatgtttgaaatatggagactatatggatagattagttttaaaaagtacttcaataaaatcatatatttcttaacacttctattcatattataataaaaaatgagtaaattacactagaggtgcttaaacttgtaacgaggtttcacttaagtccacgaacttgcaaaacgagcatcgagatctctaaacttggtttaatgtatcatcccggtccaaaacctcatttgaccgtggtcttgcttacgtggcatgccacgtggacgatgacatggattttttttattttttctcccttcttctttttttctcccttttgacactgacaggtggggcccacttctctcctcactactctcctcttctctctgacctcactttcccctcctctctatcctctctctcttcggccggttaagcgggacgggcggccggcgaccgaagtaggcgacaagcgggtcggagcggggcggccggccgactggcggagcaggtcggtggaaaaaaacagtgccaggcgaggctggtgagggggcggggaggccggcggcggcaacgacttcatctccgccaccgagctcgcgcgctctatggccgacgcctccctcgcacacgtggccacggtcggcgacctctcctcccgggtgtggtcagcgacgcctcccccacacgcgtgctgctcctctcctctccggccgctgcccgtgcatgcgcgtcctcccgtcggcctcacccgcacgcctctcctttctcgccgaccgccgtccgtgcacgcgcgctgctcctctcctctccaaccgcagcccgtgcacgcgtgccgctcctctcctcccgccggccggcacccgcgcgccgctcctttcttgccggccgccccgcccgtcgccgcttcggttgctggctgcccatacgtcctgctcaaccgcacggagagagagagaggatagagagaagagggaaagtgaggtcagagaagcccactgacaggtgggccagtggtagaagggagaaaaaataaaaaaaaatccctgtcatcgcccacgtggcatgccacgtaggcaagaccacagtcaaatggggctttggaccgggatgatacattaaaccaagtttagggatctcaatactcgttttgcaagttcatggatctaaatgaaacctcgctacaagtttaaggaccgctagtgtaatttactcataaaaaatagtggtcaaagttatcttttaaagaccgtatcgttatttaaaacgacaagtattattaaatctagagggagtaataaacattgttttgtgtgtaagtttaattggtgagacgaggatgaaatggtagttgcgcagtactcttaaaaacacatcatcatcattgttttgtgtctaagtttaattggtgagacgaggacgaaatggcagttgcgcagtactcttaaaaacacattatcatcatcattgttttgtgtctaagtttaattggtgaacatatcatcatcatcatcatcatcatcatcatcatcatcattttatgtctaagtttaataggtgacgttgataaaattaggtaatgcaattaatgcatcccacattaaggactattaattcctccttcattatatatatctccgttttattttattttatttgtttcattatctttatgaagcatgcaaccgacatggacggtttacgggtgcacatgtatctatccgtttaattatatggatgctgatgcatattagaaactattaagtgtggcggatctctttttatagttgctaatggcaaaggcaggcgaatcttgccatctgctagccgtgatgccctattaccctcctcgtctagaagaaccaaaaaaaaaacactaaatattatctgacaaagggtcacacatgttagattatatgagatataacacactacagtatataaaattataggttgtctatacatcatttgatagaaaatccttctataaatcctgcaaagtttagaccacccaattgcattaagatttgcgccagagcaacaaattaaaacccacaaaacctcctcctcatcccctttctcacgacagaaacccacaaaacctcctcctcatcccctttctcacgatacagtcgctgcttagctctcacgcgtccccccccccctcctctcctcccttctggagccatcggtagcgagatgcccctaccccgccatcttccttgtctctggtggctcctcgctgttggatcagccaccacctcctaaccacaagctagctattccactgctaccaaccggcaccgacgcctccaccttccacaaccatccctctaagcccggcaacctcccccttcttctcccttccccttccacccctcccatccccactctaacccgggaccctcatttattggctcttcgctagagtttgggttgtcaccggcattgaagaagaaaaggaggatgtcagagttggagaaaaaacatctagagcatgaatcgaaaagcacatctagtgaatcaaaatctgtaagatttgggaatagattttctatcgacagaagggtagccattctgataaaattactaatatggtgtagaaaagctccacgagtaaacacggttataagagttgtggcttaaaagattaatgtcctcgctgtatatgtaagtgggttgttccatatttataccgaaagtctcaaaattcatggaattcttgacgtttgatttattctagctagccgaggctagtgtaaaataatcttcaggtttcgggtctgcaaatcatacagtgtaaaggctgcgttggattctcccagaagagttggattaaattttggatactcgtggcacgcttttcaaactgctaaacgatgtgtttcgtgcgaaaactttctatatgaaagttgccctaaaatatcagattaatctatttttcaaacttgtaataattaaaacttaattaacacacgttactaccatctcattttgcgtgaaatacttaatcttcatttttatcttcaggagattcaaacaccaccccaagctagcatgttaggcgtgcatgcttcgcttaattctcagattattctcatatgttttcactgccgctaggcgctacagagagcatgtcagtcccatcacttgttcaattcaacctttttcctttccatatctgaaccccttctcatagttgagaaaaaaaaagaaaaaattaagggcccatttaaaatcataggaataaaaaaacagagaaataggaaaaacacaggattctgacaggaatacaattgtaaaacagagaactgtaaaacacaggaaaaataccagaatggccattattttggactacaggaaaaacgcaggaatcagatgagaaagatagactcagaggaaatgttccaagaggttatacctcttgctaactttcctccaatatatgcataggattacccatttcataggaattttaaaggattggatagaattcaatcctttgtttcaaagctttcataggattttttttctataggattgaaatcctccaaaatttctacattttcctacaaatcaaaggggccctaagtggaggaattgattgcattgtataattccaaagtaaaaagacaaattatgttttaggttaatttcattcttttacttagaaatttataagtttttatgatcgattttccttacaatcacataaaacacacacgcccgcagatatacatacgccagtacgtatacatagcccttatcgccagtatattttatgtgccagtactaataattgtaagaccacaattaaagaaaaaagtatgaaatatcccctgaactatcatggtcgaccgaattattccctaaatttaaataccggacattttacaccctaaactatatataccggacaaacaatccctgaaccctgttcggggcggttttgatttcagctatcacatgtggcatcaacgtggcagcctaatcagaaaaaaaaaatcccttgggcccacctgtcatccagcttctcccagcccattgcgctctctctctcgtgcgcgtactcggacggccagcggcggagctcgctcgcgcggctggggacggaggcgagctggttcccctaaatccagccgccgccgccctcttcttccctttggccgcccgcggaggaggcagccggagctcatggtgggcggcggcgcggggatgggaggatggcaacgtcncggggacgggaggtgtgcggggtcggcgactgcgagcttcttcgcggcgccttgggaggaacgaggcgaatgcccagccgctgcaggtgaggaacgaggccggagtcgaaggcggcagacaggaagatcggcagcgtgtggtggcgagcgcggaaggacctgtccgcgagcgtggtacgcaccagcgcagcgggggaagggaggcggaggagtcatcgccgagcacctcgacgccgcccatcgctgccctccgcgccgaccgcaagcgccgacggcgcacctgacccgccgtttctgcctccgcgccgacccccggccgctcgacctggaccggcggccgcacctcgcgccgcccgtcgccggccctcgcgcgccgacccccgcgccgctcgacctgcgcccgcgcggccgccacctcgacgccgcccgtcgccggccctcgcgcgccgaccgtccgcgccgtcccacgccgccgcccgccgtgcgcgccgccgctgccgctcgacccgcgtgcttgggggaggatgagtgagagagacggagagtgagatgagaagatatgacaggtggaccccactacttttttataaatagaaagctgactgtactgttacacgtacaccacgtagaccaaaatcaccgtggattaggtcgaggggggtaattcgtccggtttacatagttatgagtgaagaatgtccggttttgtggttcaggggggtaattcagtcgatcgtgatagttcgggaggtaattcgtactttttcccaaattaaatagctagggtaagggcatgaagaattttacatgaataattccgctgcaatgattctctttgcgtctatatatatctagatatatattgcacactgtaatttgttttataagtttcatggctactttgttccatacacccttttatttgttcttgccgtgtatttgactcctttgttttgcacctcttttcattttctacatgtgtatgttctgatactgtaatttaaaaatctagtaaaagcttatcgctctggattttcattttctttttgaggaaaactgatttttatctttatacttgaatagttagatttcacaacacaatcagagcgtgatgcatgtgagagtgagacgattgagattttatttaggagtgaagtatatgggcggtccctaaacttatgcgggtgtgtcatctaagtccctaaactcctaaaatgcatttttagatatttgaacttatcatgggtgttatataggtccaaacgagttctaacccactccatgtcctgacgtggtattgtcacggtggtgcctacgtgtaagtggaatccatataattaaaaaccataattttctcatataaggtagatagaaaaaaatctaaagtagagaggagaaaatatgtttttttaattttatttttctatgtgattggcacgtgggtccaactaatacgtaggcactatcgtggcatgccacatcaacgcatagagtgggttgtagctcgtttggacctatatgacatccaagacaagtttagagatccgaaaatgcattttgagagtttggggatctaaatgacacacatgcacaagtttaaaatagctataatatgttgcgtggacaaaacaatagaagataaacttccctatcagatttgacagaaaatttacttataatttcagtcgacaggcagattggaccgcagataattcgcatgattaatttgatagaaaaaaatctactcgttctgtcctgcctctttttcttaaaataaatatgaacagtaagcaaacttttgtcaaatcgggttttacaattttatgacatggactcctacgccatcctaaaataagttaatctaatataagatgtgacattttctagcactacgacgtctgtacagattcgtacgtagtgctagaaaatatcaaatctcgtacaaattaacttatttcatcacagcattacagtgggacacactgcgaatggtagttatcccacgtggcatcatttgg

SEQ ID NO: 58763 - DNA, 3202 bp, Oryza sativa
ctgaagaaatcgccatggcttcgttgagacgagctctcgacgagttctcttctctgcaagcagacgacggacactggcctggagacttcagtggtgttatgttcatcatgcctggcttggtagtatatttaaattgtatctgtctctggctaaataatttatgcttagctatttcgtggtttaatttctggtgatctagctaatttctgtacaaataaatgcagatatttgccttatatgtcactggatcactggacactatcatatcaccagagcatcggcgggagatatgtcgctatatctataaccatcaggcatatttttttccgtatatatggacgactgaccataaaataattataatatgctcatgtattcatggtttaataattttaattatagaagaacgtgtgttactccagtacttgcagtacgaatgtttataaaaacaaaaatgggtggtttgcataaattaaagcacgagttcagacttatttgctcagacaaaatataagcatatttttctaagtaacaattaaatgtcattagtataaaaaacactgagtaaatttcccaaaactacatataacttaaccaaactgtgtcaaaactatagatttaagataacgtatcacaaaacacaaatttaccatcaaaattatcattaaaatattgcaaaagtacatatctaataatgtttttgtcacaagactataggttttatttaaattactcgaactatatattattatattagagtaataagttatgatgaatttggtgctaaacctataattttgtgataactttattattaaatctataatattatgatactcgctcttaaatctgcaattccgcgataaatttaatattaattctatagttttatgatacaccattttaaatatataattttataatagcttggttagagaatatgtaattttgtgaaattcactttaaaaacatttgattttccatattttgtgactgcaaattctgcacatgcatgtgttatatagaacgaggatggtggatggggcagtttgatgttgagctcgagcaccatgtttggcacatgttcaaactatatcacccttaggcttctcggtgaagagacaagcaatgagcaattagccaaagggcgcatatggatcatattgcatggcggcactacctttgttccacaatggggaaagatatggctctcggtctgtctactatattatcgcatgaatccacacaataatgaattttgctaaacaattgctttcgttgatttttgtagggttcagtttactttcgaaacatcttgatttatataaacatgactaatataatggttaactaaatgataggtatatttagcactttctaatcgtaccaaccgattcatattttaattaaagtactttcacacgattggttttatagtacaaggttttcactttcgcgccaaaaatttcggccattttggtagaaacgaaatttctggatttttgggattttcggcgttttttagaccattttttgaaattttaacacaatttaactgaatttgactaaattcacaaaaaagttagaaaaatcgaaaatttcaaccgagataatcatttgcctgggtaagaattggaggcagggttcaatctatcgggaaggggaaaaatttcaggggtcaccgaaatttcgaaaatctttcagaaatttcgaacggaattttcaaacaaaatttgaatttaaacaataaaaataaagaaattttaccaagatcagagtatagatgagcatcgagtctattcaatccaaagcagaggaacaggagattgaaacacagtaacacgtaaggatgcgaggcttgtgcggcttgtgtcgtcgtccggtcatcgtcgtgctgccgaagagcgatggagccgccagcggcaactctagccaaacggaggatgcgaggcccgcggcttgtatcgtcgtcgtggtgccgaagagccacggagacgccgccggccactccaaccaacccgccgcctccggttccggccaccgccgcggccgctgttcgctagcttgggaggatggcgacctgctgcctgctgggcgagctgtcggaggatagcgaagcagcagcagcctttggtatataagtgaggaggggataggaaattgaggatttttaccatgaacattgttttgccgaaatttttgaccggagctcatgtttatcaggacccaccaatagacccgaaatttcgtaaatttcgttccgaaattttgaaccctgattagagggaaggtagaaaaaaaaagcccaaaaggcaaaaagaaaggagaaaaaacgaaataagaaaagaaaaacggcggaaaaaaacctaagcccgaaaaaaaaagggacggaggaaaagaaaaaagatggaaaaaagaaaataacagcgaaaaaagaaaaaaggacaaaaagagaaccggaaaccttaattattatatatataggtataaaaaagaaaaaacagcgaaaaaagaaaaaaacggacggaaagagaacaggaaaccttacttatttttcttattaggtatagataagccatatgacttttttctagtcaaacttctttaagtttgaccaattttatataaaaatttagtagtattttcaacacaaaacaaacatattatcagaatatattcaatgttatatttaatgaaactaatttgatattttagatgttgttaaatttttctataaatttgggccaacttgacaaagtttaattatgaaaaaaatcaaacgacttataatataacgcgttgattgatttcggacaaattaatttgattcactacagatacttggagtgtacgagtgggcaggaaacaaccccatcttccctgagctatggctgaccccacaatttcttccttttcatccaggtatatatatactagtaataatcatactgtatactcctacatcaaatagtagctagttgcacacaaatcaaaaacagtttaatggcaatgcctggagtttatatcagacttaaggttcatgaaaattctttaattttgaactgaatttacttttgtgcaggcaaattctggtgcttaactcgcatggtatacctgccgatggcctacctatacggcaagaagttcgtgggccccaccgcgccgaccatcctggcgctgcgagaggagatttactcggccc

SEQ ID NO: 58764 - DNA, 6363 bp, Oryza sativa
agtcaatttatagttggttgttgagaggatttagaatagcccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaagggatgttgttggaccatcgatgcaaaatgaggaaaatcaacgaagggaggaacaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggagacggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaatatcacttcagcttttgtggcaagtgagatgtacagcagtgttgttggtaacattgtctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataatgatacgtactatgacctacatacatttacatcggttgatgatcgaacaaagagtatgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaatgtttgccttatacatgatcgtcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaagagaagaaatttaattagttgtgggacaagttggatgagttgacaacgaagcaaacagatgagcaatctcgcagaccactagttgaatgtgacgagcctcccatacctcttggtgcattacatgatgacccaccaacaatgagaaggaggtcagggtcgtccatcagaaatttcactcagtggattgagaatgagcctaaggagaagtggtctctattgttcgacaccgatggatctcggtatggcataatgacaaccaatttggtagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacatagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtggatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggtgtcgtcgcgcagcaggcgattccatggtgtaacaaagctttcgatttaggaaataaaatgctgttgtgatgtaatgagtgttcggactaaatacttctatcgtgtaatttcaattcaatgttgttgtaatgagtacctccgactattgttatactagtagtattgcgaactattcggtgttgtatcataatgttatcgtgatgagtgttcggactaaacacttttgtttgtttgtactcttgtttaatatgtgttagtaattcgcttatgaacatttattacttatgttgaactaattatttatatgtttctgatcaacctatttgatgaaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctagagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctaggaccgaccaacacccttcctccgtactctacagtcgggcctagcaaggcttggttgctccagttcactgtaagtaaataagttgttattatcatacgtgcttatttgcgaccggatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtctttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgttggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaattttttatttccatcttgcataggctgatgacgcacgggatatcagtgccgatatcaccgcagtccaagtgaggttgaacagaggtttgcacttgactgacgttgagcagagggtaccttcgaccggatgcggaaagatgcggtggtcatgcgcatcttctcctgtcgcagcccgtgagtcgtacctcagctggtccggtcaacccggctcgcgcgccacgtcgagcagactcgactacggccctgtttcgccggtctgctcagcccagaggtttcttaagtttgtttctgtttttctcgaaacatcaccccgtcgtaacttgatgttccatcctcgcaggacctcgtttgccttcaagcgcccctagcttcggagcagtgcgacctacagcaccggtttcgcacggtacagttcagcccagatattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacacggtactttactttttattactactgttaaatacttgtacgaaactgatggtccttgtccagcaggatttgcagccgggatcttcggtactagggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttgtcttacaaacttgtaaagcagtactacttttgctattactactgcagtactacttgtgtttgtctcgtctatatagttcttttcattcatatggtgctagaacaacttatgctcacgacaacacactttcggcgcttcacggtagtgtcagatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctctttgagttcacatatattgcagtgaaaacgacgctatataattgacaatctgaaggcaacctcttcatatcttctttcccactagcacaccacacacaaaaatggaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaaca

SEQ ID NO: 58765 - DNA, 1977 bp, Oryza sativa
tgttggtgatgagcaggaggatctggtctgcccgcggacgcggctgcagaatgcggtgtggagttggctgtataagtgggtggagccggtgatgagcagctgggcgatgagcaagctgagggggagagctttggataggctcatggcacatccactacgaagacgagaacacgcagtacctctgcatttgctctgtcaacaaggtagcttcaatttattcttctcctcctctttatggtcatatcgtttattagatatgtatggtgcattggtgctgactgttagtttgattctggagggactagggtatgtcagatttgagctagacatatcaggattcagattgtttggatatatcaactgatatctgtcttcttattgattctttttaacaacattcaggctctaaacatggtctgctgctgggcggaagatcccaattcagacgcattcaagcagcatcttgcgagagtacctgatttcttgtggctttcagaagatggcatgaaggcacaggttattaacttttgtgtctttcatgcataaattgaatatgtaacatggttaatgcgtctactgtcggtactaccataactttgacaaatgttttacatctaggaaaattttcctattactatctagtgttttcattaaatttggaggaaccaggacagacctatgaattattgtacttccagtgatgttcaattgcataattagggggtacatcagtagaaatatcaattggtatggtaggaataaagctaaatctttaaacatgacacgcctttcgttctacaaaattatctatttattcaaggaaaaaaattgtgatagattgttatctcaatgataggtatatgatggttgccagagctgggagacagcatttataattcaagcgttttgtgctactgatcttgtaaatgagtatgcttctactgttcagagagcccatgagttcttgaaaaattcacaggtacagaatctctagtttaataatctaaatcataaattaactactttataagataatccagcatatattgcatattctttcttgaaggttgttaggaatcatcctggtgaccaaagttactggcatcgccatagatcaaagggttcttggactctttcatctgcagacaatggatgggctgtgtctgacactacagcagaagcactgaaggtcattatgtttctttgttctttcctttttgttactaatgtagacaaatgaagtataaaactagtgtcatattaatctagtcctaataggtgatagcacatcgaataagctcatgcataatttctacgctgtcttccgtagaaatctgacataatttcatttcaggctgtattgttgctgacaaagatatctattaacgtggttggggatcccattgaaagagaaaggctgcatgatgctgtcgattgcctcctatcttttgtggtatgcattttttttaaatacagctatcaaacctgatcttgtaatttcctttcagagtagcccacatacgtgatattgtggaaactatatctcgtatactgttatcagttgtgctaaccaggagaggttaaaggagtctgtcgcaccagacttacagggacaatgggcttaaatatgttacataacctttgtctggaactcagtatgggtgcagctgtgaaatccaaatccaagctcagaacttgcacaacttgttgccaactttatgtggccaaaatgttaaaaatcgaactaaaaatggtgattgtgctctcatagtctcattagtccttcggtttaaaaaaaaagtctcattagtccggggagattccttcagaaagttttagttgtcatggtttaaagatgtgaaaaccatctgctcaacgtattaatttttccttgcagaacaaagatggtaccgtttctacatatgaatgtaaaagaacttctacttggatagaggtgagtttctgcacactatcgcc

SEQ ID NO: 58766 - DNA, 2830 bp, Oryza sativa
tctagcaattcaattagcatactgaaaatgatataggctataaccttcctcgcacaaatcaagtggtttttaggaaagaaccatggtctttacattagataaaaatcaggacatcgacgatatattttttactgtagtaacaaactgatataccatacagtaccttctgtacaaggattttaacacatacaattccatctttaactgtcattgtggaaacttgaaaagaaactaattagatggcctagtttaactcctggggatgttctaaggtgattcagcattacttgtgtgaacattttaagatctatctcatgtgttgcttgtgctcctgtactgatgttaggaacacgttggatgcttcaattgctccctcttcttcaattaccccaactaccgcaacttatttcccatctgggctcttggagagtattgtaatcgtcttcgctcagagaggcgtgcatgagaacatggcaggaaactcttatacatgctgcagatatattgatcgccctgtacaaatattactcggctatacctaaaaaaacaagcaaaatcttctagctccgttgcatatctcggatgtaattgcttgcgatccaatttgatgttgtatatatatattgtcaagactggttatcgtaaattcataacccattggcttttgaggcttaaaaaaaattcaatatatatgatgggttcttatttactattccctccgttttatatcgagtctttgctctgatatcggggttgtcgaaaatgagcttttgtgctcgcttcatgtggttaggtggttggtatctttgacaaattcaatgagaaagatgagttagatgtgattctattgcttcgaaaatgtgtttattgacatgtttatcaacaaatacgctaattcctactgtacaacactgaaactggaaaaaaagcacgttaataatgctaattggagagaaatgtcagaattaggaggaagtatttgcaacaatagtcgtatatgaggaatctcaaactcaaggtgatatctggtgtgttttttgcaattttctcgtgttaaaaagagggttattcatgcagcaatgatggcttgcacaaagtatcaactgaatcttgggcaatcacgtggccttgtctcagcaaagaatgtgaaataccacaaagttatgtcactactattaaactgtcattagtagcaaaatttacatgagtcatatgtgaatatcgcaaaatttgtcaaatctatcaaacgaagcaattaatagccactactatttgtgatcatctttgtgactcccgtgcgaatgcgacagctactctgcttcttcgttaggaaaaacaaaaataaaggcagataaactacgcaaccattgatttgttgtgctcagttggcaaagttgatggtacaattatgacgtttggtggaatttgcttctgaaatttaaatttagacattgcgtgtttcattattttctcacggaatttaatttccggttacacaatcacatgatacaagtagttccttctcttctctttaaaataaaaaaataaaaaaaaccacgtccgtccgattgcgatccggcggttggcatcagctctcgttgactctcaccttgcggccgcagcaaccgccgcccttcgccggccgcgtcgccggcgccggcgacgacgcggtggtgccgtcggtggtggtgcggtcgaggaactcgcggttctccttccagacctcgccgtcgtcgtacacctccttcttccagatgggcacggacgctttgacctcgtcgatgacgtagcggcacgcctccatcgcgtcggcgcggtgcaccgcggacgccgccacgaacacgctcgcctcgccggcggggaccgtcccgaggcggtgcgccacggcgagccgccgcagcgagtgggcggcgcgggcctcccggaggatggccgcgagccggcgccgcgccatggccccgtacgcctcgtaccggagctccaccacccgcctcccctcgaagctgtcgcgggtggtgccctcgaacgtggcgatggcgcccgccgccaggtcgcggacgtggtccacgtaccgtgcgatgtcgagccggcctgacccctcgtcgaggatctccacgaggtcctcctcctcggttgccgctgccgccacggggagctcgtcgctagccatggggtggggttgagatcgaagtcgtcgcgttcgtgggagagagagagagagagagagataaggtttcgtggggacgggagcgcgcccgcgcgactgcgcgaggggaggcggcggccggcggcgcgcgctcgtcgacggttggggacgggaccgagcccgcgcgacggcgcaaggggaggcggcggccggcggcgcgcgcgttggactctggagcggcggcggcggcgcggtggaggtggagattggagaaatgtggggaaggggagggttgacgttgactagggttagaagctatacatatctggttattgggcttcaattttatagccaaaacgactaataaagtctataattggtccctagctacaatgcatgcgggtcaccgcgagggatagggacttagggtgggagtggagcggcctccctgccggccatccccgatagtgatgtgttttggaccattagatttttcttagatggtagatattaaccatcttcatcccctaatacgtgaattcaccatggggattgatgatcggtcccatcgccatctataaaattttgagctatgaagtaatcgagcgagcatgcgctagataaatccaatctgcttcggaatcttcaggtttcacaatatttgcagcatttaaattgaaattg

SEQ ID NO: 58767 - DNA, 6902 bp, Oryza sativa
tgagttctgtaggctagctgaagataggaagatttaagacacgtgcaactatttctcattttgatactatcgatcccatcattccgcttatcctgatgtttatttctactgtttgttagcaaacaaaaattaatttatagttcaaactcctaagcgatataaaagaaaatgttgcaaaataaatcatgaaaaaaaaccttaaaatcaagttcaaaactaaaatttaaaaaaattaaattttagtttgtaaacataagtatataagtataagtataagtgaaacgatgaggaactacgacttcaagtcttcaacgtacagatctgaccaaagctataaatcgttcaaacactttatgttaagcaacattattcatgagccctagcccctatttttcacttgcactttgtaaatacgcatagaagcaataaagattaatctactttcaagagtcttcgatttgtgttttgctcgggtgcggcggttagagtggcgtctactgctcattcagaccgactgcagcagcaacaggtgacggctgcgcaacgggcgatcagcccggaggtatctgtccagtcagacctacgcatcaactccggtcagaccgatctccatcgattcgatggtaacttttaattctgataaaagatttagattttggtaatccaaccatttaccctctctgattagtttagttcttttttgaattcagattagcttagttgttgttgttcgagcataaatgctgaacactaaggctgtatttgagggagaggagattgagaagattgggaagatacgtaaaacgaggtgagccattagcgcatgattaattaagtattaactattttaaacttcaaaaatggattaatatgattttttaaagcaacttttctatagaattttttttcaaaaaacgcaccgtttagtagtttgaaaagcgtgcgcgcggaaaacgagtcagaatctcccctttctcctgtgaacgaacacagcctaattcaactatgaatagcaaattgaatcaactaaaaaattcagtcatgctgactgcgctgctttcaattgatttgcatttttatatactgttgtactgattgatttgggccatttggcactcaatttcgaagggcacactcttgagaggtactgttatattatattaattcattatattcatggtatgtgaaacgaaagcggctgaagatactagagagtaagctagttgtggcacagtaaccatctcgtacttaaaaatgaatgtgtgttgggccagcaatatggtgctagctgatgacggtcgtttcctgtgttatttacaggaccattgaaagcacatctcggtgcaagtattgcccttatccctacgtttaattggtggcatcaagtaaagcgaccgccgtgattaggactaagttttgtgtccaagtttaattggtgggatgaggataaaatgaggtaagtcatttagaggactattcatccttaattatatatttatttcaaattagggttttggtttcgcaatcccttatgaagcgtgcaaccaaacatggtataattactggggtgtgcacactactgtagataaggtaaaatatatttttttacgggcgggtggagcaaccacctagcctagcatatatgtaaaaaaaaagattttcataatcggacatcgtaatcgtacgtgaaaattgatttttcatacatggacaagtttaatatgcccgttaataaaaattggttttcgtagacgagcgaattaagacgcatgattacaatagacttttggcaaaaaaaaataaaaaatttccctaaatccaagattaccaaaattcaaaaaccctagctcccggtgaagtcggcggctgatcaggtagcccctcccgaggccaccgtcaccaaatatgcgagggagggaaagaggcaagagaggaaaggctgtaccgttggatccacgatgcatagttcatagcgatcttcgaatttttttttctcttaaactgcttatcggatataagatccgatcacaccgttatattcattataattaaatctttagagcaacatgtcacattattttgataaaataaagatatattccctccgtcccacaaaaaactaacctaatactggatatgacacatcctagtccaatgaatctggacatatccctgtccagttcattgtactataatgtgtcacatccagtcctatatttacttttattgggatggagggagtatgttttaaccattaaaatttaatgtcttaaatgcgatagcaacatgttcatcatgtgtttcataaatttttaaatgtttcaacggctaactttttttttcatcatatacaacttagtttattattagtggtcgactgcaacatgtgacaacctgatcttttttaaaaaaatggacacctgatttatactagcttaaaaaaatttatcttttgtcaaatcaacatattgcttgttgttttttatgaaaaatgagatgatctatcatttacttctggattggtattttaccaaatttctctagagagcagcataaatttctttttttatatcctccatgtagtgtatcttatatctttgggaattggtttgtgggtattaataaattataaaaccaaatatcttatccttgttaaagcatattctatatgttaggctctacggcttagcagaaatgatatggttttggataaatcactattcaaatcttatgtacaggtacttttcaaaacaaggtattgactccgattttgggcacaactataaaggtgtgatgagaacaataaacttatgaacgctgcatgtcgaaccttaagtcaacggttatataatttttcgccaactttggatagagatttacaaataagcttcaataaatgtagagttttatctagtgttatttggatgtgcttttatggatttgttggtgtgtgctcagaattgagtggatctatgcaataatgggccatagctcgttgagtaaatgacataattttcttccgttattaaaaaaaaaatcaacgtatggcttaagaaaatacaactctttcttggtagaaatccggctacagatgatggggttatgtattagtactccatagaaagaatatccatgaaaaggacaaccgcgtacatcatcagcttatcccaagcggcaccatttggctccaagccctttaaaaagccagcagccatgccaatactatcggtaggcctggtccaggaggcaaagagcaaaccaaacacacgcgcgtgtgcatgctctatagtctatagctaagttagctacaccttcttctccatctccggcgagtacccgttgattggctggcagctgctggtggtggtcgcggccatatacatatagctaaagctgctagctaccatgtggaggctgaaggtggccgagggcggcggcgcgttgctgcggtcgacgaatggcttcctcgggcgggcggtgtgggagctcgaccccgaccacggcacgccggaggaccgcgccgacgtcgagagggtgcgccgtgagttcaccgatgaccgcctccgccgccgcgagtcggcggatctcctcatgcgcatgcaggttcatatatgttacttaaccgctcaatcatcggctaactgacgatcgaccggttatactcttttcctttttttaatatatgatgcagttaggttttatacgtatgtttaactatccatagagaataactatatattttttctaaactgttttatcaataaataataatttatcttttatatctatatataaaatattttcgaataagatgaatgtttatttaataagttactaattaattaattgcaattaacaccaatacgaagtcgtgacagtgttggctttcatctgatatgattttcttggtttcatttcatacgatgttacattcatttcgattttgttgcagtttgcaaaacagaaaaagcttcaacgtcgtcgtgatagtattccaccggccgtcaagcttggagagaaggaacaggtgactgaagaaatcgccatggcttcgttgaggcgagctctcgacgagttctcctctttgcaagcagacgatggacactggcctggcgacttcagtggtgttatgttcatcatgcctggcttggtaattaatattcaattgtatttgtctgattgtctctagctaaattaattcatattttcgagggttttagtgatctaattgctgtccaaaataaatgcagatatttgctttatatgtcactggatcactggacactacgatatcaccagagcatcggcaggagatatgtcgatatatctacaaccatcaggcaaagaaacaaacaaaaaaaaactatatacgggctgaccctaaaataataagccaatatggtttaagattttattaagtatagaagaacatctattactctactgtccacaagtactgctaccactataaaaacaaaaatgtggtggtttgcataaattaaagcacagttcagatatataagcatatttttgtaagtaacaattaaatgttactagtatgaagaaacaaacattaagaaaattttacaaactacataaattttaatcaaattattgtaaaactatagagttaagatgacgtatcatagaactacatattgaccatcaaatttatcatgaagctatagatttaaagtgaaatatcataaaactttagatttcaataacgttgtcatcacaagagtattgattttaatcccttaaacctacagttttgtgataattttattattaaatctatgtttttatgatacttaatcttaaaccaatagtcacatgataaatttaatgctaaaaatatttgtagtttgtaatacaccgttttaaatctatagttttgtgaaagtttgatcaaagtatctgcttttactagaaaacattggatattctatattttgtgacatcaatatctacatgtgtgtgtagaacgaggatggtggatagggcacgttcttgagctcgagcaccatgtttggcacatgttcaaactatatcaccctaaggcttctcggcgaagttctaaccaatgagcaattggctagaggacgtatctggatcatatcgcatggtggcgctacccttgttccacagtggggaaagatatggctctcggtctgtctactatataatcccatgaaaatgcactatataataaatcttgctaaagaattacttttattggggcagtttaatgtcaaaatgctaagctatatagtagtataaatttgagcaatataatggttaactaaatgatatataggtatatttagcatttacaaattaatcgtataaagatttatatttttaagtactttcacgcaattggttttatagtcattcataatacagccgatgataactaacaatgttattcatcaagatcgacctttccaaattaaaacatgcagctcttataaaaatcaaacagagtttaacatatattctgaagtatatataattagtgcatgctgctaactaaatacacgtagcttgttgattcgtttccgtcaacttaatttgaattcgctacagatgcttggagtgtacgagtgggcaggaaacaaccccatcttccctgagctatggctagccccacagttccttccctttcatccaggtaaatattaataggacactgtgttgtgtatgtatatatcctcctacatcaaatagtagcaatataaaacaatttagtggcagtgctcagagtttatattttatcaaaacttcattaatttattacgcatgtgtaggtagacttttaacaggattttagtgagaccatgaatgtgccactagtttccgtctcttaaaacatatgttagagagcgtatttcacgtttttgtgagcgtggtgttacgtatgtagtgatatgtatgtgtatgtttaaaagaaaattcattaaatttatttttaagaataaattttaatttgggtgcaggcaaattttggtgcctgacccgcatggtatacctgcccatggcctacctgtacggcaagaagttcgtgggccccaccacaccgaccatcctggcactgcgagaggagatatacccggtccactacctcaccatcgattgggcccaggcccgcagcgcctgcgccaaggtagagagagagagagatactattttaggctgggccgaatttgttgggcctctaattgggcctaacgtaattgtgcttctttttgggggaggcgtggcccgtcgtgaggcggcgattctcgccgccggtggcggcggcggcggcggcagtggcgactcgccctccttccggcggcgccgttcctcctccatcccccctgtctctctctctcctctaactgttcgtcatgctctggattttggtggtggcaggaggatctggtctgcccgaggacgcggctgcagaacgcggtgtggagttggctgtacaagtgggtggagccggtgatgagcagctgggcgatgaacaagctgagggggagagctttggatgcactcatggagcacatccattacgaggacgagaacacgcagtacctctgcatttgctctgtcaacaaggtagcttcaattttttttcccctttgtgatagtcatcgtcaattacagatgtttgatgttaagtgttaaatttgattcttactttgctcttcatttctagtaagagaaatgggggccatgggccctagttcaaaaaaaaaaagtgttaaatttgattccggggaggctaggatatgtcagatttgagctaggcatcagaattcaaacggtttgtgtgaagcggtatttgtcttcttattacttgttactttaaacaatattcaggctctaaacatggtctgctgctgggcgga

SEQ ID NO: 58768 - DNA, 1771 bp, Oryza sativa
ttgtggtatgcaaattgtaatctccttcaagactaacccccatatgtaatcttgtgaaaactatggtctcattagtctgggtgattccttcagaacgttcttgttggcatgattttaagatgtgaaatcgattttgtcaacgtattagcttttccttgcagaacaaagatggtaccatttctacatatgaatgtaaaagaacttctacttggatagaggtgagtttctgcacactaacaccctaacatcacaaaaaaactccatgattgtgcctacatcataacacaatcaatctaatttatgatgttgaaataacatcagcaacatgcatgtacttcaaattataaaacacgactatttgattcagcacgtcatgtatgttccagtacatttacattgaagaaatcaccagttttattgcaaattcttatggccattccagtaagcctgacaagtcttctctttttccaacctagattctcaagccttgcgagagttttccaaatatggtggttgattatccgtaagtgatgcaattacataaatcctggtagccccttttcactttgtagataaaataactccttgcaactcatactgttctataaattggcagatatccagaatgtacctcctcagtgcttcaagctttggtgctgttcaaagaactatgccctggttaccgtactgaagagatagaagaatgtgttagaaacgcatcaatgtttattgagaacacgcaacgcaaagatggctcatggtttgtagcaagagcattttactgactagtggatattttttctctcttctagtctactccctccgtcccataatataagggattttgaatttttgcttgcaacgtttgatcactcgtcttattcaaaattttttgaaattattatttattttatctgtgacttactttattatccacagtactttaagcacaacttttcgttttttatatttgcaaaaaaaatttgaataagatgagtggtcaaacgttgcaagtaaaaactcaaaatcccttatattgtgggacggagggagtaacaatttgtaacacaataacttggttattcggcaggctaggcacttggggtgtatgcttcacctatggggccttcttttcagtacaaggattaattgctgctggaagaacatatgagaatagttcttccatcaggaaagcatgtgattttataatgtcaaagcagctcaatactggtggatggggagaaagtcatgtctctaatgaaactaaggtaagttttttctctctctttctcaacatcattcattttttttatggttgaataagcctgtgtagttcatttggttggaagttttatgataattggcatgtaggatacacaatggtgattaattagcatagttttttaaagcacgactttaaattcaactagaactggcatttactgcgttaaggatattaggggtgttttgttaatttctcatcaccttgtacacaatattttgccttgggactagatcaattgagcattgtttatccccaaatcttctctagaagtgacatactgaaggtatagtagaaccaacctcacagccctagtaatggtgtgtaccctgctcagtttaggccttgagcatgggcgggcttgttcatacccctcaaaggaagccattcaagcaaatatttgttcttgaattagcatagggtttgaatcacagcccattcatttgatttgttgtgtatgttgaagttattacttttcatttgcaacaa

SEQ ID NO: 58769 - DNA, 1024 bp, Oryza sativa
atgagagccaaagcccaatatcgggccgttcactctgggccaacggcccatgcccgacggccgacgtgtctcgccgtccgtcggccacgcggtcggccgccgagacgcttccaggatactacacgtctctgcacacgcgtcagcaagctcctgtgcttgcaccgtctacttatctcaattctcaagctctcagctatggagtaaactatacttgcatcttgggtatttttttcagagcaaatcgagatcgatccgacagaagcgagcgatcatggggcacggcaaggaggtgaagacgaggccggatcccaaggtggagatccaggttaggtttgctgcttaatttaattaatttctccccatttgatcgcattttgtatttcttttttacagtttagttcagatcagtgttagcttagcttgcggagtggattaatggcgatcgatgtggtgggatgggatgcaggagaagggcgagatcttcttcttctatcgtcccaaggtcggcaaggacgaggcgcgcggccccgacgacgtgcagcggatgtacatcgtcctccgccccgaggccaccggcgacggcggcgaccgcgccgtcgaggacaagcaggcgccggactccggcaaggagggccacaagaatcagcagccgcagaacagcgacggcgatggcggcggcgaaggcggacacggcaaggaggtcgtctcggtgacagagagttgcagatttttcagagattttcaggttaaatttgatggatgccggtgttgttgcattgcaggaggtgaacgtcgaggagcaggcgctgctccggctgatcgtgatggggaagaagagcctgccggacccggcggcgaagcgcggccgcccgtactggggttacgtcgagctcgtcaccaccgacgtcgaacacatcaaagacgcgctcaaggaaggtacaaaacgcattcaaattttaatttcgttgttccaaatcgaaatgtgaacttcttatgtatgaatttgttgcgatcgattttgcag

SEQ ID NO: 58770 - DNA, 903 bp, Oryza sativa
tgtagttcttatgttctatgtcggcatgtggatttgcttgtgattcgtttcgaacttatcgatgtgtttatgtttcgtcgtgtaatgtcagacttcggcatgtcgtgtctttagggtctcgtgatgtaacgtcggactaaggcgcctaacgtctttaggtatgctgatgtatgtcggacttcgacacgtaatgttatgttatattattgaactctacatatatgttaagaatattttgattacatgaatccttattttctcacaacatttactaactttgcttgctttacatctattctttcctcccaggaaccaccaaggagatgtcaatacagagaatggatagacaccagaaaggttctaactccacctagccgtgttgtacagcttgaactaccagagcaatacagggttactaaagcgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatataatctatgtaaccgcaatgcaaatagtcgtatcatgttcaaattttactactatttcttcatgttacataattctccttgtttaagtccatataatgtttctacgacccagactgcgataggcgcctatataaattatccgagtactaatacgtcgaataaggtacaaaataatacctcacttaacatatgaaattgcgcaacaaccaactttaatacatttttataataatattaacaagttttaccaataaatacttctttatttattattaacataacatagaaaaatcttttggccgtacttttttcatctgggtccctt

SEQ ID NO: 58771 - DNA, 3442 bp, Oryza sativa
attagccccttgccgccctctgtatgggcggcaagggcctaatcgcaattttggccaacgacggggcagacggcgcggtcgacccaccgtctgccacgtcagcttgccgcccaccattagggcggtaggggctatttctgcaatttttttggtcgatagattatttctgtaaatattaaaaaaaataatctaaaaacgaaaaaaactcccgcctgcacgcctcctgccaccctaaccctgactcccctagggcgactgggctgtttttttctcgttgggccgtccgtcgccgggatgggccaaattcttgggtgttcccagacaacccattggaacggaaaaagtacaccgaaggtccctcaccttgtcgtcgggattaaaaaacatcctcgaacctcaaaaccagatatgtggggtctcttaactatacaaaaccggtcacccgagatccttcggtggttttgaccccggttttggtctacgtggcgctgagtcagcgtgggacccacgtggaccccacatgccaggtgtccacgtcaccctctctttcccctcttctctcccttcctcatctctctctcactctctctctctctctctcacttctctgcagctggccgaggcgaggcgggagggcggcgccgcgatggccgccggcggaggcagcgtgcgagcgcggcgacttctccgatttttccgcctccttgtcctgctcggccgacgtgggcgcgctcgtgtcgtcgcgcgcggctaccgcgtcggccatggcgagggagccgccccgcttcccggtgccccacgcgcggctacgacgtggggtggtgggggccgaagaagcggtgagagggtacgactacgaaacgcgctacttccggcagcggctggaccacttcaaaaacttttgttcttggtgtggctttaaggtcgatctatgtgccaaggtctcaaaatcccctccccgaaaacctcaaaaattcctgattcaattttaaatctagattttgttgaaaagttccacattggttgtggaagggcaaatgacctaagatattagtggaggaacccctcacctcaacggctagcttttggggtgggaaaggccctttacgatccttcagattttgcagtatttcaacttttgggcgggtgttttcttgcaataaccatgatatcgtgactatattttaacattgttactatgataaagcagttatgttcctactttggtcatcatgttattacgccatttctacgagacggacctaaaaagagatagcatgggggaagtcagcaggtgtactttggtcatcatgttattacgccatttctacgagaaggacctaaaaagagatagcatgggggaagtcagcaggtggatttgatcaattgatcggagtctgcccgacgtgcgaacgctttgattgacgtggaaggaaggggtgcataatatttattatgtggagggggtacataatagatgtgctatattttgtcatacaaattttaaagatgccacgggccaagatatatacaatacaagcatgtactcacgcgcatctttaaaaaaaaaaaaggtcactcacatgggaagaaccagtcagctctccatcttccatccgacccataagacaacccctccctttttatggacaccggattatcaaatctgaatgtgtcgttcttcatgtcatacacacagtaggcgcagtcaccaatgccattgatgatcccatcagagcataatctggttatgtttaagctcgaaaagaatatacagctgccataatccgatgaaagaattgccctggagcaggaggtgccgaggaagagagcttggtcacctagttccttcacctccaaccacctgcgcttctccagatctgcctcgaacacgtccagcttgatctccttcctcagctcgtcgacgccccaacggcgtacattgtaaaatatggggagatgccaccgccatcgaaccatcatcagccttccagtagcgcacgatatgacgaggtaaaaagtgctccgccaactgtagccttgacaactctaggcttgaggagctatgccgatcacgatatctgcactgatgctatcgctgaactcgtgaacgaaaagctccccgtcactgctaatggagtagagcttgccattgtagtaggctatgtcgcgcgcgaagcaggggccgccggaggcaaacagccaggttgagtgcattcccggccggtagaagaaaacgccagagccggcgatgacggcggcgacgagatcaggcgagcacacggcgatcttccgcacggcgttctcgccgaagcacatggttcgttgtccctctttctcctccccgtagtcggggaggatggcgtcgtcgtcgtcgtcgcagtgccagtggtagggcagatcaatcctggccttggagattgggttcatcaggaagcactccagctgctcgctgcggtcgtagaggagccagccatcgaacgagccgcggcagacgaccgtgcctccagcttggagctcgtcggggacggggatgcggtgcacctcgccgtcggggagactctggtaggtgatgcggccgtccaagttaagccaggggagcgccggcggcagagggtgctgctgccacgcggcgaggcgccaccggcggcacacggctcggaagcggaggcggtcgccgtgggacagcagccggcagaacaccatgcctgccagctccggctggagatccggccatggtgaccaggtgctttcatcatcgtcgtccatgatgccggctggaggtacaacaacgacgtcccgcccaagatcggatgcagcaggcatcgcgtacgtctaagatctgtgcgtacgtacgtgcttgggatctctatagctggctcgatcgtatacattgattatatatacgtatgaattaccgagtccgaagctgtcgaccgagttgtattttgctagctactagctgttaattttgtggtgctccctccgtctccatttcatattataagttatttgtttttctattttaagtttaatcaagtttatagaaaattattgtaacatttcaaacaaaatatcatcaaaatatgttcaatattaatgaaactaatttgttatcgcagatcagtatatatttaaaaaattctataaatatagttaaacataaataagtctgacttaaaaaaattcaaagcgacttatataatataaacagagagggtagagaccgagtccataggttctcccacagagcaaggataatcataattataagtcaattataaatttatttggagaagaataatattaaaatgattttttcacaacaccgagctttcatttttctatatggaccataaaattcactcttttaagttatagctgactccaaacccccctctccaccctctactccgtgcaaaagcatgggcggtggcggcgg

SEQ ID NO: 58772 - DNA, 5824 bp, Oryza sativa
ccctcgccaaccggctgccgccaacgaggacaatagcggccgagcatggaggccgagcgcgccatagtcactgctgcgaaccccatcctcagcggcgagcgctcaatgaccgccgacctcgaggccatcaaggctcctgacacagctgccccgctccctcctcgagcttcctcccggccctccttactccctctttgagttcccttgctaaccggccaccgccgccgaacccatcctcagcgcctagcgtgccatggcagcagacttcgagggcgtgaaggcttccaaccaggctatcgaggccttcgacgccgcctcctccttgcagcagccgacgctgccgccgcctcctcacagcagccggtgccaccgctggcgagaagaagtagccagaggaggaagctaccggcaagaagggggagaaggggaatgaccgaatgaggagttgctggagatagggaggagggtggggcccactgacatgtgggtcccgctattttttatcatttgtcttacagacatgtgggcccatagtctctatctctacttctactactattattaaaattgaagatgtttttgtgaagagatttttgtacgtcgtctttgtccgatcgatcacctgattccgcgccatccgttttagtccatcggcgcccttcaagcctttgcgatggaatttttggctcccttttctattttcgggaatgctaggggacgggatatcgtcccccaacgggatagctcctcctccataacgtgattcttatccatacacgcaccaggcctgctcactcgccgccgtcgctgtcccccgtcgctgctgcgcccgtcccctgtcgcctccgccgccgccgtgcccatcccccaccgccgccgcacccgtcccccgtcgacgacgccgccgccgccgcgtccatgccccaccgccgccgtcgcaatcccccgccgccgccgcgctcgtcccctaccgccgccgtcgccgtcctcatctacaagggacatctgcagggggccgaccgcacgtgtcggggtgctcctcccccaacgggatgcccagctatatatagtaggaatcacctgatacctggtaggtatcatccgatacttcgtaagtatcacgcgatacatggtagaaattgtcttatacctgacaagtatcatatgatacctcgcgagtatcacgcgatacgtgttagaaatcgtctaatacatgacaggtatcgcatgatacctcgtgagtatcatacgatacgtggttgaaatcgtctgatacctgacaggtttcacatgatacctcgcgagtatcacgcgatacgtggtagaaatcgcatgatacctgataaatatcacatgatacttgcaagtgtcacctgaaatgtgtgtagaatcgtctgataccttataggtatcacacctgatacctactcgggatcatcatgttgtgtagaatcgtctgatacttgataggtatcacacctgttacctactcgggatcattccgttcgaaaacgggattccattatatagcagcctctttattttttgtctgtaagatctgcacaaagatttatatttatgtagacccaacttacaattacactcatttacaaaacgcttatatatactatagaacacttacaaatagttacagtgtatctgcactcagttatattataaaaaaattgattttacaactgcttttgtctctagaattactatttttaacatgtttgttcttttttttttgttgaaaacgtagtattcactggttgaaagttttgtaagatttgttggtccaaatctaatgagtactccctccatccctaaatatttaacgccgttgacctttttaaacatgtttgaccgttcgtcttattaaaaaaaacttttgtgcaatgtgtaaaactatatgtatacataaaagaatatttaacaataaatcaaagaattaataattacttaatttttttaataagacgaacggtcaaacatttttaaaaaagttaacggcgtcaaatatttttttttaataagacgaacggttaaacatttttaaaaaagttaacggcgtcaaatattttgagatggaggaagtattatgatgtagtgataaacaatctacttgtagaatgcaaagaaacgaggtcgtggcgacccacacgcacagacaaaagatttcagtagtcaaagcgagacgattccgtcacttccgtgagaaacaacgacgttttctgagacggcgtttccgctgctcgccgtcgtcgtcgcccatggattcggcaccggcgccggagccgccatgagatgcaggaacgggttcaccggaggcgcgacgtccatctcgccctccagcatcttcaccaccgcgcccatcggcggccgcgcctccggccgctgctgcacgcaccagaacgccacctggtacatcctcaccaccgcctccttgcaccgccgctcgtcgtcggcctcggccacggtcaccacggcctcgccgtcgctgccactacagatctcgtcgctcggatgattgatggcggcggcggcgtcgtcgaccatcatcaactcgccgcgctcgtacctggcccacgcctccatcggccaccactgctggctctccggcgcggcctcgtcgaagttcctcctccggccgacgatcttgaggaggagcatgccgaagctgtacacgtcgcacttctccgtcacgccggactgcatcaacgtctccggcgcggcgtagccgggggtgccgcgcatgccggacacggagacgtgcgtgtcgccgcggttcaccagccgggccagcccgaagtcggccaccttgggcgtcatgccgccgtcgagcaggacgttgccgggcttgatgtcgtagtgcacgatcttgtgctcgcactcctcgtggaggtagcggagcccccgcgcgacgccgatggcgatggcgcgccgcgccgggacgccgacgtcgcggctcaggtcgaacaggtaggcgtcgagcgcgccgttgcccatgtactcgtacaccagcgcgcgcacggcggcgtcgtagcagaagccgaacagcctgacgaggttgatgtggtgcgtcctcccgatggtgcccacctccgccatgaactgctcctcggacctcctcctgtccatgccgccgcggagcaccttgacggccacggcgaggccgttggggagcgcgccgccgtacaccgtcccgaagacgccggcgccgagccgcgccgagtagccgcgcgtgaacccggcgagctgccgcggcgtgaaccggatgggcttctcgtgcgccatctcccacaggaacctctccaccgtcgcgctccgcatcgcggcgtcgggcaccacggcgtagtgcgccgtcgccttcatctcggcggccaccgcggcgccgcagctctcggcgccccggtacaccttgaccagcaacgccgcgaacgccacaacgaagatgatcgtggcaatcactgcagggaccaccgatcgatcaatgcaaaaatcaaacaagaggaagcaactcaatataatcgaaatcaagcagccagtagatgagagaatatatgagatgatcatggaaaccgatgacaagggtgcacaccgtaacggcaggcgacgccatgaagcaggtgatgtaatcttggtgttttgatgaaagcatgtgaagagtgacggccttgtgccttgctccacacggccttgcaaatcttaataaatttagccggcgattaactttttcttgagagagaggcaagcttatcccaactctgtgactagtgaggtgattgcgacatagcttagcggatgattactgtagcatcactgtagcaaatcctggattaatatgcttcgttagattcgtctcgtaaaatagtctaggggttatagaatgggttttgtcagtaatctacgtttaatactcctagatagtaagattctgaaagactatttaatagtccggaggatcaaacaaaaccatagttcgctgaaattttctgttatacttggatagatatatcacatatatttacctcttcactactttattagacataaaatttaaattagtttaactagtttgaaaaatgtacggtcgacactgtcacaacatctccaaagagcaccaaataaaaaaaagtgctccaaactccaaagggtccctatcccaagtcacaatccctgccattcgtttgttgtcgccttaactctatgtctgcacatttaaaaattgaacgttattattgatggattcattcatactctctccatcctaaaataaactaaccttgaatattatgtgatacatcttacaaatttagttgtactatatatttagattcgttgaactaagaagtctaagatgcgttacatactagtacgatgtttgtttattttaaaatggagagagtggttttcaaagtctgcttagccaccatgtgccctgctggtttgctagctggccatatgccacccctctgctcgtcatgctcatcctcttcgttatcatttggatttattttctataaaaaaattggaacttatcattgctaagttcattattttttgtttttagaattctggcagccaacacattcctctcgcctcctgcccccctgcctcccaatcgtcaccacatatattaatccattaaaaatatagctattaaagataaagatatttgtaggcaatcaataacatatgacaaagttaaatacagagggtgggatttagatattgggttggagaaaaaaaatgtggggagaaaatatttttagggagttccctaaatgggggttgtcaaaaattgaaaaaaacttgaacaaatatgtaggtgaattatcacttgtattagtttgaatacatcacttcatggagctagagcccatctctcaagtgtgatgagatgcatatatatatctttaaggatatataagtggaacccttgtttgacatttcaagcaaaagggaagtagatcagtagcatcgccacttgtgatgccactatttgtgcatttgtgcaatactctcttttagataatggattaactaaaacccacactctacatcctacatgtacatgaccaaaactgtgcaatactcctttcaacaaaaactaacagttgtgcaactgtaacttccaggaaacatccaaattaagagaagcgctaatacagaggtaatgtcaatccaaacaactttatggtgttgcgcaatgcctaacattcatcatctcctctccaacttgcttcaaaccaacgaccactccactctacgagctccaaactccacccatatcttttgccacatactacttcctcagaataagttaattaatctgagattaatttattttggatagacgtctgtccagatttataaaattaggatgtgtcacattctgtgctatcaccgtaatggtatttgattagagcaagtttaatagtatagccaactactaactccaaagcatctacagctaatgtaatagctaattcatacaatagttccttactatactattaatacccggtcctacctgtcatacacacattacgtcttggagtttgtgctgcagctggctacagatctgtagcccactgcttttctctctcttcctttatctatttaaaatatgtttatagctggattatagcctgctattatacctgctcttaacaatgtaatgatccaattggaatgatcacctctgcagactgacgagaccctgatctcaatgagttatcactttcagctgaatctgtagtgcttgtccacctaagcgcagccgccggcgacgcgaccaaatgctggaacgggttcaccg

SEQ ID NO: 58773 - DNA, 4941 bp, Oryza sativa
cgatctcgaacaggtgcacgccgaagctgtacacgtcgcacttctcggtcacgcccgcctgcatccacatctccggcgcggcgtagcccggggtgccgcgcatgccggacaccgagacgtgcgtgtcgccgcggctcgccagccgcgccagcccgaagtcggccaccttgggcgtcaggccgccgtcgagcaggacgttgccgggcttgatgtcgtagtgcacgatcttgtgctggcactcctcgtggaggtagcggagccccctcgcgacaccgacggcgatggcgcgccgcgtcgcgacggggacggcgcggctccggtcgaacaggtaggcgtcgagcgcgccgttgtccatgtactcgtacaccagcgcgcgcacgtcggcgtcgaagcagaagccgaacagcctgacgaggttgatgtggtgaatcctcccgacgctgcccacctccgccataaactgctcctgcgacgtcgaccacccgtcgccatggccgccgacgtggaggcgcttcacggcgaccgtgaggccgttcgggagcatgcccttgtacacggtgccgaagccgccggcgccgagccgggccgagtagttgttcgtgaatccggccagctgctgcgccgtgaaccggatgggcttctcgccggcgatctctttgagaaacctctcgacggtggcgtcgcgtatctgggagtccggcaccacggcgtacatcgccgccgccgccgtcgggttggtgttgatgttgacggccgggaggccattcttcttgacacatctgtacacgaggtaaacaatggcgactgatccagcaatgctcaccactgaaagcactgcatcaccagagatcaaaaccaagcatcatctcagtgaaaccagctcatcatctcgaaacaagaaactgaaaattgaaaagaacaaaagaaagaaaaaacatgtacaaattgccgagatttcacgcaccgacgacgatggctaggaaggagttgaaattgctggaggcttgcttgttgaaatcgtcgaacgactggttgggattagcagacatgttggtggatgaataatgaattactgctgcaaatgaagaacgaattgggaggattctgaacttcttggtgatccaaactctgaagctgatcgatcaagcttgcatgcaaactaacaatgcgtgtagcatatgcagctgtaatctggggctgaatttatagcactcaaggggctatcgtgttgggacagcaaccaaagaactgttcaacacgcgctgcagtaaccaggtcaagtcagaaaaaagaacgcgggagatatgataattaacctgacagcgacaggcatatcgtatctcattagattaaaaaatgcagaagaaaacctgaacaaaagaactaggactctgcttacttccctcaagaagaaaaaacagagagggtctcctgtctgaattattcattgccgccgttgatatgaagtattcatcgacgcaatcactcagtttcgacccttccattcatcaaattttgcagaaaactcccttactttctctttttcagaacgcggtcctatacttgaattttttttcaccttcacataagatatatcaggatctagagggcctttacataagaatacataagacagtgaacttacatttagagacttaagaaagattatcaagttaagcgaggactttttgtaaaattgccagctcgtgcaccaggtgatgtggccatcaccggaagcgaacatgccagtaagaaaagcctcggagcgctctggtgcgagcagatcgccttcatctttaattactccgattgactcctgaacaaaataaaaagaagaagagaaaagtcaaatcttctaatcttcatcacaaataaaatctcatgttctcccaaatcccaatgttaaggcgtaataaggctccaggttagggtgactgcggcctaagggagcaatttctactgggcaagaggatgttgggtatccaagcaagcgacggcggaggcgccattgccgccgtatgcggttctccctgagccatcgctgccgcccccaccgcctccgctcggtacttccaaacttcggtcgcggcggataaggcagagctcgccggagaaagttggaggcaccaccgtcgccgtgtcgccggagagccgagcgcgtcaccgtgccgattcgattttgagtttacctaagggtttttgtgaaaaatgacgtactaaattattacacctccgtcttaaaataaatgcaaccatgagtttccatgttcaattttgaccgtcgtcttatttaaatttttttatgattaatatttttattgttataagattataaaatatgaataatattttatgcgtgacttatgttttttagttttttttaaaaaaataaataagatgaacgatcaaaagttggacacgaaaatttatgattacgcttattttgggagtattaccttattccacaccgtctgatcaagtataggtggtggagattaaagaaaggcaatattgcaacacgcccccccttacaatgtttcctttcccaattcggactcgtaatccgaatccgaatgagatttaaaacattcggcgccggcggcggcctatattaagtagcacaaacccacatctctgatcctcacaaacgcagccatggcggcggtaactgtgctcgattgccaagtgttcggcattcacaagatggtgctactctccgagacagcggccgcgccaccgccgccgccgccgttggcggagcagcagacagcgccaccggcggtcacgctacggcttctcgtccagcgggcttgctgctaccacgacagcgacgacgacgccgacggtgtcgtcgaccacgacatggacacaatggaggacgtgatctgccgagcgccgctccgcgagctgatggcggatgatcgcgacgacgatggcgcctcggtggcggagcgggcgttccgggagatgttggccgggatcgagcaccagacgctgctcccggaggtcgagccggaggtgtcgaaggccgcggcgcgcgtccgggcggtgtgcgagggtcgcccggaggaggagatcgccgggctcgagctccgcctgcacgtcctgctcgtggtgcacgtgttcggaggcgccggcgacgacgacgagatcgggagcgacatggatctcagcgacgtgtgcggggaaacagaggacgacgacgacggcgtactcatcagcgacgaggacgacgacgagtacggcgtctacggcggcggagggtgcgccatggcgcgggagggcgggccgagcgacggcgcgctgctgctgtcgggcttcgcggcgcgctccgacggcgcggagctcgacgacgacgaccagctcgaggtgacgccgcgggacgtccgccggctggtgcgcatggcgctggacggcgaggacgtcgagcgcgacgaggcctaccagcgggcgcttgccggcggcacggccgtgtcgccggtgtcgctcgccgcgatggtcgaccaggcgctccagtccgttcgccggcagcagcagaacgcgccgcgagacggcgtggttcgccggatgcgcaccggattctgacgtgcagcagagcggatgacgtgtcgcgccaacgcaacaacgccaagttttgtctgttactactactgctcctatttttgatcttggtagagaagttggttgtcaatcgattattgaatagcaaaagctgatttcagaagatgtttgggggagtttttaagctaatgcagcttctaccagaatcagaaactcccctaaacagtccagcttttggttcagattgaagctgtagttgtggaatccagaaaataaatagaagacagaaactgggaaacccacctttttcatattctcataagctggctgctggttaccagccagctgcttctcagaatcttaagctcaccaaacagacccttaggtactgtttttcaaattgattgaaggcaaatgcaagccttgttcaggttcaaatattggaatcttgaaatcagcttatatgtttcaattggatgtaggcagattaaaaccttgttcaggttcaataattcaaatctatatcaagcatgcactgtccaattcaaaagctaaacatagcaaattagaaatctggacaagttcagtgcccatttgaagctggaatatgaaatggacaaatggtggtgtatgaaactatcaatttccaatttccgcccccaaattcagccaaacaaaacttcaggttaattaggaactgaaaacttcaatggccattcggttctgcttctcgctatcctatccttccgattggcatagctgtgcatcaagtatgaaaatgcactagattaaactaaataaagcagctcctacatatatatgagtgtcatgtcaagcatggattaaattaacatagatacaaaaatgaaacatgattaattactaggattacttaacacacggatcacagaaaatcaatccttgcatgcaggggaaatcgatggatcgacctctctccttaacttgttcttaattctcatgtacaatcaaagaaacacacacgcacacacacatgcgtgcactgcatctctctgagcaacgaactcgattgatttgattttgattcgctagggattaaagagaagctgagatagagatttcgacgatcatgcgacgctgaaggagctggctgcgctctcgacgaacttcctggcgcccttgaaccacctcttgtcgccggcctgcgccttgcagatgtacagcttgccgtcgttgacggtggccgtgatcagctggtgcttgccgccctcgtcgccgtccgccgtcctcgtcagcaccgttacgctgtagtactgcttccctcccaccaccggcgccgagctctccaggatgttcgccgtcgccaccgcgtccgactcaaacccaccctatatcgcatat

SEQ ID NO: 58774 - DNA, 709 bp, Oryza sativa
gctattccaagcggcaaacaacaatttctattggaaatagagcaaaaacaagcttttggcgcgacaactggctccaaaactcctgcccaaaggatgttgtgccactctgcttcaagctagcaaaacaaaaacaaagaaatgttcagaaagagctggaaggcaatctttggctccagtccttcaagcaattcaccacggtggaagaaatcaacgaattagtgcaactaggggagatgctacagcaaattcagcttaacccgcaagtgcaggatgacattgcttggaactggaatgagaaaggtgtttacacagcagaaagcgcttatttggctcagtttcaaggatcctttgtaacacatgacttcatttccatctggaaagcacctgcggaaccgaagactcgtttctttggatggttgatcattcaccaaaaaacgttgacagcgcaaagcctccttcgcaggcattagccttgcaactagatctgtaacctgtgcaaagaagcttttgaagacacaaaccatcttttccgttcgtgcatttttttcggaaatgtttgttccctggttagtgcttggggtggtcttccctccttgtcattgcgtgatgacatttgactgtggtggaatgatatcaactgcatcaaatccaaagaacaaaaaagagtgatctctggaagccttctcaccacctggtggaatatttggtt

SEQ ID NO: 58775 - DNA, 4420 bp, Oryza sativa
cacaaaaattattgagcatatctgattaagtgatgtcaaatgtctgtgctatttgttgatttatgaaatataatataaaatagtaagttggttatgcatgagaacatctcaaacaagcattaggtgcgatactgcgaaattttgatgattgaatagggcatgaacaatgtaagcaacggcgccctcaacctcaaggtgaaagagtgtgctacatacaattcaatatacttgatttatttttatttacactttcatccaaaattgcgtgcaactaccactctccatagaaaaaaaataaaaaggttgtatataaaataaactagtttaaaaaagatgggcaaaacctttgatgtcaatcagattcatgtcgaggtcatgctgaagttgaagttatcatcgagaatccatggcatgcttcctatacattaatatgatctgccattttactgcagtctcagatgaaccatgatatggtttcctgtttctgtcatgtcatttttcttgttgtaaatggcctcatgtgtgggttcataccataccacaaagtgctcaccttgattcttttcctagctgtttaccttttgtagtagatttcctgatgatacttcaacggagcaaaaccacttttcttaattgttgcaaaatcacttctcttaattgtttagacccatttccaatctatgcaattgattataattctcatgtttgaacctgctcttggatgcaaataatacttagtacacagctgtactcatttggaacgtcaagattttaattgtgtggcatgttttgtatccctatctcagagagttgccgtagctgtacattgtgggattcgatctgcatgtgttcggttgcattgccataccatgtttcatccatgcatgattccatgtcaaatgacattcatgcgcttagccgcaaaaattagctagacagcttatcttattaggcgatgccaaatgtcagtgctatttgttgatttatgaaagaaaaatagttaagtttgttatgcatgagaacctctgaaacaagctttacgtaggaaactttgatgaaacggcactgcacggaatatgtcgtatccgcgcatgtgagttcaatggaactcaaagtctacaattgtgtgtgttggacgcatacgcgggtgtgtgcgtgtggtgttgtgtgaacttagaataagttcgtgtgcgtacttagttgtaccttcataaaaaagtaaaatgtaaaatactgttgttttgatacatggtatatgcgattagagcaagtttaatgaaagcgccggctactgtctccaaaacaaccaaattggcctagttagtatagctagtgccaaaagcggaccactatataatcggctctctacgcatttttcactgatagcttttcttttttctaacctcagctttcacggtataacctgttggagcatgcgtgcatgcatttttatctctcatcttcttttcctgcctttttttttttgccctttggggagacaaatctttccgtttcacttcccccttgggccatttgataaagtcatccttccatccaatatccatatatgatttgattcccatggtcatggtgggctgctggctgctgctatgctagtgatcgatgggtgagttgcaggtgagctcagcgcacagcgccgtggactcgctcctggggcggctgatccggatcctggaggacgaggcgaggctgctcggcggcgtccgcggcgacgtgcagttcatcaaggacgagatggagagcatcaacggcttcctcctccacgtcctccacctcgaccgccccgaccaccagctccaggggtggaccaggcaggtcaaggacctcgcccgcgactgcgacaactgcgtcgacgtctacatgcagcgcctcgccggcgccggctccggcggcagcgcgcggcggctcctcaggtaggggtgcaagtgggtttgtccgtgaactcgcttataggaaaaaaaaagtgcgtaacccacggattcgatttacgggttaaatattaatttaacttataaatgggtttatggatggatccacctctatatttagatacggcaagccgggttacaacgagaaacgaaatcactagttagcgtgtgcgcgctgccggcgcgcgttttatgcctagaaggcccagcgccggcgcgcgcgcctctccacgcttttttttttcgtttttttcgtttttttttcctcgctttttttctgacttttttttatcttttaacatgttttgagtttaaaagtttttaaattttgagtagaaagttttcaaatctcgagttgaaagttttcgaatctcaatttgaaaattttcaattttttcaaatctggatttgaaagttttcgaatctcgagttgaaagttttcaaatctcaaattgaaagttttcaaaattttcaaatctggacttaaaagtttttgaatctcgattctttagttgaaagttttcaaatctgagttgaaagtttttaaatttcaagttgaaagtttttaaaatttgactataaaatttaaaacttaaatcgaaagttttcaaatctaacttaaaaatttttcaatctgtcagtaaaaaaatctcgagaatattttcttaattattatcattagtgtcagtatattaataaataatataggtagttaaactaaaagggagaaagtgctcgccaactctttttcttgcgcgcgctagcaatcccccgcgagaaaacccataaattattttttatttgaccttagcacccctatcgtcaggctcctcacgctgccggcacgccgccgcatcgccacgcggatccgggagctcaaatcgcgcgcctgcgacggtcggggagcggcggcgcaggtacggcgtcgtcgtccccagaaccagaaacaatgccgccgccgccgccgccgcccgtcgcggcggccaacgtgggctggcgaagaggcagctgtcggaggctggcggcggcgaccaccatgccgacgcctcctccgccggcaacaccaccaagcaagatcaccggaggcgcgcgctgctggaggaggagacacccgcgaaccttttcgcaggtgaaaccgacacgctggtcggctggctgctggctgccgccgacgagcaccgacggccaaaagtgatatcaatcatacgacctgatgacgaggagctcgtcgcagctgccattgatcctgtaaagcgagcgttggatgatccgcgcatacttgaattgttccaaatcaggcagtggcacagcggccaatctcatcccggctgggtttaccaagacatgatgacacaaatactccctatgattcagcacatgcatcgggcgctgggagggatggtatccgattacgacaagaggaacaagaggagatatacgcggctgaagaagaaaaagaagagaattgtggtctcaaatttttcgagaaaaaatctgggctcaaaggggaacaaatttcctgtaggaacgacgtttgacgaggtgaaggaatttatcggtggaacagcatccgacaaggatgaggaggaggaggaggaagagggatttctacaagcagcggcaatggaagttcatgaaagatttgcaatggacgttgccaagattatttcagaaacgatggcatccgagatgggatttcatcaaggaatgacatttcaggagatgatggagactttcatgaaagataagagctacctaattgttcttgatgatgttcctgatgaatcgctatggcgtggcatcgaatcagctttccccggcaacacggctcacagtgccatcctgctgacaacccggtcacctgccgtagcctactcctgttcaccacatgacagagtcttccctcctctggatcatctcatcgacttcttccatgccaaggctgtctccctggttgaaaactatcccagcaacggtaacctggatgaagtgattagatccatactgtcaaaatgtgcctccaactccactgacatgtgcatcagagcattcctccatgtcctttatgccaatcctaacaggaacagggaagaacttcagggcttgtgtgatagcctgcatgattcacatggtttaatgctggatgaaaacatgcagcaaatcctgatgttctggtacaacgacctgcctgtccattacaagagctgcttgacgtatctctctctatttatccaagatgatggaagcagtagcaacagtactatgatgatcaggagaacaagcttagtcagaagatgggctgctgagagcataaacacagaacgaaacgggcagacagcgctggatgaagccgagcgatgctttggtgtgctcttagcaaaaagatttgttcttgagagagacatcggcgcttctgggaagatcaagagctgtgcagtgaatggcttgatctcaaagttcatcaccaaggt

SEQ ID NO: 58776 - DNA, 780 bp, Oryza sativa
cagttgttggcaatctcaaagcactgcggtatctccggctccggtgcaggtcatatgtccaaagcaagctcacccttggggaaaaacagttccagcatctcaaggttcttctcatccacggcgaagacattaccgatatcagcttcagcaagaatcctaagttggaaaaaattgtttggagtttcagggagatgaaatccatttctggaattgagcgtcttccgagcttgcgatcatttgagcttcatggtgactgcaacccagataaggtggaaattgctctaaaagatcaccccaaccatccagatttggagcatcatggtaaccgtcaaggccagggagacgctgctggaagcttggatgctgatgctgcctcaacctgtgcctcagtctcagctcccaaccatccagatgtgaagcatcctgataaccgtcaaggccatggagatgattctgctgcctcgacctctgcctctgcctcagcatcagctcccaaacacatccagagtattacttgattgattcattaatttatcctcaaatcaagatgcatctgtggataaaatccttgtcatcttcgtcctatctcaagtgccagctcaccgagttgatgaattccttctagtgtcaatccgttggcctttcctgcatgtatgtcaaatttctttagacatataatagttgtactcttctggactcctaattttcaaccttatgtaaattgtaatgcgtgcttgtttgtatggtgtttgagagctgccctagctgctagtcatgatt

SEQ ID NO: 58777 - DNA, 1409 bp, Oryza sativa
cagaacaaaatgagattcaggagttactctctggcgctgtcattccatcctcatctgatgggaccataaaataagtaagatgttttgatggtcagtacacagttcttgatatttccaaacttaaatgcagcatggacatgtacatgaaacctccctatagatgcacttgcacaacaatatgaggtatataaatcagagaatacatggtatatcatttttttgcgcttaaccgcactaatttgtgtactgaaactagttgattgtcgtcatttgatctaattccatcttctgatagatcagttttggacacttcagttctgctttgggcattgtctagtcctatcctatcaatagatgaactctggctgtggttgtgcgtccatttcgttctttcgctgttgcattcaatagactattttgtcacattagaaaaaacagtgggctagttcacaaacaattgggttgagcatcgctttcatgatatggacatgataagcagtgtatagggacttgcatgagggatcagcaactagcgaaaaacgctactagtagcactgcatgttgagcaagttgttgcctccttgatgctatccttaatatctcgacaaccaatgctttcttaacacgattgctgaaagataggttcattagctgataaaggttatgatgatctataaagaaacaagtttagattgaccatctaaaacataactgaagatgtcagggaaaattagacatgtgcaatgccatctagcattataagaatactttctttcagcatataaaattcacagtcattcccaagcaatataatactagtgatgaaacaatgttttcctcactttttttttctcatcatcattgacttgtttgttgtgcagtgaccaacatgcaaacaactaggggagataaacaaaggaaggcagaacaactggtcctagaagaatgatttgattccaagatgcagtttgtgtcctgtgagtcgtgtaaggctgaagctttgggacaccactcggcagtcgacacgtgtacaccgcctcctgatgctattcttatctgaagagtatagtgatcaacatcacctttctgtttctggaagggtttttgtctatgggagatgaactggaggatccctttgcatagataatcaagacaacaggaagatgcttcatatgatgctacatgtatggaaatggcaggcaccggcaatatgtgaagaatatagtggctgtgtggactcagcttgagccggcatcgcaaaagctgcacaagaacacaacagtgacagtttcactcttcttttagctgatgttactgttatatgatgcctgagggacatgcatctggtgagttcttacaagaacaaatcaaggaaccaaatgacagttttggttgctatgttgattttt

SEQ ID NO: 58778 - DNA, 1621 bp, Oryza sativa
tttaagttagtttatcttaagacttcataatatctctccttttctgaaccagcaatattataacatttcaattttcaagtaccattgtattgttcttatctccatattgaatcatgtggttagttaattgtcctctcatttctttccatgaacagatggttcaatctttgtctgtgcactaattcaggatgctactagtaaaatcttgcctaactagtgacggaaatgtaagtgccttactgttgttaatccccttcctcacaggctcatagatttcgcaagaactccattactaaacagtcaagaacttcacatgtatgcaaataaactctaacatgcaagctcaagcactaaccatggttggctgcagccgaggcggtccaggaacatatcatgctgttcctcccgcggtggtcggcgtcgagggacagcatgacgcagcgtagccggtcatcaccgtcgtccctcggcggctgctgctctcttgtaaaactcctgcacggcgcatgaagggagctgaggcaactgcggcctgtggagggtggcggctgcacaagcacagaaatcatactaatgctcaagaaaaccaacccaaaaatcatattaatgctcccggctaatcaaggtaatagatgcttctctcttcctactaacacctaaatcccacaattacacttctttttctctaatgccatccatcacattgtttgcagggggttgatgaattagttagtgcaatgcagggactattatggagtgcaccttcttctagacagcttgtgggggacatgctacccgggtgtcctataggaggccttcggctacagcgcagggggtaggccgagttgcctaggcccatgcggttatttgtaatacatggaaagggatagcagccagggaaacctatcctgtatctgtacatgaatggtatgcaccaagattataagggataccatatcacacatgccggcaaatcccccagcattatataaggggcgctggcatgaaccctaaggggttacgcaatctttcatactcatcgggcacaaatccaatccacatacaactggactagggtattacctcgcattgagggcctgaaccagtataaatgtctgtgtcaccatctctccttgatatagaacaccctataaattatattgccgatcataaaaatcgacacatctgtgtacaacttggcaataatccatccacgcaccattcctcatatggcaataatccatccatgcaccattcctcagatgaggatcttgtatgggtggtatccttatattcctgtacataaatcatgtaagtataagcatgtaaaatggagctttactcaagtgtgcatatcaatgcctagatctagatggctagatgtgagcaccgtaaaggaactaatgcttaggtagcataagttttgcataccagctgtatgtgtgttcagagaatagctataatcattgtagaatcatgtaaattcacttatgctgtcaggtattccaaattttttgaattctaactttcaagtgaacttgcatagtctcctgcttctagctatatcagacggcagatgcactagacgaccagttcttataccttttactcttaaataatg

SEQ ID NO: 58779 - DNA, 6515 bp, Oryza sativa
acttgatgcaatgtacttatacggttttggagtttccgtattgatattagtgtactccacaaagatggtgatttttttccttttcccgcagacatccaaatccgtcctcgttttcatatgaacggcatcttttcttccctttctagtatgccttccagccacctgcttggtataaacttgaacatgtagcattggtgaaacccgagtttctgagctcaggaaatatcatggacgacagtgtcttattgttcttggaaaccatgataagtgttactcattgctaattttgtgcagtcccatcatggtttacaacgttttcttaccatgtattccttgccatttgctgacatgttttatttgttatgctaatgatgttttggcatggaatttcccacgatatttcaaagacactactgcgggttgatctatcaaaaaataggactgataaaatcataattgttttgagcagattggttcactgcacacattcatgaggtatatatgtcataaaagttggctgggtgagtgatttctacctcagaagatcatgaattatttagccttaaagcttcctgattggtggtgggtttttggccttgatcaagcacttcatgttgacattgatatctggagttcaagtctttttcagagcgtcagaagaaggtaattacattgtgccatcttttaaggtgttagcaaattaattttgtggcctatgctatggtgtacatttctgaatttgatgattcagttcttctggagaaaatgtaatttgattccagtacaccagcaacattactctacacattgttgtcatgagcaaaaagttgtgcaaaattccatgtgaagtttgctgcgtggggatttttcttagtgactgatactagtgagttttgcaggttgaacaacaagaagtgaagaggtttgtcactacgatggtgctgttctgcccttttggcaagaagttggaagagtggtgtcttcaggacatcctttgttgcttttttggtgttccttctgcagtcctggaactgatatttatatgtgcccacaattggtgataaatgacactacttatctagataaagagtcctgttgttagctccacaatctctttagctaaagagacaagaatgctatagtagtatgaaactgtcaagtttctcgctttactgttgttttgtggctgtaccacgaagactcttgtgtacaagcagaaactccaaaagtttcttgcactagaacatctgggagaacaagaacacccaaagggagaaggctttaaactgagaagtagccaaacctctactcgcactccggaaggctacatccagtcaccattttgcagcctcagaaatggcatccatcaaagtcgaaaccgcagaagaagctatggtacgggacaacggacttgatgtcgttcaaggcattggtgctgaaaccacgggccctgaacaactcttgcatctttctcgaacctggctgaaggcagaacatccgaccaaccctggccatatggagaaaaatggcgccgccatggtgagcgaagccgacgaggcgaggtggactgaaaagctgaatcgacgcgcgtagcgtccatgccatggcaccggcaccggcacctgccgtctccctcacccacacgttcagcacgaggtcatcagtagatgcgaatcctagcccacccccctccgccgccatcagcagcgcggcgcgtcgagcgtatctccgggctcggtgcggcggcggcggcgactccagcacagtcaacttctcctcgtccatgtcatactctagtggggaggaaaagcttccttcccacaaggacgcaggccttggtatcaatctgatccttctccttgtgcagaatctcatcgctccagccatcggtgtaggaagagtacatcctgagagagctgtaggagtccatcgtgcgagtgcatgcggcgacgaccagaaatggtcccccgtggcagtgaagatgatcgttatggcactccaaaaggccacacatcacggccgccgtccagtactgcgtctcgacggggaagggaaatccatcgatccactgctcctcttcttcttcttcttccaccattggatcccagactacgaatcgctcctcctcgtcggagcaaaccctcacgtagaagaggaccaggccgtgtcggctgtcaaccgctgatgcgaggtcgtatatgtcgggactcgccctgaatgttgtcgtcatgtggacgaatcttgcgatctccattggctttccgggttcatcctcgttgatgaagtagccaagcataggaggtggatcatggaacttgcggaggaggcggatgaagcaggggtcgccgaggatcgcatgccattgcttgcaaaccagctggagtcgggcgaacagggctgggtcctccggtggggggcgaaggagaatctcggtcaccatatcttcattgagcacatcgacgagtccgcagcggctgcttgaggccgtggtgttgatgatggcgtcgccggcggagctcaagttgaggccgtcacttgggagctcatcatgagcattgccgaccggagagaggtcgacgatgtccttgtcgccaccgccggccacggcgtctgacccgaacctccacccgccgaacaagctggggctctcaatccacggaatccacgacggcggcggctcgtatggcgtcgccttgccggtgaggccatcgtgatcgaggacgccgtggccgttggggaaggggacgatgtagctgccgcctaaaacactagatcaccggcatacctagcgtttaagatttgtaaacaaagataataggagccgaagtcaatcccttaaaacactcctccccgaacctcctcctgtatctactattggttgactgaaaataaaccaaaagcaagggtggttgcacatcttctgaaaagaaaagggctcggtatcgagtcatctactaaaaaggaccctccccgctgtgcgcccctccttgaattattcggtcatgcaatactttttttaatacaaagaacaaaatgcatttcgacctggagccggcctcctcctgatcctggacgaggcggccaccgatcccgctgctctcggcgagggaggtggaggtcgtcgtcgtccccgccgccgccagcaccagcgccgcgccgggaccggtggtcatcatgttgccgacaatggcggtgcccccgctgtcggagtcggcggtgtcgccgccgattaggccatcgatgggccgtggctcgaacggggtggggaggtggcgggggccgttgggatcagccatcgtcgcgaggcgtgatttgaaaggggcgaggcgtggtttggtggtgggggagagaaggtctcagagagagcaaggggcccgtcttaaatagacgggaggtaacttgctcggtaagccagcctccaccgccgttgctggctgccgtgctcggcctcggcgatgagaagcttgaagctttttctcgccgatgccaacggccatgtggcgattaaacaggaaggtgactcgccgagtgctcttctcggtttattgggccagaggcttttcggcccaacagaagtgtggaccttttgtacttgtgaaaaagtttaccctttgatccttatcccttaaccgtaaaaccatgcaggttttaaggacgattttcgctgacatggcatccatgcagcaatctaattatcagataattaagaaaatagagtggacctgtttgtaagtgactcccctcttctctcatctatcctctccaatccgcattcttctcgacgtcctgtaggtcctacgctggcgtcagccatcttgcgatgcgccacccacgtgtccttgtcgaagtttaagataatcgagcacactatcacagaagaggaattgaacacacagtagaaatctactctagcaattaaacgtgtaatcaaaatctgctcctgcaaccgaacgtgcagtcgaaacctgctcctgcaatcgaacacggcaagagggcgatcatggacttcattgctgtcaagaataggagggagagaggccccatgggaggatggatagagggaggaagaaagagtgagagtgtggatgacacacatgtttcaggccactgacatgtgggcaccacataatattccttgatgacatagcatttttaaccatgtcaacgtaccacgtcaccaataccactatcaatactatcttatgaatcattttgtaccggttttaatagttgaggtattcgttatatccggttttatggttgagggatatgaattagattgacctataatttaagggagccaaattggaatttttagttttactctcaacaaaatgagacccacaattagattaccggaaataaaagggccagctatcaaaaacttcaaagcaattacaaatcgggcgcccgatttgtttctcaaaaattgggcgttgtttcatttaggggtgaaaacggagcggattcggacgataatggtcataccatatcctaaaccatatattttaagcgggtgcggatagtgtacggatgcggatacggagcagattgtttcggatgtcgaaaatggtgcggaatcagttcggtaacggattaaatttatcggatgttacgtgtgtacgcaatcgatacaacatcgagttagcaatgcaaggaacaataatacaataatcaataaacgacccatcgtaataattatgtgcttaagtgttaatcaacatgaatatatgatgcccataatataaaagtacagctacgacagtgtgacatgagacagtgaaagcctcagactaagaaatctaggttaactgatgaattaggcaattggatgaaccaacttatgtaagatgcaatagatagagtggttacatgtgttgataatttcggattatctggcaaacagcctatcggataatctgatagaaatgtcggataatccgtattcgctggattttagagataccatatcctcatccgtatccgcattgtactatccgcatccgcatccatatccgccatatttctaaagcacataccatatcctcatttcggacggattcggagcggaacgaatcgatccgttttcacccctagttccactagtcgaataaaaatgtttcacctattagatcgaaaatgtttcaatcccttaaaatgttgaaacacatttgaaataagactgaatcattttggtgcaacatatgaacatcgaatatccccctactgaaacaccaacaaataaatatcaaccaaggacaaagatatgaaacaccatcaaaatcccatcgcaacatttcaatccaatacaaaagaacatcaaattacaatatataaacaacagtttcaaatatattgaaacatgaaacacatctgagtatatcaaaaaaataatgaaacaccatcgaaaaacccattgcatcatttcaatctggctaatgaaacataatggtgcatgggctgaaacatcaaaaaattcaagagaaaaacctagatctatctcttcctccgctctagtggttagctaccacatgaactgggatgctgtcacgcccagaaatttagctcaaatttccagactattttatgtattaaatccctgtccaggatcaggcagggtacataaaacgacaagtaatatacagttccaaatgcaaataaaagcgtaaatacttacagaagagacacttaatcctcacaccgaaacgaaagcaacagcagcggaaaaaggcgatcctagcggggcttcagctccactccataggcaaaactcaattggggtctgagccttggtcttctaacttcgtcttcagctcagaagcactacacttctgaaaagggggaataatagcaaggctgagtacaaccaccgtactcagcaagccacaccaacgatgcagacgtgcaagaggaacacaaggacggtttgtggctattgcataaaggcggttgtaaaacattttattgagcaaaacagtaaaattgttgagtaattaaagtaacattaaatctcaactgatcaacgctacaccacgttgaacaggcccaatgtggacccccgtttttataacaggaatcaatcgtgtaacagtaccatttccctggatcaagtagtctggtacatacgagttcatagctgaaataccaaatacacatacacgagagtctagtgcgaattattacatcataagcccgcaggcatagtcttagatcatcggactgagcggtccggaatacattccaaaagcagaagtagataaggcagcggagttaaggcagcggcacgccattgccacaggcaacgaccgtaactaagacctactgagcgccatcgtcttcatcaccctcctggtaatagtcatagggatcctccgaagcttcatctccggcctctgattaagtttatatattgcaagggtgagtaccaaccgtactcatcaagccaccacagcaacaatgcacatgataggggtattcaaaggatggctatggttcttttgcgcaaagtaagtttt

SEQ ID NO: 58780 - DNA, 3543 bp, Oryza sativa
cacatgagcctcgtcccaacacatgagacgtgtcacggcaaagctttttgataacctcgcattggcagtacccgctccatgaactttacatcctcatgcactctaggcgtacacggtttctagcagtgagaggagttctggcgcacccgggaaggaaagactcacacatgcattaagttataagtatgtttagattctcacatggcagtcctgccgatggcgacaccactgtagacacccgcctcgcggtcctaccaatggctgctccaccgtagagcccctgcctcacacatcaagaaaccattatgcatggatactgcctccgctcagctatctactccgctaggtctatacccatacgagaagtgcggttgtacggggatcgtttcatgcttaacttcatggctcggtccttaattaaccggggacggcactagccttttccggacaccacccaaatcctccgtccgctccagtcgaaaacagttgtttaatttttatttctcctttcataaatcatgtcatcaacatcatggcaatgtggcgctcatgtctccacatgccgcatctcaattaccttcccaaaggtaattgcccaagcatatagcatttgataaatatgagtatgcatgattctaaaatagcatttctaagcaattgtcataattgactagggactcatacgtaaacatggttacgaaggcataagggtaaacaataatcaaggcatggcataatcacaagtaggatgttcataattgcatgcaattttatttgtaaacaaaataatttcgcaattgggatcgacatgttcaaggaatagtgatgacttgccttgctcgtagtcctgcgggtcttgatccttgctcggatccgcaaccccctcgggctctaaaattacgtgcgaagaaatgatttgaattcaattagaattcaaataaaatccaataaactcaaataaaagtcgaacgcgaatcgatctgcctatatcgactacaaagtttgcgaaaccacgttattccaattttagtgtcattcaacctaagttatttcgtgatttagaagtacactcctgaggattcaacataattatttagctcttaataaatctaaactcctaccgcgaattgattacttatagagattaccaaaaataatctataattatattaagttttgcaattctacgactataattaatctataattaaattctaattattctaaattttctaaacctccttattctctctctaattttctatttatttttccttttctttttctctctgttttttttctcttctttctttctttcttcttttctttttcctctccttttttttctttctcttcctcccggcttctttcttcctccctctctcggcttctcctcacctctctctctctcggctcacggcctacccgggcggcgacggcgaccggacgcgaggggagggcggcggcttaccgacggcggcggcggcgacggcgccgcaaggcgtggtgtcgcccggcgcggcacacggcgcggtgcggcggtaccgagggcgtcgacgcggcggcacaaaggcggcggcgcagtggagagggtagagaggaggaggagggaatggagtggggagaataggggaggtggggtttttatagggagagagggaagagggggccggttaatggcgacgcgacagcggcgcacagagctcggaacgactgcgacgcgcggcgacgcgaccgcgcggggcgcaaggcggcgaggggacgggcgcggcgacgggacgggcgacgcgacgacggaacagggctcgaggcgacggcggcacgcgcggcgcggcagcgggatggtgacggcgacggcgcagcagcggcggctcggcgacgcgacggcggacggcgcggtgtggggcgcaaggcgcgagcgcgtggcacgaggcggcgacgggacgatggcgacggcgacggcgtgcggcaacgcgcgacaggcaagaggcgcggcgcggggcgcgaggcggccagccgcgcgcggcagaggagggggcaaggctagggaatcccatcgagcacctagagtgcaatgaatagtgtattttcctatttatccctattttagcctatttcctatataaattttattctataaatcctaatttttgcataaatgaagtgtactcaatatttgtgttattctaaccaatagatacaccctagattaatattacccatattataattttatataatttatttgaatctttaattagggctaactcttattccaacgcacttaaatttaaatttaattgatactaatatggtcgcgataatatttttatttatttctatcctcacctaatctttattttaaattgtattccaactatttatttagccaaattaattttagggtttattcctaattagttactctttattcgcgattaatgaactccgaaatcaaaatccaatgaaataggcaataaaatcggcatgatgcaatttatttaaaaagtttttgaaaatccgtatttttagagttttgattttgttggtcgaattttcagggtgttacacccaaccaacccacctgaactacagtgcattgggtcgatttattaagtgtgagactaatcacggtgaatctggtcgaccgcccataaccgcgggcacggctattcgaatagttttactctgatcagaggtgtacaactgtacccacaagacacagccccacgacatgtttccgtgcgctgacatgccaccacgacataccggaaagaggccgtgaaaggacccttcgcataaccccctctaaccaagcacaccacacctcaggtttaacccccactcctcgcaaggcagcgggcagtcccctctcgtgcctaggtgaatccggaagccgcataggccatcgcagggcccatccaaactccatcacgcccacccttgcctagatgcgtaagctagaggaaagctacactacaagcccagccgttgcccacgctggcttgtggtaagcacgataaattcttccagggtttcccacgaaccggtccttaattgccatgggcacgactagcaaaaccatgcacccacagcccaccatgtagtcgcattttagttggataattacgaccatgaagcatggccagatgtctcgagcacgcagctcattctgatactaaaaagggtctaatactgtaattatcccatcaactgagctagtggtaattaagcatggctaagcatatagttttagctaggtcacataagtaacatgagctagtcgatttattacccaaggttgacaaaggacagatatcaagtaaatatggcacaagcaaacagataggtaatacccagatcccatgtaattagcaagacatgcaattttatttgcaaacgataaaacatttgtaaattaggatcaaaattctgggaatgtgtgactgtaacgtcccgccttcccccaggccgggcccacttacatatgatagctttcataggtcgtaacatgagctagtcgatttattacccaaggttgac

SEQ ID NO: 58781 - DNA, 4206 bp, Oryza sativa
  unsure (1)..(4206): unsure at all n locations
cattaaaagtaaacaaacatgtagagcttaattttatatgaattttgcaagttgagtggcccaattcagagttcgaatgaattagatatgaattttagaagttttgagccatttaaatgaatttctagaattattatttatttattgcgcaattataaattattttctcagaggaaaagggggatgctgacgtcatcaaaggggccggcgctgacaggcgggccccatgcgtcagcgggccaaggggagggtgcacggtggaccacgtccaccgcggcctcgggcgcgccgtggaccaggaccacgccggcccacgggcggccacagggcaaggcgggcgcggccgagaccggccggccgagcggcgacggcggcctagccggatggccaccggcggcggcggcgcaacgcgggcgaccagcgaaggggagatagagggagagggagggatgctcaccaagctcgcgcaacggcgaggagacaacgggaacgcggcggcgatggactcctcggggaggcacggcaacggcgggactccggcgacgtccggcgaaggaggagcggctggggcacaacacagtctgggagagaggatagaggggttaggaagggaggaggaggcgcggtaccgaggggaattgcggccggaggcggcaatggcggaggtggctcgggtacgtggtgaaggggtggtttcggtggtggcgaggagaaaggaagcggtggccgggcttgggattgctgcggtgaagccggtggtgacggtgacacagtgcggcggcggttccagccacggggaacgacggccggagctcgcaaaggcgatggcggctcgggttgacagagggcagggcggctcggtgggggattggaggaacgagacggtggccggtgctcggcttggagcggtgaagccgatggcgcaagcggagcgccgcggcgacggccaggncgccggtggcgcgcagccggagtcggtggaggcggtggagagaggtggtgcgcgtggcggcggtgcttcggagacggggaggggaaatggagcggatgccggggtgcggtggggcgctgcgatgctataggtggcagcggcgcagtgcgggggcgacggaagcggcgacggcgcgcggctggagggtcgccggcgtgcggcggcgcacgggaacggcgtggggagctcgagagagcacgcgggagggggcgatgagttggggaaacggatgaggggaggccggggtgcatttttataggccccggagagggagatcgtggccgaggtgggcggcaaccgccggcggagggagctccggcgacgtgggcgagtgaggctcgaacggcgccgatttttggggaaaataggggagaacgtggaggaaggggaggacgtggggtggaccacgtccacacgcgcgcgggagcggggagacgcgcggaggaggcggcgtcgtggggcggctcgggcgtccatggcggcggttggagccggaggaaggggatgggcctgacgggtggggccgtgggtcccacctatcagccaaaggaagagaggggaagccgggtgggggttttctggactttgggggagaggggagccgagctggccgagcggcccaaagaggagaggggagggaggcggcccggccggaggggaaaggaggaaggaggggaatgggccgaaagcggcccaaagggagaagagggaattttatttgcttttctttttaattaattgattacatgatctttgtgctattaaaattattttttgagctccgaaaattcatgcgaaaatttcggagaatatttagggcacaaagagtattgcaaaatattctcggccaatgatttttaaaggaaaaattttaaattctcccattatttcacttgattgaattgacttaacttttatttaatttctaaaaaatatattatttaatgatttttaatcccgaaagaaaatcggggcgttacagatgccgctgtggatgaggaggtggcaccgacgtaccctagaatcactaccacgtgctcatgtggcaaatctgcaccgtggtcgtcgatgcagaccaagctcagccacaaccgcgtggctgccgttgtcgatgccgtgccgagctcggccatgtcagccacaactgcgccgccgccatcgtcaacgccgcgaagctcggccgcgtccatagaagagggagcgagagaagcgaggaagagggagagcgagataagaaacgagtggctgagaatgaggagcgcccgatatttttatttttatcgggcactcaggtaggaactttttcccataaacctgttttgggctgaaagcccatatgtgttttgcaggaaaaatagtactctattttctgggggaaaaagtacaccgaaggtccctcaacttgtcatcgagttacaaaatcgtcccgcaaaaccagttatccagcgtccctcatctatcaaaaccggttacaataggtccttcggtgtgtttgaccccggttttgacttacgtgacggctgagtcagcgtgggacctacgtgggccccacatgtcatgctgccacatcaccctcctctctctctcttttcccctcttatctcccttcctcatctctctctctcccttctctgacagccgccggtgggaggatgagggtgtcggcggccggcgaggggcgacgcggcggcagtgatgacggcgacgagcgacgcggcggcgatgggggagaaactgcaagtgggcggcgaggaggagcggcgcgcgggcggcgaggatcagcgcgcgggctcccccgccagccgccgcccaccgcccacgaggcccacgaggcagaggaggaggcggcgagcggcacggcggcgacgacacggcaaattacagaggatatcaccaaggtccatataaacaagataatcaccaggcaaattactgctgctgctgctacttcaccatttgtgcatttcctcttctactatcttagctgcagctcgcacgctttgagtacgtgcattgttcaactgccatttctctcctcaattcaaaaaaaatatattcacctttttctcattcgagctaaaccatttcgatcaatggaattcggacgatctccagcccttctactcctcgttggtaagtccgagaaactttcaggccggttaactttaggctgttagcacacatcttcttcattcttcaacaatggcgtgtctcaatgcagggttcctatggtcacagctgcagttcggcgctgaggcagccggcacgacggtcttcacgctgtgcaacaactgcacctacaccgtctggccgaccaccttgtccggaaacacagcggtcgggggccatcgggggcggcgacttcaagctatcgcccggcgccaacgtctcattcccagccccggatggttggtccgaccgcttatgggcgcgcacggactgtgcaccctccggcaccgcgtcccttgcctgcgccacggggtacttcggcggcgccgtgagctgctccctcggcggcgcgccgcccgtcaccctcgccgagttcacgctgggcggcgccgacgggaaggacttctacgacgtgagcctcgtgggcggcggccgacgggggagtccgcgcgccgctcctccccccgccgcacgcgctctgctcctcgccgcccctccccgccgcccacccgcagcttctccccccaccgctgccgcgtcgcccctcgccggccgccaacgccctcctcctcccgccggctgagtcagagaagggagagagagatgaggagagagacaagagtggaaaagagagggagagaggaggctgatgtggcagcttgacatgtggggcccacgtgggtcccacgctgactcagctaccatctaggacaaaaccagggtcaaaactaccaaaagacctattgtagttttaatagttgagggaccttcagtgtactttttccattttctgggtcactcagcgagaatgaaagcccacctaattggtcaggctggtctctttcctttcatccgatcagtcacgcggccgttgccaacttgccgtccacgagagcaagcaaagcaacttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58782 - DNA, 843 bp, Oryza sativa
tccacaactggctatgtaaagaccaatgcatgtagcccataatgagtagacacgtgaaatatcattggaacatcaggatccattagaagctaactggatcaaacataaaagataggaattaactttaaaaaaaacagcaatagaaacgcaaaaggtgaagcgtactaacttctccataaattgcccgttcagatagaagagggtaatcactagcagagacaaaccaggatgaacaaatctgctctttaaacttatgcatacgtgatagctttgaaataagtgaattgtcctcatgtttttttttcccacagagagaacacaatccagctagcagttctacgattaatagatttatctcttgagacgacgtcttgttaccacagcgggtcagtggctgtaaagtacagagcaagctatactttaacctgcaacaaggcacaaaatgcagaaacatggataagggacagctgaaaaggtaactaaacaagattaggtgaaaatacagaacactcatataattattgataccaagaaacttactgcacaatcttggattataataagcatatctgacttttcctctgccatacgagaaacaaggccaggataccacgggccaaaaaatatgacatggaatacgatcaagaaaattagagaggagatataaatgttgaggaaaagagaaaggctcatccgtaaatccaaccccattgactgaaaactggggagatggtgatattgctgccaagaatatccaagcagtatacctgtatcagagaacagttttagagaacaaatatatcatgtttacttaatttacctgctcccagactcacagaggtc

SEQ ID NO: 58783 - DNA, 1181 bp, Oryza sativa
cgtggctctacagcctggcccagcccccgctcctcgcaccgcgcaaggcgcggacacaattggggggcctcggggtggcgcgtcaggcccctcggggtgctatgtcagcctctcggggtgccacgtcaggcccctcaggcccttgccctgcctggacccaaggcccttgcccagctgccatgtggcgaggggggaccaggctaggcggtcattaatgggcggtgccccaaccgtccctcgaagcatttagtgcggtcagggcggacgtgtggagccacgccactggcccgcctcaaatcgggcgtaaccggtctgtgaccggcctgtcaccggtcacatccgattgacgcgcggccatgccccacgtctcctttgtccccggtggagtggaggtagctatgtattgtcacatcaggggcatcatctggactcctctccacgagaggagggcagccaccggtctgcgctcatttaagagcgaatgacagggctgcccccccacccccccccccccgtgtcaggtggaggacggcgccgggccccaccaaagggccaaccgtggcttggcttccgggcgaaggcattcgctcgtttaagagtgaatggcagggctgtcccccgtgtcaggtggaggatggcgctgggccccaccaaagggccaaccgcggtttaacctccgggcaaaggcacgggccgcggattggccacgggagggtgcccccctcccttctccatggaagagtaggtagaggcggtgcatgtggtatccccttagactataaaaggaggaccgtgcccactaaacaaggggggatggttttcttgaatgaagccaaggcaagctctagcctcaagttggtgatgtccttggtgcagttctagagtcgatcaaagtagaataggagagacaagctctctggagctagaggaactcttgtacttccgatctatattcccacacacaggagtagggtattacgcttcgtagcggcccgaatctatatatccctttgtgcttgtgtaagctttagtggctttaaccgcggataatcgacctcccagagtgcacctcctcctccggccgaactcacaaaaggggatctcacgatctcccgctagagaggattactcctcgacagcgtcaaatattcatgatcggagggagtattatttagggcaat

SEQ ID NO: 58784 - DNA, 1255 bp, Oryza sativa
cgaaaggcgtcagctcttgcagcatccggtacgccggcgacgaccagttggccgccggcggcgacggcgacgacgccggcgtggccgcacaggagatccggagcttgaggcatcgggcgaagtagtaggccaggtgatcacccgggcttgttgcttcacagcttcttctgccggcgatgtcggcgaggaggtcgtcaagcctcgacatgatcgccgaggcgtggacagcgtctccggcgtccacggccatggcgccggcgaggagaaggtcacctgcgctctcctcctgggttgccaccacgttgccgttctcgtgccctgccactgctaatctctcatcaaattcaaagctagctgctaatggatcagcattggggacagagaaatcatcttgcagttgcagcaaatcattagcagattcttggattgccatcatttccaagaactcatgatcttgatgaatctgatcgtgagagtgatcaccatcaaattcattagcagattcttggatcaccatcgtttccaagaactcatgatcttgatgaatctgatcatgagagtgatcaccatcaaattcattagcagattcttggatgaccatcatgtccaagaactgatgatcttgatgaatctgatcatgagagtgatcagcatcaaattcatacatattggcattctcatgaggattttcttctgcttgaggagaccataggaggaggctactgctactgatctcttcaaattgtgtggagaagggaatgagaagggagcaagggtatgacatggtctccattgatttgttttgtgatttgagctgttaactcaacatgaattgcatatgctctggtttatgtggttttacacagtttatgtagacaaggatgaagcgggtgttaggaccatttctgaagataggagtgaaataaatttatatgtgtggacctaggatcttcatggctaatgtaagctgatttgtctgatcttgaagccccaaatgggacattcatatgacaaaggttctttttttgttgcctttttgtgtagttccctctaccaactttgtaagatatgtgagcaagcaatcgtgccaatttttctgattgattagaatgaagtagcagaggaagtgagcgtgtgcatgccaggcaatattcctgaatgcttgttgctagatgtcagcatgtggtttagttttgaatcatatgagcaaaacgatttatgcatgattctacaacctgtggacaacggggtgcag

SEQ ID NO: 58785 - DNA, 1011 bp, Oryza sativa
tgtggttgaagtttctcaagtatttgatcttcgttgaaagcatttgtgcttgttctcccttgtttccagtttaattctagcttccttaatcgggttttacttaatagttttgcttcagccgcttcttcttttgtgtgtacttttcaaggttatcaattctaagctctcttagctccatcagataacctagttgctttagctcaaaaccaacatcttttctattgacttgaaatccttttaactcttgcaaaaattgcagttttccaacattagaaatatttgagtgtattgggtatcccgggacaagaaagttgtgcaattttgcaaggttactaatgtctccaggcaaatgaaaacaattatcccatttttccagatccaaaatccttaaatgataaaatctggaaaggttaattggtaaatgaaagttattgccaatggtggtccctagcctaaggtaccgtaggtggacaagtgttgtaaattcatccaaaatggaccccaccgcaaatggcattttgggaaaataaagcacacgaagagcacttgcttccttaaacaaatcatgaaagcatccaataaagcttttatccacttctccaaatatcatcaaagtttgcacgttttcaacctttagtcttttctttagttttatcagttcactcttgaagttttcatcagttattccatcagtatcatttgcgccatctgtgatgatagataagtgacgaatggatggccggatttccactgatttcacattagaggaatgtaaactaacacactcaagagatgcaactttcaatgctagattatgtagcagatcatgaataatatagcatggatgcccatcagtttcttctcttttaaaaaatccatgactgaccaaactatctatattgcttagagctatatcttcaaatgctttattttgagattcggaatgtaaaatatctagtcctatccaaaagcgaatgagctctttgttgttgaacttgtaatcttcgggaa

SEQ ID NO: 58786 - DNA, 730 bp, Oryza sativa
cgttgatttccctttcacatggtctctctcatcgtgcacacagccataatcatgatcgcaatcatcaactagagaagtcgagaaacaaaggcgtttaccgatagcatggatggtgttgtgtggcgaaccgcagcatgcagcggtaatggaatcaccaggcccgttgttagtagcacaagaagagcatgatgaagagaatcccaacagcttgccagccgctttggccgtgtggtgagcgttgaggaagaggtcgctgacgcagcccttggcgtgctcagcagcggcctcggaggtgtcatcgagctcgtcctggatgcggaagtagtcgagctcgtcgagcacgtcgtcggcattgtacgctaagtcccgcagcttctgcaggagctcgttgaggtcggtgttgtggatctccctaccgcgaacgttgttgagcatggcccgcgcgtagagcagctccatcttgagggcatccacattgggcccgagcttctgactggccgcccacgcctccaccaagccgtctaacacagggttcaacgccttgcccaccacccaccgtgccacgatgatcccggtatccattgatcgatcgcgtggttgtggatgctggtggtttcaaggcaagatagatgtatagaagtagtagatgcagctgcctgcaataagaggaaggaatccatgcaattgatcagccactcgatagtgtcatactagtgcttaattgtactac

SEQ ID NO: 58787 - DNA, 1021 bp, Oryza sativa
attagagttttttctcgttttacgtgcgagcgtgtagctctcgtcgtttcggaagatcgctttcatgaggatcagagttcggaaggttgttgtgaagaagcaaggcaagtcactgtaacatcccggcctagggcttaataggattaatagaatacttatatcaacaagttgcaacttcttttccggaagccaatctccaaagaacttcagggttaagcgtgcttggcctggagcaatttgggatgggtgaccgaccgggaaattcttctcgggtgcacacgagtgaggacaaagtgtgtagaaaagacatgtgttggcctgtgagggcagtctatgacctatgaaagctatcagatgtaagcgggcccggcctgggggaaggcgggacgttacaaaatggtatcagagccgactctcgcggtttcacgggcgcgtgtgtcgcagttggacacatggacgtggccaagagaggacgttcctggcctagggttgatcgacgggggcgtcgatctctcttaagggggtgagggtgtaacatcccggcctagggcttaataggattaatagaatacttatatcaacaagttgcaacttcttttccggaagccaatctccaaagaactccagggttaagcgtgcttggcctggtgcaatttgggatgggtgaccgaccgggaagaattattcttcccgggtgcacacgagtgaggacaaagtgtgcagaaaagacatgtgttggtctgtgagggcagtctatgacctatgaaagctatcagatgtaagtgggcccggcctgggggaaggcgggacgttacagtcacacattcccagaattttgatcctaatttacaaatgttttatcgtttgcaaataaaattgcatgtcttgctaattacatgggatctgggtattacctatctgtttgcttgtgccatatttacttgatatctgtcctttgtcaaccttgggtaataaatcgactagctcatgttacgacctatgaaagctatcatatgtaagt

SEQ ID NO: 58788 - DNA, 2114 bp, Oryza sativa
cctgcattatgtcattataacctgtgtcttctgcagctttgagacactgtcaagatcatcataattgagagactcaaggtcaagcatatcttcaccgccatcctcatccatacccactgcctcagcattttcttcttcctgaaaattttgacgataaatgaacaagctctcaagagtatcgcttattaaatctagttgcatggcagaaatagaaataaactcacaggataggcttcattgtctgacagttcatcaagatctgctaagaaagaatcagcaaggcttgcctgcgaagtggcaccaatcagaaaaaaaaaaggcgaacaagtgaccacggaagaaaagaacttgcaaaccttaaacagaatatggatttagcacaagctactatcaagcagttagaatgtactcaccatgataactcctgctccaacttattgaggaggatcagtacacctgattcatagtggttatgtagtcagtggcactgtgcaaataaaaagaaagatgtagtaagcggtattactaccaaactattattgtagaatgaacattggccactataaatattagtgtaagcaaagttttgtgacacattttctaatttacaacacggcactccaaacagtaaagcttttttgggcagagaaatacgaagtacataattaaacacttaattaaccctttgttcttcggtttatcgatttggtctgcaatgcggtttcgccaaaattcagcccttcggcaatcctaaaattatgcacatctagcaaggggaggcaccgaggcaggcatgagatgtccaaccgaggattttaaaaaaaaaatagttaagaaactataccgctatacttcgcataaaataaatccgctaaaaactgattggtttcgagaatccgtaccataaacgaggcccgattagatttatcacagcaaaataatccaaacagagtaggctagggttcgtcaccaacgacaggaacaaatccatccgactcccaacggatctcaattccacacccgcccagcataagcaaggtagaaccgaaccttcgtctgcgtcgattgatcgcctctccgccgccgccgctgccgccgcagccgcgccgccccgtagcgaggatgagaaggagaaggaagaggacgttgtgtcgcggcaaaggtatgtttggtcttttctgaggttgttccgcaaaagtgcatcatgcgcaatatacacgaaggggcctttctgaaaatttaccaatgggcttgagaaatccatgggcccacattaattgggccgaatgagaattgggctcgcgtcaagaccacaatagattgtggttgccctcgccatcgccggcgaactcgctcgcccacctccacctgtgccgccggcggcgccggctctccctcccgccgccggcatcttcgcgctcctccgttctcggtccccgtcagcttggttcgcagcggtgtgcggtggcgtgaggacggggagcggtttctcgcggggcccaacggtgcctccggcggcggcaacgagtccttcctcttccaggtgtgtttatctgggacttaggatgcatgaaagattgtcttctgtttgatttgcggcgcagcagacgatgagagaccctcgcctcctggatcctggtagaagtgaatactgttagtatacctgaacaagaataggggtagagtgtggatagtactagtacggagttattatgttgattaatgggttagaaacttagaatgctgagttctgtttttgctcggattcatatagtcttcattcttcaaccttctagtatcatgtcatgtcaaaatggtaaacttgttcttttgttttaatgtgaatagcttacattacaacattatcggggaaaagggtgggaaatgttgtaagcagaagctttgctttcccttttttttttcctatcgccacttatttcagcttgtgagtggtcgtgttctaggtgtggttaaatcgtgagaaacgctcaagggtttttttggctagctccacaaggtggtgggctagccggcctgggtttgaagcctcacccttctatttatttaatattaggtcattccctaatatttgcgttttaggtgtggtcaaatcg

SEQ ID NO: 58789 - DNA, 4236 bp, Oryza sativa
  unsure (1)..(4236): unsure at all n locations
tcctgcagcccgattttgtcgatgaggaatcaggaagtgatactgatgaacaagccacagaagatgacttggaaatcatggaaccaaaggaagggatggcatttgccagtgtgaatgatgcttttgtgttctatgagagatatgctcagaagaagggattttctataacaaggagaatctcaagcactttccaatccttcaccttcgcttgcagaagacaagacaacgctcaatgctcctcaaacaatgcatggaagcatcatcagaatgaatgtccagctaagataattgtggatcttgatggtcctgacgacaaattcttcttatcttcagttacgcttgagcacaatcacgatctcagtccaagtgaaacaagtcgaatggaagttttcatatgtaacaaaaaactgattcgtgtgctaaaagaagaagggtgtcaaatgggagagcagacaatcatgccaacaagaagtccagtactccttgcttgcaagctgaaaatcgcccatttggtcaaaaggatcccatgaacaatttgcaattggaaagaaaactgaagctcagtgatgcatataggctttatcattacttcttctgcatgcagttcaagaatcctagctttttctatgctttggactttggcaaggactcctgcctgagaaatgttttctgggcagatgcaagaagtagggcttcatgtaaatatttctcggatgtcgtgacagttgacactacatacttaatgaacaaggagagcatccctcttgttccttttgttggtgtaaatcatcacaggcagccgattttgttgggatgtggactactatcagatgagaccactgtgacctttctatagctgttcaaatcctggctagctatgtcaaataagccaccagaagtcataattactgatcagtgcgatgcgattcaggatgctatcgagaaagtttttccacaaacttgtcatatatggcgtttacagtctgtcatgaagaagatgcctgaaaatctcagtggattctcaggatttcaaagcattgaaaatgctttttcaactgtggtacataattcattgacacaaactgtttttgaaaacaattggagtaagataattgacaagtttggccttcatggcagaagcgcatggcttaatatgctgttctgtaataggcataaatgggtgcccacttatgtgaaaaataacttttgtgctggtatgttttgcacacaaaatagtgaaagcattggtagtttatttcatggatacatcaattctaccacaacgttggacgagtttctggaccaatataataaaacaattgtgggcattgattgtaaggaaactgatgctaactggaaatcctcacatgaggttgtaccatgtgtcacccattatggcattgagaagaaattccagaaggtttatacaaataaaatgtttgaagaatttcaagagcagctaaaaggtaagatgtactgttatccaactcttctgaaacaggaaggttcggtttacatattcaaggtgacgcaagatgttaaaattagggagcaacaatgtagcttggatttcacagtgtggtgggacagagatgattgtgatggaagatgtaaatgcacatgccgtcatttcgaattccggggaatattgtgtagccacatcattaccgtacttgctctactgaaggtcaaaaaagtaccctccaaatatgtattgcagcgatggagaaaggatatgattcggagacacggtaccattactaactggtcctataatgagatggtcgactcaccggttgcacgaaggtttgatttgttatgcaaatccttctatgaagtggcagagaaggcagtggtatcaaatgaactgctcatgttggtgctggatagtgttgaagaattaaaacggaaggttgatgcacatacagcgcaaaattcatgaaattcaggtctctaatccttcacagagcagaccatgaggtgtgatgatcatgaagctccctttctcctgacacgaacaaccgacattttcagcgtccccatgtaagatatctttcttctagctgaaacatttcgaggggtaatgaaactactgatttcaatctgtaatctcggtgattgatatgtgtgaaattattgatgtgaagttacgttctgaaaatgcgttcccttataaacccacctttaaagcatgattattgttttctacatacttatcatggcttagcagtcaactatccagctggttgcaaaagaactactaccagtagtaccaaatggtttggttaatacacgcaaaatacactttggcatctatncttagtttttgctctgaagcatgagttgtttgctacattttggagccatttccagctcattttggggctatttttagcatgggttgtttacagttttaacctcaccaaatttagcttgttcttggattagattctcatatatcagcgagaattcttcactttggacttgcaaatccctcagtttgccggctttggaattccaaagggaaagtcacgatgagatccctcttctacgtgactttcctggccattttgtccataaacgtccattcctctgcatgcttgcgcctcctagctgaaactccattgccggtgatcccaaatggccagccaggagcaccggcgccgccccctccggcgaacattccggtgaacttgccggccaacgtgccaccggagatgccagccaacttgccggccaacgtgccaccggagatgctggccagcttgccggcgaaccttccggccaacgtgccaccggagatggtggccagcttgccggccaacgtgccaccggagacgctgtccaagattccggccaacgtgtcaccggacgtgctagccaacttgccgccggacgtgctggccaagctgccggcgaacgtgtcgccggagatgctggccgacatgccgccggaggtgctggtgaacctcccgccggacgtgcagaagcagctcccggccaacgtcccgccggagaagctggtcgccgagctcgcggcggcggggaagaaccagccggcggtcgccgccgccgcgggcatcccgcagatgcccaagatgccggacttctccggcttgaccgacctgtcgttcccgccgatgccgtcggcgaagatgccgtcgatgccgcacaacatcacgctcttcgggttcgacgtgcagatccccgagttcatcaacaagatggtggatgaagaaaccacttaagcttgatcgagcttggcaatggcgatggcgtcatcattgcctcgagtttttgtgacatggttggtggtgtaagttgcgtgccattgttgtgacctgtacagcttaatttctctgaaaagaagttgtttagatttttggaggaaaattagtatgtgttgtgtgtgggaatatggactatggtttgtggccgtgttgcatctttgctcatttgtgaatctccaaaagtatcaagggattgccatttttctgtatcttactatggttgtgtttagttcaacgcaaagtttggattttggttgaaattggagatgatatgactgaaaagttgtgtgtgtatgacaggttgatgtgatggaaaagaactgaagtttaaatcacagcctataacgacttcttgaattcgttcaagaattttatgacatataatgcgcgctgatgtaataattcgaaatgcaattgcaatagtaatatgaaaaaaaaatcacaaaacgcgcggttccctgtaaataccaatagaagtctatccgtttgaacggcgacacatctaaaatggaagaaaaattacttttatcagcctctggtccatttattttctaaaaaaaaaatctttgttaatcccttatccacttgatgttactgctactcgtcaccagatgtttcataggtccaactaggggaaaaactgtttagatagtttgggacagagatgggatacttgtttcagatgtcttaaaaattactgccagttttgaattttataattaatttataattttttttcattgtttttatattaaaccatggctttcaaatcaggagtaaaactataaaagtattatcttattttttttagaaacataaaataaacgcaagtgctcgcactcacccatacaagcaagttcgaaaaacttagtcggcgagctatgtttacttcgctataattatttgttttcagtcatgtatcttcatcttatacataggagctgga

SEQ ID NO: 58790 - DNA, 2753 bp, Oryza sativa
  unsure (1)..(2753): unsure at all n locations
gaagcccctagctaagtatatatattgttgtttgttacaatagatttgccagggtgttgtaggtcacattggttggcattgatttagtacaagcaagcatatatatatgccatgtttgctggtgccctgcaatgtggctaagttttacttgcacattgtttggtgccttaggcaagttatctatgtttccgccatgcatgttatatacccttttcatgatgtcatggatttggttggtcaacctttttttatcacttatgtatttcctgatgtgtagttcatgtattaacagtggtgtcaatgttgaatgtgtgtgctgccaattaatcatggaaaatatttttataaaacacacagaattgcttatgttttgaaacgggttagtagtaatatagctgaatctggaggaaagataggtgtacgtacacaaattaaggagccgtccggccggagcgcacagtggaggtggacggcaacgtacgtagcgcaatgtgtcgatgtgccccctcgctcgctcgaaccaatcaaccaatctgatgaaataaactgtcattctggtaacagtaacataaccttttgcatgtacagataggaattctaagtttgcgtttatatatcgcctccggtgaaacgtgctcgatcagaaagtctacgccaaattaaaggtttagaaaaattganacgatatgacggaaaagttaaaaatttaaagaaaaaaattggaatctaaacagtgccaaggtacagtgattgaaaaaaaattaagcgactcacggttaactgcagcaaccggagtcgcagccgaagccgaagtagcagcaacaactggagccggagaaggatggcacacaatcggcagctagcgttgatcgaccaagcagcgaaatgaatagtgcagcagaacgtcgacacaagaaattgcagcaaattttatagatgcagaagaagagaagggggaaggcaacggtcggtagcagacgtgcagcgaagggcaaagtgtccgattccaacagcacacaccaccgcgcaactttcaccgtttctcgagaatttaccctttgctttgatgaaggggcggagccacgtgtaggatagcttgagcttacacatgacaaaaaagaaaacaaaaacaatgataaaacactaaactttagataaaatttaaacaaaatgaatataaaactacatgggtgatacctactcttgataccttcctgcctccaccttgttcaagtcagtaagaatttaccctgtttttgtcgaaatagtttaggatatgtcctcctcctacgtggctatatccttattctggtatttttcttttctggttccttctttcaggccctttgaatcataggaataaaaaaaatagaggaataagaaaaacgcaggattataataggaagnnaaatataaaacaaaagattgcaaaacacaggaaaaatacaggattgatcgtttgattgggttgtaggaaaaacgcaggaattggatgaaagagatagactcaaaggaattttccaatagattgaatctcgggctaaatttccttcaaaacctacatgcaataagtcattccatgaaaattgtataggatttggaaaactccaatcatttgaattaaagggcgaaataggaaaactttctataggatttcaatcctataaaatttctccccaatattttttaaaaaaaaaaatttttccccccctttttttttttgggaaattttttccaaaaaaacggccccttaaaaaaagggtttttttttttttaaaaaaaaaccctttggaanaaaattcccaggngttntttgaaaaataagtttcntttagggtgcttatttgtaaaatatattttcaaaaggacataaatataaaaaatccaaccctggttactactacagcgacttgttaccatacaccagttgtcagttggatagaaccagtccaggaacgtgtggccccctagcaggcaaataccgggcccacatctcagtcacaagaaggcaccatggcccacctaataattcccctccccaaaaatcggttgctcctttgcctaatcactcaattccagtaactttcctctcatctctcacagaaaaaacattcctctcatctccaatcagcagctatctcccttcctcatcaccagcttgctgtgatcttatcaggcctttttgttgttctgctggtcttgctcggtaattttttgctccaaatccatctcctttctcttcttttctgctgttacccgccgtatctttgctttaccttcttctttttttttcttttttttttttgcgaatccatcttgctttagtttgttgttctgttccgagtaaaaagaatacccttgatggcctagtctgaccaaaaaggagtgtgaagctcttcgaaaggaaaaggtttagacaatacgagcctcagatgctcggttgcttagtcgatccggtggtgaatcgaacaatttaattcactgatgctgttaatctttttctttaaaagaaaattcctttctgttattggtggtattttcttcaacataaacatatatctgaagattcttcagaaatgatctgaagtctgaagatttcagcgtggcgccttagctgatttattgtaactgtgatgaatatagcagcgttgactgggtacagtacaattacttgcacatcctattatgtagaaacaagaaatttgatgaatataacaaggaattcttaatgtttatggccttaaatcagctta

SEQ ID NO: 58791 - DNA, 3895 bp, Oryza sativa
catgtgttttgcccatgagagaaattgggaaaaaaaataaaaggtgatttgtgattcttttgttgtttctgatatgcaagaacaaagggctggtttggttttgtggcataacttgagcttaccaatttttgtcaatcctaaattttggcaagttttagcatgactaatcttgacaaggaaaagttgtgtttggattgaagtcaaaatagcctaagttaactattgaaatggcctatttttctaggctaagcaaaaatttaacttcaaaccaaatagaaaacactattgaaattgccaaatattagtaaaggctaattcaggccacaaaccaaaccagcccaaagtgtagaaggtggattttggtgacttgaagttgtttccacaggccgctattcagcatgggcctccactcccggatacctgggctgaggcccgtagtggcgaaaaccaaatgggccatggtccatgaattttctgtgggctgggcctccaggcccattagaaggtgtaacagcttcgttccaccatggcgcgcatcggcgcatgcaggaggcgggagggaacgtgcatggcggtgtccctccacgtggatgcaccgtgcgcggcggccgcccgccacgtgggccggtgggccggctcgccacgtcggacgccacccaccgtagcgacgatctcctgctccatgcatataccggacgtgatgatcaactcgatcagttggactaattatctacgtcaaaggcagtcaaagcctgaaaatattcatgaggcagcattatttaatatatattttgttactaattttactttgggtgggtgtttcgttttaggccaccatttaaccattgtttttactttaaatcgggtaattttattttctttaacactttgggtcaccctcaactccttaatttatcaatctaaattcaacttgccatgtgtaaaaaaagatctacaaacagttgaggaagttttattgacgagtataagctgttgtaccattcatatgcttgagaagagagttgagttagtccaaaggctagattacccgatccaaagtgaaaacttgattaaatagtgatccaaagtaaaacaccggcaataaaagatgatccaaagtgaactttactgtggtgtataatatgattcgacaaaatgaagtcaccatgcaattatctaaaagagaacacttgcatgtcgtgaacattcaaaggcacatgtgctatatatatgcttgcgacaactatataattaactatgtgcatatatcttactatattatatatctatacatgcttagacttgcacagacaatccaaagccatgaagccacgtcagagttggacgacacgtgcatcgatccatgtcgtcaagaagaaaaaaacgaaagggagctgctgggtatcaatcaaaaaagaaaaaatcaatgtgctttgatagcttttagctttgcagacactgtacgaaaattccgtagaaaaattcgatcactttgttatcgattcgatcgatcgatccgtcggatctttaaatttccaaccgcacgatgacgatggagaactggagatgattaggtctcctttatactccatttgtttaatactataattcattataacttttttcttgttatacttttttttaatttgattaaatttgtaaaaactagcaacatttataacactaaattagtttcattacactgaatatatttcgataatatgtatgttttttgttagctaaaaatgttactttattttttataaatttggtcaaatctagaaaggttttgctaggaaaaaagtcaaaacaatctataatatgaaatagaggtagtattgacttttacatgatatataattaattttctcttgtaagaatgccatttagggtttgttgttggcgccattgcttttgggaacctttgggagtttattagtggttttttcccaccctccccggcgttaggaggtttacttcttattagctaactttttgtttattttcttgtgttttgatttttttttcttgtccccggtaacggctttctgtttgttgtgttgtgtaactaaacattttctttttttctaatatatcgacgtgtaattgttttgtacattcgccgaaaaaaaacatacgtgagaatgttcactgaaaagaaaaacagatcatgtacgtattgcaagtaccggtttttctcctctaggaacattctcgtcctctcactcccttttaacgtggcatacacgaatgcctctcaaaaataaatcaaaaccaacgatttattttcataaaagaaactaaattaaaaaatcgatcgcagggctccattacttttctcgatcgtcaggcattcgtgtatacgccgtcaattaatagatctccatatatcttcaagaaacaatgcctataaataactagttctacataccacagctcactcaactcgatcgaccatatacatatagaaacactttcttcttcgtcttcctcgatagccaaaatacactgtgcttggagatcatcaatggcgatagcgaagagcgagtgtgagcgccttgcatgggcattgctactggagagcaacctcctcgtcggcaaccgtcgcagcaacggcgacgacgacgacgacgacgtcgatgtggctccagctgcctgatttaattacggatataatatgattattactactgatcatctagactatattatgatgagtataacgatctctacgttaataagttctgcatggtctaagagtactcatctacatgcaaatatgcagcactttcaattagtcctgtaataggtgatcactgtggtgagtgtgcagactgcagaggttttgctgtgtactagctagttagctactcgtactaattattcgatgcatgcctttatctattaattactcctacttacttatgtgatatatatagttggcaataaagaggcatggtatatatgaatatatctggagtgctatatatataatgggaaacttatgtatatatgcgcaataactctaatgtaacacgacgtgtaaacatatggtttgtcaggtatgttaactatatatatatatagagagagagagaaataataatttagacaaaatttcatgctcaactactgtactagctagctagtggagtattatattatacctcttgtgtattaattaaacattagtgtttctgttccgtggaccatatatggtagtgatggattttgggggtttcagtttgttttcttccaatagccttcggaaaaccatatccgagcactttcatggtagatgacctgagtaaaatatatgtactttcttttgccgaattaccctcaattataagtttggaacacatttttttctcccaacaatagcctttggaagacagtatatttccacttgatgtacatgactagaaaatttaaagtgcatgcatgagatgagaggcctttgattgttcagtcatattatttcatttcgcaactgatgagacgatatgatattgacacatgatatgtaattatatatagagctatatctaatagaaaattcattcttaaatcgaagttcctgttcctgtatcaacggtttgctggtttgcaaagatggtatatcaacatgattatatagctatatgttatctaattaatgctacttttaacatatacaagttaataagttatttgtgccataaaatcacacatagaaagctagaatgcctcactacaagtataatattgatcttaagaaaatatatattaggagcctttatgctagacacggttgtacctaataagagaaaacttgtccagccaagctaaattgtcaaataggtcgaatattttgcatcctgcatgaagaaagctgcagaaggggttttcagct

SEQ ID NO: 58792 - DNA, 1136 bp, Oryza sativa
gctaatacccttgctttggccaacaaccaatgtcaagtttgtcaactagtaatcaactaatcttgatcagatcctcctataaattgacgagaaacatgcagtattcaaatcatcaagcagctcctggttttgcagctctagctattgcctagcaagctactagccactgctaatcttgccatggcttccaattcggttctcttcgccacggtactcgccatggccgtcgtgctcaccggcagcagcagctgccaagcggctcgcctcctcgccgacgcaacaccgcctgccgtgccggcggtcaccttgccaccgatgccagccattcctgccatcccggcggcgacactgccgccgattccggcggtgccaaccgtgccgaacgccgcgttgccgcccatgccggccgtgcccaaggtggcactgccgccgatgcccgcggtgccggctgtgcccaccgtccccgcggtggcgctgccgccgatgcccgcggtgcccgctgtgccgacggcgacgttgccgccgatgccggccgtgcccgccgtgccgaacgccgtgctaccgcccattccggccgtgccgaaggtgacgctgccgccgatgccgtcgattccggcggtgcccaaggtgacgctgccgccgatgccatccgtgccgatgccgttcttggcacctcctccttcggcataattaaggacgctgccagtgcttgtatatttagtgggtcatttgatttgattaatcttttggttatgtattaatttcccctgcttgatttgttttctgtgtgtaaatgcatgttgtatacttgtatgcgagttaattttttttgtaatttgttcaagctgtacatggagtgcgcggctataagtatttgtatatggcatttgtttatataagttcattttggttggtttaacttctgttcatatttcataatggttgtattttgttgcatatatatgtcttttggtaacttggatcattaattgtatcaaccgagatgtgtgggccggtattctaagacgaagtacaataaaaatggttcaacacaataaagatgactcaacaggctgtatatagaaaactacatatataagtaaaatcctacatagatttgtactatctataaaaaa

SEQ ID NO: 58793 - DNA, 2376 bp, Oryza sativa
ccgtgccgaaggtggcacttccgccaatgcccgcggtgccggctgtgcctaccgtccccgcggtgaccgtgccgccaatgcccgcggtgcccgctgtgccggcggccacgttgccaccgatgcccgcggtgcctgcagtgccggcggcgagcttgccgccgatgccagccatgcccgccgtgccgaacgccgcgttgccgcccatgccggccgtgccgaaggtgacgctgccgccgatgccgtcgatgccggccgtgcccaaggtgacgctgccgccgatgccatccgtgccaatgccgttcttggcacctcctccttcggcataaggacgctgtcgatgcttacacatttattgggtcatttgatttgatatcaagcttttggttatatatttcctctgcttgatttgttttctgtgagtaaatgtatgttgcatgcgagtttttttttttttggaatttttgttctagccgtgtttgtatatggagtatgcttggctataagtacttgtatgtggcatttgtttataaaagtttcattttggttggttaattttacttgtgttcatatttcagaatggttgtattttgttgcatatgtctgttggtaacttggatcattgtcattgtatggtaaattgaatgtggatgttctaaaagcaagtgcaataaatatgacttggcacggtaaagatggtccgatactccgataggctatagggaggaatacacgcaagcacaatcttatatagagcggtgagaaaagaaaaaggggaatatatactgtagaggactttagatttgtagttggttgtagtttgaaaaaagaggagagatataatattttgtgggtttttattgtctagattttagaagataagatagtagtgggcttggttagggtgaataatgactattgtacaagctagctgctatactgcctataggtgatatggaatttggctatagctaccggttagcttattattattgttgttgttgtatgattgacactagatcgagaaaaggtgcgacaaattaaaccattgcagtgagtgtgacagattttcctgaacagtatgggaattgaacttatcgctgtaaacaaattctcgtaaaattcatacaggccagtgtgaaaattctcatttctgatttcttgttcagatcatggttttaccattttcttcctccatgtcgatgccaaaacaatgatagaagccttcttttcccaataaaatctgactggtacaccataaacagttaatgcgtaataatacagcacattttcgatttttttttcccaatacactatatagaactattatgttacacaagaaaccatatgttaccatatatcgattttttttaaaagagaaaatagctctctatatagtgtatatgtggcgacgggccgggcgtctcataaatcagaggtcatcatgtactcaaagttcacataggctgaactcgcatgcttcagaagataaacagtgtttgaaaaatatataagcaccagctagctggagtcccttttttttaaaaaaaaagatagagattttacatggggtcgaaatttaataaaggattagttatatgacggactgtactacataactttttttaaggttttatatggagaaaacctggccaaccaagttataatatttgtcaaacagaggtccagtattttgcatcatgcagattgcagaatggctttcagctgcaagaaggtaagctaaccaactcattgaaaccaattaacctggcagctgatacacgtactcttgctttggccaacaaccaaatgtcaagttgtcaactaatgaattaatctatttgatcaactcctataaattgctgcgaaagatgcacatctttgcatcaccaagcagctccagttttgcagtgttctaactattgccaagctagctagccactgagatctctcagccatggcttccacttcgggtctcctcgccacggtgctcgccatggccgtcttgctcgccggcagcagcagcagctgccaagcggcgcgccatctcgccgacgcaacacctcccgctgctgtgccggtgcctaccgtgcccgctgtcaccttgccaccgatgccggccattcctgccgtcccggcggcgaccctgccgccgatgccggcggtgccaaccgtgccgaacgccgcgttgccgcccatgccggccgtgcccaaggtggcgctgccgccgatgcccgcggtgccggctgtgcctacagtccccgcggtgcccgctgtgccggcggcgagcttgccgcctatgccggccgtgcccgccgtgccgaacgccgtgttgccgccgatgccggccgtgccgaaagtgacgctggcgccgatgcc

SEQ ID NO: 58794 - DNA, 5225 bp, Oryza sativa
gatatcttctggcaccatatatatatatatataccatatatatatatatatatagtactagtacttgccaacgaaatttggtagttacatcttaaaatatagcatgcagttacatatgcgcatgttatcagataaagtattgaacaaatattttagaaatagattttttgttagattatggaaatgtcttcagagaaaaaaaaacatgttgcattattacatattaattgacagaaaaagtatgttgcattattacctattaattaattaactgcgggaaaccatacatattaacaacattaaccataactacaatcctatggagtacatgaggcaaataaaaatcagaggtcattacttttggctgtgtgcactaaattatatatacagagcgtggagatataatcatattccataaactaattaaataataataatcacgcaaatcgtcacagactcacaatccacacaggctagctgaagactgatgcatctgaagatagcagtattaattaatttgcaaaagttataattatctcatgtctagtcaaattttaaattttagtaattaagtagctgcagtcattatggataaaaataacttctagttttactatggatcatactctctccatactcgtaaaaaaagtcgttaggacagtgacacggtttccaaaacacaacattgactttcttatttctacaaaaatatttattaaaaagtaatatatgtatacttttatgaaagtatttttcaagacaaatctatatatatgatttttacattttcaaactcaacaacttgagagttatttatgatttatattctcaaggtttgacttaaacattgttctaaacgacttcctttataagtacagagggagtatatgcaaactttatggagaacactgtagtttactgataccatgctaaaaaaaatagtttaacgaagtacaaccgttcaactgctctcaacctgatgccttgtatgagatcagaaagctagctagcttgtgttgacagctgttctaatgatttgagatatatcaaacttgtcaaaacagtacacttgtgctgatctaatcacatttcaactgtctatctaatcataggtgagctaaccgaggaagaacaatgcaacatattgggccacctctattaccacctgatgatctcttcttcctaaccaataattaacaaatccttgcagatggtttggaaggtcaacaaccagtgtcaagatctgaccatgcaattagctttgtgagctataaatgtatccatacattgctttgcatcaaacaacactgaatttattgcagtagttaattagaacactgaatatattagctgtgctaagtgtagctagctcagtgggcaaagcaagcaatatttcaatggcttccagctcgaacttgctcgcgatggccattgccgtggctgccgtgctcctagcgggcaacggcaacaccggccacgcagcgcggcacctcgccgacacgaccgaggcgccggctgccgccattcctgctgttccggccatgccgaaaccgacgatccccaccatcgtcccggcggtcacgttaccgccgatcccggccgtgccaaaggtgacattgccgccgatgcccgccatcccgaccgtgccggcggtgaccatgccaccgatgcccgccgtgccggccgtgccggcggtgactctgccgccgatgcccgcggtgcccaccgtgccgccgaacactgtcgtcgttcccgccgccgtcgtgccggcgttgccaaaggtggcgctgccgccgatggccgccgtccccaacgttccaatgccattcctcgcgccaccacccaaggcctaaacgtagctcgtttcgccatgtgtgcacgatgagtgtcagtgtgtgtttaatgctattttgttgattgtacgtttttgcatggcgtacagatattttgtcattctttcatgtatgtactgtatactatatatgtgggcttgtacttgattgaattttatggaatcggttgtcgaggtttcttgacaataatctctgaattttactacaattcctgggttgaccgacacataaaaaagaaaattccattcataccataataaagatcgaacaaatttgaagaatacagtgtagaattaatagtactaccttgcaaaattgtggtactacttaaaatagccggctaaacctttctatggatagggttttatgattttctccacataaaaccatattcttttgggctacttttaatattggaatcaaaagaaaacaattataaataggaactagagcatccctatcgcttgccccgtgcatggccccccgtgggctagggatgaaaacggtcggaaataatcggaaacggtacattattttattatttttttcgaaaacgaacggaaacggtctggaaattttcatatttatgaattcatctatttagtgtcaacttcaatgccacgcttacagaaataaaaaaaactaaaatttgaaaacggtaaccaacggtaaaattattattattatattagttttgcggaaacggtatcggtacgatcgggaagtttccataccgttttcacccctaccgtgggctgtgctcggctgggggcacatcggcccccggggtgcgatcccctatgggcggtgcttggggcacatccctcccaccctccctgtggtcggtgcccaagacacctctatcacctcttgggcatatttttttctttttaatccatgtgtgtttttattaagcttgggcctttttccatttttttttctatagcaggccaaatccaacaagatgcacacttggacttcgtaggccacatgcttttttttgttttttccagattgctatttgaatctattttaaaactggatgtacaaagtttataggtataaaattcacatgaacaaaattacataaagtttatatgttcaaagtatttatgcataaaattttcgcatataaattgtttctaggccaaaatgatatgctactaaatttctttcaaattaatatatacaaattttatctatacaaagtttctatatactagtacaaagtttacacgcaacaaaatgtctatttgtataatttatatatacaaatattttgatatacaatctatctataaaaggaaaaaaaaaagaggttagctattggttgtgacccgcataaaacaagaaacataagtgggctctttttctctataagggttcattagcttacctaggaagagaagagggagacctacctgggaagagaagagggaggcaggtagcgctaccacacgaagtagcactgattttatcatgcgatcgcacgtcctaggaggcacatgatcaattgcgaattagacgaagcctttgtaggagaagtaatcttgtgccaacaggtacttctctatgtccacctagactttaggaaagcactaggacttgggaaaccttgcccttcaagcaaataaaaaaagagccagattgaattcatgctaggaatccaccagtcagaccgtctgaacacctacaatcaggccataattcattgtacatttgcactatattaaaataaattttaaggtgtcttaagcatacaagtggactaggaatcaaaaaataaatcacctgtaacgataataagtagatatgcagatgcaaaccgtgctttcattgagtgcatgtaagcaggctacaatgttaccttcttgtagaaagtcagaatataaggctaataccatggtagattgtgagtgtttagtcacttctgcgagaactcatgttctaactctacactcctacgtctgccaagttgtggtatgaatgtgataattttggagcaaagtatttatcgtcatatccaatgtttcattcataaaccaaacatatagaagttgatttctattttttaccagaaatagtatatatcgaaagaagcttttgacaattgagtttattcattcataagattaaattgtagatgttgtcaaaaaaacaaataacaaaagggcagttgaagaacttttatgttcgatctcaatctagaacacggttgagaatattgagaattgagattgagggaggctgttctgtttcgataacctatgtctgcgtgcgtgtgtatctaatgtaatcatatatcatccgtataaccgtgtaggaatcaaattcatagcttatatagtaattttatcatgatgcaaccaccctaagtagcacacgggtgcagtgattgaaatttcgaaaacccctccggcacgcaactatttcgtccaaaattttatccttttttccattttagtcaaattttgatcaaattcaatcaaattttattcaaatttaatacaaaccaaactttgtataatcctcgcctttcaatggcgccatagaattaaacacgctttccatgcatctctattattccacattccctttatttattgatagacattggattaccattaagccagcaaacaaacactaaaccatcaccagtcaaagcactctcaaaacaatattatcatgggaagaaaacgaaattaagcttcaagctttgtcgttgttgtcgttgaccagcagcaggtggtccggcgtgacggcggcccagaactcgccgtcctcctccagcgccgccatgtgctccggcgccagctccacctcggcgtcgatgccgccgccgccgccgccgtcccgccccgggaacagcgacaccttcccgtcgtacttgttccccttgccgctcctcgccgccaccgccttcccccacccgaagtcgcacccgtacatgtcgaaccgcggcgagctgctcacgaacacgccgctcgcgtcgaacagcctgaacgccgacaccgacggcgccgccgccgagcgcgcgcggatgcgctcgtcggtgtgcgcggccaccgcgcggcccacggcggcggccgcccacccgtgcccgcgcgccaggagctccgacgccggcaccgcctccgtcgacgcggggaggatgctgttcccgaagtactccggtggcagcggcgggcggaggcggccgcggctgttgaccgacgcgcggaacaccacctcccggcccggcgccagccgccgcgcgcgggtgacgcaccgccatagcagcgagctcagcgcctggaacctcgtcacggcggccgcgccggctgcgtccccggcggcgaggagctcccaccgcgcgcgctccttgagcgccgc

SEQ ID NO: 58795 - DNA, 2520 bp, Oryza sativa
  unsure (1)..(2520): unsure at all n locations
ggagcagccgccgccggggtgcttgtcggtggtgaagcggccggcgacggggtagtacacgtggagcgcgtcggcgagggcggcggcgagatgtttgacgaggtggagagtggcgggcggtggccggaagaggaggcccttctggatgtagtcggcggcgaggagggacacgtcccaggtggtgagcgggatgcgctcccgcggccgtggccgcgatggcttcaccgtgcgcgtcgacaccacgcgcaccggtggcgatggcggcggcgtcggcggcggcggcggcatcctgaggagattgcgagcgttgggtgctcttcttgttcgatcaagtagagaatttccacctctatactaactcacctctccttaattaatcttgtgtttgtgtgtatatataatctaatcttttgatgagttgctagtgaagttcatttaggctgtgtttagtttactaaagtttgaaagtttggttaaaattgatataatatgatagaaaagttgtgtgtatgaaaattttgatgtgatgaaaagttgaaagtttggaaaaaaactttggccttagacttggtactgatacacgacattttgcaagtcgtcacgtctgacatgagcatgcatgcctgctagtacgttcaagtgttcaactaatcctagagtaaaccattggcttagtgccattagcactagggagtactctaatttaaaagcaataacacaagtacacaccatagcccttcttttatacccctaaaataaatcaacttttgtatttaaagactagcaatcccgaaggccaaatcctaaggttcaaaaaaataaacgaaaggatgaagaggaaattcagtggaaggtgcatgtgctcaacccgatcatttactttatatatttactagactagatttcagatattatctttgacttacaggatggcagattaactcaaatctgatgcagaagattacagatcgatagagtccgtcaactaaaactgtgctgctgcttacgaaacaaatatcaactgcaagtgtaatagctcttcttgttgtttaactcgtactccctccgtttttaaatatttggcaccattgactttttttaaatatgcttaaccgttcgtcttatttaaaaaaattaagtaattattaattcttttcatatcatttgattcattgttaaatatacttatatgtgtatatagttttacatatttcacaaaagtttttgaataagacgaacggtcaaacatgtgctaaaaagttaacgttgtcaaatatttcgaaatggggggagtattatatactccgacagtcggcatggcaaatcatcccaaagctaaacagtccatccggtcaaggtctacatattacatatttcatgcaaaatgaggtggtaataacatatgattaattgagttttaattattacaaaattgaaagatggattaatctgatattgtagaacaattttcatatagaaaattttcgcacaaaacacatcatttaacagtttgaaaagtgtgccacgaaaatctttattttcatcttcatcaacttttgttggagaaacgaacgggactgatcagcatcatcaggctacaactacttgttcaattaactaattgtaagaattaaaatgtcggaataagcatattatttcatggaagactgtaaataaaaattgttatcagaaaaaagtgtgaaaaattgtttctggccggtaaataatctcattatcgatttctgataagaagtctataaataaattccgtaaataaataaaaaaattgtaacagatttatattctaaaagctgccaaaagtttgattttattattttactaaaaattattagaagtacatgtctaatttaattttctaaaacttttgatactatttgttaattgatatatattgtaagtttacataggatatgtaatgtgttctaagagtaaacatgagtgctccattaacttttctcactatagtctaatatttttttaatattataatggttacagttaaaatgccatttattttggaaacgagtgtaaataaaataagcaaagtgttggagcccttccgcctcctcgtccgggccgcggacgttggccctcgccgcatcgcggaatggctccccgtcgccgcccgccgcctcgccggagatctgttcttggtgaatagtacgaaagattcggagctcatcgaacaaggtacatttcttgagcttccctgcttcgggagcgccacctcgctctcgctggagctagggttccttggcctcgccgtgccgccgtcctgtgtgnnttcgcccggctttcaccaatctgtccatctgcggtgtcctcttctggcccatgcgagctcggcgacgccgtctcctcgccgtagttcccgtccctgaagaagctcaccgtgctatctgctcacaggatgaacaatttcaacatccactccaattctctcgtggagattgtgctccaggggataggattgcaacagttcaatgtggtggcaccagc

SEQ ID NO: 58796 - DNA, 4331 bp, Oryza sativa
ttcagctcagagtcaacccgtcgccaacatctcagcacctaagctggagattctcgggtggagtactactaatttagatcagagctctgtcaattttggcaagatgtcgtatctcaaagggctgttcatcgcatatttctatgtgtatggagaagaggatcgcaatcacgattgtctaaggctcttgcagcactttcagtttgatgccatccccagactttccatcctacttacctactttccagtgagttcagttcctctgctttgtgtgacatcatactaacatcgtatatgagagcactatcctctattatgagtatatcatctattcaactttcaatgtaacaaacaaatcatttatggaggctggttcttagattattacacaacagacaatacgcatttgcataatctactgaatattcggtaagacaatttagtacttcaggcatgttttgcattgctcaagcccctgcatcatgtttgagcacaccacttctccattatttcctactctatcttaatatctttctaattgatggcgttacactttccaccttactatgagattatgtgctaggactatgcaatactacactagtttgttatttattgaagcaaacatggtttctgaagagtggagagaatttgaaccggtcaatcatagacattatttctactcttgcactatatattattattgcgaagcttaaattgagacatggcgcatacttatagtgaatgcacagtttctttttatttgctaagcttccatattggctggacatttttaataagtaatccaaatgaaatcattagcttgtaacaatcatgccctgtgcggctaatgaattatccaaaatgatatgtttctgtacttttccaggttctatatatgaccccatgtttcctagatttagaattgccagattctgttgaatcagaattaaaatttttagcttatagcaagcattttccatatgctaataactttcttccaatgagatgtttggatcctctccaactattatatataatcacttattttactttgtacaacagaccataaatggcgatatatacttgatggaagatatgacagtgctccctgacattgtgttcttgaacttaattttcttttcaagtggatattgtattggtcctagcttattccatgttctcaggatgaccactggtgtcagaaggttgaagctagaattacataatcattataaacgagaggtaaaagctgaaactatacttggtttgtttatctgatgcagagttactaaggaagttacgagaagcaatttgtatttacatttcctgtcacactaggcttgatttgctattttgctacttgccctactctatatagtggtttgatactgatatatgtagtaaatgtgtgacatatgcatctcctatcggcaatactttggggcaacacaacaaggatttagaagatgatactaactggctatgcgttattgatattagaatacttaggacgtgcgtaaatttatactccgttttcacagaactttctcataggacagaggttggcttcaaactagtacccaagttgttattcttttgcagacttttttatgctggtttatctcgagttgttcaggcagcctgacagcttgaggcaagcttaatgttgctacactaatataccgctcttttcagttttgtggatcggattgtgtttgtgatcttccaccaaactggacatccgaggaacttgtgttgaactcccttcgtgaagtgcaaatcactaacctgagaggaactgagaacgaatttgctgttgtggagcggctattcagttgggcagcagtgctgaaacagatgacaataaatttccataactcaatcaccgtgagcactgcaagagagttgtgcgagatgttactgagcttctccaggccagagataagcatgaaattttacattaaccagggatcacgtaaggttttgtatgttccagaagactaatgtgcctcatcaggcttgccagttgactagtgaagtagaactcattttgctttcttcctttctctgatggattgatgaaagaattctgtggacttggttctttgatggtgatgaaacacaacttatctgggttcccaatcctggaattgaatggcaagaatcaatctcttggttggaaaaaaaaatgaaacgaatttttttttcatctcatcgttctacatgttgggtaggcttaatgtgtggctccagcctccggacaggaaaactcttctgatctttctgctcagatatgctactgctgctaagctcaatctgcatcacactagactgtagctgaatgctacctggatttgtaagctagcctggatttgtatttcagcttggatttgtatttttggtcggatttatttgggccgtccatgcagatatctcgcagcagcagcagcatctgcacgttactcacgtggcatctccaactctaccgccaaaatttgtattctttttttgaaaaaaaaatcgttggctcccgcgaccgcgacgcctcgtcgcggccttggtggtagagtacaagaaggagccaggcttctcttctcctcgagccagcagcaacacgcacgcacgcaccacacacgtagcagcagagcaatggcggcggccatggcgctgcaggtggtggccggcggcggctgctgttgccagcggccccgttcttggagctggtcggcggcggttgccggcggcgcgtgcggtggcgtcggacgcggcggcggcgaaggtgagcgaggaggaggggaaggtgaggctgggtgggtcggaagtggcggtgagcaagctcggcatcggcgcctggtcgtggggggacaccacctactggaacgactccgagtgggacggtacgcactgcctcattaatcaatccatcgaattgttcaagcttgttttgtttgtgctggaaaagattagttcttgttgctaattgttgcagtcaaatttagctccaggtgattctcagttgtttaggtgttacctgtagtaggtctggttctaagcagctcaaagcagcaggggcagaaagtgtgtgatcaggtcatgcttcccatgcgcacaaggtgcttgttgcattgcctccccgggtgacttgcacttgcacgcatgtcacttcaatcctctccggtgtgaaatattttgtcatgtgatttcgacaaccaaaaagtcccttttgttgagacatatcgtctacaaaccaacggtcatccgattgttcttgttccggactacaaccatcaggcaggtcactggttttggtttggtgtttccctttcaagagggcccggtgtaaatctcttcctgattagttaattagcaacttaacatgtccctatcattggttagttaattatcaactctgtccttttcctgcccctcttccccctctttctgggagagtttttcttttgtaaggtttccacttcaggtgtatgttatggtctttgtatttgtgatacaatcgttgctgctgttttgggaagaaaagtcttccaaaaacagaacaaagaaatgataagaaaacgtgcttcctttgatttcatcagacaggagactgcaggaggctaaagcagcatttgacacaagcatagataatgggatgaccttatttgatacagcagaagtttatggtacagcggtaagaaactagaaaaacttcatgattcctcgctcatattttccttgcgtcaaaattctgaaggttcatttaaccttagttgttctgtccttcagctgatgggagcagtaaattctgaaagtttactcggagggtatgccacgttttgctgttcagcactccattttttttattattttttatttttgcgaaagtcacatgtgcagcaatagtcacctgttgttgtctctcttgccgccagtttcatcaaggaaaggcaggagaaagaacagattgatgttgccgtcgcaacaaagtttgctgcacttccatggagatttggccgaggaagtgttctttccgcactgaagaaatcgcttgaccgtcttgggttatcttcagttgagctctaccaacttcattggtcggcttgtctgctctttctctgatacatactttttctgtaaattttgagcattttgatctcagccgcttttgtttctctgttttcaggccagggctatggggaaatgaaggtacacagtccaatgaaaattacccatataaccatttttatgaattattagatagttccttctagcatgacaaaaacttcaacattctgacatcgttgagcattattcagggtatcttgatggacttg

SEQ ID NO: 58797 - DNA, 2963 bp, Oryza sativa
taataaaccatttggcatataattagctcttggccaaccgatggggcccttgttcttgtaatgactcatttccgttgttcaggtgttctgtcaggaaaatacactccagaaaaacctcctaccggtcctcgatcaaacacatatacccctgagttactcaccaaggttatattagtacatattactgaacccttaagctagctagttacatacagcttcagcttggatgcgccatttagtctctgcaactgaacatttttcttatctaaaacctataaacatgtttcatgtgcacagcttcaaccactcatgaacaggatcaaggagattggagaaagctatgggaagaacccaacccaggtgcttcacctcatataatgctcagcaaatccatgcaagaaaaggaattaatatctccaagtaggatgagcagcaacttgcaaggaacagaagtgcagttccactgaaaacagctggtgttttcttttttttgtttcaggtttcactgaactggctgacatgccaaggcaatgtggtgccaatccccggagccaagaacgccggccaggcgcaggagttcgccggcgcgctcggctggagcctcaccggcgacgaggtcgaagagttgcggtctctggcacgcgagatcaagggcatcaagatgcccatcgaggagtcatagacatgtaaaaactgaagaagtttttcatgtatatgataggagatgtgtattgattgtaccatgcaatagtaaacattttacggcgataaaatgtgtagaaggtgtagaaaatgagtcagaaatttctgcctgcatgaatagaaaaggtttatatgactttgagccagccctgcccagtgatgattcaaatgcctgtacaatgtaactttgacgcaaacacgcgtgaaccattacacacttgtatttaaaaaaagaaatagatctcatacgtacgttttatattataagtcgctttaaatttttttctagtcaaacctttttagatttgaccatttcataaaaaaatagtaacatctataaaagtttcccataaaaaaaacatctatacaagttcagagactctttatataaattctataagtaacatacgcctgtagtgactttgtcaatctctagtatagatttgtcggctcagtcctcaaagatgcttataggggtatggtttgtgtgtgttcataggggtgggtgtgcgtgcgttgtgagtgtctgcgttgtactgtgtaatttaaaaaaaaaatgatgatatgaatactataagtttgattgaatcttatcataagcaccagatttaaacaataagattgcaaaatttaattatttaacatcgaaggaggccagaagttcttttttttttctatagaatgattttaccgccaaaaaaaaataaattctctctctctctctctctctttttgagttatttggaagcgatatacccagagcggccagcggcgcgtccacgtgtttacccgccaaacacacttgccagtctactctcgccggcgtcttcctctcctcgcctcgtctcgttcgtggccaaacgaagctcgcgcctcccggccactcgcagtcgaagcccagcaaccgccgccgcgccgaggccgagcaacagtgaggaggtagcttgcctgcaatgatggccgggaccctgcaggtcgccggtggctgcctggcgcccctcctccccagccgacgagcggcggcggcggtacgcccgccacgcgcgtccggggcgtcggcgtcggcggcggcggcggcggcggcggtggaggaggacggcaaggtgaggctgggtgggtcggacgtggcggtgaccaagctcggcatcggcgcctggtcctggggcgacaccacctactggaacgagttccagtgggacggtacgttcgcccaatgcgcatactcatcgatttgcttattaactcttgattatttttgtgttattccacctgcaaacctgcaatcgatcgggattgattgaccagttcttgatttaggatctcagtagagagttggagtccggactccacctaatatgttgattttgggggaattgttgggattgattccactcattgtgttgtagagtttcatgtagctgatgagctagctttcaggttcaaaggggtcatagttttaacctgtactaagggctaagtagtaattaaggctgtctaactgaggtttgtaaacttactaaccttgaactaacagtgtagtactatttgcaattgatttctgtcccaaggtaactgtaagtggtggtatcattaagacatgaacatcctggggcctagtctaagtaaacattgcattgcaattatgacactagactaaacgtcaaatatttatggtcagggggagtatgagttaaggggtcaggtctctaggtgaatctttgatcatgaacatgctcatggatttgttctctctgcttgtcctaatgttgttgcaactcgcaacgttcgaactaattacagattgtggaatttaagcaactcgcattggaatgttttgagtctgatttttgtatagtttggaaggcaccagccatctaaggatgtaggatctgaaagtgtgatatttaacaaagttgtctttcttttttgcattccttttttcctgctacttgttatttgtttgttgggctgaaatcagggtcatacatcccatgtgcttgatgtgcatgttgcattatctgcaagaaaccacgtgccacatgtaatatgctttgcgaaattttaacgaccaaacacatgaaatgtcataaatctctgcaattgttagtgaagtagacaatttgcttaatgtcaatgacaatccaatgacaaagataccagtgacagtcccttaatatgatgaagcactctgaaatttgccagataggaaattgaaggctgctaaaggagcatttgatgcgagtgtcgattgcggaataacc

SEQ ID NO: 58798 - DNA, 2994 bp, Oryza sativa
aacaggtcgaagtagccattgcgacaaagtttgcagcccttccgtggaggcttggccgaggaagtgttatttctgcactgaaggactcgttatcccgccttggcgtctcctcagttgagctctaccaacttcattggttgtctcattgtcttttcactccaatattatgtgtttattattgttgctagtttatttaactggtgtcatcatctccttttcaggccagggatatggggaaatgaaggtattctttaatatacccatatttaaatactccctccactttttaatatatgctgttgatttttgcatatatgtctgaccagtgcaaatatgcaaaaataagttatgcttaaagtatgtttaatgataaaacaaatgacaacaaactaaatggtaattatatgaatttttgaataagatggtttgtcaaccatatgtttaaaattcaactgcatcatatattaaaatatggaggaaatacataatagaaatatttgaactgtactcaggaagcagtgggagcaattacattgttcttacatgattcaggttaccttgatggtcttggagatgcttatgagcaaggtcttgtaaaagctgttggagtctcaaactacagcggttgtaatctgacttcaagagttacatatgatgcagtttgttgtgctagttacctcttttcagtgaaactaatttcaagaacgctctttctataatttgatacagaaaagcgtctacgggatgcttacgagcgcctcaagaagaggggagttccacttgcttcaaaccaagtaaactacagtttgatatacaggaaccctgaagaaaatggggtaaaagcggcttgtgatgagcttggtattactttgatcgcatattccccgatcgctcaaggtagaattctgattctctgattctgttcttcacattaccattcaactatatcaagatcttttttttgcaagaaaaatgttcaatctagtagtttaaatgaaaatgtcctatcttagaactgaaatgtttacttcatcgatcatcattccatttctcaaatgagtgattatcgaaaataaaatcctagcttaatatgtctcctctgttcaggtgttctgacaggaaaatacactccaaataatcccccaactgggccccgtggacgaatatacactcctgagttcctgaccaaggttgtattttttactaatattattatgagcttgttgcatccttgttcacgaaccctctcctattgcactgctgcaactctgctcattgaagatgtttcttattccaaacagctccaaccacttattaacaggattaaagagattggaggaagttatgagaagaccccaactcaggtgttcttgctgctcaatatttccttttctgaagtctacccattgccaaaaacttagaatgcaaattattcagacataggagtaaattgtaagagggaaaaaatgataatttcatctttcaacaagctcaagggctacctggagatcaacaagatcccaaatgctgaagctaaaacaaccactaacactttgaattctcggaaatttgcagtgcaccaatttcgatgacatagtagtaagcaaagttgctccattctttttttctcctgcattttcttcaggtggttctgaactggctgatctgccaaggcaacgttgtgccgatccccggagcgaagaacgcagagcaggccagggagttcgctggtgcgctcgggtggagcctgacggatcaggaggtggaagaactgcgttccatggcacgagagatcaagccggtcatcggattcccagtagagaagttgtaatttctagtgagtttttcttctactttgggtctccgagaacatcatttacataaatacacaatgatctagacatacatagataggaaccatgtgtagtctttggaactgaaaattaagatgtcttagaaaataaccaaaatttacagtctgagtagcgtacatgcatgtatgctcatcgaccatattacaactaagattggtaactggattatcttcaagaaaccaatgttttattttctctggaaaaagagaaaacctgtttgcaatgtaatgaatatggccagtggcgaagccaggatttgagtatgggggggggggggcaacaaacaagtgattacacttcacacgaggtaaaatatatgttatttcactttacactgggtttagtacatatttttactttgcatcagggtatatcaaaataatttgtgttttacactagattgcatcatataactgcaggaaaatcttataaaccacgtgtgaaacttgtgatatttttttaccaagtttcacaaagttttatccatattttgtaaaacttgatgaaatttctataggtttgattatgtttatcctggtgccaagtgaaacttatttgaaagcagctcggtaaaaagtgaaattgggtgtgttttacccgatgcaaagtgtaatttactccaaaattaacaacaaagtgcaaggattaatatttcagcgatttgaaactaaaatgacgtgagaaagtttcctaatcagcatgtgcaagcgcgagctggaaatacaatatatcaaacgtatacacagtagtagctatagacggcgacgtaaatgatccctgactaattagagcaagattaatagtatagccaattgctagctccaaatcatctatagttaacttaatagttaattcatacaatatttataaacatatactatacaattaatatctggtcccatctgtcatacacacatgcatcttgtagtccgtgctgtagctggttaaatctgtaacccgctgcttttctctctcttttttttatcttctcgaactgtgtttataactggcttatagtatactattgtacctgctcttaagcttaaagctttgaggggatcgagcaattagcaagtgtctatatgggtcattactgcgttttcatgaagttaataaaatt

SEQ ID NO: 58799 - DNA, 1261 bp, Oryza sativa
taaagtaccatcattcagagatcgtgtcaggatcttaaaatatacttatattttaaaatggaatgagtacatataaacacataagccaaacaataggctacaacagagcaggcatgctcgaagtgccagctgtggtgaatgatgccattgccgtggaggaacaaagctccagctccggggaccgaccggagaggggtatcgacggcacggtcagaggatccttatccagtacttacatggtgctcgtttgtacccaagataatgttagagcacggaaaagaacaaaaccattaacacatgattaattaaattttaattattataaatttaaagaagtaagtttacctacttacttcgttccaatataaactgtaacttagtatatatcatatttacattagattgcacttatattagaactagaaaagtaatatttttaagcaatttatatatataaagtttttacgaaacacaccgttaagcagtttaaaaaaataccaataaaaattgaaataaaatatatatcttaatttttttagggtgcatatgcgtgcgagttgcgacggtgtacatgtgagcttggggtgtgtttagtttaaaaataagttaaagtttgaagaaagttaggagtttgaaaaaaaaaagttaaaaatttatgtgtgtagaaaagtttttattgtaatataatgtgatgaaaagttgagaacaccgggaaactgaacacggccttggtcactcgctccctccacagaaaaagtactacgcctacggcatggcctgatcatggtcaggtcagcggccaccgccggctttacgcagagcacacaggcagagctttgacctccccacgattccccaaaaccgaatattttttttcttcttcttacggttccggccggagtacgtgccactctacactacttgtactagagaagtatatacggtacacggtctaggacctccgagatctccgcaagatttttttgccacggataataagggtcccctgccaaaattttacatcctatcatattaaatgtttaaacacatacatagagtattaaatataaaaaaaataactaattatacagattgcgtgtaaattgcgagacaaatctttcctaattgctccatgatttgacaatgtggtgctacagtaaatatttgctaatgatagattaattagacctaataaattcgtctcgcagtttacatgtggaatctataatttgttttgttattagtctacgtttaatacttt

SEQ ID NO: 58800 - DNA, 1580 bp, Oryza sativa
actataattctgttccacgacgtactccctcactctatccattaatataagcatatgtttggtaattctcagcacacgttactgtgtcaccataccgtttgaaaaccgttggccgctgataaaatttggtcaagttctgttataactgtaaagttcagtttgggtttttttttttaacttgaccggaaaactaggcgatttatgttctcaagcaagctcggaaagtccggttttcataaaaacaaaccgatgttcatcggttttgtaaactttgttccgaacattaaagtcgtttttaatctcaacattaatcttcactaaaacaccaacattgattatattgcggactaaaaagagtatcacagaaaattgtcacattcaatctaacctgcatagagaagtaggagtaattcttccgtcccaaaatataagcattttataaaattttttaatggtatctaacaagctagagagataaaactaaatagggacatttattcttttacctgagaaatggggatgttcgtttattggttgagaaaagtaggtactatgtactaagaactataagttttgaacgtagcgaggagtatattttgggacggagtacatgtttatttactgatatatttaagggagtaccccataaaactcccacctttaaactaacatgcataaacaagtaaagagtagttccgtccaaaaaatacagggactagtgaagttttttttttacaagaagtacgagagtggtaaaattaaaaggggatatttattcttttacctgataaatgacctatgtttaatattgttgagagaataataagaaagtaggtagagaaattgaggtaagaaaatatacggagaagttctatatttacaccatattagtagcggtgttatggtatactcacctacccgataagagggagaccaccatctatcttatggaccatcactgttaacctaaattctactgcagtgagaatctatttgctttatgtgtattttttagtgtttatcctactatcatcattaatcagagggtgacaatttagttttcatcagtttacctaatataattagaatccgctatgatgtataggtattttgttagttgtatgataaattttgaatgcaaccaggagtactccctccatcacattttaaatatagctgtaagtttctagattcaatatttaatcgttcatcttatttaaaacttttttatggttgtatttttattataaataatattttatacatgacttatatttttattttttttcgaaagaaaatcaaataaaacgaatggtgaaacgttgaatacgaaaacccatgttgacagcagcggatccacctcccgggcaagtcgggcagccgcgcgggctccgctattaccgtcaccactattgatagctattgacacccataaaaattaatcgatcaccgaaaaatactatgggcttaatgatgatgctggctccaccactgtacgttgaatacgaaacccacaactactcttgaaatgagacggagggagggtttttttttttttgggaacagtactccttttcaag

SEQ ID NO: 58801 - DNA, 1199 bp, Oryza sativa
cgcgctgggctgggcatgggcagggacatctactcgcagctctggcacagcttcgccaatgtcgacgggcacgcggcgggcgcgctcgcgctcgcgacgctgacgccgacgccgcgggcggcggcgaggagcgacgacgtgtcgagccgtctcgacgaggccgacctgagcatctgcggcagcaacgcggtcgtggcgccggcgctgcccgcggacgacgacgacgacatcgacgccgccgcgccgcgcgaggaggaggaggaggaggaggaggggccgggcgccgcgcgcgccgccggcgcgtcgtcgtcgggcgggtcggggagcgggagcgggagctacccgctgttcaagcgggggagggaggagctggttgacagccttagcgaggtcgccgacgagacccggccgtcgaagcggccggcggcgaagcgccggactcgcgccgccgaggtccacaacctgtcagagcgtgtaagacctcaagaacaccaaccaaccattgatggatagatggtgttgcatcatttgcaacaaggtgaatgttcttgattttttttgctgttcttgctgcagagaagaagggataggatcaatgagaagttgagagcattgcaagaactggtacctcattgcaacaaggtaaaataatttctgcgaaaagttgtgggaatttttgttatcctgtataatagtatagtgttcttggctattgccatggttgaattttgtggcaatttgatgattctagctgtttctcagactgacaaagcatccatactagatgaagcaattgagtacttgaagtccctgcaaatgcaagttcaggtttgaaatcaaactttccccatttctccacagtagcaatagaatttcaatccttctggatgaatcaaatcacggtgcctgattgtgagactgttgcttcatgttcagatcatgtggatgactaccgggattgtgccgatgatgttccccggtacccaccagctcatgccaccgatgggcatgggattgaacacggcatgcatgcctggggctcaagctcaaggcctgaatcagatgcaaagaacaacatattacatgaacaattctctgccaaaccagatgcctcagatcccttctccagctatgaatgcacccagtgttccagacgatatgcagaatgataatcgcatccgcgggccaagaaatccttt

SEQ ID NO: 58802 - DNA, 1558 bp, Oryza sativa
caatggatatcaccgacaatgagcagaaaatcaaggcatagcggctgataattgcattcatctctttgagatcttgaacaaaaaatgcagcaatcattcctccgatggttatagcatagatgggctgcaaggaaccatataccaaagcagagagacttcctatgactgcttgtctccactctggtgcattcatcgcaagaagcctggagaaagatggtgccgggggagaaacagaggaatcggtttcctttgaaatacctggtgtaagtggcattggacttgctctggacatactgagacggctggtactggtccttgccactgaagaggccctaaattggtcaccaccttcttgatcgatgtagctcaccatcttctgcagtttcacaagtcgtgaatatgggccacccttattaatcagttcatcgtgtgtgccaatttcagctatagtgcccccatcaaccactgcaatctgatcggcattcttcactgtggaaagcttatgagctactacctgatcaatttaaatgtataatcagcgccacggtgccaaacaattgtacaattaatcttagcattgtaaagtagggcagtggaggtggtgacgatgtttaccagtgttgttcttcccatagatgcttggtcaagtgcatgctgcaccagcttttctgattctgaatcaagtgcacttgtggcttcatcgagcaaaagtatagccgggttcttgatgactgcccgtgcaatggcaatacgttgcttctggccaccagatagcagtgctccacgctcgccaatctgcaagggcagggcatgcaaccatagagcatcagacacagggataggtgccataatacttgtttccttgtgatgcacataccttagtctcatattcctcaggaagcccccttatgaagttgtgagcatttgctgtcatggctgctgcatacagttcatccattgttgcatctggtttgccaaacaagatgttctcttttatggatgtaccgaagagtgcatgatcttggctgacaagccccatcttgctcctgatccacttgagctggagttctttaatgttgacaccgtcaaccttgacagttccttcagtggcatcatagaaccgttgaaccaatgctattgcggttgacttgccgctgccactggatccaaccaaggcaacagtttgcccagcaggaatctggaggttgaagtctttgaggaccgtcatgttaggcctcgatgggtaaacaaagcggacagactcaaactgaagctctccccggacttgatccaaaataagtcccttggggtcatcagcatttatctctggcacacggtttatccgatcgagaattcttgtggcagcaaccgacgcttctgtgaaatgcttcagttcagggagtgccattccaagggatctgcaaaattttagtagtatggtcatgtttaatcttctgtctaccaaatggattcatgagttcaaaagggaagagagaacagaagaacatacaggccgcctaaaacgaaggaaatccctgcagcatatatccttcctccg

SEQ ID NO: 58803 - DNA, 5946 bp, Oryza sativa
taaccttttcttttccaatgtgttttccgttaactttgcaatgtctaattataattgtcttaatttcctcaactgttttttgctgcttcggtgtttcattaattaccaatcccatatcgattactgaacttgtgaataacgccacaacctgaatattttgccttgttatctgctcccgtcagaattactaggatactattcgtatattattatgcaatcattttgtctttgcataaatatataagaaactcatcatgggctcaaggtgtccatattcttttacgttacgtttgtgagagaaaaaaacaaatgcatgtgatcctacaatttgtgtagtctataattgcattattgtcatgacagttgttgcaaataaaatagtatccctcatgatgctggattccaaatcaagtgaggtgtagatcaacaaattaagacttcttacagtttaattgttttcatgaccaggtatcattagtcaaactatttgattcactgctgattcagtgacgacctataaatctaggactagcatatctctcacaccggcacagggagacctgcatcgctctgcacgtgccatccccttcgtcttaaaaaaatagtggtagaagttctatactacagaaggaataaacttccaagtaagtactgtacttgtgtttacttatagactgaagcatagggtcgttgacaaacaaaacatatacaaattaaggcatggggtcagacagacaaaacgtaagtccgggtcaaatggggcttaagttactactgtgatggagattaattacttcctccgttcttaaatatagacacatttagaattaaaatttttacacgatataaacatttctgtgacactaatttcaatgcatggaaatcacagcattttcaaccaatcaggtatttaggcgaggaatccaagcaatttgaaatttaaaatttgaccactgagcttactgaaagaaaaaaaaattccccttacatcttaaaatttgcaaaacaacgtaaaaatccttatactaaggaacagatagagtaaagtgaaaggccggatcagagattaactaaccttctcactgagaacttcctgaatgagcgaggcgtccttggagatgctgttgatgatctccgaggtggtggcctcctgcgagtcgaagaagcccacctcctgccgcagtatggcctgcaggtacaggtacctgatcctcagcacctgcctctcgctcgtcctgctccagcaatacccctctgcaaaaacaaattaagccacatgatttaggtaaatgcatccgtacgtgtgattaattagcaggcagtaagtgatgttcttttctttttttttacccataaacgccactgccagcaccgcgaacgccaggtacacgaaattcaggcaagactgcacgcacaggacgtcaaaaaaagaaagagcagcaaaaagttagacagaaatgttgctcgatcgggcgagtgtacaaatatacatgcatgcgtgtgtgttctgtgcagacaaggtgatcgacgaattcactagaccgcgagtgtgactgtgtgacaacgaaccttctcgacctcgcgcatgaagtccacgccggtggcggcggcggcgccgccgtgggcgccggcgcgcgcgtacccgagcgagttcatcacgtcgctggcgaagatgaggagcaggttggtcgagcacccgtcgccgatggcacccagcgtgcccagcgccatgagcagcacgtccacccggtccgcgaacttgaacatgccacggaggctccgccgctcgccgccgccgccggtggtcgccgcggcactcatcctccttaatggtgcactcgggtagagagcgagagcgagagcgagatcgaggcaggttgaattgagaggagaattcgaagaagcagcaactacggatcacttgatttgtgctgctgctgctgcggcaatggcctttggcactctatgctaggggtttatatagtagtaacatatcactaacacacgcatgcttttttttttcttctccttgtcttgttggctttgcatgcatgatgagggtgcacactgcatcacattgcaacataagggtcgatgatgagttggaattcaaagcatgtgaccaaagttgagaggcaactagagatgccattggcttggccagtgaggcggctgatgactttgtttatgcgtataatattaacagcggtttttttaacttttaattttccattatgtgctccgtaatgctttgttagtagatatatgtgtaccttatctttaatcatgttagacttttgatgccaattggagctagcggccggtggtgtggtagtgtttttggctggtttttgtctatgataaaagtacagggttggtaactgatcagttaattagtgacgttgctttttgggaggtaaagttgacaagacaaaggagctgtgttttcaaccctatctattatttaattcctcggtgatttataattagtgtaacatatatacttcaattattgaccagttaggatatttttcttctgctactcctaaatgttaaattcattttctattcattatcactgatgtacaacttgagatcaaataatcattctaatacatcattttctacattctgtttctgcctactaaaaagtaaaaacatttgacttcttaaattttatattgctgtttatatctcatgggaagtatgctaaataccagattaaattttgtatatatatgttaggagatttatggaaaaacctaaaaatgtttgaccactaacacggaatttttggagattagtgtttgattgcacataattttaatctgcacaacttatactaaccttcaaagcatatacatgcatcatgcacacttaccatgaatgaagtgttgcgtgcagatagcttatcatttgcaagtgatgctgccgctaatcgagtagactaatcaagaaaagatagcgctagctagcttgtcatttggaaatagcaatgtaatcatgccggtcatcgagtagactaatcacaaaagggtgggacgtaaaagctagcacaaaatcttattgaaagcactttatgtttacaaaaataattttacttagctttaaacaatatttgcttctttacccaacccactgatgaattctccgatagcttgtagctgcaagtttcaacatgtacatgatgtacatcgaaagcaactggtatatagcttctttgtttgctagggcattagaaatgacggtggtctaagtcagtactacacatgtctattcatattatacgtccctgatgtctgaatttctgaatacacactagactggtcagtcaatctgaatcaatttcttctcactccagacacacaaaaacaatcccatgctaccacgttgctagatcgccaggaatcttagtgaagatgatgtgtccagttttatattttaggtacagtaaactttcgcagccatgcatgattaaaatagcaacgtgttagtatgttagtttgtcttctggattgcttaaggaatcaggacatagttatgcattaattattggctacattcactagctaatactgctagaggatgcagcttcaaggaagggtatgtagctgcattaagaaattaaaaccgtgtacactgtacaacactatggtctccagatgtcactggtcaaattatcaactactagtatgttctaatcacttaggctgtaggagtaataataacaagtaaactatactcttcgatgatttgcacgtgctgatttgtttattccatgataggatcagctgggtctccatgtaaatcaactaatcaagtggtagactggtagctagcattgctgaacttgcttccactgagaagagcctctgttcatggcttttttgtccgaccaaggtccaaattgtttataaacaaattgcatctggattcgacaggtgctcatcataattcatgacaacatgtagaagcacgcaaacgaagggcatatatcttcatcaaaagaattgttgagcctccaattgcacaaaagctaaccatttcattattctcatgttgttctttgttttgtcgtgtttttttagaacattgttttgtcgtgttaccaatcatctatctattcatctttgttatgaatattgttttgtacgagtgggtaacctgacaaataatatactactagatgatatatgctacaaagttttcaagccgtacaatcttcttttatctcactgtagatcgaaatgaaataaatgaggctacttttgtagtaaagattttttgaggatggtactaaaataatgcccatttaagagcatgagtacaatctaatgctaaacctattacgacgtgcacatgcagactacacaaagaaccatgctccctgcttccctgggttcaattgagcatgtgccataattaaactgaccgtagtttactttgtaatttatgcacatgcatactctagtccacaactagataccatgtacttaatcttttaaaaacgtcaaatttaatcaaattgttcatcatagactcgtcaatatatagctatatatttcgactcgtcaatatatagctatatatttctgcagagtgcaactgtgcaagtctataattctatataatgatggactgtaatagtacatggtggtaagtccgtttgacacatgcattctgtcaattggcatgataacctaattaaccacgtacaagaaagcaagaataagcaccatatatcacctcttggctattggaaataggttagtgatcaactaattaggtatgttggccaccatgagctaattattttgttgttgccgttgctgttatatgttgttgttggtggtgtgtgtgtgtgagcgtgtctgaattttgcggcaatctaatgtatttcgagataggctgtacactagcaactgtgacttctctcgagcctcaaaattcaaaagcaactaacatttgacagagcaagcgtgcagtgacatgctatgttaagagaaagacttgctttagctttttgtttcttttccatattctatattcttgaaaaggactgcaaagctcttctagtatatgcaattagctgctttggaaggcacttcaaaagggatgaaggaaagaaggctgtcatatcaattactcaatcatgaccagatcatcgatctgatgcagttaaaaatttcattaattttgccagtgcatccttcgaattaaagaagctacgaggtcgtggttcacatgcttaggtttttatcatatcatctatttactaatcgcattctttggataagaatttagtaatcaattacacgcatgctccgagatttgctaccgccatttttaatttacgaaaaagtctcaatgctgcccttacactataatcgaaagtccatcgatctagcaccattaacttttataccggacattcaacccctcaagccatacaatatcattcctccaacaccgtaagatggttttgaaaagtggtttttattaaatttgaatatatattggatgagttttactaggtggcgtattatttgtacatatatttattgaaatgtctacctaaaccttccatttttttacctttttaaaaattgaggatattattctagcatgacaaattaatatagagtataaattgatgactgatgattgacgatatataaacatgctataagagtaattataatcgcccatttaagtttcctaatatgtaaaaccaccgtccaaaatcacctgaggacgtaatacagtattgtaaagtttagagaattaaacatcggcttttaaagttagcgtgctagataaactttcagtcaaaatttaggggggctatataggcaattttccctttaatatatgaaacttttagttatgcatttgacaatttgtcttattatttttttcaaatatgaaaaaaaatatatcatgctt

SEQ ID NO: 58804 - DNA, 1213 bp, Oryza sativa
ctcacccactgggaaaaaagaagaagggctttttatggttttcataattaacctaccagtccacaacttaactaaatgttgtcgcgttcttaaaacaaatcctaacttaaattcagcaaaagaaagggagtatcaagaaacatgacatattgacatgaatggcaattggcaattagtggcacttcttttgttacttcagaaaattagtggtgtcgtgtgcaaaaaaaaaaaatccaaacaaatgaatacattgcatatataaaaagagggacagaaccatgcaggcacatacttcaattgtaacaaagctaatttcttttatgtaattaaaaatgaagtacaagtacccatgaagctatgattcttgagtatttaaaattggattaacatgttcagatcgtgcaatcgcatgcgtgcttggctagttattttatccttttctattattacataagttttcacatgcattaccaatctagacttgatctaatgacagtgctagtgaatattacagagcattgcatctgctgagatatatacttagtcatttacagataaccttccctagctccttgccagcagtaatggcctaatccttattccctttttatcagaccaaaatatcataatagttttatcatgcagtgtacgatcttaagctatcttcactagtaggaaacaaatgcagtgccaacttgtcggagaagtatactagtaggaataataaagtactacttcctgctgcccaaaacgagaaacatacagcttctagttctagtgttaattttatcgcgcatatgggcagatgacacacgcacctcatcttcggtcgggtctccggcacagggtgcatcaacaactgacagaatgatgcttccttgggccacttgagcagcagctgtggaggcaagacgcggtgccgtaggttcgccattgctcgcatcttctcctccatcgtctcgaacgtacagaacaactgaaacaacagccgtagacataaaatcagcgatgagctgagccgatgacaagcagtgcatgcggagaactaacagcgcatttgatctcaagcacccgcacctcgaacaagagcactcctaacctatacacgtcggaggcgaaagtagcgccgccgcggtcgtcggcctcctcggggctggtgtaccaggtgagctccatcgccagcacgctcctcagcgggaacgtcttcccgccg

SEQ ID NO: 58805 - DNA, 1340 bp, Oryza sativa
tgccgagaccccatccaggctccgaatggcagagcaaagcactccactccaagcaaggagataaggatctggagagccgcggcagcgacctgacctgaacccctgaacttggtggcaagagggagacgaggcgacgcgagaggaacacagtagcggcgagcagcgagccacacaaacccgctttaaaatcgcggggccttcgctgctttaatttctcgcccagcttcggtagccgcctcccagccgcacaaaccccctccccgccacaccaccacaccttaccctcgaaccgagcaagcagcacagacagcacaggttactagtagttccaactcttcaatgcacagcgaccagcaaagctctcccctgaaaactgcctagctaccgccacagcccacagaccacactgctcctctgctcctactatgcaccaaaactcaccggaaagctccaaaagcgcgcgcggagagatatagacgacacgaaacaacgactcttgacgccacatacaacacgtcccccccttgctcatcatcaccacgggaaagaaaagggaggagaaggcgatggagtaggcgcggccactggccaccagctagtgcacgccgctaccacaccacacacgccattatgctagctacttctcccttctccggcggtacaccttcattcatttcattttaaatacagtcgtgaattttcgtgtttaatgtttaattatttttttatttaaatattttatagaaaatataaaaataaccatatataaaatattgttcatgttttatcgttaaataaaaggactaccctgttgccagtattcaacactcgcaggcgattccgaagaagatttgcgccgaacacgagggcggaaaaaacgaaagcatcgcggagtaaaaaataacagctgagctgacccgaatgacgtggagctaccaataatggaaacggccgggccgccgaagacacggagacccggacgcccgtctgttgaccgcccaccgtcgatgacagctcggcccgcgcctccagggtggcccacttgtcagtgaccttctagcacctcgttgcgcgtgagaaaccagcggggtaggagcggattaggaaagccgcttggtttatccaagagagtggcgacttgctggcctttttgtttaataaccactcactccggcgtgtacggggtgcagcattagtgttgattagccagcggagtgttgaaacccaacttaaattacccatcgatcgggtgacgggtcactgtcggtggggccggcgtaacgcacgccactcatgggcccacctgtcagggagcgctgggccggcgagcagctagcgcg

SEQ ID NO: 58806 - DNA, 2389 bp, Oryza sativa
ccagtggatcgggccagacaggccggccggggcccgttgtgccacgtgaactgaacagtggcgccgcgcgagcgggtcaaaaggcggagccgagtagccgactggcgacggccactggctcggggagcaagcgcatgacacgtcggcacaagtggggtgggcgtgtatcggtggatgatttggggctgagacttttcaaaaatgttggaactacggggtaacggagtagaatttagatcactcacgtcggccctacaagggagagcgatgcagcgttggatctgaattagatcaccaggccaccagggtccgcacaagacagcagggggaaatgggggcccaagcaatttcatgatcttctttttttttttttttggagatcttctatggacattaacagtgatagaaatcatactaggattacattgtacattaacagtgttacgtaaaatattactccctccgtcccaaaatataagtatttataagtatttttagactctgacagtctccaagatgctactttaactaacaatatctaaaaataagatattttaaatagaaagaattatatattatgatagtttgtttaataataaatctagtaacatcaattgtacatgattgatatttgttacttttttttgctattaatagttaaagttaaaaatgtttgactcgtcacaatgctaaaaatgtttatattttgggacggatggagcactacttagggaggatatctgatgctctaccggataactccagatccctccaggttaataatacttgtcgtgttggataagtatacacggttttaaaaaaatatcaatcattttattaagtattttgtagactaatccatacatataatctttagatttaagacaaatattttataaattatttgtgattgaaagattttaaaatttagccttagtcttgtccaaaacaataagtattattaacttggaaagagtagtacccaagcacctaaaactcactcttgagacatggaaaattttgaataaaagttaataacatgcatctacaatagcacgaaatttccaatccaagttttatttgcatgtcgagaacgcctgaattgattcacttgaagatttaacatcgaaaagcattgccgatttatctaggcttagactgtctccaacaagtgacccataagggcacctaaacccaaaatgggtctccgatagtactattttagcctccaacagagtacctatacagaagacccattttgcgtgctataagaggcataacctaaatctgagtatcctctctcctgaaaatctatttgcagtaatggttctcttttaggtcttattgttagagaagaccaaaaataggtattgaactctttaactgtagcgctatgcaaacgtgaaatgggtcttgtattttgggtttcattgttggagatagccttataagttcctgctgttacactaccataccatattgcacatgtttgacaacggataaataatatatttcatggaaacaagaaaggctacataatgacggagtgaccataactgataagtttaccaaaatggttagattattttgtattataatttaactttgataaaacaacaagctggcagcatcagagcttattacaattttaatgcacaaaatttgatagatgctgcacaacaggaattacaatttggtgattaatcatctaatttactgacctcatggggtttgtctccctgaagagagcgaaacaatgcactcttggaccatttcctggactcttctcttcaaaagcttatccttcacaccagaaagcatgctgcggtagaagatctccaggcgattgagttcatcagtacctgctgtatccaagatgttctcaaattcctttctaatatcaaagacaggagattcttgaagggaacgtggaagtgttcgttcatctagaggtttacgaaatattgaaatgtgaagtatgttggcatatctctccataagtgtcagttttgaccgaagaaactccagctcttctgaggcagcagatagcttttgttccaactcagcgctattccggtcattcactcccgatgttgatgcctgtgctctatcctcatgaatttcttggaagttctcatcaagaggaggccacatcacaacacatggtatgtaactgtcagcagtctggtttctcccaagcacaccactgcggcctctgccccaagcccacatcctatacccatcaccagcaacaagaacagtgtgagcagctccacaagtgacctgcactgcaccaagaaatttgaacccatttgtctcaggagactgaactcttatcgggcgtagagcatcccctgaatcaactcctgaaaagctggcatcagggcac

SEQ ID NO: 58807 - DNA, 4055 bp, Oryza sativa
aggcaatttcatacacctcccaagaagatccttcgctaaaagctgagataagcacaggacgggatctactttccttgtcacctagacccaactggccatggttgttattgccccaggcataacaaacaaggtcacctcctgtataggtctctccagcactgactgcagctacgacatgctcattaccacaggcaaccttaacaacagtgtgaccatggaaatcccacacaggtagtgggacacagctaggtgctatacaaaactctccagcatcagtctgctgcgggcaatttccccacatccacatagctcccagagtgtctatggcaaatgacatcatgcccccagctttaacagaagacaactgcaacaaaacatacagcaggattggttaagcacaaagatgaacttttaagtagtattacaagtttgcagctttggttgttcttataagaaagggtgatctatttgtaccttcaatgaagactgtgtgctactgttctgtgcttcagactgcagcgtttcaggtgaacccaaatcttgaaaacgctcaaccaaacatgggaaaagagaattctcttccccgtagccaagctgaccatccgttaaatagtcaagaaagaacataacaggcgctgacttggatattagtagaatggtttcaagtcgccaaagctcaaattacataaactttgtgaaggatacagatgttgtaaccccatgaccagagcgaaccttcatctgcaatgttggacaatattcagaacaaagcttatatgtattaattacatataggtaacgcatttgattaacattttggctaagaaaccatttacagttaaaactagtaacctgaaggaaaattatgtattattttttcttactgaactcttagtaacactgatgtctagattttctttaacttccatctagttaaatcaaacagttgagatcattgtttgtaagagttttgctttgatctaaactgaactattcatttgcccattatttgccattgatgtcacaacgacatgtgagctatatgttagtttgttttagataaggccataagggaagtgacaagctcccagcctttgcatcatctaaggatgcacacagccattacatcaccaaatgctaagcaattatataagttagtgaaataatgagtctcgaagggattgggcaaattcaatgctatacagtatgggaaagcgtaataaaatacagtgttctttgcaatgaacaatttgtcgatttcacttattaagcagttcaaccattccaagcaaattcaggggaaaactcataccatatcaaaaaggcccgtagtaacagcacaaaaattcaagggaacggaaatgttcgcatggtctgtgcatattgtacaggaataaccccacataccaaatgctcgtcagggatcaggaccataggagccgcaaagtacagcaccggtgaatctaatctactctctccgtttcaggttataagacgttttgactttggtcaaagtcaaattgttttaagtttgactaagcttgtagaaaaaaataatagcatttttaacccaaaacaaatttattatgaaaatatattcaaatattgatttaataaaactaatttggtattgtaaacattactatatttgtctataaacctagtcaaacttaaattaatttgactttgaccaaaatcaaaacgttttataacctaatttcagagagagtaactaccagtagattgcactagaaaattatgcacgcattgggcatttgggccacagcaactcagtaaactaaaattcaagttaccagtggctagtcggttactcgggtgggcgctctccacaaaccgcaaatcataattctgcaactacttcagtactttcaaactacagttgcctacacagccgcacagaatgctatcacgaagcgaatgaaagcaaaagcactaaccgtccagcgcaaggctgtggtaggcgccggatgcgacggccacgaacctgggccgcggcctcccgccggcggcgaccacggtgggcacgtgctcgtcggcctcgcgcccggtcccgaggcggccgaacatgccccgtccccacgagtacacctcaccgtcacctgcaacgcacgcacgcccagcaaaacccacaaaagccacgctctcagatcccgaatcccgccgatgcctcgataattcgccccgggagcaaagcgagcgccgttaccggtgagggcgagcgtgtgggcctcgccggcggccacggcgaccaccttgggcggcatctgcggcggcagcggggagcagcggtggagtggacgagagggcagatgaggaggagtgggaggaagaggagggcacgagtacaactggaggcattaccgcgagagcaaggcagtaaaatgagcagcggaagcgaaggcgataaggactcgagcgagtcggtgtgcagcacggcaagtcaccgcttgcggaggagctcgtcgacgtcgacattgacttcatcccgcttttcccccaagaatgatccgggagatggcttgggacgcgtgtcgcggcgctgcatcaccggaaaaagaggtggttggaacttagaattggcaggtgtgctgctgatggtgcgagtcgctagtgagatttggacaagtttggggagtacattactcctgtggatgtagagttgtagacactggcaaccaattcagatatctgatgaactactacacattctgcatctaggaaatgttgtgcattgcagcgagaggggattcctttgtacaagcagcaaacgtcatatgttctactaagttctaacacattttgggttcagttgattatctcacatacccacggtgcaagtacatacagcaccctgcaccctgatggttccacaaaggaaaaggaattacgaccttctcaaactctcacatatttgacagccagatgacatcgatcacagcagatgccgcaaggaagatgcaactgagaaaggcacacgcgatggaggccgctgacaagtcgcagaaacgtggcagtggcttgcagaagttggggagcgccgtgtgccggatgccggtgcggttcagattcgcgactgccgccgctgctgatccagcactcatcattgcatatgcgaagatctgcacgcgaatgaaaaacagcagaagttagatgttaatcttgcattccacgggaaatgtcaggccaaagccaaatgttcagctgctatttgttgaactaaagaaagttgtggggttgcaatgggaatggaaagtaaagcagcttaatgacaaagagtttttaatcaactttccatcggatgatgtgagaagtaaaatatccacttgcaagagctttgattttgagacctctctaatcaaggctagtgtggtggagacaggtatgacagaagaggctgttgatgagctagttgctgtttgggtcaaagtatatggcataccaaagattgctaggaatgaggatgctattaagtccattgctgagttggtgggggaatttgaagctctagatggtgctagtatcagaagagatggtccaatcagagtgagagttgcttgtaaggaccctagggaattacacttcgggatgcatgtctatatcaacaaagtgggatacttaatcagatgggagccagaagggtattcgtctattgagaatagaccaattcaccctgatgacgatgacaaagatgacaaagacgagaatgacggcaatgaagacatgaatgttgatgaggattacaagatgcaaagccctactagaggtagacagaaccagaatacaggtgcttcatcaaggggtggacactctgcgccacctgcttacaaaggcaaggaatataagagtggttatgtcaagaagattgcctctaagaaaacctctactatctcatcctcagaactggttttggagaaagaaaaaaagaaagagttagtgtcactacagcaggaaccaaagcacacagagtcacctgagctggtgttgtgggagaaaaagatggagatagtccctatggaacaagaatcccaggaaat

SEQ ID NO: 58808 - DNA, 2696 bp, Oryza sativa
ctgatctttctttgatgtaacctgcataaattaccattttttatcagaataactgcattagtgcctaatagcatctctattggtcatatcttggacatttcagtttgttaaaaaaaatcatgaacatttacttataaaggaccattgctttgcaacaggcttaatatagtaggagttgggagtttgtactgacttcacaacaaataattttttgggaaaaaaaaacgaacctcctgcaagaagtcagcaacacctttcctctcggggcagcggaacccacacctctcgaagaactcaagcacatgctcccgggggccctggtacacgatctgcccctcggagagtagcatgacgtcgtcgaagagctcgaagatctccggcgcgggctgcagcagcgacaccaggacggtggcctcgcccatgtggacgatctgctggatgcacctgatgatctggaaggtggtggagctgtccaggccggtggatatctcgtccatgaacaagaccttggtcgggccgaccagcatctccgctgccatcatccacagccgatttcagccaaaggatcggaggggcgaacgacatcaaaagctgaggcggggtggaaggaggcaccccgcgcgcgcgagggcctacgtacctgtggtgaggcgcttcttctggccgccggagatgccgcgccgcagctcgtcgccgacgatgacgtcggcgcacatgtccagcccgaggatctgcacacaccggcgccatcagattcatccgatccagctgcgtcgcgatccgcaagggaagcgagacgagacgagcagcgagctctccccttcctctctgcggcaaacaatcgaacgcctcgcctgcaacttcctcactccctcctgtagaattcgcgctctgctctagctgaagcgtggaacggtggaataaaccaaacgccaacgctctagttcttctgtgtggctatcagctatgtaagatgggctttattaggccgtaagtgggctgctagctatccattagggccaaatatatgggctacgtaggtgaatgtggccttgtttccgttcactctcttatctcttctgagtttataggccaaccagttcatcgattaagcatatttagtatggagtaagaaaaaatttcacagaaaaaaaagagaggttaattcctgtaggaaaagaggatgggaacctgatacgtaccctgagaatgtaatctgtctggagagtgctcccctcaactgaagtagcctacacatcgagcaaaagaattccagacctcgtcacttcgtcggtatgaacgaaatacacaatataatcaggtagtccagggttgaaatatgaaaatggtgaattggtctgtgaaaaggatgaaacaaagaactgcacaccttcatgaacaggtcgacttctggatctgggtatatgcccagctgcctctccttcttcgcgagctccttgagcaactctgcacgcgcactcgtatgtacgggagacgggttacgtacgtacgaatatttccagtattttgccacgtcgaaagggcgatcgcgactcaccgtatctctggccaaccccctgacacttggcggagaagtcgagcgtctccttgacggtcatctcgccagcgtggacgtcgtgctggctgatgtacgccgccgtcttctgcggcacgaactcgtccagcccgtagccgttgtacgtcacctcaccgctcgtctgcatacgccgacgtcaccaggttagtattggaaagtcggctgtgttcttctctcaactttcccaacatctacactttcatttttcacacgcattttttctaaactactagatgatgtttttttaaaaatattctatagaaaagttggtttaaaaaatatattaatctatttataaaaaaattagctaatactactccgtcaaaaaaaaatccaattcaagcaatgaatctggtcacacatgttcagatttattactaggattggtctttttttttttaaacggatggagtatttaattaattatgtactaatcttttgctttattttttatgccgggaggcaaggttatcaagtcaatcgacataatggttgcatgggtcaaaagatcgatgacgagatcatgtatatattcacctcaagagttgggtcgagcttgccggccagggccagcaagagcgtcgtcttgccggaagaaggtgggcccagcagaagcgtcatcctgtgtgcgagtatacgattacaatttgtagctcagctcgtcgaacatgtggctgtgtcgaggcttgtagttcagctcgtcgatcgtaattcgtatgcgtgtaggtatacgtacctggacggcctgacgatgcccgagacgtccttgaggatgtggagggccttcctcttggcgaagttgaggccgacgaggcccagcagagactcgcccacgtcccgcgacacgttcgccagcgtcggcagcgcgcgcgtcccgacgtggcactccgcctgcacgttcacgttcctgaacctcacctccaccgtcggcatctggatccccgccctgccaacaacgatcgagcagaatcaatcaatcacaaggctcgagccgtggcgtccatggccattttcactcgatcgggtggttgttggttcgttttttttttcttttaccggtcgatgcgggcgcggagctttttgaggaagcgctcgttgt

SEQ ID NO: 58809 - DNA, 5820 bp, Oryza sativa
  unsure (1)..(5820): unsure at all n locations
gcaccgcctcggctccggctgcctcctcttgtacgtgctgcgggtcagccatgcttgcacggacgtgcatggattttggtcagtggccgccagtgtggtgtcaaacatgcgcgacaaaacccgcgtttggttacaacatgccggcaggttaaatagcctggagctagccatttgtctcctttgatgtggatggatcacaaggaattttgcaagggttagtttagtgtctggctctcctaactgaaatgcagtgccgaaactgagtgatatgttcaagaacatgaagttggcacatagttatttttggcatttttgcttgacagctctgatacaccagtgcacgcacggacgcacccagtgaactctgaagcttagaatacttgtgctgcgttcagtgagattcttcgaagggaacaaacgagtgcaagaaagccaaatggtaaggcctaagcatcttggcataatcgcggagaaatattccagagtctcatctcggtgtcatcactgaattcctggctgattggagcattccctctgaagctttcaacgcattggatgaaacatttagcatgtataagcggccggcatgcgtatgtaagcctgatcggcgacaaaagagaatcagatggagcagcctgaaacaatattccctatatctgttggagagtgcggactactaggtaagaagtgtggcaccgtgcttccctcctccctcctcgtcaatgctccggcgccggctgtgaacgccgtgcccgtgacgcctttctccatgatgccggcgacccgcgcttcgcgctgcacctccgatccgcgccaccccggccggatctggacggctggcgtcatggtggcggctggacggtggtggctggacgggggtgtccgtggcggtggcggtggcggtggcgatggtggctgacggtggcggctggcgacggtggtggctgtgatagtggcggtggtggctgtcgacgatggtacctatggcggcgatggttgaaggccatcatccggctgacggtgcgtcgtcgtcagcggcggtatgtggaggctgggaaggggtctggcggcggggaaggaggagtccaggtgcgggcacgccgtcgacggtgggaacaactgtgggcggtggccttggccgaatcgctgaagggacaatgttgttgaccgacgacgatccttcttgtgcggattggtggtgtaggtttggacagggaattgcgggcgaaagccttgccgagccatttggctggctgacaacggcgacgccgtttggcgtcgttcccctccttggaggagttgttttagcatacccctttcctttccctaccatattctccaggtgaaaaccttgcttcggttgtgaacgagcggtggcggcgatccacgtcgcatcctccttgggggcactgctttggagaaacctcttcgtgcaaggatattgtcattggtctatgcattggcttcgaacttcagtcctaggccttgacgaggccttctagctccacattttgttttacttttctcagtttgggtcctctcttctcttgtttggtgtgttcaacttgtcttgaactacactctcttctagagtggatttttgtaataattggctgtagttctttttgagcaaaggccaggatattatattccattatcttaaaagagaagtgtggcacagctgtggcatgataatgattttgatcgtgcattgaactaccccacaacagcacccctaccccacaaacagcacacacagttacaataatggataatttcgtttctacccctgttttaatgtcaaatattgattttgctcctactttttagggttttcgttttttcctcacttttttgaaccgaaagaggcgtttacccctagtttagatagaagtgagtgagaccgggcttatggaattaaataaatagagaaaaaaaggaaataaacatttttcatattgttgattgactcttttacccctaggaaatatccaataggggaaactattccagcctctcatgaaaaccccatccgacgacattcggtagcgcggtaggcaacggcgagtaggcgtcgacgggtggcggtgagcgggcatcggcaggtggtgcttcggcgcagacccctcccgccggcgagcaggagtggccctacgcgggataggtgactgggagagggcgcgacaacggggtgaggaggcttggaggcggcggtggggagggggttaggtggtgaccgagagggagcttgaaggcggcggcgggcagagagattagaggcggcggcaacggctctgcgtgagtgaggaggcgacgacagcagtcaggcgacagcggctcagcgcggagaggaggcgatggtggcgacaacggcggcggcaacggctcgacgttgggaggaggcggtggtggcgacgcggcgtggggaggaggcgacggcgacggcccagctagggggctacgacggcggctcaacacggggaggaggtggcggtggcgacttggcatggagagcaggtgacagcggcagcccgaccaggggtgacggcagcggtggccaagatgcagagaggaggaggcggtggcagcgaccaagaggcggcgacttgtagcaatatgacattttgttttgccaaattttgtttttttttcaacatttgtccagatttatcacatttgaatgtcaaattttgaaacaatatttttacatttgtccagatttatcaaattttggaacaatattttttttgatattatgtcaaaattgtcatatttgtaaaaaaaaattgatttacgaaaatcgccagatacgctatagggtaaatacagaactaatgaactaaaatagggaaaaatgtgtaacaacacagtgaggctatggatgtctttttgtcaaagatttaatatgtccatccaaagtagggggcaaaacttagtttcgtttttttttttaaaaaggcaaaaacgaaaatattaaaaagtagtggcaaaaccaatattagacatgaaagtaggggtaagaatgaaattgcccttacaataaagtgttgagttcgagttctcagcttcgcaataatgtccgtacctgagaaacaatgaatgaaaacgaaaaatacacctgagaatgaaaaatgtaaaattcatcgatcaattgcaaacctgagaaacaatgaatgaaaacgaaatatacacctcctgagaatggaaaacgtaaatttcagagattaattgcaaacctgagaatcttgtataaattcaaattcagagatcaattgcaaacctgagatggaaaacgtaaatttcagagattaataacctgatagtcttatgtaaattcaaattcagagatcaattgcaaacctgacagtgaaaattatataaattcagacagagatcaattgcaaacctgagatggaaaacgtaaatttcagagattaattgcaaacctgagtcttatgtaaattcaaattcagagatcaattgcaaacctgagagtgaaaattatataaattcagacatcaaatcgcaaaaaggaaataaagtgcggtgagcgtggatcgaacacgcgaccttcagatcttcagtctgacnnnnnnnnnnnnnnnnnnnnnnnnnnnntgttcaaaaggttcaaacacatttaatcaaaatggcgtgcaagcctactatttggcaaagttttgacatttttttcttgctcttcgaatacccgttaaactaatctaacaaaaaaatccattttattccttcaaaatatttatttggatcacttaggcccctttggactcagaatttggaccgagcttatcttcggcacgcaaaaaaagacatgtcattagcaagtgattaattaaagcattaacaacaataaacttaaaaacataatttatttgatttttaaagaaaattattttttttcataaaacgtaccattagcaattcaggaaacacgctaacggaaaatgaggaagttgttggtttgagttggtgaaaagaactcagtcttaacctgtattttttttgagtcattttactctttaaactattgaaattgtccactttttactccttcatactatctccgtcccaaaataagtgtagccgtagatatccgtgcccaatgtttgaccatccatcttatttaaaacatttgtgaaaaatttaaaaatatttagtcacgcataaattactattcatgttttatcatctaatagcaataaaaatactaatcataaaaaattttcaaataagacgaacggtcaaatgttgaacgtgaatagtgcaaaactgcacttattttgggacggagggagtagtatttcattccttttatttatacaagtcacattttaagatgatatttttttaagccgtggatgttaccattatcaaagttcaaaacggtttcttcctttttcatgaaggtttgcttaaactttaaaatctcgatgtttaagtcaatcttagatgctttcccaaacctacaatcagtgataaaaaaattcaaaaaatgttgagacataagctataattcatctaccagctataatcctagcaaattccaatgcaaactatgactaatatagaggaaaaaaagaactgaaataccattagggagttaagtaaaccttttaggtctaaaatgagtaaaaaatagtttagaggttaagggctccaacaaaatagtttgatggagtaacaagtgatttattttctaatctaaaacaattaaaataagaaatagaatttcgcttgaattcaatatcctgcaacggaaattttagggggaagcgtgaaaagcgtcatttctaaggggtcgtctagattaatatcatttcaaaccatatcatttttgataaagttaacaaagatatacatttatttagttttttatcaaactttaataaatatataaaaaaatcatgctaaaacttggtaattttgatattgtcaaaatttggtaaagcttattttggctagcagccttttaagtcagcaggatgctgaaggcctctgtgcaattcgaccgcagaagcacggcctacaaaaagcccaaaagaccgagagaccagaagacttcttcggttaatccactacatccggcccaacaattgccacggactcacactcacccgtccgccgaaagcctaatcctcgctcccgccgtcgcgcggcgtccgcttgacggcggttttaatttgcgcacgtaccacggcagccgccgcgcggccgcggcagatatccggggaccgtggccgtgtccttggccaccgggatcacgcgcggtctcgcggagatcgtcgcggactcgcggtgcgcggtgacgccgggatcgcgacgacaccgggccgcccgtagtacgcggcggcggctgaggcatgcagcgagggggacggcgccgtggcgtatgattcatcctcccgcaaacctgccacgcactacgcaaaaggtaaggagctctaaaccaatcgctattaacgcactgatggttctcgtgccttcgtgcgtgcgaacgtgccagttttatacattagttaaatttaatgtttacgcacgagtttaatctgcgccgatggggagatatctggtgtcttaaggctcatgtacctgtagtcaactagtcactctactgcttttctttttaatctacttcgagaaaggtggtctgaccccagatagtagctaggtagtatatttgtaagcagttttacctttattttgtttgaatgggtagggattagggagcatcaggggcactactcattcatccactttagttctatgaaaagtggggaaatgatatgatagtatcaaggtgga

SEQ ID NO: 58810 - DNA, 1534 bp, Oryza sativa
tgctaccacatactagccttttctgcctctttaggaatagggacatactgtagtagccaccatatgaaagattcagtcttactactatcttctatgggcccttggtctttaagaaaaacttctgctaggaaaaggaagaagacatgcccatacatttagtgcgtgtattggtatctaaactaactagctagattttgcatctacctcagcattgcatagaactgctatatggattactacgttttggtaggtgcgctatcttaatctcttttttaagagataatatgaatctctgtttgagcaggtactatctttagtctttctattaattctgaactatttgaaaaacgtgatcagctgaatcaagaaaataagcacagagtagcttatggcctactgaaaccgttatatatcctataaatttgaactctctttattctttcatgtctactttgtgactacgtcctattctacttttagttagtacggtttatcgatattttaggtttgttggttcaacaactgaattggaaggaatcaccggatacgtacgtacacgaggtcccaataactaaactctagcttaattgtgtattcagtttttctatatagttcagttgtaatcctcatgataggatcgagttggagtggtcctgtttattcccattctaaattcaagttgcccggccggagtggcatggccatgctaccacacaaagtgggcaaatctaattgaatctctttaaacgattaggcttttaagcttttctatacgtttctaaagcactgcaatttgcaactcatgcatgcatgaaaggaaaaaaaaaagcagtacatgtacagattcagagcaactggatatcaaatagtatatgttctgcccttttaaagctgttatgtctacgtacagctcgttttcgttccgtcctgaattccgtgcttttacaccagatacgtactcttattcagagcatgtttgccatgttgcttaatttatgctctgttgcatcataaagcacaaatcactttgattatctttgtctatgttggctatcgaagaaatttcgtagttgttcgtatactggtatcataaacatatacataaatatcgtacagctactgacctcaacaatgacttgtgatcgctttagtctagcttttgctggctattttctgcactgtggcatgctgctctttgccttggttggaaggaatgcgcatggttcatgcatacaacgttgttcaagagtccatctcactttattttttctttggaacgaccgagactattcagatcagttcattgctgaatgggtttgagaatttaataatttgtttgcaacggaagaatttgaaggaattatgaaggatttgcgttgttttttttttttgctactacaaaaagtatcagtattgcaaattggcaacgccattcaaatggttgagatgtgttcaagaaagggtatctgacatgatggacacgcatttgtgtgtgcaagactgatgaacatatgaagtaatttggtttgttagg

SEQ ID NO: 58811 - DNA, 1093 bp, Oryza sativa
gtggtgttacaaaccgggaataaaaatcaacacgtactatataatccctattacttatgctcttctctcgtccacgcaacaaactctatctctttctttctttcttcctctctaactcctgccttatctctttctttcttcctctcttttttcttttggatcgagcgagatcgagggccggccgggcggcgggcggcacggccgacgtggcggcggccggcgcggtggcggcctgcgcggcggtggccggctggcgcagagaggaggcgacagcggccggccgagcggcgcctctgtggtttttttctcttttttttagaatttgtgatttattgcatgattctgtgatgtatttgatttgtgtgcgatgtgaatttgtgatgtatttgcgatgaattttgtagaacttgtgatgtaatttgatttgtgtaattttttttttaggatttgcgatgtatttgatttatgtgtataagtaacttaaagatttgtgatgtggatttgagatgttaatttgatttgggatttggggatatgcataccacttgattggggagaaaataaaaaagaaaaaaaagaaaagaggactatttgtactgctattattccctctttagtcccggttggtaactccaaccgggatctttagtcccggttggtgttaccgggactaaagatcgatctttagtcctggtaacaccaatcgggactaaagatagcgatttttagtcccggattcgtagtccaggttgaacaaccggaactaaagggggttacgaactgggacttaaaaaagcacttctccagcactgctggtagcgatggccttcacttgcgtcaatgccgtgttcatcgtcgtcacactcgtgctctgggcattcctcgtcggaaggtacagccggccggcgccggaacatcgatcacactccacgtccacatccagatccgccgaagaaatcacatggcgtgacatacattgtgttatatatatatatatatatatatatatatatatatatatatatatatatatatatatatatatatatatatatatatatatatatatatatatatataaacaaagagatat

SEQ ID NO: 58812 - DNA, 1643 bp, Oryza sativa
atatagggtgattgtaaatgaacattgtgatattcactatcctgtggttgagatgtctaatagatcaaaattaagttgtatttgctggaacagctacatgaagagccatatagcatctagcgactttgaaggtattgtacaggtatgctcacttctaaggaacatttttcagatttgcatttgatgaaatggccattattaaatatcccccttttttcaggtttgggatgttactaggagccaagtttttgttgaaatgagggaacatgagaggcgtgtgtggtcggtggacttctcacttgcggacccaacaaaattggttagcgggagtgatgatggttcagtgaagctgtggaatatgaatcaggcaattttattcttgcacctggtgtatgtcagcttttgaactaccgataacatggttatcgagcttatgtctgcaatagtagactaacttgcctctgctatggtaacactttttcatgaactttgcaggctgggagtgttggcactatcagaacaagagcaaatgtatgctctgtgcagtttcaacctgattctgctcgttccattgcaattggatcagcagatcacaaaatttactgctatgatcttcgaaacatacgagctccttattgtacgttagttggccacacaaaaacagttagctatgttaagtatgtggatgcatcaactatagtgtccgcatctactgacaactccttgaagctctgggacttgtccatgagtcaggcaaggataattgacagtccgcttcggacatttacaggtcatacaaacactaaggttagaatatcctgcataccttttttgttacggtgcataaacctttctcggggtattgttctggatatggttcttttttatctaatataacaatcatcctgtgtaaatgtagcttttgcacaaccctaaattgttattcattttgtcagttttctgtgcacctagttaccacctttttccctcagcatgttgttgttatatatgttcagtctttgaattacatgtcataaagcttcagtgtaatccctaattagttcttgtgcacctgcacaaaatttgctctccaacttcggtagtattaaaaatttcaacatgccttataggtggtagtaccccaagcaaaatgtgtttaccaaggtactaggtggtagttgagggagcagcagggcatcctctagtgcctaatcattgataagtggccaaatggttaggcgggcgggttcaccgagcacctaaacactgtctgggctggctagaaagatatgattaaggccacttgcctgcttttttgagaatgacacttgattttcgagattaagattctagtatagccctttcttcatattcctttagttgctttcaggcaaaagaatactttgttttatgcttaatttagttatttcttgaacctgttgaacagaattttgttggactttctatatctgatggttacattgctactggctcagagacaaatgaggtatgttttctaagtttccaccaaattctctgccgactatttgaaggttaatttcaatgtcatacagcgacaccagcttttgtgcaaagctaatcattggagttgccctaatgcagtaaactttgttgcaagcatg

SEQ ID NO: 58813 - DNA, 20807 bp, Oryza sativa
tctctcagaaaccaatattgagatgaaagaaatcaggtattaagatgagagcgtcatggaaaatgatttttttttttgttttgtaacctgcattttctatgtaacagttgaattaatgtttgccgaattcatgtgaaggaatattttggctcacttaccttagtgcgcaaggtattttgtgccgtaagatgaaatttggtattgaaaacataggcatagaaattattttttataccatacgtgcctgtatattcttgcttggggtttaatattaattcaaatatctaactttcctttccatctcgttttacttcaggtttttgtctaccacaaagcatttccaatgccagtcttggcatataaattcagtgtcacagacccaatatcaggccaggagattgacgatccatcacagttcatttcatgcgtgtgttggagagggcagtcctcaacgcttctttctgctaattccagcgggaacattaaaatcttagaaatggactgaccgtgcacaaatgggcagcttgtgcgcgtccagtttccaatagaaatgaactgacttgacacccaagggaatgcgcgtgcccggggctagcatagtgcattggaagtttgccttcaaatgcagagaggtctatagggcgcgatgtaactttattagagttggagttaggaggttgataggacagagtggtagctgtaccagagttagcataggattagatagaaaacgtagcataaatagggaaagtatttgtgacgcaggggatccaagaggggttttgtacatcattggtttgaggtatacttatataggcaatcaatccaagcttcagtcattgctattcttgttttgaaatatgaacttttagtgccctttcaattgatcgtttcccttatttctttttaagaaccacattggttattttcgtacacatttaatgttccctgcatatattgaaacatttgatacgatgaaatttttgaaagtttgaaaggaactaaacacaacacactaggtctggggctacgtccaacacttttttatcatcattatttgctggatgcggaaatgcacgtccacgtcgatccaccgggcacacgccacacacaaactgtgaccaagttgtagaattcgaagtgcacagccacaccacccccagccccaaagtcccaaacacgttaccgctaatcagaaagtcagcatttcttggggtctcgcgggccgaagacgaagttgccggcggagtagcgcccttgcagcccgtcggggagcgccacgaacctgcggaacttgagcggcgaacccgtcttccgcccaggctggagcgccacgccgcacgccgcacgcgacggcgaccgcggcacgtacaccctgcagtccttgctcgtgaacgccgccacctgcgtccccgtctggatcaggaagtagccgcgcgcgtccgtcgcgccccacaccgacagcgcccacttcccccgcctgcaccgcagcagcgccgccgcatctgcgcacgcacgcagcaaaaagcacacgttatttttcagcggccaaaacgaggccatcgagcgcaggtgggtggtggtggtggtggtggtacgagtactatacttgggaggggcgaggcgtccttggacttgacgtagccggcgtagcggcaggtcttgcaccagacagcgccctcgacgccgatggtgaagttcacgttgggtggcggccgggggagccccatggcagagcctcctccaagctgggtgaggatcacgagcaggacggagaggcagtacagctgaagggatcccgcgaacctagccattgttgtttgtcaaatgatgaagctctatacttatattaaattagtacgtcgcaatgataatggaaaggatgagcaaagatggcgcaatttataggctttgtaggtgggccgatcagctagctaggctagataccgttttgtacggatgatgatgatgatgatgatgatgcgtgtatcgcttatatgggggaaacggagctcatcacgtgcatgtacgtggccttttcggtgttgcaagctacctgcgcgcatccggattccgggtagcgccgcttgcactcgttaaaatggataatgttgatcgaattacttgttttgataggcacagagtacatccacttgttcaaaatgttagcataatctagaggccggcccaggttaatcatgttgtggactggttagtacgacctggtcgatcgattggccgatgcatcaagtggtgtggaacatgatgcattaaccattttcgacaaattaattaccaggcaaatttgcagcctgcaaattaaccatgcatgaacagaccaaacaaaagagttttttttttcttttgacaaaatgagaacagtttgagccccatacaagtaacagattatcgtaacattaagtgttgagtgaacgttcgttcgaaaaaataaaatgttgagtgaaccactgcaattaagcaagctaggagaagccatgcatgctatctatgtcaatgcaataaatctagactagcttctttaaaaaaaatctgggtgctccaaagaggttttctaattaagtcatttcttgaactccgcacggatttgtttgttcagaattcaagctgatgcttaaacatcagagaaccacctagagcacaaaatcggcaggcacggcatctagcaacgcagctacggttcatcatgcacgcatgatgaattcgcttccgcttttgctccagctagcataaaaggggcgcggatactttaatttgcatgcaaagggatgtctttcttcttcttgatttgtttgatggatggcgtcctcacggtacatctatcatcgatcgccgccccacgacacacgcacgcacgcaacgcaggtcaaaacccaaacaatttcagccgcgcgcgacatcgtatacacggaaacttcgtcatgtgtgcgcgcgtatccctgccggccaacagtttgtcatggatggaaaggattaaccaacaaaacaccggcatgttccattcctgaagattcacgttgcataaccgttctgccaaagttcgaaactgctttcttggttttcttgggctgtgatgggcgtttgcttgggccggtaatgacaagaccaaagcaaaccgtccgtccagtggcccagttcccacgcctcctgcccttgtccatggcccatcaaagccatggacaaggacatcagcaagttagcaactacttggccctaagtgctctgttatcacttatcagtgaaactcttttgtttaatggtgagagaatactaagacgatttaattattactccctccgtttcagattataagactttttagcatttatttatatttatatagatattaataaatctagacacggtactgttcatgggagggtggtagtacttattaactattcacgctactctcagtactctgtatctcaacatccaagggcggctctgactcttgtattctgaagagtgattagtggctatagtaaacaggccaaaatgcagacggagcataaaggtgctggaaaattccgaatatacttactagtcagtcgtcacaaaatgcatgcttaagtagagtattcgacctcatttggtatgtgttggaatttaattcaattaattaattgaatcttagcctaaacatgatcaccttctgctcatgtggaaattaattgatatagctgacctgagatgaagccattgcttttctttttttcttcttctgttacgaatcccttccagtgtctaatcgatcgggcgattgatttagggtttagggttggagagagttgagtcgtcacgcagcctccatccttctctttctttatatagcgacactggtggggctcgggggtttatctcaatctaaaattcgaatctattttgtaccgatcacacaaaacagatttatctcttagtttgtttcttgttaggatagaaaaaccggtgggattttaaccttatcctaactaaccggcattagccgataaaatcaaccaacattctccccttgattttgagactaactgacgagtttatcacataaactagctccccaaggcaatgtgtcttcaacaacattatgcgtcaccgagacaacaagacctatagtttactatagtacccaaataaactcaagcttaacttagtgggtgttgattgaaaaattaagtccccctcatccaggatcttagtgaggctattatttatgcatgtactggctagaacatatcttaattaatcttaactttatgagcctttagagtatggatccatgagcaaaagcttagtttagtaataattcgatcctgggacatatctttcacaactatatcaatgtgttaggcagaaaacacataacatgttgctactacaatagaaaactgtgtgtaatcagtgcacaacttataacacagtatattttgggtggtttacaccttttgagtggtttatgagcgctatttaccacttttagttctgggaaatattcttatgattaattataacatgctttaaaatctaaactgcatcgtcgattatgcagtaagagattatttttggagcttttccatggttattgctcccctatgtgtggacatagcttaatcttagttaacttaataatctttatatatatccacacatctcacaaaataagtgtccaaatgtctctaaacttctgagatcattggactttagaaatatgagcatgttacttaagattgctttgtaaataaacaaaacattcttaataccagtggtctagtctggatttaattaatactgtcaagattcccagtaaaatgtatgccaaatctgtatgcatccagatttgagctaatctcaagcttctatcagctgaatcataaatgattatctttataacttaacttcagcttgactaatctttaactgaattctctgaaattatttctttatgtcaatatatgacttactgatataagcccagtactccttcagaccaaaataattcatggaaaaatttcctttaatttctaacagcaatatgtattgcttgacaataaaatgtcattagtatggagtaccggtgtgaaatttccacctttaatttccatacagctatccacctcacttgaattattcgaaattttcatcagtcgggcttaatttcattaacccacttaaatggcccactattttgactcatttagaaacttctactaaattctttattttattcatcaatctcaattatccttacatggttcgaaaaccatttagatgaacactttaatgtcttattttgttcatccatatcaatttattcttacatggttcgaaaaccatttggataaatgcttatttttaatgtcttataaggtgaacaagctttatttagtgtttaccaccataatccgatctcataacttcatttgattttagcattagtgtcttaaatttcttaaaggaaatcggaggtcgcttatgggtaaacatagccataaaaaatcatttgttggctaatctcttaacttcgtgaaattttcacttaaagctaaacaacaccattaaaatctaagggaaataatatctctatctcatgagacgttccaaactcccctaggtatgtgacataagcgacaatgacacaatttcaatgacgtcttacttccatcattatagaataattattctcctcattcttatttaagcttagttcactaatgacgcagcggaatttaaaacatcatcaatgtttgattaagtccacaaatggatttcttaagtctgtaccctatatatgacttgtatttccataacaaaaccctcaagttatgttatgtatatttaattgtgtaagtcacaaattaagagatacaaatttctagcatccacataatggagctatgagtcataaatgaggtagaataatcttctcttattagagctcttgatgagctcccactgattgtattatttatttaatggaagcataatatcttatttttcataaacttaaatcacttaattttacttagtgaattatcatctaagtaataatagatgtcagaaatttctaagggtgaagtgtctcgaccttaatgagacgtccattctcccctagaaatgtggccgaataataaggccatagtttcgacaacgtctcataatgattcaacccaaaataatgcccttaatcttcttatttaactactttattgaatcaggacattaagcatgtccctatttcttgcaaagaacttacacaagaaaatttcaagagtagcatacatacgacatagaggcaactttatttccccttgcgaggaaagtgagctttattattattaaatttggagttgctacaaccccatagtatagcttcatcttttccatcaaatgacaagattaaaaggatcttacttagtttgcctcttagtcttctatatttcttattgatttgcggaatgatgaaccaagtcaattatggtccacttggtcttagtattacaactctgaaaatgaccgtagtctaatgggagaagaatcatatgaaatggacaagtggcgcatataaatgtgcgatatccatctcacaaagtttgcacgccatgtgatttatttcttgtgctaccttttaaattatggcggcaaatgtgcataggcactaaaattgtactaagcatttgttttgacaaacttctaaagttcatctcaacgtttgctagatacagtttcacaatgtcatgctcaaaattctcccctaacactaacagggatgataatctcaatatttgtgagtgacatgcgaaacatagcattatattggccttctcccaggctaaagatgcctcttgagtttaggaaacattagtgacattagctgcgggagccacaagggatcctttgttaatgctaagtcatactcaaataggccttaggctccgttaagtcaatgaggaaaaataataataatttcatagactttaactgataataaaattaagtggcactattattgtggttgcttgtgcaaattacgtacaatagtacattaacttacacaataataacttaatctttatttcgctttgtatcaccgttgggcagagacaaaatgaaggaattacttataatccaaaatcaagtcaccgttgggcagaaatgattagggaataaacattaatgtcacatcaccaaaaggtagaagtgataaagtaaataatttaaaatcccaaatcaaatcaccatacggtagaaatgattaggaaatgacgccattagtgatgctatagaattaaaattaaaatccttagccatatcaccgttgggcagaaatggtaaaggaattaagattactgatagattatatcctcgatcacatcaccgtaaggtagaagtgataaaaggaattaatgcactaatggcataaataaaattctaagtcatatcaccattaaggccaaaatgacagagaaaattaaaataatgattgacaatacttagatttcttcccttaattacatcaccgttgggcataaaataattaaggaaataacaatcttaatgaaatcatctttctttgtagataaacttcccgttggttccatttatctagaaataatttactcattatttcaactgatcttaaataataagaattgttgattgcatataattagtttaccatagcttaatcaatcgtatgcaaaataaacttagaatttcatagtcaaagcaccattggtcataaataattatgaataatcttaaaattaattccttaattatatcaccatttggtagaaaataaataaggaataaaaattataattgtcatgcaattataataacgtgggttaaatataacttcagatcttaatactttctagtcgaatttctcgttggttccattcgactataaataattaagttactaaggcaatgaccatcataatgatgttgacatgaaatcataaatattttctagttaaatttccatttaactagggataaattaaatggcttaaggaaataataaccttaataaatattgacatgaaatcatattaacgttggtcaaatataatatcatatcattaatttctttatgagtgaccaaataattgatcataatttccagaaattttaaatggctaagaaagcacataaatgaatttctgaaaataaataagacattaaattcgcgggcttaagattaaaattaataagagcccactcttattggtgaggccggcccaaaacggaccggctcacttatgcgcgcgcggcgctgaggtggccgcagcccagatcggctcggcccattaacggcgatggcccgacgcgggagcgaggacggccgtccgatcaaacagacggccaagatttcgcccgcgccgaagaaatcgcgtgccacggggaatgggtgtaaaccctaaccctagctcattcttgtccccttctcttcctgattcggcgtccggcgagcgagcgagcgaatcggcagcgatgttgtgacggcggtccggcgaggcagcgcgcgcgtgcggcagcgagcgccgtagcggctccacctcggctggctggggggcgcacccaagggcggcgccaagccgtgtgctacggcgtcggcggtccggcgaggcggcgcactagcgacggcaagcgtctatgcggccggacctcgtcagcgggggtgcggagcccgaaggcagccgccaagccgacgcttcccgtccccggtgagggacggtggagagacaagctccaaggcggcgcgcgcacggcggtcaaccggcgcggccccgaggagaccggagagctccggcaagcttagggggtctaaatccggtaattaacccgaactcaaacctaattttgacttgaatttggatttaattctggtatttgtgacttagggttcttccccccaaaaattagggttcctcatttggggattttaggccgattggatccggcttattggggattccgggaaatttcaatcttgtttattcccttttgcttaacagtggggaatttcaatctagtttatcccctgttttccccaatttacttcttaatccactgttcttatatgataagaacctagggtttatgagttgggaacaatgagagtttcaatctggtttatctcattcgttctccgcttagtaaaattcgagagaaaaaaaaatctctctctgattgaatttctccttcccttactgatttctagccgaagctatgatttacttaagcatgaaccctaattcgatctaattaacttaaatatgacataatgctcaacacaaagcaactttaagaactaataaacagaataaggggcttaacagattaatcatggcatcatgccgggcttaacagattagggttcatcacttcattggcacagtgccttcaatcagggatgatgggatcaagtggctaagattagtatctgataccacaatgttggaatttaatccaattaattaattgaatcttagcctaaacatgatcaccttctgctcatgcagaaattaattgatctaactgacctgagatgaagccattgcttttcttttttcttcttctgttgtgagatacctcacgaaccccttccagtgtctaatcgatcgggcgattgatttagagtttagggttggagagaattgagtcgtcacgcagcctccatccttctctttctttatatagcgacactggtggggctcggggtttatctcaatctaaaattcgaatctattttttaccgatcacacaaaacagatttatctcttagtttgtttcttgttaggttagaaaaatcggtcgaattttaaccttatcctaactaaccggcattagccgataaaatcaaccaacaggatgcaagactattttccaattcttgcaagaactgaattggtcaatgtgaacatactataatgctctctttgctgtgaattactcgttctttttgcttttttttttgcacagcacccaatatttagcgtcaaagccggacgtaaaactggacatctatactgcagcgttccaaagtgtactctgttttggttttgttactgaacctggcgttgccacctctctctgttctaaataaacagtgacgaaataattacattcacataggatattactgatacattccggaaggtgtatagtagtagtactatctgcaactgtgattaagatcaagtggtcagaggctgcattatatagtccatttggcagagtaaccatttccctccaggctctagcaatgtgtgcaatcagaggcttacagatccatggacgacgacttgtaagattcctactttccagagttccagtggccagtgtttggaactttggatcgagtgaaccagatggcctagatttcaacgtcttaaaaaatttgcaaaatttgcaagcggacaaatcatacaagtttgaacagagaaccaatggagaaaccaccaatgctacactgacaacaagcgatcgaaacatcacagccgcgctacctctcaaactagaactgaacgtacacacacagtctcgctacctagtcgctactgcaagtggaacaccatgacacacgttgacaatacgtatgtctagttgcctactttaattattccttccttgatcgatcgatcgatcccgcgcagtcacgcacctcggcgcgcgtgccgcatgcccggtcgccggcgtaacggccggccatgagctgccggagtagctagagccagctggttagccggaggggcactggccggcgttggcggggccgtagaagaggacgctggtggggcagtagatggcctgcaggccgacgggcgggacggtcctggtctccttgaggagcgagaggccgatccacttgtttggcgggtagacgggcttgtcgcacagcgacgtcggcgacgagcccaggaacaccttgcaggtgcgcgggttgaagttgcgcaggtcgtagaacatcaccaggaagtagccgttcgcgtccgtcaccgtccccgtcacgttcaccaccttcttcccgtagcacaccagctgcgccgtcgcgcctgcaccgcaccacgacacggtcagaaaaaaagaaaagaaatgtgtagcaatgggggacagagggagaagaggatcctggatgcgcacctgggagaggtgacgcgtccatgtcgctgctgtagcccctcgacttgcacgttttgcagtagaccacgccctccacgatgatgaacggcagcggcggcggggccaccggctctacggccgtgtcgttggaggacgacggggccggcgccatggccgtgtcggtgtagggcgacggtgccggcgccgtggccgtagcagcggacggcgaagatgacggcgccctggccgtgttgtctctgctcgagacgacgtcctcggccatcgcatggtgcgctgggagcagcaatgcagcggcaagcacgagcagtgccgagcagactacggctgtgtggctcctcatctttgctgaactccttgactttcttttgcttggcgctaattttagttaagttgcagtgtgtgatcagcgttgctccggcaccggctaatttatagggcgatctgggtctcgacttggccttttactaatttgcagtttgaccaaacaaacagcccggctaaatcagattccgttcacagttaatgcgtttcccgtctacgagagtagcctggggagcccggtgatgtattacaggggacgagtgcattgggaaagttacagtcctgccttcttggcagctgtacaacaacatactaggaccgtaaaaaagtttccgttcaattggaggcctcagcgtgtgatccaaagttccaaatgaaacgcccaaagagctccaaattgcatcaggtaatataaacgttcttctctgttcacttcatcacttcccttcctagatttgggaagcgtgtcaagatgagttttctgaacaagtgtcgcgttctcggtgaagcgagatcgacccgttcgtgaggatgcgcgcggttacgtggttttgagcggggggcgcgacctggtttgacttcacgggtaatgatgactgcgccttacaccggcggcagcctcgcgtcccggccgattgtttagtcgcgggcgataaatgcaccattagtccaggtaatatgaaatcctgcctgtatggggagctggggttaatctgccgcaacttgctgcatcagattccggtttactgcgtcaggtgatatgtgctattgctaccgatcggatctgcggcggacgagaggcctcaccatcgatcgcggcgctgaccgtttcacggcgcgtactgagatgccctctgcttgtcacttgtcagtctgagtctgacgccggagaactgagcgatagaaggtcttccgcggcagagagccagagatgttccagctgcgtgcagccactctgtatgcagcgtgggaaaatacatttgacaactctcaaactctgcagcttcgcgttttgcctccaccgacaaaggagcgcaacgggattttgcatccagtgcggtgcaggtgcagccgtgcaggtagcgatcatgcgttgcctgccttgtccacatgtagcgcacaccaggaaaggagaccaaattacagaccgaccgtgattaccactcgaccgggagattacggactgataatgcacttcactcttatctcccttccactttcgtactaaacttttccccctcacgtggttaaagaaaaaaagtataattgacaatgcatataacaatatcagagtgcattaacgtctgatggtgcatataaataaatgtacgtttgtacgcacgctatgaaaatgcatgccaataataaaatctaggggttatctattccttggtacaaattcattctttttagagactttttacgatcagattacaccatgagtcatgatcatacaataacattttatcctcttcttccctgtgacacccgctcgcactgtcacactctaacccgatcaccgacttatgctagcggcaccaccaagacctgctcaaactggccttcgccatgcccattttctccccgtcccctgtcacgagtgctcatattccctccggtttgataatactagtcgttttggacaagaacacggttttcaaaaaacaactttgactactatttttcattataatacgtataaaactgttaacaaatatatgattttattaaagtactttttgagactaatctatacatgtagtcaccatatttgaaagataaatattttaaaaatgatcaacccgaagggagtacttgtctaaatggcaacaagatgctcttgctctcatagttatttgcgtacgtcttcaccaatgacgccatcattatccccgcctcctaacccctcacagtaatgcatctctaccagtgacgccgcttactggctttctccaaccccatagctttagtggtgccgcaaccgcctttccagttgccacccttccatgtttgctgccccaccgttggtttgtcatctctcagtcatccatctaagctcaaaccctcggtactagtgttcaaccctagtgtctaatgctcacagcgaaatcctaactattagccctagggccgcaacaatactagtgtttggtctcaacttgttgcattgaacaagttgaaaacaaccgccaatcagaaatagcccaaaataaccccaaaacatcaacttggtatgcaacctcagcctatctggaatcaggagagtactggttttcggcccgtcaaagatttaaagtttttcagaggaataagttcatcggaggtccctcaacttaacagtgagattttgagccgtgcactcaaggtcctattgtagtatatatgggtggtttcgctgacatggcatcctagtcagaattttttttaaaaaagtatgtggggcccacatgtcagctacaaattttttttcttctcttttctctcttttctattctcttcttcagtgagagagccgtcgctcgcccgccgtggcgtccttgctatcgccgccgccgccgtagtcaaagtggtggctcaggtagagcgtcactggagagacggagacgatggtgcgagcaaggcggtggtcgggccgcgtcttccgctccgcgtggtgctggcgttaatggtgagcaccggcaaatccgggccgtcggcaccgacagtgctcctgacctccacgatccgtcccccatctccctctgcccagggatctcgagcgcggcggcgtacgacgcctgccccctcagccgccaccgctcccgagggcagggaagccacctccacctccagattgcccgatgcgaagggcgggcggtgcctgccccttcagccgccgccgctcccgagagcggaggagccgcctccacctctgaggcacctccgtacgcctcagccacctccgccccgtcgccacggtgaagggaggtaaagggagcagcgcccgcgagccgtcggtcggtatccacggtgggtctgcatcgtggcgcgcttgtcaccgccgtcgctgccgcacggtgagtcccacctccatgatgcgcatcctcccagccagggacacggacccgaatgcgacgagccataccgcggccgccgtcaacgctttagatggctgcagaagttgggctgcggcgccgtggaaggagcatcctcgtggtagtcggacgagctgtcggaggaagccgatagggacggcgacgtggaggacgcaggcgccggtgtgatcctcttctcacccccaccaccggctatggccgcggcaatgttgttgttgttgttgtgatccccctcgtcggacggagcataggcagcggctccgggcacgggaggagcagaggggcggggtagtgtggcgggcgagcaccggctccctcacttaagaagagaagaaagaaaagagaagagaaggagaagaaaagagaagaaaaaaagaagaccagggtgtcacgtcaacgaaaccacccatatatactgtcatagaaccttaagtgtatggtttgtgtgagtttagggatacacatttattttttggttaagggacctaaaaaagctcgctgttaaattgagggacctctggtgaacttattcctttttcagaggaagccactgaggcctagatttggctattgaagatgggcttggcccagttaaggcttggtgcaaggatacgaaatcttgtccatcaacggttgatcagacggtcatcgattcagcggcctagggttttcgccccgccgtttgtaggattgcggctcttaaaagcccgggggcgactagtgaatccggaagggcattgcgcagcctccccattctctcccgtcgttgtggcgttttttttgtttcctccttttgctttgggatggctctattgcttagcgtgattttacctctcttgccgttttttcagattgatttgcaacgatttggagcaatgatgagatttgagtatgatctctgtgatgtgatttataatctctatatcgctacgttcttgctgagctcctcgttgctgttatcgttttgtttgtcgttgcttctttgagtctgtggagacgagcaattttctgctgagatctctcactgattttccttcggtctggattttttttgttctttttccttttctttttgtctaaagtgaaaacaagattgacgaaggtaatattcagtagtttccgatgtgatgctaatattcgcctaatacatgacgccgtgcagagagttcccatgagatcaggaaacaaaagatgagctcttgccgcaaacacttctagatattgcttaaccccggaaaagttcagcataatctttcataatagaacactggctctaagcagcaataaaggaaatctgaacgtcaagcgtccatctgtttctagttgaaccctgcataataccgaggtttgtaaggtacaaatacaatcggatcacccaattcatacataaggtacatgattcagtcgtatgactaacccagtttaaggtccaagccattgcttagtgaggtggatccacattccacatccttcagagtctgtgcatgagcaatctgtgcaggaaaattacagagcaacatctaaaatactgaagcatttcaaaatctcagaaagaaacaaaaaggagggtttgagaaatcaaacaaaaagttttggtcactttctctacccacgtaacccaatagtaagctactagcggccactgtaggtaggcttcatgagctaccctgcatagtttcatgtaggttgatgcagttgctttcacgaactgaaagctattccacttccatggtaaaggggttccatgaaagggtctatatgttctaggttagtatactttgtgtctctttatgccttgtaatggagcattgctcttgtctagcatcggtctactgtgcctgtgtatgtagtaccatgagtagggcatgcacgcttcctctgaatggtgcttctatagtcctatacttgcgtctatctttatactgtatcctatagtctgaaaaaaagaaccaaatatccaggcacagcaacaaaaggggaataaatttaaaacaaatctaccatggtttttcgatctattttctgtcttatttttatttttggagggaaagctatgtatcttgatccgtcaactaaaataaaccaatgatttctcagctaaccattcttataggctagtatttgcttatttatctctaatttagagatgaattaagatctgaaggcaaaactacaggaccaagaacaccaaagaacttagctacctgtttggatcaatgtctttctttgcacttgtgggttcaatacttatatgaaattgctgccaagtgctatgtttctcacgagtgtttgcctatcatctgtcaacatttgcctatgaagaacatttacacaagatttctttttgaccatttgaaagggaaaattgatgatgacgatgataatgaactgactaacaaacgaagatagtacaacttgataaatagccagaatgattatattctttaccttgtcgcacagcccgtaccgctcctcttgtcgccccctaatctgcacgcagataatcgaaaaacacatgtatattactagtgatgtttggtctcggttcacaacgcaatctgtaaatctgtacaagtgtcctgacggcacaggtatgaatcgtatcagaagtgggccgtgtttacgaaagacgtacaatgttctggaggtagcagatctcgcctccgatcttgcggtccttctcggagcgcaccttgcgcatggcggcctccagattgtgctccagcgcctccagcgacggcaccgtgtactcctcgccgtcgtccaccgtcatgaacctgccaaaaacacaaaagcacacacgatatcatgacgagtgacatcgatcagctcgcatcgagttgcttacctcagctgtttctccaggaggtcgcacatgctgcccaccttctccagctcggcgcgcctctcctacatgcatgcgcggtgccaaggaagagaaaaaaaaaacggcgcacgtttatttactggtgagaaaacgctcaaacaactgattactacgcgcgttgcgttgtactacgtgctacgtacctgcctgatatctgcccaaaccttggtgtgcgtggtggcctcgtacctctcgacaaactccctcacgctgcgccaagaaagaagcagcaacgaaacgtggattaaccaacaatgtcaggagacagcgcgcgcgcatatacatacgtgacggatcgacaagcggatgtgtggcagggcagcttacgaggggacggtgggggagaggaagtggtagagcttgccggaggcggagaagaggaggaggaggaggtcggcgtcgcagaggacggcgagctccctggccttcttgaacaggccgtccctgcgcttgtagaaggtggactgccgctgcgtggggttctctatcctctttatctcgctgcgccccctccccattctggccgatcgaatcctccctctcctccccgcgactccggccgccttcccgaactcgcaaccgcggcgcggagcaggcgctgcccgttaccgaggcgttgcgagaataaggaaaggttcgccgctgtagtgtatgtatgggagagattttgcccaggggatgcacggttatttttactgttttaaagaggcagatggaggaagaggagaggagggggtgcgggaaatgaacaagatggtctagtcctgttacatgtcaggcgccgcgtgcgtggcttttgcttcgctgcaggggtggtagggagcatggctgagagcctgagacggtaatatgtacgtgacatttgccaaagcgacggagacgcgtcgagggcacaggcacagtgggttgcagggggggagtctgttgctcccgcttacgttgtactactactgtactcctgcggggcagcacgtcgcgactatagctcgagagtacttctactgcattttgttggtttcgaaactatctatcggctcaaagcccctcaagcgcgctgaagagccatcccagtatggccttgtttaggcaccgtttagttttcaaaaacttttcacaaaaacatcacatcgaatttttggatacatgtatgaagcattaaaaatagataaaaaaaaactaaatgcacggtttgcatgtaaatcgtgagacgaatcttttgagcataattagtccatgattagccataagtgctacagtaacccatatgtgctaatgacagcttaattaggctcaaaagattcgtctcgcggtttccaggcgagttatgaaattactttttttattcgtgtccgaaaacccctttcaacatccgatcaaacgtctgatgtgacatccaaaagttttaattgaggaaaattttaagtttgtttgtcacatcaaacatacggacacacatttaaaatattaaatttagtctaataataaaataaattacggatttcgccagattacggatttcgccagaaaactgcgagatgaatttattaagcctaattaatccatcattaacaaatatttactgtagtaccacattttcaaatcatggcgcaagtaagcgtaaaaaattcatcttgcaattttacacgcaatctatgtaattggtttttttttctaaatttaatactatatgcatgtgtccaaacattcgatgtgacaacgtgaaaatttttattttggtaactaaacagagctatgccactgtacgtgtagaccgttacattttcacatagaacataaatacgtttttcagttcctaagcacactcagtattaagtatagtcgtatactatttgctatactccgtttcggtaggtctgagggggtgaataattgagcacacctgggtgcaaaattgataagagcatcctcaacagctcatctaaattccatcttctatactcttatttagatagtcatccaaaaagattcctactctatattacttttcactccaacagatcatccatattacatactatattttactaatttttacaactaccacatatgtatcaccactctaacaaaatttcccacctttatctcttcactccccacctttctctcttctccaccgctgatctccccgcctttctctcttctctaccgccggcgccgagaggacggggaggacgagggccgaccggaggggcggccggcgggtccatctccctcctcctcccgccgatggcccgtcgccaccaccacccagtctctgtgaaggggcggcgcgagcggcggaggggtggcggccggcggggcagaggggcggcagggtcagaggagtggtgcgggcagcggaggggcaacagaggagcggtggggcagaggggcagtggggtcagaagagcggcagcgccggcggagaccctgagcgacggggacggcggcgacctcactaccagatctgctgcctctccacctctactctggtgatctccacctccaaatccggtatgcacctcctctctcctacggtatgcagtccatatggtggcgcgaggtcggcagttgaggatggcgtgaggggagagaacctccatatttagcttgggaaggacgcggtttggaggtcctctaaaaatggcgtgtgtgatggaaggtctgctggagcgttgtttttcacctccatgcgccaaaaaggggatggaggaccggatagaggagctgctggggatgctctaaaggacagatatccgcgcgcactgcccccacgcggctcagccgcatgacacgcgtggaaaggggacggcggaagggcgcggggaaagagggcacgtggcggtttttcctcttttttctccttttttttagtatttttcgtttttacacattaaaaggtatagacacacacgtataaaaaaacatatttttgtctactgttagtattataataccaatattattaagtgtaaattagtaatttactaatacaatgattagaagttaatttgttatttatgtttttttctaactaaatcgatctacgatcatccattacattgggatctctcaatattcatcgaaaaagcaaaaaaaaaagagaaaagaagatttagttactgttaaatgatgattatactctctgcacctattttgacagtaatatccctccacatttctattaccgttaatagtgtgataatataaactagctgggtgacccgcgcaattgcgcggctagtagccaaacaaaatcatataattttcagtatgattttacttaagatttattaaatagctatcctcgtatttctaattatataatttttaaaagt

SEQ ID NO: 58814 - DNA, 31761 bp, Oryza sativa
tctttataggcatgttacttaatttatctcgttatgcattttagatggtcttttctttcaatagtctttatttttattataaattttagttatttataaattgtattcctaattgaaatattatttttctttttctattttcagaatttattttttaaaaaaaatagttaataccgtattgtgttcttttaatgttttaattttttattttcaatttcagttgtttcaaaattgtatttctacttgaactctctttttatttttctaattttcgatattactttatttttttgatttttctaatttttgatattattttattttatttatctcgtattgggttcttatatggattcttctttccatattgcttatttttaattccgaatttcaggtaattttaaattgtattcctacttgagctcttcttttattttcttttgctaattttggatttatttttatttttattccgaattttaattaatctcgtattgggtttttatatggactcttcttttaatattcctttttttttaattccgaatttcaggtatttttaaattgtattcctacttggactctcctttccttttctaattttggattttattttatttttatttcgaattttgattaatctcgtattgagttcttatatggaaacttctttcaatattgcttatttttaattctgaatttcagctatttttaaattgtattacgctctaatgtgggaatttctaacccccacaacaaacgtgatgcctccttttggcccgcgcaattgcgcggctagcacccaaacaaaatcatatatttttcagtatgattttacttaagatttattaaatagctatcctcgtatgtctaattatatagttttgaaaagtcacaccagctgctaccccttacttctgtcatatccttcttttgtttcctcggtctaccactatttctattcattctccttgaaacctcttaaaattagatcttatagctttttgagtttattatctcgttgggtttcgtttttataatttctagaagtcccgtcaaacgctgccattatactcctctaaggcccgtccactctcttttctctttattgtcattgggattttacaaatcgaacataattatcgtccgggttcattttttttactttctataagtcccgccaaaccgttagcggctttgccattgtacttctttatggctcgcccgctgcctcctttgagattttaaaatgcatcatgattatcattgttttatttttactttttagaagttccgaacctttaaaaattggaccttgtagtttttagagtttattgtcttgttgggtttcattttttatagtttcagaagtcccgtcaaacgatgccactatacacctctatgacccttccgccgcctattctttattttcattgggattctaaaatcaaacataactatcgttggaatttattttttattttctaaaagtccgctaaccgtcggcggctctgcaactatactcctatacaccccgcacgctgcttctcctttttattctcattgagattttaaaaatcgaatatgtttatcaattggggttttttttactttttagaagccccggcaaccgtcttgctcatccctccttttaatcatcattaggattttatttggtgttttactaacaatttttatatatcgtattaactgccaccactattcctacttgaaatattttatttctttttctaatttattttttaattaataccgtatagtgttttttaatacttttattttttttattttttgaatttcagttgaactctcttttatttttttactaattttgaatattttttattctgaattttaattaatctcatattggtttcttatatggattcttctttcactattacttaattttaatttcgtatttcagttgattttaaattgtattcctattttaacttttttttctttttgctaatttcgatttttttcctatttttattccgaatattaactaatctcgtattgggttcttatatggactcttctctcaatatttcttatttttaattccgaatttcagctattttaaattgtattcttacttggactctccttttattttataatttcggattttattttatttttatttcgaattggtattaatctcgtattgggttgttatatggaaacttctttcaatattacttatttttaattccgtatttcagctatttttagattgtatttatacttggactcttctttttttttctttttctccaattaatgtgggaatttctagcccccacagcgaacgtggtgtctcttttcaaagttgttttaataatataatagatagatagatagatcgatccaaactttacaattaaatgagatgaacggtttaaataagagcacaaaggaggctgatgagagaggagagactagaggaccgaaaactgatggtgcgaccttccgctgatcaacgccccccacgggtgtctttccatgggattttgtaggattcggccgggttacccgggcatgggtggtgagtactgagtagtaccggtgagaagccagccagaagcggcgtcatggtgggctggtggctcctttcctcacaggctagctacctactgtagcttcctgccgtggcccttgctagcactagctttacaggggaaagaccggaagacgacgacgagtcgagctctctcagctgtgcaggtgcagcactggttctggctagctcctagctcccggccactactgtgactgatggcgacgcgaggactgcacctgacacgacctatcctccctgcatcttgtggacggacggctccggctcatctctatcccaggctctcagcccataacgtcggactaggataactagctactcaaggatcatggttttggtccggggggcactgtagagcgtagagttgtagacatcgtcacctacgtggaataattgagttgttttctgatagcggtgtagcggagtagtagtagtgttcatctgtctcaaaatattattatcaggataggatgtcacttattctaagacaactagtctgcagggtggatccggtaaaatatagtagtggaggcggaacaaaatacgcagcaatccaacataaatcaaaacatgtatcacgtgtaaattggctaaatacctagtttaaagatcacatacattgaattaatgatacgtcgataattttgtccataccaaaccaatgtcgattagatgacatgtcatgcccaatcgcctattattcttcatgagtagtaatctatacaaagaaaaaggcaaattaatgaatgattgaaacagacttattttcaattcaaataatttagactaaactctgcccgaggtctctttggttgaattaaacactcgttactaggtgcaggatcactgacttttttgttgcttgaactagaattagaataactagctgggtggcccgtgcaattgcgcggctagcacccatacaaaattatctatttttaatatgattttacttataatttattcaatagatatttcattgtcttaagactttgaaagaccaaaccatatcatccccgtatttctaatgttgtaacttttataaaagtcacatcagttgttaccccttactttttttttgtcaccctttctttatttgtttgttcgatctaccatggcttatattcattatccttttaacctttaaaaattggatcttatagtttttttagtttattgtctcattgggtttcatttttttatttttagaagtcccgttaaaagctgccaatatacttctctatggctcatccgctgcttcctctctttattgtcattgggattttaataatcgaacataattattgtttgagtttaatttttactttctagagtcccaccaaaccgtttgtactcttctacggctcgcccgcttcttcccactatttattatatttgagattttaaaatcgaatgtgattatcattgaggtttattttttaattttttggaaatcccgccaaccgtcgtgaccattctgcttaacggcatgtccgtcgtcactccttttaattgtcattgggattctatatgggattttgttaatagtttttagatgtctcatcaactgtcaccactctactcctttacaaccctttacaaccatgttacttcttcgatatttattatcatttatcatcgttgtgttctagatgatttttttttgaaatttccatatttttcgttccgatagattttatttataaattatattcctagttgttttactctattttcagaatttattctattaattatttggaattttaattaatctcgttatgtattctagatggtgtattctttaaatagtctttattttttattacgaatttcagttccttttaaattgcattccaagttgaactcttctttttattttcttatttctaatttcggattttattttattttttattttaaattttaattaatctcgtattgggttcttatatatggacttgtatgaaatgagggcactgtattttttttctactgctgcagcctaagcgtgctggcctggtatttccaccctatatatgtgcgggaatgtatgttggtttagaactctataatgtatagttctgcaattgatttttctaaacggacaaggactcctagtacggatggtatgatccataattagattaatatgattatcttttgtacagtaaatctatttagtaattttaaatttgtattcctactcgaactctctttttttcttttcttctaatttcagaaatttatttatttattattctgaattttaattaatcacgtattgggttcttatatggactcctctttcaatattgcttatttttaattccgaatttcagttattttttagattgtatttctacttggactctttttttttctccgattaatgtgggaatttctagcctccacagcgaacgtggtgccttcttttcgagctgtcttaataatataatagatacgcgagtaatgttctttttgacatgttagacaatctaaagatgtatagatatagaaaacaattataagtatcaatcacaacctcattgaacttgaactattgagacacaatcttatacttgtcttttagtattagagtttcaatcacaatcacaaccagtttttggcttgctgcctgcctgccttgccaccttgcgccctcgcagcgcctcgttggagagcggcacgccacctccccggcagcgtggcagcgcaggcgctggaccaccgcgtctcaaggcccccccgggcgccctccaatccgcccctgctagtctggatgcactgtccagatttattatttagtatgaacaaaatcctatcctaaacaacaaaattttgggaggtagtactacgaagccactgccagcaatttctccaaataaaactagctgggtgccattgacacggctagtgtgtgaatgacaaatgggtcccataaatatttattttaattctaatattatataagcgccacgtgggatgaagactaggtcaacgccaccacgtcatccaaacagtcctccaaaatctccgagggagttaaattgtactggtttcaatagttcagggagtcatcctttccaattttgtggttgagagtcatggattagattcccgtcactttaagggagttgaagtggacttatttctatattctatagtactccaatatcgcatttgggctacttggttgggctcgttgctacgttgcatttgggccgtgggagtacgttttgcattgggccggtgagttccttcttctcggcgtgtgtattcgatttgggcgatatgattcgtttcgtggacaggtttggcgctctttttggttgtggatattagcgcatgtataatggtgtttaatagtaggccctctttgttatcacgtaagtaaatttggtgacgtgaaagaaaaagagagaagaaaggagaaacatcgttgctacgcatgacaacggctcagaatcgactcttagcatttattaacggaaaatttattgcatgaaggtggagaaaagaaaagaaatataataaaaaatatttatgcattaatggtttagaaatcttattgtctctactattgtaggaggatactccctccggttttattttaattgacgctttggacaatgacacgctctacaagatatatctttgaccttatttttctattacaatatatacaataaataaatgcatgtttacttttattatagtgttttgaaagacaaatatatatatatatatatatatatatatatatatatatatatatatatatatatatatgtttttctagtttctttaaactaaatatttttaaagttattgatgggcaaagttataaaagtttaatctcaaccttgttcaaaacgtcaattaatatagaatcagagggagtagtctctagtggcattaattaatatagagagctcatattaggttctacctttttgtacgtgcgtttaaccggcatgattgtgtttaccattgatgactatagtagtctcatttattaacctgttcaagactgtctaatcgtggttcttgaacaatcgctatgtgagacatgacgagtatttgaggactgtaagcaacagcgtactgctgaaactgaaagtatgaaagagcggtgcagtttgaagcacaattctttgtacaggactggatttaaccatcgtcagtactgttttgtattttacagtgtggtaattctacatcttttcacctggtatatcggttcttgtatcctgaagtttcggggtatattaaatttctttcgtgtgatcaatctggatagagtattgacaatgccgactaactgacacatgttaatatagcgaccaagctagtagcaaaaatacaatcaggtcagtaggtcagcaagtatttcagggaaaaaaaactttgttacccaatgaaataccaactggcctgagagcatcaccaacagattatctataatctttcctcaaaaaattgtttttggtttcctaaactgaaaaaaggaagggaaaaaactcctccctccaatagatagcctaaattcattccctaaaacttaaaagtttttttcttccacgcgcagaaagatcgctatcttccacgcgcaggaacgggaggagagagaggcgggagtgcgagattgggagcgactttcgcgagaatgcacgcccgcatataaacggagtgaggaatcgagagaagggaactccaaaactcgggtagaagattaggggatttgttagagcagttttttagactaaaatcccttaaaatcagttttaggaatcagatatgtagactgttggtgatgctctcaagtcaagtagcggacgatatgcgattttttttaaaaggaaaattggaaactctaccaatcagttaagaaggaaattaagtgaagtacatgtccacaagatcggtccaccggccaggtcgagcaaatatatactatataatatatacactacatattatggggtacaagaatggatactttcgggaaacaacctctgcgcaacgatcataaatttctaccacaacttgaaatcttgaataatggccagtagccaagtacattgtcggtgtctgccgtctgcgtggcatggcactgctgaacgacgcgtggtcgatccaggtacatgccattcctatgtatgcgaattatgagagcagaccaatggtaggtgaaacaaagaatgcatgaactatagcagatatgaactcagcagatatgaactcacgagccatgacccatgagtgtgttgaagacgagagcctgtacatgtatcggagaagaccaaagcaatgttgctgttcatttaagggaggaagcaggtgaggaaacaacattaacaccactgagcacacactgcgcgtagcaaaaatgagcccatcaccacgtcccagcgtcccgctccgctcttcgcggcgatgggcagcgccgtgccgacacgacgccccgagatggctacctagctgacacgcaacgccggcctccggatcgatcagtaaagagagtgcagtgcagtgcagcctcgtgtcgtcatgcacctggaaggaaaaggttactgtatttctgcttgtgtgcgcgattttcgctgctagctggcaatcgtgggatttgcagcgtactgtgcaggcccagtgtaactcgacgccacgccggcccatcgtatttaatgagctgagtgtaagcaggtacacaggccgcccaactaacctccttcacggcgcatttacgcttgggcatggccggtgtaaccgtgcaagcatcgtagtgccatcgatcgctgctgtaagtttgtaacatgtgcgtgtcctgcggagagttgtgtgccgttgtgcatggaatggaaggcaaagcataacatgggagcttttcatataaaggccaccagcacgcgggctgccacttcaagcttcagctcgtgatcccatcagatcagcaagcagtcgcgaaatggtgccgatggctaaggctctcgcggtcgtgtccgctttctgccttcttgtggcgccggccgccgcggcgcgtagcctcgtcgacgtcatcggcggggcgttcggtggccggaaggactactacacgcccggtcctactggccagcaccactcttctagtcccagtcgttcgtacattacccagtctcttccatatcttatcttgctactgctcggttacgtcaactggtcaaacgtacgacgtaatgttcgtgcgtgtacgtgtttcccatgcagattcgcacaaggctccgccctgcgcgccgacgccgccacagggaggtggtggaggctacaacccaccctcgccgtccattggaacctctccgacaacgccgggaggaggtggaggctacacgccgacgccgagcgacacgccaccctctccgtccagtgacacctcgccgagcactccgggtggcggctgctcgtcctcacccacgccgtgcgacgcaccgccctcaccgtccagtgacacgtccccgacaacgccggggggaggtggaggctactcgccgacaccgagtgacactccgccctcgccgtccagtgacacctctccgacaacgccgggtggaggtggaggctacacgccgacgccgagcgacgcgccgccctcgccttctagtgacacctctccgacaacgccaggtggaggtggaggctacacgccgacgccgagcgacgcgccgccttcgccgtccagtgacacctctccgacaacgccgggtggaggtggaggctacacgccgacgccgagcgacacgccgccctcgccgtccagtggcagctccccgacaacgccgggtggaggtggaggctacacgccgacaccgagcgacacgccgccctcgccgtccagtggcagctctcgcactacaccgggtggatgctccactcccacgccgtgcggcacgccgcccgcgccgtcgagtggcacctctccgaccacaccgggtggaagctactacccgcccacgccgtccattggcgacgtgccaccctcgccgtccagcgacacctctccgaccacaccgggcggaggctccccgtccacgccatgcgacacgccgccctcgccgtccagtggcacgtccccgaccacgccaggtggaggctactacccgcccacgccatccgtcggcgacgtgcctccctcgccggccagtggcacctccccatccacgccaggtagtggaggctactctccgtccacgccatgcagtgcgccgccgtcgccttcaagtggcacctccccaaccacgccgggtggaggctattctccttccacgccgtgcaatgcgccgccctccccttcaagtgacacctccccgacaacacctggtggcggcaactacccgcccgcgcccaccattggcaacgtcccgccatcgccatccagcggcacctccccgagcacaccgggtggtggctgctcatcctcacccacgccatgcgacgcgccgccctcgccatccagtgacacttccccgacaacaccgggtggagggtactacccgcccacgccgtccatcggcacctcgccatccacaccgggcaccggcggaggctactaccctccctccccttccaccggcggctacacgccgactccggacgttccgatcagcaccccgtcgagcccctactccccgctggtgcccacgccgccgtcgagcaccaccccgatgcccttcgaccccaacacggcacccttcccgtgctcgtacgttacttcgtcaaccttagcgccgcgcatatccacacgtacgtcgtgcataatatggagtatatcaggtgcatttactaatctaacgcacgtgtcgtgtgcgttctgtctgattgcagatactggctgtcgcacccgggcgtgatatggggcctgttcgggttctggtgcccgatggcgcggctgttcgggccgaccgccgcggcgccgttcggacacgacctgaccgtgccggaggcgctggcgaacacgcgcgccgacggcgtgggcgagctctaccgcgagggcacggcgtcgcttctcaactccatggtgaacagcaggttccccttcaccacgcagcaggtgaaggacgcgttcagcgccgcgctcagctcaggaggcgaccacgccgccgcggctcaggcgcagctcttcaagaaggccaacgaaggccacgtcatgcgttaggctaggcggcctctcgatcctctgtacttgaacgtactcgccacgtgaggcggattcgatgcgatgtacacgcgagcatgcgtgcaggttcatgtcggggtggggtttggagtaatccggcgtgtttgcaactttgcattatgtttgatctagagcggatggcctctggaataactataggagagttaagtacgtatgttttgttatccttttagagtccatggccgcacggaatgactacaggagtgttctctgtggccttttaattcagtatgtacttgtggcgttaagcatcagacgtgttctagtatttctagttctatgaactactggcatctttcaatttactcagctcttccataggattcaatactcgaaaccatatgcattgagatttgaatactcgaaactatgtagagaatgttgagaatgagcagttatgtgcatttgagcaactcctaaccacatgatcacaatctaacggtttagattacatcgctacactaccaaaagagtttggttgtttagggtgtgtttagattcagaggtgaaaatttttggcgtgtcacatcggatacaccaacacacatttaaagtattaaacgtaggctaataataaaataaattacataatccgcatgtaaactgcgagacgaatttattaagcctcattaattcgtcattagcaaatgtttactgtagcaccatattgtcaaatcatggcgtaattagacttaaaagattcgtctcgtaatttacacgtaaactatgtaattggttttttccgtccacatttaatactacatgcatacgtctaaacgttcgatgtggcagggtaaaaattttttggtgggatttaaaccgggcctagttcccaacttttcctttaaacttccaacttttccatcacatcaaaactttcttacacacacaaacttccaacttttccatcacatcgtttcaattttaatcaaacttttaattttgacgtgaactaaacacacacaaaatctctgtattgacaggaattgtactactgtgccatgcagtagttactgtagcagactcataatgccgttcacacaggatcagctctgtcctgtgctgcaaatgatcaacatccgagaggagacggtgaaaagtgagaacttgtaacggcgatgtcttctgcaagcctcggtaggcttccttcatattaggattgaggtttcaaggctagagacggtgaaaagactaccatagaacacggaacgagatcctacgtcagagggacgtccaatacgggatcactgttcgtagcgcatctgacggcaccaatcgttcgtagcgccagttcgttctccatcttcgacccagaagaccattcagtcgtcgtcgccgccgccgcctccgcctgcttggtcttatcgccgaggacgccgcctgccaagtccaacaaccacaccatgctagtcactcttcaacatggtcggcaagaaagtgtagtttccaccattgatgttggtgagctacacacctatgcagggaacgaatcgacggcagcttcatgcctggtgcagaagccagacgcacgcacaagtgttgatgaacctgcaatttgtagagcagccaggagtggccatggccgggcacgatggcggactgcggtgcccaaacagcagcggcaagctagagagacgctgtagccgacagcgtgatgaatggcaacgagagaggagtagtagtcggcgacgcggtggacggtgacgagcgagtagtggctccgcgacacccatttttcccttcgcgagcgaacaaagccagtgacgtggtggacgatggcgagcaagtagcggcacccggcgtcgccgatatttccccctcacgagcaaacgagagcagttgcaaatgaggaccacattgcgctattcatcaggagcgttggatgcttgggggcctgtggatcgaagagctactgccctctggcctctgacgtagttttcccaacgtcaaagatccggttccgtagaacacctaatacatgtcggctctataggtatcggaagtggtgaaatcaacacctacagtgcccttgccaccgacacgagtgcatgttagcacgaaccggcacctttctaaagaaataagtgccgttctaaagaaaaaccatcatcaatactataaataccagtttttataaaaaaaaacccgacatctttagtttagtttattgtaggtgctggttataaaacaccaacacctataataaattatatgtccagggttttttagaaagccaacatccgaaaaaatcgagccgagccaactgcgtcttatccagtcacacctgtccttatctcctcacccgtgactctctctccccctctcttgcgactctctctctttcttcctctcctccccacccgcgagccggtagcggtgtcctccacacccgcggtagcgcccttccctaacaccctcttccgcggtagcaacaggatggaggtggcagcagcgtgcggcagctagactggaggcggtagcacgaatatggcagttgtgggtggatctggtagtggcgacggctccctccaacccctctcgccaccctcccacggcggattaagcgctggtggtagccgcgagtggatctggtggctgttgcggtggtggtagccgccatgggtggatccgtcagcggtgacggcggccgagggcagatccaacgccggcgggagtgaagttcttggaagttctttgatgttgtgattccatgattccttttgtgattatgtgatgatgattgtggtttattttaggggtgcaaagtgtgattgattcgattccaagtggaatcggtatgtgactattgacttagtgttcttgaatgtttttggatttcttggattgatcggggtgaagggaagctactcggctcggtgcatcagctcgcgtcgagccgatgcatcgaaccagcttttttttattcgtggaacctcaaaggtgtcggttctaaactaacaccagatccggcacctatttgattttcacatcagtaccgccctcgtgatgccggttgggaaaaccgacacctaaggggatttctgtagtagtgaaaggggtagaggcctgttaaatatgtgatctgaattttagacttgcaatatattcaaataagtttcctaatagaacttgactattatgattagttccctagtatgacttttaagtctttcctcactaggacttctagatttctcctatatatatcctgagaaattgtaattattgaatttaaaaaataaattagaagctagctttctccgttttttagatttatagaaacttgttatcaaaccactggttcttaggctgcgttcaacaaatgcagtcagagattagttttcgtagcacgtgaaaagagacagaccattagcagataattaatcaataattattattataaacttaaaaaatgatttatttttatttttttaaagcaacttctataaaaaaatttcttgcaaaaaaacaacccctttggtagtttgggaagtctactaacgaaaaacgtggaagttataatttaaagttgaaagatagaatggggcttagaattttaagctattctaaaaagggcatgaagtcttttcctgctgaagcggaaggaataggtagcagcgctagcgaagatagagatgctaggccaggcctagctatagatggccaaatgggccgcccgacccggcacagcccaggcatgactgtgcctggccgaggccatttgggccggcacggcccaacatacacgtcgggtcatgccgcgctagcccacgggctgcacatacgatttaggcatggcccaataagactttggtcgtgccgggccaacccaaaggcacgacagcccatcgtgcttctccacagaataggtatattgttcatccctcaactatttgggctttgtctatattgctggaaaattagtctattttgtattcctcttctctttgggccttgccttatatggttgattaagtatattttgggtccctctattatttttcttccatcgtgccgggctatgccggcctatcgtgccgagggaacaggcccaggcacggcacgattgtcgggctaggccggcacgggcacaaccctagtcgggccgtgccgtgcttggaccagaccaaattaccgtgccttgggccgggccgtcgggcctcgggccatatggacatctgtaggcccagctagacgcctcggctagactacttatggcttgctttgcttcttgacaagacataaatactcaggacactaatgattttttgctaattacactacttaatatgcttagaactaataaatcactcttagaattaagcatttgcaccatggtatgtgaagagtggcccaatgatattttttttctagctccgcccacaactcgtatctatatactctatagatggccataaggcccgaggcccgaaggcccggcccatggcatgactttttggcccggcccaagcacagcatggcccgacttgggtcgggcccgtgccagcccggcccgatcgctgggccgtgtctgggcctccccgccggcacgctgtcgggccggcccggcacaatgggccggcaggccaggcccggcacacaaagtatagggactaaaaatagacatataaatgtaactgtccaaagaatagggatcttaaatagacttattagctatttatataccacagcccaaagaagagggaggtaaaatagacttttttagctatatatatatgtcacaacccaataggagggagggaaattagacttattccgaggcgtgttgggccctgcctgtgtcgtgagtgcggcacgtgggctggcacggcacggcccagtgtgtcggttgggccgtgccggcccgacaagcctcagcccaggccgtgcagtgccgggcggccccacatggccatctatatactccctccattccatccctccattccattttaagtgcaaccataaattttcgttcccaattttgataatccgtcttatttgaaaatttttttagtatttttattattatgagatgataaaacataaagtaggacttaatacgaaacttatgttttaatttttttaaaaaaaaattttcaaattagacagacggtcaaagttgtgcacggaaaattatagctgcacctaaattggaacggagagtgtatttgatatttcttggagcccagaagccagatatatcagtctcctaccaaacaattttttcgccggtttcctggcaaacagtatcaaaattttttggctgagggaaaaactagcgcgttgtttaccgtatcaaaatacaacaatcaatagcatagtgcacgtactgcaagtttgcaacagccaatggttcgataacaggctgatagcactgcggaaatcaaaatgacaagcataaaggccacaacagccaacagcgatcaactcaaatgctcaattagattgtactagatttgttttgaaaaaaaaatgtgcatactacacagtcccaccactcgcgtggtaagttcgaagaatctgtagcaacaaataaccaaaagtaacgagcgccggccgaggcaatggatagagctgggaatgaaccagagcagatcccaaaaccatataacgttgcaaacacaaaactgagacatttctttgcagggaacaaacaaggtatcaacgtaactataaaaaaactagctggacataacaccttatgcataaacatagcactattctagcgaagggtaacaattacagtgcaagctgacactagagaggaatctagtctattctattctattctattctattatatactaaaagtccattaaacttcctacaaacgctcctaagccgccacatggcgctcctacaaacactcctaaaccgccacgtggcactatctaatctcattgttgattttcacttagattggtgcaccgttaatttagaccattagattagatctattattaaaaaggtgatagtttttctaaaaaaatatgcaactggtggctgggaaaaggaaagaaaactaaatgtccatacgcaagtataattgagaaaaaaacaaataaagcttcctactgttaggcggaagaaaaagaaataaacatctacgtacgataaaaaatgataaagccaaaaaaatgtgtagttagtaccggtggaaaaaaccacggtctaatgtacgattttgtataatataaaatataatattacataatatacagaagtacatgcatgtaaactagatctataatataaatatcaaatatcaaatcaacggtctctaaatattatcttttaatttatttttaattgtatatccaatttatgatccattgtattcatttaattatataaagtaatgatgtataaaagtaatattatggtcttaaatacatcatgacacattgggtcgacatacaatatgtaactttagacactaaaaatctattaaacttcctacaaacgcttctaaatagccatttggcgcttctatgaacggttctacgccaccacgtggtgctctaataaattatagaaaaccttacaaattgtgagaaaaaaaaaatcatgcaatcatttttattggttgacctactattttaaaatattagattagatttatttaaaatacatctaatctgctcaaataataaaaaacacgtgaatagttatacgtatatatatacatacttccgtactttgctagcttaaaaaaaagaggaaaaaatgtaattaggattgaaaaaagaaggattagccatgccacggtcccacctaattgttacgagttacacgtacataggtacctttcacccaaaaaagtgaaaaaaaatctcaaatgtacaatgcatactactattcaccagattgagaaaaaaaattctcctgggtatgtacaaaccctgtcatcggctttcacttaaatcatttagaaaaattagaaaaataaaatctccatctcctcctcactctcacatctacgcaacactgtcgtcccctccctattgttttatctattaaattaaaagagaaacaataaataaagtttgatattttttaatacaaagtagaaacgtgggcactcacaacgcgcgtacactcacatctatgaacgcgcacatgcacatactcctatgagtactttcgagagactaggctgatatatattgagattgacaaagtcactatatatgtctcgctgtcgacgggtacgtcacctactactgaaagaatttgtcaagtctgggatatgaacctgagtgggtaaattccatcactacgaacctaaccggttgagctacgttcacttcacaataatgttggatattaaatcgaccataatttgtaagctacatttctagaatacttatatgccttttaaaccagtggaatcattatttctaacagttagatctatcttatataagaaaaaccagatgtgtatatatggtacatcacatttcaaaaatattattgtgcaattatatttcgatttcacattagcttgcatggaacttctgacccactctacatgaaatgttcatacatggatcggctctcaaattacattaatcatattagcctatataaatccatatatttaatggagcatcatgtcccacccaattaatcgttgaataaactatgataatatatatgcaattaaaaatgaaaaatagcttagttttactttacacttacttttcgttgacatgttttctaaagaaaataagtctaccttcttttcaagtgatgtagaagattataaataattgcttatagatattacttaaatatgatataatataaaactaataggttagaaaattataaaagaaattaatgtcgacaaaaacaatttatggaaaaatcgtggtagatgttcaccggttaatattttgctcttataagtgtctcaaacttagcatatgacacatgcccgcgcattcgcgcgggctaccttcctagttctttatagaactcaaacttctattatggcgcactactaaaaagccataatataggacttgtaggactagtcgggcaccttaatagagaaggtgccctttctactgtacagtgccccttgtttgatggatttacacatttccagattgtagattgctgccatctctaccagctgcagggtgcgatgcaaacctttccatggagacgtctcttaaatatggtattgtctttagcatcagtatgtaggaaggcgtgataaagatggttgttccaacagctgcccagaccgacgacatacccttgaaacaaatgattacaagaacaatatacactgccaatattatcaccatgctaattttctgcaaaaacaaatatcaaccagaaaaaggttagtaagtggaaataagtttcagcgggtgaaaaaaatgatattatggtgtaatggctggattcaatagctgtttgtagtggataaacaaaaaaaaccaatacatttgatttgttttgtagaaataaggctgagtagttgagtgacatgaaagtaaagttctatgtatacctaggaatttgctgcattggtggtgaaaattttcagcatggtgagcaataagacatcggtaactaagactcaaaattgggttgatttatacaaaataggtttctgaaacaaacctagacagaatcagtggttccgttatggtaatactgattgacttctgtcagatacgaatacaaatattatatactatagaagcacgacactggcacactgctaaaacaaaatagctatttggtttgatgtccaaacgagaccaaatttggcttgtttctctatttgaaatggccaaaacttagcagatcttgccgcatggatttggcaatgcaaagttcagcttgaattttatgtgattattagtttggaaaataagaaaggtccaaattttaaccgactgttggaaagattgctcggtgccaaactgcccgcagtcagtttgtattgaatcgaacagttttaccagatagggacaccaaaaaattcgtgctgggtgagacacatcagacagggattgaaataaaaagcgggccgtagccttcgatccaaaaacatcagtcagggaggcaggattacagctagaaattaggaagggggatctgaagcttgacttacactgagcacgttcgccaatatttgattcttggtgtcagtttccccctgcttcgtctcgcatccatcaatatcctggcctttctcaagatcgacgaattcggttggttttgtttctccccctttctcaaaatcgacgggcttgggaagctccatctaatccttgtgagattgcctagagattccctgtcttgctctcctaggtaaggcggcgagagcttcttgcagatcttacaaatgcgcgctacggcggcttcgttggggaatatgtgagatggagaactctccgattccgaacactaacgaagaattacgcgcacgcctctccgattccaagtctgtctccaacaccttcacggattcacttacgaagcgcgggttcaaggtgaccgcgtagaatcacattccctcctctgctcccgtcgccgctgctcccggagtagctgaccatggagtggctggcgtctcgctggcgtacgccgacgtcagctcctcggactcctcccctcccatcgccgctgctcccgccgtagcggaccatggattggccgcgcgccgtcgtgctgtcggacgccggagggtcccagcaatgctctggtctccatcgattcgcgcctgagatgctaaaaatgctgtgataaaccctagtgtccgacagtccgaggtacggtggcggcggcggcggaggagctaataagctctatcagccttcccccgttccccgtcgtccggtggacaggttagtgaacaatggatgtcggatcaatgcaaatgtcacataatcctcttgataagggctcttttggaataaaagatttttaaaggattgaattcctataaaaaaaactttaaagctttcttgaaaaatcattaggattgtaccaaatagagattttagagaaaacttagcaagagttccaacctcttaaaaaaatttatgaatctatctcttgaaaaaaaatattatgcaatactctaatatttgtttgaatcaaataaataccatgtatttaaacaagtaaacaaacaaacaatactaataagaaatatttttctatctatgacaaatcgttatatattttcttttacctatagcagagcatgggtattttactgtgtagtagtaggtagtgtgatataattaacggcaaacatagctagcatgtcgactattccaattttctaaaaaagatttcaagtaaaaaaatatagataattttatctcatacttcctccgtttaatattacaagatgttttgcctttttttatagtcaaatttctttatattcgatcaaatctatagaaaacatagtaacatttcaaacacaaaataaacatactatagaaacatatttaatggaactagttttttgtggatgttgttttttttctatagatttgattgagtaaacttgtccaatttaatagtgggatcaatatatttttataaatgatacgaattagattacacctacatttcgagggaataaaagtggacttattatgcatgagtttacgcgggcctgtgtagcccaaacccaattccactcttgggctggttagctttctagcccaatattacacgatgcagcaaagtgccgcgcgtgcagccagtaagaatgtactccatccattcacttcagctagatttcttgacagccactttggttgacgccttgacggtaccaaactgttgaaccggccaggcgcactactagagttctcatacaggtcatatccatctttgatctttattgaagcccaacggccagagatgtaaatctccttcctgccaaacattgtttttcctccgggcctcctgccaaacaattaggccattcgtgcatgcgtgcgacttaaggggaaaactagcacgtagtttagtgtttaccatatcaaaatgcatccgtcagtagtgaaagtttacaagttgcaacagccaatggttcgattgaagactatacgtagtccccattcagcttacaggcgtcgtagttgggttgcggtggcaattcaatacggctatacggccggccggtgcgagagccctcgcgcaacaaccgtataaatcgtctgcatttattcgtcagaagctcaagctcagctcagatatggatcgcacgcatttgtgtccccctggtttgacattcggttgattcacgacctcgaatgaaagagcccacttgctggactggatgtacgacgcactgaaaatctgaggcatccttgtttctcatcgatctgttggcaattcgttcccattagctttgacaaaagcttctcctttcgcagctcaggacagttcagagagcgggaccatagacgtactgtacctcctatagtccatagatcgacacttccgagttcagactttggaggaaggctagagattgaggtacggctaatgagctaagataatgaaacaaccaaaaaaattataggtaattttttatatgtatttgaattgtttgtggcttaataactaaatatagctagtaatgaaaaatacactaatactctcaaggttccagaataattttatttttggtcctcctatttatcctaaaacaagttgacttttaaataatcctagattattatattctgaaatggagagagtaatactaatgtaggcatagattagacttttactagtactacaaatctaaatatggagttgattcattgaactatggctgtgtttagtttcaaagtttggggagaagtttggtagtttggaaaaaaagttaggagtttatgtgaataggaaagttttggatgtgatgtgatctgatggaaagtttagagattgggggaagtttggtgtgaactaaacagggcatatggcatgtctaatactccatccgtcccataatatgataagggtttggaggaatgtgacacagtactatgaatcgatatgttatatttgggacagagggcgtatgtgactagattattatattttaggacggagagggtaatttcatcgggattgataaagtggtgatattctagtttttttaatgtgtaggatatgtgaaaaataaattatttaagacaaagagaatataactctaaacttaaatttaaaaaattatttttttctacggctacaagcaggcgataattcaaaaatcaagtgttacagatgcaactgacctgcagacagaaccagctgaggttcaaaagaaaagacaagtgtcaaccgacgagctgcatcctgtattgggttttccctgttcgaaagaactgaagaatgtactactagcgtcattacaaaccagtcgtccccttgtagtttgttgctcacgcaatcatcaatgcgcgcaagcgcaaccatcgaaaagctccggtgccgaatcagatcagtggatgattttttacttggatttccttttggcaaattgacccccatcagaatgtcaaaccgtggttgttatcttttgatgtactccacctgtattgcgcgcatgcatgcgttgtcaccgccggcccatttcatgggcgcgccacgacaacatctgctgcaggtttgtggagctctggcctcactctcgtacaagtgcggtgaggtaacagatcaccaagtaatgtgcacgccaaagtcatcgtttgaggtgtcgaaaaaggagcgattcatgaattcaatacagtactactgtactagtatcaatttattacaggaacagactctgtttgtgagctacgtgtactcatcatcttaaattacgggagtacagactacagagctccgcacttccgctacaaaaaagccacagatatcctttacatctgctccatcctttccttcatcacggcataagtttgcggatgctgtcaaggagtatatggtactcctaggtactcctactaacacaactacacaagcgaggatgtttaggtgttaggacattaggtgcactgttaaaagtggagaaaagtaccgagtcctgcttgaagtactagcaagctgaaacgacatgactactagagcaaagtcaataatgcagctaacaacggacggtaaaacggcccatgtcagatagtgcagctaatactaaaagctcagtttttactagatcagtccatcatgtgattgggtggtgttaggttggccccacaaaatgtgtgaaaagctacgctgtaaccggacagtaaaataagcgttggcttatttctctctcctaagttctctctcctccatatagaaattaaatgatgtgtcatattttgaagcctgactagtcagcttattgtacctgctctactgatcttcccatcagctgttattcactgttgacgctggccccggctagtgatgtccacactccacagatcgtcaccgttatccattgatatcggtgggggcagtttggtaacaggctaggctagatgcacgggtacgcttggcagcattttgcccacattggtccctggtacggtaaaaatccaagttcagtctccattaaatcctacaggaccagcaacggagcctatagttacatacacacgaaccacactcttagctactatctctatcttaaaataagtttatttttagcttctttcaaaaaaaaaaaaactaaatatcacctactgtatcataataagtttattttttagcttattttatttgttccaaaatatgtttttaaaataactattgtatcaatgttcgtgaaagtaaaaaaacagtagtattaagagtagataaagcaaaaaatatttgcattagtatttgataaagtaggtggattatagttttttttttgtttttattgttatgtgtgagataggtgaaatttttttaagggaaaacaacactagaatagtttactgaaaataaatttgtactccctccgtttcaaaatgtttgacaccgttgactttttaacacatgtttgatcgttcgtcttattaaaaaaaattgtgaaatatgtaaaactatatgtgtacataaaagtatatttaataatgaatcaagttatatgaaaagaataaataattacttaaattttatgaataagacgaatggtcaaacacgtactaaaaagtcaacggtgtcaaacattttgaaacggagggagtagtattttagaacggaggtaacgtagcaaacattttaggacaggtgaagtagttacatcatgtagtggcattagacaatttaatagtttactgacactagcaatacggtagggaggggacaaaaattgagttgctgctgcgaggtgcaaagagcagcgatgtgcggcgccatttcgcgttgaatcttcagtactattattcactaatccgattaagcagacgaccctagtacagtacaggtatgggtaggagtttacgcgcggttacgccgtgcaagtgcgaaagctcagcggtgggcgatcgctgccaagtcggttgataccagcagaagtgctcgtcccaggagccaatgataagagccaaaaccgacgggctcattctccagcttaactctcacaggtggtactaactgctggcctctggcataactccgactggccgcctgccaccacccccacgcttagtagcattcaaacaagatgcacgccatgcctgggtcagccagcatccaaatccaactcactcgagcgcgagctagcccagccgtcacatgggagatatcgtgcgtacgcttaactaacgagacaaagggccacataattatgcgggggctcatgaccaattaattaacggtgttttgcatgcgagtgcgacgccgcagcgctgcactgcactccactccactccacggcagtctgcagacgcggataagcgtttcgaccgatcgggccgcggcgcgagggaggggatcggtgcgcgcgtcgcagtcacgccgtgtcggtggtctccctccccctcgcgagcgattcaggtcgcttccgtggtcgaacccggcaaatcccatcgtcccattcattcgctcactcatcgacccgccctccccctccgccgctgccagattcgccgcgccccctaccaggctaccacctttgccacaccctcccagacctcgcatcgcacactgatgcggtgatgcccgcaccgtgccatctctctctcttttttacttctcgggctttccttagtttccttcgttttcccacacgcccacgcgcggacgccgcgtacttagctagcaaggctagctagaagctcccatacttgcacgtacgctttcccattctcttttgcttaaaccgagctagagctttgctagctcagttcgtccatgagagcagcagcggcgggtcggcagcctcgcttgtagctagcgataatgaaggtctacatcacgtcggcggcgccgctggctggcgaggcaacgaaggcgatggcgtcgccgccgtcgccgccgccgcaccagcaccagcaagcggcaacaaggcgcgggtgccggtcggctgtcgtgacggggctcctcgccggcgtgctcctcttccgcgccgcgctcctcaccatcgaggccggcgcatccctctgcccttccaccaccggtaagttttcacttcgcacgcaccgaggccaccggcggctgcttggtgaattgcccattttcgtttgcgatatgatcatctctgacgcgattggccaatgctccaggatgcttggactggagggccggtctcggggactggctgtacggcggcagcggcgacgcgatggaggtgagtctttactggtcactggtggtgtgctagtgttaggccggcgcgtgcactgactgcaccttcgatcgtgcgactaacacagtcagagtgcgttaggaaacaggggtgacttttatgcgccggggttttgacatttgttttactacttttgcgcgcggcggggcaaagctgtagtacgggacgaaacacgccgttgggcacggagctcctcacgcggttggggcgatttttttttccgcatggttcggctcgctagcagtaagcgccattcacgggaaggggaatggaatgtcagggccgcgtcggcaacacgtcgcggcgttcctaccacgtgccccgcggccgcccacgctgacaggtggggccagtcgatccgatccagagtgctgcatgctctggattctcaattttttgttaaccactgtcacagtcggccgttgtcagctctcgcctctcggtcattggtcaatccattccgcccccagctacggctcaccggctgaattcaaatgcagaccagtaagccaagtaccacccactagtgttgttttgctcttggagaagtaccccaagttgaattacacaaaaaaatcgtgaaattagtagtactccagtacctttctcagtcaacttgtaccagaaaaacggcctaatccgacgaggagttatctatgcactggttggcgatttgcgcgacccttgccattggcatcattcctcgagggccctaccatagttggtggcggcttgggatattgtgttgccagccgctacggtgcccggcacttgtgacgtgctcgtgaggattctctcgcgctggtggcctgcgctccagctaggacatgctcgtaaagatggcgcccttgcgtttggagctacgtggccttttcagttccgactatacagcggcccttttggcccgtgaccgtgagcctgagccactagctattcatgaacgcgtacggtaggcataacccctgtggtttttagtgctctcgtgtcacattgtacatggactggacgcctaatgtacgggatccaatcaacgatgagctaatcagtactctagtactaatgaccattttaagcaagaccatgtactgtgacagtttgtgtttttcttcactgggtgtgactagttatatactatatccatgtttttctttttctttttttgagaacatactatatccatcttgattgagtttatgaatataagaatgctgattttcgatcgatgcgtggaatggtcaggaattcatgaaggagtggaggagaggtcgcagggaggccagcctgttggatcccgtggtggtggaggcggcaccggattcgctggacggcctcatggcggagatggacaccatgctggcgtcctacgatcggctggacatggaagccgtggtgctcaagattatggccatggtataaaacttatcagcccatattccgacgcgctttctctattacgaactttgctaatctttactgaactttttattagtcttgtatcatgcttgcatgttactggcacctttgctgaaacgagtgctttccacgcctaaagaccacacatcatatggtccatgtgtcttgcatcctgccttgaaattagagaagcggaacgtatggtcatgcatgctctccactaaatctccggttaaacatgcaaacgtcacttttttaggcgtgtccagttgaaatgactgcaacttgaagcgttctttggctgtgtttacttcctgaaattagaaagaagtttggggaaaattgttagtttggaaaaaaagttaagagtttatatgtgtaggaaagttttggatgtgatgtgatataatggaaagttgggggttggggggaagtttggtgtgaactaaacagggtctcatttgtaggagtaggattagattcttttgtagctagggttaggattagaccgtgttgacccttgacactacaatccaaaaatgaattatcgagctttgatccattaatagtactcctatattgcaagttgcaacaactatattcgtcgattttttattggggataatcttgaagcagctgctgaaaatggatcggaaggttaagtcgtccaggatcagagccctgttcaaccggcacctggcctcgctgggcatcccaaagagcatgcactgcctcacactgcggcttgccgaggagttcgcggtgaactccgcggcccgctcgccggtgccgctgccggagcacgcgcctcgcctggccgacgcctcgtacctccacgtcaccatcgtgacagacaacgtgctcgccgccgccgtcgccgtggcttccgccgtcaggagctcggccgagccagcgaggctggtgttccacgtcgtcaccgacaagaagagctacgtgccgatgcactcgtggttcgcgctgcacccggtttccccggcggtggtcgaggtcaagggcctccaccagttcgactggcgcgacggcggtgccatcgcctctgtcatgaggacgatcgaagaggttcagaggagctcaatggagtatcaccagtgtgacgcgtcagttgtcagggaatacaggaggctcgaagcctccaagccaagcacgttctctcttctcaactacctcaagatccacctcccagaggtataaatcaaggcaacaattggacaaagatcacgcctacatgcctacatttgcctgacattaatttgacgtctggagatatatctgatgcgttttgcttgagcagttcttcccggagctcgggagggtgatacttcttgacgacgacgtcgtggtgcgaaaggacctgaccgggctgtgggagcagcacctcggcgagaacatcataggcgccgtcggcgggcacaaccccggcgaagacggggtcgtctgcatcgagaagacgctcggtgatcacctgaatttcactgaccccgaagtgtcaaacgtactcgaaagtgcgagatgcgcgtggtcgtggggtgtcaacgtcgtcaacctcgacgcatggcgaagaacaaatgtcaccgacacgtaccagctctggctagagaaggcaattagctctctgattctcttgaacatggatgccgttttcttggttacagtactaatgacaaaacatttttttcccctgtgactgtcgcgtgcaatgcagaaccgggagtcgggattcaggctgtggaagatgggctcgctgccgccggcgctgatagcgttcgacggccgggtgcaggcggtggagccgcggtggcatctgcggggcctcggctggcacacgccggacggcgagcagctgcagcgctcagccgtgctgcatttcagcgggccgaggaagccctggctggaggtcgcgttcccggagctccgggaactatggctcggccacctcaacagatcagacagctttctacaaggatgcggcgtagtcgagtaacacagtaaacgacacagcagcaattgagctgggaaagagtatataagtatagacgatttggttcgagatctccatgtggcgcagagctgggttcatgtcttcatgaggagagggaagtaggtgctgccttcagtctctcctcgctctggctctacgtgcaacatgttcagtgacacagtgtagaattgtatagtgacgatgtatataagggctgttatctatttcttggttatagaactaaatgaaaaactagatgcaaccacacgcatttatagaataactatgtcactgaatgaaaaactaaatgaaaaatgatgctagacatggtagaataactatgctaaacatattagaacaatactaaaattgaatatcaagcacagtgtagtgctggtgcatttgtttggtaacttagcagatgtacaatatgaatgtgctagtatatgattagtgattacactgtaatataaaactacttttctgagaacaaaacacaatcaattaatcacgctctctcagaaagactccacttgagtagtagaatagatcattcttaatattttccgatacggtcagacatatataattatggggaaaaaaggcttgaaatttacagccaaatgttaagaactgacagaaaaaatggtagctttggaaccttgatcgattgctactccatccgcttgagattataagtcgttgtgactttgatcaaagtcaaactacgcaaagtttgacttacacaaagtttatagacaaatatagtaatatttacaacaccaaattagtttcgtcaaatcaataatctattatattattaaaggaatagaaaaagaagcctccacgttcactctaatggcctagaaattctcacattaatcgcagaaaaagaaacaaacagagtccatataggaatacaatttaataatagctgaaattcggaattaagaataagaaataggaaggtaagactagagtccatatcggtatacaatagaactaatagaaattcggaattaaaaaataagaaaaaataaatgtagaggttagagtccatctagaaatataatttagaaattaaaaaattcaaaatttaaaaaatattggatgaagactatagagttcagatagaaatagaatttaaaaataattaaaattcggaatttaaaaatattgaaagataagtttagaatccatatatagaaatataatttagaaataataaaaattaggaattaaaataaggaatattggaagaagagtatagaatccatacaagaatttaaaattcagaataaaactaataaaattaaagtagaatttggagtactaaaattagaaatttaaaaaaggaatattggaagttcgctctcatgagacacgcaaaattatgttgtcattttaatatatttgaataatacattgagaaaacatatatattattataagacagaaaatataatatgatgtgtcggtgacatgggaccgggagtatcatgacttagagacttgaggcagacacgatcacccacgtggcctaaccccctcggggggtcgggcccgagggtgatacggccgcccttctctttgtctccccgaggggtcggaccgctcccgtctcggccccgagggccgaggcgccccgaccccttgtggat

SEQ ID NO: 58815 - DNA, 11912 bp, Oryza sativa
cctaaccgcatttattgcggtttggacgagcgcgtcacgccgcatgtaacgcagtgcagcgcgctcgttcgtccggtctgtgatcagtcacagaccggtcagatcgtgggctaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagagcgaacatgcagattgttaaactgacacgtggtggacaagaatgaccgatttgtgactggtctgacaatggtcatgtcgtcagcagacagccatgttcccacgtcgcgcctgcttccggcggaagtggaggtaggtatgtgccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaaagggaggagaggagaaacgatcccagaacgatcgggggctggctcgcactttgtagcttcttcatacacagatccaccaaaacacaggagtagggttttacgcttctcagcggcccgaacctgtatacatcgcccgtgtcttgtgctttttccattctcgcgaaccttccacacacagactaggagcttagaatctcacccagggcccccggccgaaccggcaaaggggggcctgcgcggtctcccggtgaggagccccacgctccgtcatgatgctagccacgcaatctgcgcgggccaccatgctaattaaatatattttaacaatatagttgtcttggattaaaaatgttactacctttttttacaagctcaattaaacttagagcagtttgactttgattaaagttaaaatgacttataatctgaaatggagggagtacttcttagaatcagtagcacaagtaaggttgatgtagcaggaaaaaaaatgactgtttgagttgctgaataatgccacatgattcttgtattttacctgttaagataaattgttttaacaggtaaaatacaaataagttcctgatgttagctccaacggccgagatagcaaaatattagagaatatactttctgcattctagtatcacatggcaaaccaaatgttggcatgttgccaaataattgaagtgatggtggtaatactgaaaaagaagttgtatcatctgattcaacgtattagctcatcgcaggatattttttagataaaatttgctataagacattcaaagattatggtctttgctatgagacacccgaagaacgtgaatcttttcatggacactgtaaaaatgtggtaattagctgctggacactccttttattattttattatttctagttgaaacggagagggaaatatttgtaaaaggcaactttgcccttgggtcaatagtgtttagcccgctgtagttggtttgaacagacccattccccattcagtctgatgatcccctatcctccaaaccctagggttaggtgcggcggcgatctgcggcaacggcggcgagctccggtgactacggtggcagattgaggtggccggcgagctgggccgctagcagattcgagcagagaagtacgatggaggggagcagcggtggaagcggtggaatcgagcggttgattcgagcagcaggggaagaatcaagaagcgagatggatcaatcattgtacatgggctcatcgtcaacgcgtaacccagtcacaggcgaggccgcggaggcagatgcagcaacgtgaggatgggcggcggcggtggaggccgcgggctgtgcctacgtctgctcaggctccggtggctccgccgcgctgtggcgctgtgtggcggctcgcggagctctgcgtcgtggcgctgtctggcccgctcgtggccggggcggcggcggcgcccgacgcgccagtaccgtgcgccgtcgtcgccgttgactcctacgccttcgccgcgccgttcgtcccggccgtgctgctgaagcgcgcgagaaaaggctactaattacacaacgcctaagtacatatacgtgacagtttattaacaccaattatatgaaagctatgaacgctataaattctgtccaattctgtacttctgtgtgtatacaagccagccgattgttgatccatcattgaaccgatttggtgcctgaaagttgtgacgttaaatcatgtcgaccagcgtttacaagcaaatcggcgcagggggcattttggtactttcatcattctttctctctccgcttcagccaaaaataataaaataatgagaggagtgtccagcagctaattatcacatttttatagtgtcaacggaaagattcacgttcttcgggtgtctcacagcaaagaccacaatctttaagtgtcctgtagcaaattttgcctatttcttatactgaggctaagccaaaacttgaagttttttttaatagctactcctctcctctctcccaccgccgcaccgcgtgctgctcctctcggccactgagcttgcgcgctccatggccgacaacagccttggtgcgactatcattgccggatccgacagagaactcgatagctcttcttctttgcacgtggagagggaaaaaggtggcggggggcagtggccaacccttctcgccatcgaggggagtgggaagggaggaggcagggaggctggcgagcgggcggaaaagaaatgaggccagcgagtggggcatggagggcgggagacgaggagaccggactaccccgcgaccgtcgccttcagacatcgatcttggcgagcaggcatcagggaagcccggaagggcacggggatcgtcgtcgggccaaaggtggtcgtcgcagcagcaggggaggttgggctcgttgtacttcggcgggagcggctcggacgactgtggcaacaacggggatgactccgatgactctcctggcctcgccgcctccttcctctccacacgctcgtctagttttgactcaccgaccattgcccttctccctctccgtttctccgtgtgctctcgcacgtggagatagagaggagagtgggacccactaacatgtgggtcctatttttatttttccttttgtctggctggcatgtgggcccatattttaaaaataatttatactcctactttatattttgcttacaatgccacatcacagccaccacgtaggataatgaccaagtcaaaccagctatgtagatgccacgtcagtcagaaccgccatccaaaccgccgagattgctcatccacaccggtttatctgtattgcagttaagggatgaaaattgaactcgcgtcaagtaaagggcccacggggatttcggcccgcccgaaatgaacaagccctcggcgtcggcgctctcctcctcctcgtgagttcgcccgccgcctgcgccgatccccatccatcccgtgagctagcagaggcgccgtcgtggtcgccgtcgttcgtcctgctgcttccgccgcatcccggtgagcatccatcagttacgcgcatcctcttgctcatctctccctacccacgcgctttttcctccaatttgaacaccctttgtttctcttctagacctggaagctcttctcttaatttgccttaaacctcaatactaatagcagtttgtttgttcccccagatccgccactgctgaacggggtgctttcgccatgtcgaggctgcgggcgctgtggcaagcctccgttaacgccaccaggcgaggtagctgcctgccgcaaacctaattttgccgcgctagtcgtatgctgggtttatttcctcaaacgaaactcctttacctgcgtttgctcatttttaaggccatttgaaatgtttactggaaaggccatatgagatcctcaaatgatgaataactatggcataaggattttagacacgggatgggaattcaagtgtgtaacagctcagtactagttatgttgatgtttattcagacagttggaggtttcttctagcattttgatttatttaaaatggatgctgctggatcgcaagttggcttcagttgttagctatgacattctaagatgcttttaatcttcatttagagtaataactcattatgtttgtctatgtcataattctttcatcctacatacgaaatttgcagccattgtgtggaattcagaagacctaatcccaccaagtgaaaagtacatcttcaattttaattcaaaagatgagctgaaaaggtggcacttgtattcagattccgagtatggaggtaatgcctcactttcaagtttttctttgcacgaatattagttttcgtgattgtcctgaataactgaacggtagaatagactaacttatattgtatatgttgtgattgtgaggtactcatggaatattcatgttctaagactttgcctggcactggaaatgttcctttgtttttattctcagaatacatgggaaaaatatgcaaattcccaagggctcaatttttatatgtatatgttacgattcaaagtttcattgtgattctaattctatgcatagaacaaaaatgaataaagctaggaaagttctctttcagagaacatcagaaaaaaaagttttctcttgaattcttgtagctcttgcagctttctaacatagttcctggatattctgacatagttactggattagtcgatcacttttagctccattcttgtcaagaggcttcactgtatacttctctcagacgatacatttcactatttcagtgtaaatattgcatgccaataactcattgatttaatgagttttcccttcgtttttcacctacatttggtcttttactttgtattaccaagaatgttccacaaagggctatatctaatacaaatatatgtggcttactatctgctatagtgatccaaatgggaatctgcctgctccttgtgctttcattccctggatgttctacaacggatacatcagtgtagtatcaattggtagttgctaaaccagtggattagatagtctgggatgtaaacctccttcaatatgatgggtagatcgttaatgcttcagtgtgttgtgatatgctggtgccttagcctcacaatagtacctggaataaacaaatgtttatttctttgtgtcttttgggtgggtgacctttctggcatgttcattaaacttcactaatatttgttggcacattttgtaactgataggcaagctctttattcacatctatggaatgatttgattgaaaggaattgttatccaggtttatcatctgcatcattggagataactgatggtggtgctggtggggatacttcatcaactggtactctgatgttttgacgtcccctttttcagggtttccttagagtgcattttcagtacaaagagggaaaactggaaaatagtttatttatctgctgttatatatagcttatgagtacaaattaacctgttgaactatggagtgtcttctagtgttgttattctcatgaatctcatatgtccttgccaacttaccagataataccagcttgctgtcttggcttttgtaattggaaagaaagcggcctttttttcatggttttgttagatttcatgcctgattcacttaatttaatttttataagctttgacagttttgcaactatttttccaacatatgcattctggaaggtctcttttctggcaatctctctttggatatgtctgagggatcaacatggaagataaggcgtagtggtttctgtggaatgagatcaaagaaggtaaagtgatattgacttggtcattgctcaatatctgtagatgctattatgctgataaacccttatttctttctccgtttcagtttaatggtttcattgatcttgatgcatatgatactatagcgatgaaactcagaggggatggaagatgctacatatctactgtatgtatcctcatcctgagacagtattgaatgtgcgatatcaagttaatacgttgctatataatctgaatcttaattaaacagatatacacagagaactgggtgaattcacctggacaacaggaagataattcgtggcaagcctttgtgtacttaccccaggacagatggcaaatcatgaaggtaatttcaattcgaagttgaaagatatggtttttgatgatacgacagcacttgtcctttctttcagatccctcttgattcgtatctacccacatggagaggaaatgtgatcgaagcaaagatggaaatgaaccctgctcgtgttgtgggaatgtctctatccgtaaatgctgagggcggtgtacctggtgcaaagactggaccaggtgattttaggctagaggttgattggatcaaggcattgaggacactctgaatttgtggtttccacaaatcggtctttttgtaggatttctcagggctggaaatttcttaccggcactttttcatgtgataattgctgaatatcacgaggcatggagatgcgtcatgcagtttgtattactcctagtcaatacaatgggacatcgaaaggaggcaactgttcagcgcagatgaataatgaggtctcttttgcttttgggggaaatgaatatacaaatgtatcacctgtttcttatggctgtctgaacatacgttacttccttgctactgtgtccgatgaatttttatccattccgcatcaactgatacctgcaggagacggtttgtacttggcttcccattttgcggtggaactggcgagctcgtgcttggtggcggctttgcccgcctgctaaatttgcacgttttggtcaaacaacacatgcattcattttcaggtttccgtagcagcaaaaacaccatgataaattggcagtgcacagccgcaacggaaacttctcagtgcaatcgtgcgtggataaacaaacaacggtggatatttcaaaaacgatctttcaaacaaaaaggtcgatatttcaaaatgcattttcaggaactgtacacaagacacacttgaattagtccataatcagaatcctaactcaggcacacatggcgaagcttcctttcctacaagagcaatatttgctcatggaccacacgtccacaccatgacaccgcaactaattaaggggaacgaacaaaaatgggagcacccagtgcaagccgagaggacgacggacgggtgtttggcgaccagtcgtcgtccactcctctgcatgcatgtgtgcacaaacgacgggtcagccgtgccgggtcatccttcaatgaacccggtcatccgcagcacggagttgcgcaggtggctgaggtcgcggcgcgcccgcccggtccccgtccgcagcgagaacgcctgatccccctcctccgtcgaccgcctccgcgacaccatcacgtggggcggcaccatcgtccccccgccgcagtcgtcgccctggtcgccgccgctccaccgctgcgcggccctgggaatgtccaccggccgagagctcgccgtggagcagtggcgcgtgatctgctgctggccccgccgagccggcgtcggcgcggtcgccgtcgccgtcgccgtcggcgggacgacgtcgtgtggcgactggtgatccggccacagcacgtcggactcgtacagctcctctcccatcgtcgccatgcgcgcgcacgcacgcacaaaccaagctacctgtgaagcgtcgatgcgtttggggtttggacgtttgggccttggtagtttggtttagcttttctctctgtgcgacgacgagcgcccgcggggcgtatatataggcgtggtgcggctggcgccacctacgtgtcgagtagcttgcgacgtacgactagccgcccgccgagccgcgcgaggaaggaagagatgcgcccacggaaagggatccgggttctatcgggtccggtcgttcggatcggatcagatgacgaattcaattacggagtcaacaaaaggctcgtgtcggtcaatacaaccaaaataaacgtggctcgtctctttgccagagcggccgcctccttcttttactgcccgacatgatgatgaaacggaaattggtcgtacgtgcatgcgaggtaaggaaggtgcatgcttgccacctgcactgtacagctagtacataacacagcgggcacgggcaatgtgcttattactcgtgtgggtaagttctgacgggattaaagatttcatttgtgattacagacttgaacccaggttaaatcgaagactaacctcgggtgcctcagggtcatcatcgcggagcgtccacgcgtcctctgccacgcatgtactcctactcgcgtaatctcttgcatgccttccgctgggaagcaagaggaatctaggggttagcattcttaattccagctttacctttctcttaagcatctatatcaccgctaaatattgcaaatttattcgtggttccttgctagcaacgcacgatcgcgatctctgtttcgtcgtttgcgtgcggccaccgagtccgcacgcaccacacgcggatatgcgtacgcggcgcccggacggaagaagcatcaggctacaggctgggaaggcttccacgtacgctgcactcaacgcgtcctgtgccgaattttttatttataatactaagtaatatttaaattaaataattagtaattctctaggaggattaaccaaaataggatggacgatcattcaaacagcgtccagacatggatgctactataaacaacgtccacctttctggtgcagtcagaccatcactacgccaccaatacgctaagagaagtatctatctatctatcttctattatatactaaaagtccattaaactttctacaaaagctctcaagccgccacgtggcgctcctacaaacgctcctagatcagcacgaggagcttaaacatccaaccatcggttttcatttaatctggtggacccattatttttaaccactagatttttattttaagaaaaaaacaaatcaatctatctaaaaaaaatcccacgttactcggccgtgtcccggatctgtacgtccgtatgtccgatgtacgtacatatcccctctatgtccttttctttttctttcttatatacttagattagatgaaaaaataaaaagttcatgttaaccatatattttaagttgtaaaaatatatgttattttaagttttattctaaataacgcatctcattgaaacatccataaaaaatattaataattaacattatagactatatgattgtatatcacaattaaattggacttataattaaaaaacaatttaaattttgagtagcattttaaaaatttactcactccctattgtgtaatactgatatatccaaataacattattaaatttatcaagaatgtattttcatatattctatgtttctgtattcatattttttttggaaaattaacaaccatatatattttttacaccatgtggatgcccttttatctcttaagcttcattcggtctatctcattggataagcttatttaggacacgcgaaacaaagcatgccatcagcgtaagattaattaagtatcaaatattgcatatcctgtgcttatctaagaaaaaatatatagaaaaatggttctatacacccaggagtacgtactgtatatatataagggtcatcctatatataaaaaataaaatctagctacttatttatacataacccgtggatatattattttcaaccattattttatatctatatctacgcaagagatgtcataaaggaaaaaaaagaagaatgtgtacaagatcagctccatcgagtagttttttctttctttctttgtggctctgagattttcctcaaattgtgcatatgagtagcaaccacccttggcgagtttgtcaaagaattcacgcggccgcagcaccgcttcacgccatctcgctaaattttttggaagtatttttttactaatgatttataaggcaatcacgtttccttaaaaaaagcaatcacgagcgcatatataaacgtgtgctcacccatcatataaatacacatacacacacctaccctaagagaaaaaatatttgtctccaaaaaagggaaaaagtatgtgcttagtatttgctagaaaaaaacatatacacatatcatcgaaaatgctgcatagaaccacattatatctttttaattatgtcattctcatctatataatgttaataattaggacaaataattttgacaatatagattattccatcgtatattacccatgaacatacataggtaaatcagatgtataataaaagaaaaaacaaaacaaaaaatatattagtttatatgtttgcgaatgatggtgagagatcagattatatataaccgggacaattcgtaccgttcttattatttaagggtgtaatttagactttttccttaaaagtcttccacataaggatttataataaaaaaaattaatcaacactaaacttcctacaaacgcttttaagcctccacgtggcatcctataaatattcctaagccgccacgtggcatcctataaattagagaaattcttaaaaggacacaacgtataaccgttgatttttattaaattttgtagaccattatttgtaaccattagatttattagaaaaaacatacttatccctaggcccacctcggccttggcaattgcatgtacgtacttacgtacgtctgctcacccccccccccccccctaattctttcaccccttttttcacctattttttctcctatttttaatcttttagaaaagaaaaaattgtatgccaaataattaagcaaatgcagcatctaaattataatgctaatatttgatctgcttatgtctttagatattttatattttaaaactcatgtcctctttaattcaactgtaaagagataaatgtcatattaattggggctacattttctgacttttgcgtgtcatttaagcaattttaaaactaaaaaaattaatgatatatatttttgtcatcgtatataacttgataataattaaattatatctaataaaagtaaaatgaacagatctatgagtaatattaaaaaaatagcccccgccccaacgttgtaacacagtaaaaagtacacatcttataattacttctaagatattatgtctttctcttaaatcagagaaaatacactcttaagatattacgtcgttcttttaaataagagaaaatcgtaaaaattctgacaagaaaacaaaacattcgaccatcagcttcgacttaaacatctgacacataattttagtttgttagattaatcatttagaaaaagaacatccgaaatctcccttcctccctgctcgcgtacaacgtgcgccattcttttctctctattttttatctccttatcaactgaaattaaaattatctatatgtaaaaaagacacaaatagacctccatctattacttgtatcttgtcaggcgtctaacgactttctactaacttaattaatttctcttaacatgcctatgagggctatgtacctatacaaattgaccttgatacttttaaaacgatcttattaggagataaataaatatttataagaaagatgatcatagcatcccaattacacatatgatctatgaagtcactaatcataataggtattcatctagcaatatagacaataggttaaaaataaatgtgtggccagttgaacatcataccaataagtatgtgggttacacctaggaatcttaacagtgaaacaaccttgaggcggcctttacaattggaaattgagcaaatgt

SEQ ID NO: 58816 - DNA, 19405 bp, Oryza sativa
aatttctttctgcacaacaactgtaattacatcagcagtcagtaggtctgaaggatgatttcggatgattccctgaacatgtgagatggtcttcatgaaattgtctcgttggatatcaagtaaaactttctcaagagggttgacatgttcagcgggcttccatgtcaaagataactcgtttattctcaaacatgctggcacctcacaactggctggcgatgacttgatgcaacctctccttgtgaatgactcagaggtctccaccgcatttctttctatttgctcttcatcagtttctttattattgacttgatctaaattcccttcattttctccttgattatgttgaggctcttcacataaatccacctcaccatgtgctggtttaactttcttagagtcttgaaataatgaacctgaaatgaaacaaacagatttaactacaaactacaatatcaatcattacaccatacttctaacaagaggagcctaagaataccactgtctgttttatcgtggcataaacatgcttgctctgatctgctctctgcctgatctatcatgctgtctggtgatggttgtcgctcttcggatctttctttcaatgtattctctgcactgtcatgagaattattctggcgtgccagtcttggtgatcttcgtggagtttcaggactacaaaatgaacctcgcttccttctctttttctgagaaaaattacataaatcatgctcatcaactagcctacacttctctgttgtcaagtcacattgcagtggttggttagacaacttaggttcctcaaggctgcacttcctactctcaagtattggagaagaataataatcatctggagggaagaactttcgtagtttcctctttacaatatcaactgaaatacagaaggatgtgttgtcaatgctagcagtgcaagaatgacagaagacgaggcgataaaaacttacattgaaaatgaagtttgtgcttcagaaacaggttctgaatttgcggtttgcccctacatatgtcaaagtcttctgccaccgcatccacattccatttatagaaaacaagcattgcacagaataattcaactgtcactttgtcaacatccaatatgctcattacttcagctatcgcattagctttatcatcctccattggcccgttcagtgataagtgttcatctaacccatctttcgagccgcatacttcatgttgatcagggaaactttgtggtgaaataagctcatggccttgagttgtcctttgcaatacctaaaagttgtataaaattttcagttcaaggagacaacatcactactaaggtacaaaccaacaattttataattcatatcctgcctgttcccaaggtggaacttattaaacggaaaaaatcaagttaggaatagttatttcaaaacgtcaaacctcctaaagttacttgaaataattgttctgcaccttaagattcccaagtgaacagtagttttattgtgtttttagagatagtcaggtattctggtattccatattgattctaacagacttgaaaaatcaaatgtaaagctattttcaaacaaagtgattccatatgaactgtgtataggcaaaaaaaatagtttaaaaaaaatacaggcaaaaaaaacgacctgtatgaaactgatttaattatttgagattacactataatattacctcataacggatccatttgttatctcaacctacctgtgaatgactaggcgtgagactgttggctgcctctgttagtctatcaccatcccgacccctcttagtacagcagaatatatcacatggaagttttccttgtggacttcctgaagaccgaattactttctcacaagcattcagaccaaatggcaaaaccatgaatgcatgttatcatcatatctgaagagaaggaactcatattccctcaaagaattgtcctccacaaacttcgcccatccagtggtcagaaatacatggccatcaagtttctctagctcaacaggccaagtcttcccttctgaattctgaagcgtgcctttggcagatgatggtaatgaagcatcaaaagtactgtggtccacctctggaatgtgaataaggaagccttgaggtatctcctacatatagaggctttaggagttagggcatattttgagccgtttctgcatgattcgagatagcaccttggccgtcaaagccattgctgagaggagatgaaatgcaaatgcaagatgcaactctgtgtgctttcagtaaattgttcacatatagtaggggtacttgtataatacgcacagtcgcacaagcataatatcaatgctcgtaatctgaaactcgaattgcattatcagaccacatgcatcatgcatgcacaaggaaatgaatgttagtatgccaccaacaatttatttttcttgcctaatactcatccgtttcaaggtataagatgttttgactttggtcaaagtcaaactacttaagtttgactaatttggtagaaaaaagttgtaatttttttaacccaagacaaatatattatgaaaatttattcaattataaatttaatgaaactatgttggtgttgtaaatattactatttttttctacagagttagtcaaacttagagtagtttgactttgatcaaaatcaaaacgtcttataacctgaaacggaacggagggagtacaacagttagtatacaaatataatcatgttatcagacactacaaaactatttccccctttatatatttaccaatatccatctcgtctattagaacaaagaccacaaatatatgacaccaaatgcatcatccattatcaatgagcatagcatatggttggctaaaaatagatgcatgtatatgttaattaatgcatcatccattatcaatctccgccagataagatgccacaatttttgcaaccatactagtactccatatgtcaatgtttggggggcccctacgggtaggcaggagagagggagagagagcactcacgaggcggcgggcgaactcgccgaccatgaccttgatgaagtgatgatgcctcctcacctcctccattgagaccgcgggcgaatacagatctcttccctcggttcggttcctgagaagaggaaagtagaggagacgagagggggggaggcggcgacggccagtggtggttggatggggggtgcgttgatggcggagtgaatgaggggggaggcggagcgagcggctctctcctcggcctcctcggcttgtcgtcgtgtgcggccgcctaaatgcaaggcgcgcggaatcggcgcccgccccgcagccgtttctccctccgcttgtcgagcgagagagcgagggagagggggcggtccttctttatcggcacgtggcggcgcgcggcgcggcgcctgcgcctacttggggggaagtggggagcgctcgatgctgggcgtctgttgcgtccagggcggatgcgacttgtcacggttaaaaagtagtccacggaggaggacaacacgcttcccttcacacgtccgctttccgctggcgttgcgctcgatcgtttcgatggtacagcgcaagagttgtaggggtttttggttgatggtgataaagaggatcaccaaaagtgcacctctctattcctaaaactgatttagaggtattatatgaccttatttttttcgtttatgtttatcggttaaaatttaattttttcagctttaaatttgaagctgatttgaggtttttcttaaagcttatttttcagcctttgcttttagattgctaaaaacgagtatgtaaaaattttatttacaaattattttttatttgaaaatatgtcgtttcgcttattccgtgaatagcaacgaagcaaagaagcccttacattgccgattgtccaatcgcattgggcatcaagggaaagagggtgagtgaatgacagcatttcaactatcaatgtgtggtcgacctgacagaccacaagaaacagtacgttcaactagccaaggcacaccgcacattaccagcggttcaaaaaaacaaggcggcacatcacttggcgacagtagcaggcacaactacacaactacagtgataaaatatggcacaggctgagaaaaaaaatgcaagagaaaactcagcagaaagtttattggacagttttatttatagaacatagctcgactcgttgacttcttttcagtcagattattaagcaaactatcctatgaatatccttgccgtttaaccaattcatggaattttcacctgaggtttcaataaacattaagaacatatcctttctagaaagagaaaaaaatccaagagcctgaaaatgtgggggaagaatgaactaaacaatatcccggttggccaagcaaacatagtgaatttgctaaatctgaagagcagaagcaataggtcctgccagactgagaatttcaaacggctgcctgtccttgaccgcattgacagtgagagggcatgaatcagtaatccagaagtggcttagcccatgacccggaccctctgaaattttacaatacacaatgtagttagtaactatatcagtcgaataaacaacagatttttcaacaactataggtgctacaatagccaaaaacaaacaaaaaaaaaacagaaattcattggtctcaaaaagaaaagaagaacaacattcgaccagagcatgattatgttcttgtttatgttgtgttagaagttgaagcctcctacgcaactagcaaagtatcaacaaataccaaatactccatccttcccagaatataagaagtactaaagttggacacggttattaagaaagtaggtaaaagtgagtggtggagggttgtgattggatgagtagtagaggtaggtgggaaaagtgaatggtggagggttgtgattggttgggaagagaatgttgatggagaagttgttatattttgagacaaatcctgaggactaaaagttgttatattttgggacggagggagtaggatttttgcatgatgttcccatacaaaactgtatgatgattaatgagggttatgactcagtgactgcattattaaggtatttgatgaaaatctatttggttttcacttaagaagtccttatgcatctctcactgcagtattattacaatggtctatatttgatgtcccaaagttttattccgtacaaacagctaaaagtttggcaaatttgcaggtagaaactagaagctatcttaataaaaacataaatatgacctaggtttccaagatgaagggtagtctctcttgattggaaaacgttacttgatcaataaaaagtacagtagcaggcaggtgaattggtaaaagaacaaatggttaattattaaacaaagaaaaacaattcaacctaccaactctaccagggatctatgccattcattggaaaacatataagttccaatgaatttacggaaaggtgtcaaatgagaaacaaacaactttgtttgcattaacgcctctagattcaaaaaattcttaacaaggaatcatataaaatatataagaaacttgctacaatgctaatattaaaactttgtgtacatacctccattatcaggctgaaatttctcccacgacttgttggggaaaatgccatgtgtcacgtatgcactaacctttgctgctccatgctctgccaatactttctggaaagaaaattgaataagttagcaatcgaaggaagacaggagaactacatagttacaaacagttatgaagtacactaaaaggttaactgctgtgaaataaacttcctcaatgacaagaccagatgagctgatgatttatcaacaaatttaattacctggcattcaatcaatgtaccacctgactgtaccaagtcatcaactataacaacatggcggcctctaggatccccctcttttatccgtactattctctgttccccttctctaactttgttgcatacaacctaccgagacacgtttaatgaaatcagagggtcaatattcagtacataggaacaccatttcttgttgggatttgaaagtggtcagacaaaaataactaccattgggaaatgttgaagttgcttatagaaccgtttccatgcaccgtcatcaggaaaagctatggttatctgataaaagtataaaggagtatatcagtctacgtttcatcaacgctgtcaagaaaaatgaaagctttaattatgtagtcagagaactcacattgtcagaatcaggtagttcctgaagcctacttttgagtaggggaatgccactctcaaaacatggcaagactgagtctccaaagtagaatctctcctgatatgttgttaagtacaagttattttcatgttgccgtctaaaaaggacaagtgcatttgatatggaagaattttacttacttgcaaagcatgaatatcaaagatcactagacttgaaggaccgcctcttgatattggtatatttgacaaaattctagcaagtgtgaaggctgtggcaacatctccttcatcttccatccgctcagacgtcccagtagggaaaaatgggagtataagagtgaatgacgaaataaacagctttggcagagcatatataattgatagttgctcaaatatgacacttggcgaactaaatgatgctaagaaagcaacatgttgtccgcggattgtgtgggcattcgagatgaataaatttggaaacccatcggcaaatgtcctgaaaaatggtaccaaagtaaatgtaagagataagtttggactaattttgataaagtataataagtttctctgagatagattttaggaaataaaaagattgttcctacctgcaaaattaccagtcagaacatcctaatgagttatcattccaattctaggtcccttgatagaggtacgacagaattaaagtattgacctttaagtcaatttcgataatgtatactcgttttgcttatatgctgatcaatcaggaatggaggtagtacaatggaactaaattttgaatgcaaaaatgtaaatatcagtgcgctgactgcagcaaatttgtgttttcccacaggtcccaagcccccaataaaacacaacaggcggctaccagatcatattagagctgcagatatatatagcttcacttttcatattgacctttccctgttccattaagggccaaggttaaaggtagagctttgtaatcccgacgaactaattgtgaaacaaagcaaaaattgttcagcgccgatgtatcgattcgggaaacattcaagaaaactccttccagttcagatatcctttcccactgagcgctctttcatccatgtagcgggaaagattcccattatgtaccaaacgaattaaggagcggttgagatacttggttggccagatgcaaaattcgggcaacaattaatggtaaacaatcgcaacattaaggactccaggggaaaaaaaaaacaacgagatggtagtaacaaagggcgggtaagaatcggacctccatgagatggagcgcagctcgatgtcgtcgttccgggcgaccacctgctcggcgagctcccgcatctcctcgcagtggaagagcaggacgttcttgtgcgccccgacggcgccggtcatcttcggcacggccaacggcgcgagcacgggggccgccaggtggatgccgctggcgttgctgacgatgctgctgcccgtggcgctcgcgccgccgaggtggaggcttgcgtggagcctgccggcggccgaggcgcggggggaaggcctcgcgaatgcggatgcggggctcgggctggggctggggctggggcccgggcgtcgggttttggcgccgaacgccgcggcgggggaggcggaggcggaggcggaggcggccgttgccatccctgcccgcgccgctgccgaggcccgggggggggggggggtcgttgggactgatgtggtcgagccgcgcgagtccccgcggtgcgttgcgttacatacgcgtgtggcgcgtgccggggagatgatgcgtttttttttttgcgagatttcgcgtgatttatagcctgcttcacggagcggcgtacgcgcaccggcggtgtgcgggtgccgggcgggtgggcgcggtggatgacaaggcggggtggcgtatgcccgaactggtcagccgataaggatgcgaatcgcccgagttttgttgggacgcatgacgctcgccggctcgccgctcgcgtcacacgtgtttaggtgcgcgtcgctttttagggtgtttgctttgtgaattttgtccgaaactcggactaaattaaaatggtctccacaggtgttgggactagatatagtaagtattgcattattgctagtactactactaaacttttaatttaggtggcacaaggagctaaagtgagaacccataaacgcagaatgatgtaagcatttagaaaatgagtattgctatatgtttaactcaattttatagtcgtagatcaattaaataagagaatgttcatatgcattgcagtatttatagtcgttgattaaattcgtacatgagtcggatgactgagttatatgcatagcaattgtcttagaaattttagtgggctgatgttgcagtatttgacggataggaccctaattaaacaacacaaatgatcacaaaccggcatctgtcgtcatccaagagaaaaggaaaaaagctttggttttgttaaattgcccaatggttaagaatcaatttggacaaaataatgccctctaaacagtaaacagtcaacatcaacgtggggaaatggcctctgagatgttctaaagccatctaataccactctctagcttccaccaatgccgtagtaatatgccgtcaagactgatgggtgagagtgagactgccagcgttggcgcccgttctatacaagaatgtctactacctgacgagttttctaagttagaaacgagagaaatgaggtagagaaatcagaaattactttggccgcggacacccgatcaaactttccgggaagcgaagttggcctccggcgggggcacggtgtttgggggtttggtgggatggactaaacggtactcgaattgtccacatgatgacgtacacatcgcttccatcaggcatcatcgtctagtagcagcaaatttccagtcaggctgcggtcagtctgctgcacgattttgcgacgaacggcgtcgatttccacgtgccggcaaagcacctgtcgccgttatccacgcgaagattaagctaattaactactactagtaagctgcacgctggtagtagcaaatctgtcgatacgcgaagtcgcgagagctccgttgttccaaatctccagtacggttggggtctgcggccaggggtacgtgttggaccaaccatctgcagtcctgcacgctgacaaacacgaccacacgcccacaccaacccgaacaaacagagcaataccgaagacagcgatccagcttattttgccctgttctgaatcctgaattattaagtttcattcatagggcttgccaatccaaattgctctgtttttcttccccaactacgtggggccgcggccacaggtgacggtgactctccggagcctgaccgctggcacggccggctcgaccacccggaagatgtggacccggaactcggccgcggcgacgagctcgaacacgcagtagtcgccttcctcgaggcagttcccgcgcgcgaacgcgcaccacccgcgcgacagccggtcccgcgtgttcgggatgtacagcaccgaccacaccttcccccccgggtctcgcagcaccacgtccgtcctctcccgcggcaggtgctgcctcgagaaccccgtcggaaacctctgcatattaacacacacacacacacacacacacacacacacacacaaaatctgctcatcaggctgtcacacgattcaggtgttgtgtgtgtacatacgatcgatcgagtagagttgttcgcgcaccatcatgaaggagtagtagacgtgcatggtgctcatgcggatgacgcagtaggggagcggggaccggaacgcgtgggcgatctccgtggcgcgctgccgctcggcggtggcgacggcgcggcggcgggacacgtaccccttgtagcgccggatggacggcgggatgctggcgagggccaggtcgtcctggaggctccgcgtcttcgccgcgccacgcctcgccgcgccgccgtcggcgtccagagccccctcgggcacgtgcctcggcggagacgccgacgatgcggggagctcgcacactgggagctcgtcggcgtcttcctcgttcttgaccgccgttgatcctgcagaagagtacttaggagcttttgagtaacgtatagttgtgtaatactaacaacaaattaaaacagttggcaacgaaatcgcacaagctatatatatatatatatatatatatatatatatatatatatatatgggctgtgtttagatccaaagtttcgatccaaatttcagtcctttttcatcatatcaatctgtcatacacacaaattttcagtcacatcattttcaatttcaaacaaactttgcgctgaactaaacacagtcatggttcaatataattttgtcatgtcactgtcagcgcaaacccgggcctttctgcagcattaggctgcgtgcctaacatatactcccttcgtcccaaaaaaaacccaggattgagttttttttttttgggacggagggagtagtgacgtgatgtgcgacatcggtaaatttgtccagggatttgatgatttgatatcgtcgaaagtggagtacgtaccaatcacgggccggtgggagtgggagtgggcctgggatgtttctctttgtggggtttagtagttggaccctcatataggctgttcccttcaccttcgttcttcaagcccatctttcaaatggagtcttggcaggaaattcagtgatgttgcgactttggaagtggaaccgtatgaaaaacttgtcttgtacatgatggtcaagttacccacttgccctaaacgttaagggcttgtttagttcgcgaaaagaaaatttttaggtgttacatcggacgtttgaccggatgtcggaaggggttttcggacacaaatgaaaaaactaatttcataactcgcctagaaactgcgagacgaatcttttgagccaaattaatccgtcattagcacatgtgggttactgtagcacttatggctaatcatggactaattaggctcaaaagattcgtctcgcgatttcctcctagctgtgcaattagttttttaatttatctatatttaatatttcatgcatgtatccaaagatttgatgtgatgtttctggaaaaaagtttttggaactaaacagggcctaaatatttataactgaagggaatatatgaattcattgtaccaaattatctaatggtacgatttatttaacacaaattcttgatacaattcgtggttatgataatatggtattcttaatcatctttgtagcgcaagaactttcttaagtgcccaattagctcaactcgcgccttgtaatccctccgtcctagaatataagaagttttaaagtttgacacagttattaagaaagtaattagaagtgaatggtggaaagttgtgattggatgagtagtggaggtgagtgataaaagtgaatagtgaatggttgtgattggttgggaagagaatgttgatagagaagttgttatattttggaacaaatcctgggggctaaaagtagttatattttgaaacggagagagtacatattattaatgtttattttttgttgtaaccagagtatgcactccatgactatgcacatacactacacgcatgtccataagggcgccctcctattagcaaactcttagacagacgggtctaagtggcaaatcactggcctcgttgaatttctattactagcgtattatccacgtgttgcaaaggggttctaattaataaaaaaaatatcattaactagttattaccattatttttatatacattatcttttaatttctatataaattgttaccgacatgtgaatttttgacctcacactatcatttttccattcccataagtagagaattggtggttgtcatgtgggtcctctagccccacatgtcatttctttattctaaaataatagggaggtggtggttggggtggtggcagattcatcactcaccaccacatacaactactactactttttgaagaagtatagattttgaaagccaactcatatggtttaaatcgtctcttcttccttctctcgtaaaaccatacaatcttaatgatttttaggtcaaaattcattagtatcaattaaacataaaatatattcacctcgcactatatatgcaaccatatgcaaactatataaaacacaggaagccttttttgttctattaaacatattacatcttatttatacatagtgtaacttaattttccgcattaacacgatagagtcttcatgcagtttacaatatttgtcatcatcaacatctgatgatgatcaatgaccatatcttttttgtggttaacgggagagtttcttttggaggctagctagctatagatagattaatggatgtacactattatctatatctatatatcttatatagttcatccccactaacaacattaattactatttctctgcactatgagttagccacgtcattacatttagctacagtcgttggattacaattaaacgccattcatttgcacgagcaaagttgctatctatcccccactgttcatgtatgtagctggcgccattactacgttgttctaaaacggcagaatatgtccataaatccaagaagctaagaggccatatgcatgaaacttaattatcagacaattagaaggcttaattatcagacaattgctatcattttttttctccccactaaagccactatatagcactctgccatttaggcactcttttctttgtgttgtgtatgtcgtccaaaacttccctagcaacaagatagaatatttgatccttcctgccacgcctggattattgacaccactgcagcaatttgggatctccgagaaaaggaaaaagaaagtttcccttcaccgatttgaattgttaatattggtcattctcaaatcttctacaaggtatgattgtcgttctaaagccctttatgtttgaagcttagctatatagcagcactgccagcacaagtactgaacatttcttctttggatagtaattatttgttagttctgaaatataagttcctatcctgaatcctgcgtttcttttcctttaattagagatggtctttacgatccacatttcctccaagttaaaccttcttattttgatttgatgttgtattctgcttgtggtgcaaaatacatatattatttttgttctacgatatgtgataaatatcatacttatcttactgctaaaatttccgctacaacgcgcggggaatcttatagtataataaatagatcactactcctcccatttcatatcttgtcattttggatctaaatcaaacttctttaaatttagttaactttataaagtttacaggaggattcagcaacacttttaagacgaaacgaatatttactagtagaatttataaattattaattcagtgttgcatatattactatacttttatatttgtcaaccgagttacacaaaccaaaacattctgtaccgcgagacggatggagtaaattaatactacctccgtcccatattactcgtcgctttaaccttttgcttgtaacatttaaccattcattttatttaaaaaattagtgcaaatataaaaatagataaatcatacttaaagtatttttgataataaaacaagtcacgaacaaaataaataataattccaatttttttgaataagacgaatgatcaaacattataaaaaaaactcaaagcgacaagtaatatgtgacggagacagtatatactccctccgtaccccgtaaaggaaatcgttttggacagcgacacggtctccaaaacagaactttaacttcttgtttctatgaaaatatttattaaaaaatgatatatgtatattttgatgaaagtatttttcaagacaaatctattcatgtaatttttacattttcaaactcaacaacttgagagttatttatgatttatatttttaaggtttgatttaaacattgttccaaatgattttttttactagcatggagggagtatactgtataatagtggttcttttcttacctggttccggtgtccaactggagtccacgatttgcaacggctggccaccactaggcgacgcgcggtacgtcaccatctccttcccaaccgaatccttcttgggccgcgcggcatcacgcgaggcggcggccgtcctagggcgaccccgtttcttgcgcggccggtcgccgccgccgcctcccatcaggtcctcccgctcgcacgccgtcctgtcgaacaccatcgcggtgaagcgcgtgttgccgtcgtagcggaacacgacgaactcgagttcgcgcagcgcctggtcctgcacgaacttgggccagccggaggtgaagaaggtgccctcggccgtccggcggatgacgaccagccacgtccggccgctgggcccctccagggtggccgccatggacgcctccttcaggcccttggccttcctcgactcctcccaggggatgtgcttgcagaagtttggcgggattttctgcattattcacacatgcatgcatgatgcatatatatatacacaaatgacattatttcgagacttgcatggtgcatataacagattgtttcgagactacgcaacgcatgcaaagctcgctttgcagaaaatgcatgcatgcatgctagcgtgacgaattctctctgcgcaaagtattggctagccatcgtcccgatccaaaattgtgatcgccatatttcgcacgatggcaacaagtgtaagctaagtgcacatatgccagacaaaagctggctaaccggcactcgtgcactcaccaggcgctgcttgaagtcgccgacgagcaccttgaagaagtgcggccgcctctcccccgacgcccacggcgacttcttcttccctcccgcccccggcatcgatccctcctaataaagcttctccaactctcactgctcgtgcgccgatcgatcatgcacggatgctcacgcagcagcagcagcggtgcgcgcgccgcctacgcgctcactctcacggcgaggagagcgagaagcttggcgcgcgccgcggggcgcggggggccgggagaagagaaaggaaaagagacgcgagagctcggcttttgaggcgggggcctgccagttttttggctgtcgcgatcgatcacacattcgcacactcatcactcactcagcagcgtcgcgtccgcccgccgcggcgccgcgccgagtggagggatgtatcaagcgtcggtctcctactctcccctccccctctcgtggctaaatatcgcctaaacccccggatatcgcggggggcggtggacgctcggtgcgcccgtggaacggagggacagagggggcaggtcgctgccatgtggggccatcagcgcgttagcgttaagctgggcccacatgtctgtgacaggtagctggtaccgcccgttccgtggggccggtggatattgctgcatacacacgctgtgtttctaatctaatttgatagtatcacacggaggcgcggctgctcatgaaaaccatgctacatggttgatgcatgggttgataaatgataaacatgtgcgatggctatttatacgtgctaattatatagtaataatgtgtgatattctttatgtacaaaatatgctctgatatctagtgaaatattggatactgttatcgcgagaggacatgtacatgacaccaaaataatggatacgatgcgtccacaatatataagccataacatatactgttgtcacatgaaagcgtgcctgaggcatcatgatatcactgtgtaagagctcacctttttttggatggaagtgtatatttcaatttgttgtcacatcaaaagcataccacctatcattggtggtaaaaaaaattgatcagagcaaaagtgcccaataatggaggttatgcggtggttttcccagagttgaataaaggttaggttaaacaggttgtccacttattgttcatagtagatcgttgatgcttaattcttcatagaccattttttctcaactaagattttcattttcagtgccctctaagtctaaataaaacttttacactattttctaccaagtaacttgatcacaacatgacaaaagaccatctatttgaagaatgaccacatatgtcgtcgtaccaatatgcatgtagtactagtacctttctttttccaatgttagaaatagtgtagtacattcgtacgggtggccgaaattgcaacagttccatttctgtctcctttatctcactttatctaatctaatttgatgtagctgtagctaggtccctgttcaatcaaaatggaatttgctcttcagatcttctcggtgattgttctcaactttagaagctacagtaaagtgaagaatcggggccagcagcccagcaccagcacagtgtcaatcggatggacgtaattttaacaccctccaaagagaacctggtcatgtactataaaatcacattggatctttgcttttggaaacatatgctgtggccaaagccatttcaagcaatgcccccctactatgaatgccagcttttcccaatggttcctgtctgggcatcgcactcacgacccccgggagaatcttttctggtgtctgcaccaaagaaccaaacatgcatacggccaagtacgtacagaaaacaatagcaaatgtagcaagagcatcgaggtgaacatagaaacagtaccgagaaaggaactgtagaaactttattccagatttatcatttattacccatccctaggacggtaacattcttgtgatgaaaatacatatgcccatgcttaaggtaactggatacaaggaacttcacatcacgtcgaaaaggaaatattacaatacaggcatgaacgacacggggaaaaaaaggcttgaagtaactccggtagactcatcagaattacagcgtgcagtactgaacaagtagtaagattttgcaggaaacagttcatagatatacatgactggaatagatccggataccggatgaccagattcaccggtagttgcggtaaagtgggctgtacatgcagctctctgcatacttaaccaggtcctttggccgagggcgcctgcttgccaaacctacagtcaggaagaacaagtgataagcaagctgtaaaaaggaaccatggacttatctttgaggaagtgaagataaattaggatgctgaccaagttcatatgcctttgctgcaacgttggctgcaatgtgggcagagatctttctgatgtttgagaagggaggataagtaaggccctgtcgaaattctcttgtgtgacctgctgagccagtgcttccgctgtaccaggatcagaatgtatcatcagtgttaacttgccagttcaacatatatgccaaagaagatctaaggatgaatcaatccgcggaattacgctagaaggaattcattcaaataattcattacagcttgcttatcacttgttcttcctgactgtaggatcagaatgaattatttgaatgaattccttctctactcttaccacctcattttgtgactgatttggactaatgcaaatagtactgcatcgagaacaatgtaatctcggtaaaaagaaaaggtacttgtggctttagttatatagtatggactatggagcacttacaagctgcaagaagcatgtcatcatgaacacggattgcaccagacatcaccacaccaaggccaaaccctgggaagatgtaggcgttgtttgcctgtatgacagaccatgatcgtatttttagtccagaacagttgcaactgataaaatctttgcaataaagtcaatggtgtttattgttaagacctggccaggcacgtatattttgccatcatactccaccggatcaaatggacttccacttgcaaacaccgcgcggccctgttatttcagattgttataacaaaactattgcccatgacaacattgtagtaagcactagggataacaaattccgagaaaagaaaaaaagcaaggtcattactgatagcgatcataccttgctccatgtgtacgcttgttcagcggtgcactcagactgagatgttgggttggacaaggcaaaaatgacaggcctctaggaatttgtgcaaaaaaaaaaaaacatcagctgctaacttcagtggttcaacagactcaaaaatattaaattgacatggtgaaatttacctcattaaatgaggaaatggcttcaacaacctcctgagtgaaagtttgcccctttccagatgtgccaatcaatactgttggtttgatagtctggaagatgcatttgagttagaatagagcctttcatagttattcatagtaaatgcaatgaatttttacatgggtgtattcatactttgactgcatctaagagatttccaacaggttcatgctcatgggcccatggtttcttgaagtgttgaagggtctcctttcgtgaactgacaatcaagccctgtcaatttattaatatccacagttagcaagtaggaacaaataaagttctgaacccaaacagtgaaattaagcaaggagatctggttcttttcaacctttgaatcaacaagccatattttcttgcggcactcctcaattggtgctttggtctgcatgtgcaaataattattaggtcatatagatatgtgtacaagccagcaaatgacccccccccccccccaaaaaaaaaaaaaaaagatgcatcacctgtcttgatatctcgagagctataagttctgcaatgcctgtcccagcctgcaagcacaagaatgaagatattgtttgggagaaaatgtaagtcaaatctatatcgatgaatacacagtcaattaaatgccattgagaagtacatgccacaaatatattgtgtaatatctatatagctcataatgagaaaatatatatagttagaaaaatggaagaacttatcctgatagaataagcataatacagtattttaaatacaaaattgcaaataactgtcgcacgaaggatgcaccagcaccaacttataaaatagatgaaaatggtcagtaaagaagcagataactacactaagatagactctgaattgtacaattgatggcatttggagttcttttcagttaatctagcaagtccacttcagatattgcagctccacaa

SEQ ID NO: 58817 - DNA, 1308 bp, Oryza sativa
cagtagtcggatgagatcagcagaaagtgaatcaactatatgcttccttgaaaagaaaatctcccagtttttgtacgctgaagcttcatctgttatgtgttaattacataaaaggaagtgactgctaggagccacacaagctgtggcgggcaaactaatactcttttgagctgtgagccagtgaggctagattgattgaatatatgtggagaaaactgcccacaatatgtattttagaactagctgacattaccaactaatttctatcatggtagcaccgtggtcaggacagagctttggagtttttaggtgccctctatgtagcaacaagtgcaatgcaaaatttgaaggttcacgtccactttagatttcaggtcggtttgaggttgtgtcatttgtgtgccatgaggttgagcacccaccaccttgcctaggagatgcaacttacttttttcctgagtcatgtctttgtatcaagctaactctgttagaattatcatcctcattgactaatgcaaaagcagattaccagatttggatctacattacaattgtgtttctgtgttaaaaggataaaaattgctaatatttatctttctttctagtttgccttctactctaattggtatgtgaaatggttgttaatagacagtggaatctttttttttagagaaataggtgtaatctgattataaatgtgaatatcaaatctgatgactccttttgttttgtccacgtaaaaaggattggctactaccatagaaggtgctcaagtttgtcaaaattccaggagtttcttgaagttgatttttggttatctatcaaccttgtggctctgctttctcatgttatattgtgctaagcagctacattgcagttcaagatgtattattttatacacaatctttggaaatgtttgaattgccacttagattcagttttccttgaatgccatgactaaatgcatgtctttaaatatagcggggtatcactgcttagttgccagacaagaacaaataactgataatagaacttgctgcactgattattatctcatcttcctattttgtttgatattagttttttcctttctaaattaatggacaagaggaacaaaaccaaagtcaggagttctttttttgtttactctgtttttctatatcaaatttaagtgacaatgctgtgacacttcttaccgacaatatgtactataaaatgattagaaaacctatcaattgacctccatgactatctttgtacttaatattactctaaatgggatattaaaaggcaatgatgatttgctct

SEQ ID NO: 58818 - DNA, 1287 bp, Oryza sativa
tacatgtgaactgcaacacacagcaatacatggcaggattttctatctctgctggaaatttaaggttctgatggagtaagcatatgtaaaagcgaagaagacagtaaagccagccagcactgcagccacgacgcccatgaagtccgggtcatagccaaaatagtccttgatgaaaggtctgacttgctgatcagattgtccagggaccgtgataaaatcctccacatctccgtactgtgacacaataaggccgtatactgtccatgccactggacaaagccaatagtaccaaacccaccattttgggattttctgcagaaacatacaaaaccagatcaacctacagaaattgtacagaaaaaggtttagagcttaaatatagacaattaagggacttaccggtcttgggatgaagaatcctgaaaagagattgaaaagggtgtaaaaggcagcacccaatatggaagcaacctgaaggtttggtgatacggagacgttcatcatgccatagtaagtgaaatagaggaaggtgaagaatgaaacatagaagaaccagaagaattttgctggtgtccattggaacgacatcattgggtagacaataagtgtgtaaatgacagtctcaacgaacacatacggtatctccacaacaacctgacaaaaattcaacagattgattataaaaagttacttatatattgaaatgaatttatatctcatttctactacatgattgtgaccttctgttgcaaagtttccataatattccattggtctgacatttttaaggtgttctgggttcagttgagatacaaagtaatatcactgacctgagctagagcatatggtatagccgagtacattccagctgcccgctctctgtaaaatacagtcctttccacagcaacaacgggttgaacagttacagaattctcaaaaccaacaaacaagacggcagcatacattgatccaatgatgaccaagagatcttttgaactctccctgcatcaaataagaaacatttaaggaaccagtgataggtattcatgaaaatattcaatgactctgcggataataacttagcctgataaaagtacatacatcttgtgaccaaccctccaaaatatagtccccaacattaaagcagtaaataatgcaaagaaaatcctgacaaggttataatcagggcttctccagtaagtccaccattgtttccagaggcagagcttgaactgattaaaggtgctctgcgagtattgactagggaagtagaggtcatcggaacca

SEQ ID NO: 58819 - DNA, 2229 bp, Oryza sativa
agcccgtctagctcagtcggtagagcgcaaggctcttaaccttgtggtcgtgggttcgagccccacggtgggcgaattctgtttttttatcactcttttttttatctgaaattaatctgacaaatttttacatcagattgtttaccaatcaccatagctatttaggaaaaaaattaacgaaaaatttaaaaaaaataagataattggaataagagcatcactcttttttatctgaaattagtctgacaaattttacatctgattgtttaccaatcaccatagctatttaggaaaaaataacgacaaattaaaataaaaaaaaaagatatctggaataagagtctagagtccatgtggaaatgtggaaatttagaactaactaaaattcgaaaatagaaaacaataaaattaagggatttaaaagtagagtcaggagtaaatacaattttgaaattactaaaattaatttttttttaaaaaaaaagaatattggaggaagattctagagtccatataagaattcaacttagaaataatgaaaaattagaattgaaaaataatgaatattaaaagaagagtctaaagttcatagaaataaatttaaaaataatggaaatttgaaattagaagataaggaatattgaaataagagtccaaagtccatatacgagtacaatatataattaactggaattcataatttaaaataataaatattgaatgaagaatttagagtctaagtatgaataaaatttataaataacaaaaattcggaattaagaaacacataatattggaagaggtgtctatggttcacatagaaatataatttaaaaataacttgaattaaaatataattaatgactatcacgtatatacaattcaatttggttagtttggttaggtaagcacaaaatttagaatcatgttaccatttcaatatattttaataatgaaatatagaaaaataatatgatatttgtaagagagaaaataaagatagtagccgcacaatctgcgccatgctagttagtggaaaagaaatttgtccataattagttgacccgttgacataaaaactagaacaaatcacagtaataccatggaataaacattattcttacttggtcaaactagaacgggcatgatttgtttatgcgtaatgattggtctattttagttcaattagatgaaatagcttttatttttaggtttaaagtgatttttagtttattttttgttaactaggatagacaaaaattacgtgaaccaaacaagttacgcattctggcatgcacatggcaatatgcctttttgttttttcctacgcccggaagcagccaaaatcagagcaggaaagttcaacgtggcgtccattgattcctcttccctgctggaaagcataacatcacattacatgtgcctgcctgagtgccccaatcgccgttagggtatccacaatgtgagacacttatagaataccctcactaactaagggtactctaagagaactcacctttacattgcagggtagcctaatgagtgtcccaacaaaaaaacccatttctctcctcttcatctctttcctattctacccttctcttccccctcccccctctcactgtctttctcacacgcacgcacgcgagagcgcaccgagtcgccgtcgccgctctctctcccaccactctctccctctctctctctctcccccgtggaaggtggcagcggcgacccccggagacggtagatccggcgccgctgtggccggatctggccccccggcggatggagcggcgtcagccgtgccgcattgaggtggcggacggtgagcgcgcggcgagcttgaggcggcggacggcaagccctcgcgctcgaggcggcggatggtgagcttgaggcggcggactcgacgagctcgaggcgaacggacgaagctccgtcggcaagggagacgagagccgcctactttgctgcagatccgtcgccctcgccgcggatttggcatcccagcaccgtcccaggtcgtcgccgcctctcgcctctccctctccttctcccgccacgcctccctctccttctcgccgccaccgccggagccacacctctctcccgtcgctggcgaccgtgactgagcgcgacgaggagctccatcggtatcgccaaggaggagaggggagaggggtggaagaggaaatcctcgcggggggcggggggggggggggggag

SEQ ID NO: 58820 - DNA, 3359 bp, Oryza sativa
ggggagggggcgtcgcctcaagtacctgtaccaacgcaacgggttccttccaccagcgcctgtgcgaaaaggagctgggggagtgggaggtctcctagctgagggacacgctctctcgcagggggacgacgctgacggaaaaggagacggccatcgctaggggcacgggctgaagcaccgcattggtgatgaccttagccttgtacactccacacacacacacaatgatacaaaacgatcacatctctttggactgggtgacggctacaccacaaaagtacaaagcttctccccaagatctcgtctcgactctctcgatccagcgctgtcacagtgtcacgccaagcaaaacagtgcattcgacgacgaaatgcacacggatacacgtgtcacatatggcttcacgctaaacactcggtcaaggtcaagcataaagcaagaacagtcagaggtctccaatgtccaatctccattttccaccggcatgatgcaacaagcagcagcagcagccgaagcacacggctccggtcacccggcggcgtccatggctgacgacgggaaggaggaagcagtctcggcggcgtggcacgggtcggttcgcgccgcggtggaggggccgacgccggaccaggcgtgggcgctgctcggggacttctgctccctccaccggtgggtaccctcggtgcagacgtgccgaagggtggagggcgccgagggccagcccgggtgcgtccgctactgtgccggcccggtgaacaaggcggcggaggctgtggccgggtggtccaaggagaggctggtcgagttcgacccagtcgcgcggcggtacagctacgaggtggtggagaccaacaaggggttcggccggtacgcggccacgctccgggtggagcccgacccggccgggtgcgccgtcgcgtggtcgttcgaggccgacccggtgcggggctggtcgctggaagggttcgtggggttcctcgacgagctcgcgcgcggcgtcgccaggaggctcgaggaggagatcatgtcgcggaattagccggatgccaggatgacgctcttgctttgaaagattgcgagctctcctttgctgctttcgctgtgttctatgcacgtcgcacatccatcaccatgaaatagcaagaaaaaactcgtgcgatgggtttgatctccgtgaaaacggaatcgtccatttcccatttccccttccaaagtgttgccttcctctcgccacggaacaactttgtccacagcaagtcaactccgtttcgtccataacatccacccagggccgttcatggccatgtgccaattgatcaaccgtataggctcctcaaaattaagggtcccgaaattcccacatttcaatacaaaccaccgtgttttaatatattttcgattgtagttattgtatttttcaaaagttccacttttcttaacctactggatatttgttttctttgggttcgataaatgttagataataattatggtaaccataaataaatatagtttataacaacgatacaacacgtactcacatacttaaaaaaaacatactcacatactaaatattttatttttttacttggtaaagaaaattaaataaccagatcagaaagcacttattttttcctaccgacgccacaaccattgacgtaatttattatttagctgcaaaatttgctctcttgtttttaatattttctaaatatagagtatcattttatgtttcgcattgggcccgaattactatgttagcccagcatcctccacttttaactactcgcagcctcacaaagaaagatacgagctcgctagtgcatttctgctattctgggcaaaccataatgggatacacacagaagttagttgaatttttttaatttttaattttatttattaaaatatttacaaaaataattttttgtttaaaagttttaccaatctacacccctaactgcaatgggccgcacgccaatcagaatcctatttcaggccaacgataattggccatacgttgatcagaatacatgccaatggactcatatagtcatgtttatctgtttatatataatggacataattatgcaagatagtgtacctgttggcccaatggtaaaaaggcttgtgtcacttataacatctcatatgctgctcatatctgttgaaaagccgagaagagcgcggccaaaacctatacattctaggttatcttcagatggcttagaatcgagaatcatcatggaaaaaaaaactgtctgatgtcattggtggagaaatattttttactcctggttggtaatctcctttagtcccgggttttcaaccggaagtaggaatccagaacttaagatacccatctttagtcccggttgaaataaccggactaaagatcccggttggtaataaggtgttactaaccggaactaaagagagggtagcggtagtccagatggtctcattttctcttttttttcttttttattttctcccagcagtcctaatggtccattttctttttttttcttttctttttttattttctcccgaatcgagtggcatgcatatcccaaatcaaaccccaaatccccaaatcaaagtaacatcccaaatccatatcacaaatcttaaagttacttataaacacaactcaaatacatcacaaatcctaaaaaattacacacaaatcaaatacatcacagattatacatctcagatccatacaatgaatcacaaaattatacatctcagtgaatcacaaaatatcaaaaaaaaagagaaaacaacgccggctgccggctgccgccgcctgcggccccgccgggaggaaaggggaggatcgatctgtgtgaggaagtggttgcgattgtggaggagaggataagtgctagggattatatactacgtgttgaattttagttccggttggtaaataccaaccaagagcaaagatctagatgatctaaagtggtgatgtttagtcccagttgatcctcggcccgctgacatgcctgtgacagggaatgaaccgggactaaagatcatagaatggctgtggggttttcaaccggggctaaagatcatttttagtcccggttcgtttttgaaactgggactattgtggttttgggtcgacccagcaaagatcagttctccagcagtgtgtaaatatctgagaatagtacttatgtatacatatatatcttgtattaatctatcttgttatttttttaaaaaaaaagttgataactgacttataagaaacgggagatatctcctcgatcgaatgataatatatatatatatatatatatatatatatatatatatatatatatatatatatatatatatat

SEQ ID NO: 58821 - DNA, 4661 bp, Oryza sativa
aaaccgggactaaagatcctatgcgcctgacacagtctgacatggaaccaaccgggactaaaaatactaaagatgatttttaatacaaaccggaaataaagattatctagtcctatttttcttataaaccgtgactaaaaattatttttagtcccggtttttaatgaaaccggcactattatagattttggtcgatcaatcaaaaatggtttctccacaagtgcaggttgcccccagggcaagacgatgctgtagatggccccgagagcgccgccgatcccagcgtatccgacgttgtcgatggcctcatgcaggggcgccggcgtgagcggcaggaacagggtcgtgtacgtctggacggaggagaccagcgacatgtagacggcccacgagatcagcagcggcagccgccacgggacggcgaggaagaaacgagggtcggggagcacaaggcccaagcagcagattattatcatgcatggcacaacaccgaagcgcaaccacagcatgtcggaggacacgtccggccacgcctccccgactgtcagcagcggcggcggcgccgttgtcgccatggtaactggtggagaaaccatctttactcggtcacctaaaatttataatagtcccggttcgaatagaaaccggaactaaagatgtttttagtcccagttaaaaactttttgacctttagtcccggttggtaacattaaccgggactaaagatcatttttagtcccggttcaaaaaagttgtcgggtcgagttaggtcccagctcatttttagtcccggttggtataaacaaccgggaccaaaaatcaactgagccgcgcgcaccagtccaccatcctctcccctctcattaattatcccttatcccttcgatcccaccgtcctctccatcccttcgctagctagcttatccctctcagcctcaacctcctccatccattctcctctcaccttcctcccccttctcttcctcctcctcctcctaccacgtgaggccgagcggcagcggcagggaggcgggcagccgagcaggcggcaggcgaggccggcgaggcggcgggcggccgacgaggcgagtctagcgaggcccgcgaggcggcgggcagccgggcgggcgaggcccgcgaggcggcgcgcggccgggcgggcgagtccggcgaggcccgcgaggcggtaggcggccgggcaggcgggcggcgaggcccgcgaggcggcgctcctcgggcgggcggtgaggcggcgggtggcggtgctcccaatgcggcggcgctccccaggcggcggcggagcccgaggcggccggcgggaggccggtgaggcggcggacggtcggcgcccgatctctgtgatgtggttttttttcctgatctgtgtgatatgtgcagccgatttgtgcgatgtcgattttttttctgatctgtgtgatgtgtgatgtgtgaatgaatttgtagagatgtttttgtgattttgtgaatgatttgtgatgtatttggggataaaaatgcagcttgatgtatttggggattttgtgattgatctgtgatgtatttggggataaaaatgtagcttgatgtatttggggatttttcgaatgatctgtggtgttaaaatgattcgtggataatatgaatggtggtgctcgaaatcatgaaagcaggaaaaaaaagaaaaaaaaacattagtcccagttgttaattctaaccgggactaaatctttagtcccggtttttaacactaaccgggactaaaaatccatctttagtcccggttatttaactgggactaaaaatatgcatctttagtctcggattcgtagtcccggttgtataaccgggactatagggggttgtgaactggtattaaaaagggtttgtccaccagtgtgtgaagacgacgtaattaacaacacgtactgcagggtttgagctgtacttcgatttgactgatgatttgtatttacggcctacgtacaggcgcgcggtgcatgaagatcttttgtagcgaggcgagcgtgataaagttcgaatcggcaagcaacgtaatcacgtatccgattccgttgaaaaccaacgtgatgcggtccgtctggccgctggacagtggggccccaagttgccgaccggaacacgactgcagcagcatatcccttgccgctgttcgtcgggggctttcttcttggcgcgcgtctttcttggcaatgctgtattgctgtgcctgtgccctgtgagcctctgacctccgttcttgtttgagttgccaatcaggctgtattgaatcagccatggataagcttgaggctttagcccttgggagcagccatagcccaagtacgcgacgccaacctcgccgcggcatggctcgagtcctgctccgacgagagcctcctgcgatctgcgcctcggcctatcctccccttacacgctgccgccgcaaaaagatccctcagttgcctcgaccgataaatcttagtgacattttggatgatctcgttcagtcattcgggcaaaaaaaagtttttgttgctcacagaaaatcacacttgaacattgaaattttcttcaagtcagaatgcattcttgatgatcgaactatctgaccacgagcagcagtggcagtagtacagtgctagctgcaattcataaccactgaaatgaccttcaacttgaagttcaatcttatccacaagttcaatcaaaaggtatgccccctgtgctgcacaaacgacgaatctaacacttcacctcctggccaaatgtaggttcactaagaggatttgggcggaaatccagatatggacgcacatggacctccaaatgggcaaatgaaatgattgcccctcgatcgaacatcggtggaatctcgttgtcgagtccactaacaccctaagagtccctctgcaaacactactgatgctagtcacttgagagatctgggggatcggaatgcaaggatctttcgaagcacagcctcaaccccggcctcaattcttgcaaagatcaaagaagaaggtagagcttgggtcaaagcgggagcgactaggctataggagtttggaattttaggagatatcacctaacgagctttccttcttgcgggctggttttcttagattggccctgtatatactttgtataatttttacccactctattaatatataagccaaagcttttgccctcctttcaaaataaaaaaaatcttatccacaagctttcaaactagtactccctccgtttcaggttataagacgttttaactttggtcaaaatcaaactgttttaagtttgactaagtttatagaaaaaataataacattttcaacccaagacaaatttattatgaaaatgtattcaattattgatttaatgaaactaatttggtatttataaatatattcaattatttgtctataaatattataaactaatttgactatatttcacatccgcagataaaaaattaagtattcggataactacacaacttatctgttataataaagggtacagaaaatacctatttccgtagtagaggtcgtggaacatgtctcgtattcagtttctttaccttcttcaacacagtactgaacatactcagaaatgtgaataatagcatcagaaatttgatcatgttctgtacttcattcaaagcagttaagccaacaggttatgtggaaggcataacaggaagatcaagctctatataatcgttaggagttccagtttgttgacctcttttctcttgaggttcaacaaacttctgcccagatagcaccactcatccaatagatcaataagttcggtaaccagagtatgacaggctattgtttttttttttttgaaatagcaagttttgacttttgaagggagaaagagagagggtacctctccgttcaaatttccaacgtgtatgctgtcctcaacagatttttcatcgtcccctgcgttcccatctgcagctaagcatttaaggcattctgatcactacaaaacaacttatactagtgtacaggaaacgcttcttttgctgaagggcagcaaaataaaacgtattaactaatggacacccgaagtattattttatgttataaaagatagtcgatataggagaacgacgactaccctttccgatcgcttcagtcattgatcactcaagacatgccagatgacgacataggaacacatgatatttgttaacgagtttcagccgaaacctacatccccggggctctgattatgggcgctcctccccaaccaatatagctcctggacttactagatgggatattatttgccaacccgaaaaccagaatggtttggggtacttaatctaaaaattcaaaataaatgccttttgagtaagtggttgtataagttaataaacgagaatggtgtttggcaagacttattgaagagaaaatatctttataataagtttataactcaagttgataggaaacaatgtgattctcatttttggtcaggacttatgaaagtaaaaatactttcttaagtatgcgttcttggattgtgaataatagagaacaaataagattttgggaagataaatggttaggaaacttggtctttagaaataaatatccatctttatatgctattgttagaaggagaagttcttctattgctag

SEQ ID NO: 58822 - DNA, 1386 bp, Oryza sativa
cgttgctgtagtgctatcgtgaaatttcatggtcagtagttcatgtgcatggtcgccctgatcaatggtggtaggacatctctggagctgtttttatgcgatattcctgcaaaattcctagtacgaattcatgcgttgcaaacaagcccgtatgtctccttcatttcttgatacgacatggatggattgtgttttggttgacaaaatccaaggagagcaattttatgcatgaaatgagaatgagcaattatcaggctgcgcggccgcccgccggcaccaccgtgccgtcaggcccggcggccggccgcctccatgcacccccggtcacggcggtagggcagggcggcctagcgcctctccagtcgcggtggcgcgcctcccggctggcttcgcgggagcggccgacaagggcgaggtgaagcgccggcgtacgcggacctgagggcgaggcgaagttgagtctgtctcaggctgatccggcgtacatggacgaggacgaggctaagtgcgtcctgtgcgcgtgcgggcctcctgttaggttgaaacggagattctttttgcctgcgtgccggctcaaacgccatctccgttggattcattctggacgcccgagatgcatggtatgtcacgttgtgacttgcctatgctaagtaaccgaagctgagtccctccgcgtttccacgctcatgccccaccatggcgccttcccccgaccgctacacgcctacaccttcccggctcccgctggcgctcaaggccgcggctcaggccgagacgccaacctttgccgacaactacacgccgccgccgtcaagggtgggctagcgcgctgcgcgccaccccctcactgagagcgcgctcatcagctactaagcgaaggctctcgacctggatcccgcatgcagggtgttcgatgaaaacccccaccggggcctgggttcgtggaacgccatggtctctctcaagttggggagtcaagggaggcgttggccttgtttctcgatctgcgaaggtatggcatactcgtgctgccagatgatctgaccatggtcagggtcgcaatcagcgtgctgttctgtaggggatattcgttttatggagcagttgtataggtgcgtgctgcaatgtcatcgacaggacgccttgacgtgacgctatccaatgcattggtcaatatgtatgtgaaagaccaagaacagctatagaggagggggggtgaatatagcaattcaaatcttgcccccgaaaatactcatcaagctggatttctcaaaatccttattagaaccgcggctattagagaagccggatctagaaaagaagcgagaaggaattcccgaaactagaagaggaagagaaaaggaattccccaaacttgaagagagg

SEQ ID NO: 58823 - DNA, 2401 bp, Oryza sativa
aggattacaaaaggagcaacctccacccttgcatccatctctctatttatagcctaagacccctaagacattgtctcaaatacccatagggcgaaaccctaccctggacttatcttaaccatccgctgttccttagactcaaaggaagtagtgcagattgctgccacgtagtcgatccgagctccccacgctgtgcggatccgcgtgctcatcacttgcaccaacaggaaaccgccacgcggccacgcaagaccgtgccttgccccgcgcgcgctcgcgaaaccgcgtgggtcccacgtgggactcctccgcatcgaaccagtaagcgccacgtcgtcttggagagcaccctcaccaattcccgcgcgcgccttctcctcccttgcgcgtcgtccgaatttggcgtgggtcacgcgagtagtcgatctcccgcgtgagagcgcgcggtcgagtccgcgcctgccacgtgtccctcacgcgcgccgtcgccgaaacctcctgccttgacgcccttgcttgccgagctgggccgtcgttgcttggatcatgctgtcctgctccatcttggactgggccagtccggtccagccgtgtggcatcctggccgagcccatgatcacgatggattggtggcctccctgccaaccaatcacagcacacatgcacatcacctcgtgcatgcatgcactgctcaagctaatgcacacacacgcacagctcgcatgctagcttgcttgaccaagtcttccaaccaagtgcatgcacgtgcactttcctcattggctgcatgctacagtaccatatgtactgtagcactgcttgctcctttcctctgtcggctttcttcgcgaatcccggcacttgcacttttgcacttgaccttgcgaagtccgttgcaaagacctcctcacacggtgtccgtccaccctgtgcaaccttgtatccaatcttgtcacccggcatccttgatcgttctggacctcaactcctccctgagtctagtcccgatctgccgttgaccaagattgacatcgatcacctgcacacacataaaccaaacaaccgttgtcttggcacagatattgcaacctggccaatgttagtccacgcacacacttcttgcacttccggtacttgtcaatttcccatcacaaaagaactataaccacacatggtttcacagtatgccaagtggatcttgcaagaagagtattctgagtgtatgcttgtcggaatgcctcattgtggacaaccatgattactgtgattgctacacatggtgaggagcacgatgcagtgaacatgtttgatgaaatgccgagggaagggtgccaccaaatagtgacaatgatgaccgtgctctttgcttgtatgcatggagggttggtggatacggggatgagtttgttgaagcggatggaacccggggatatcagagttgtactaactgttgaacactatggttgtgtcatgtgtgatggatatgcttggtaaagttgggcaggtggatgaggcacatgctttgatggagcaaagaatgctaatggaggcaaatgtggtgatatggggaacattgcttggtgcatgtgaaagacatgagaatgttagagttgggcagtgagcggcagagagtacctagaggccgagcgatggaacgatggggtttatgtggtgctttcaaacgtataggctgttgccaggatctggtgtggtgtggagagggtgaggaggaggatgacaatgaggaaaatggcgaagtctgtcagctgtagcctataaatctacaaagggattgcagttgaagtttgttctgtctcattgattcatttgcagtaactagtagacaaatgttattttatgaaatcaataagtaattaatcttatgcctattgtcgttatggtgccattttcaattgctgatagtatagatggcgcatcaaaattatgatagtctaatttactggcataagatgtgtggtaggttaaattgattagttcctttggataatatagacatagtcatgatatagctggtttttatggaatgaaaattagttacatgaataatacttttaactagtggcagataacagttatccttcattaggcgcttgctgcttgtttcaaatgctgtatatgacagctatatcattttttacaattctttcaacacttgatttactcaaattagattaatatgttatgtttctgtccactgctagagatatgttccatcaaattctagtactaatagaatattctgcagtgtgtgagatattaaatcttttagtaaaatgtccacattgaataaatcttaggttccccgcaaaaaaaaaaagaataaatcttaggttaagatttggacaagcatattttacctcagagaacaaaccacatctga

SEQ ID NO: 58824 - DNA, 1958 bp, Oryza sativa
aaaatacgaattataaaaaaaattcatataagacggacagttaaagtttgacatagaaacttagggtttgtcttttttcgaaacggagggagtagtatagaaagcactcacgggtgcatcatagaggatagtataacatgggttcttacgcatacatcttgttatcactagaatcctccaacttccccttctgttgcatccccatgctaaaataagaacagcctagccaaaaccctctattaggaacaacagaaagccttaaccaggagcaacactgatgggctccattggcaacggccggaatggctcggaggttggcatacagatcccagcgatggggaacaaggaagtgctggagcgacctgccataccaagatggccacggctaggcgtcgtcatggtggcaactagagctgttgccctggtgatggcagtgctctcaatggctctaatgatctctgccaagcagcggggtagtctcaagatcttcggcatcgagatcccgctttatgccaattggtctttctctgattccctagagtaagtatcaaagctgctctatttcgaaatgtgttaagctcatacagagtactgagtcgttctgattttctgatggtgttgttcgggatttcagatacttggttgggatgtctgcagtttcagctgcctactgtctcgctcaacttttattgactgcacacaaggccgtgaagaatgcccctgtggttcaatccaggaactatgcctggcttctgtttactggtgatcaggttcgtcaatgcttgtccatttggcttgatcttaactctctgaaatcaccggcgcttgccacggccgcaggatgggggggtcgccggcaccggtagagtagggggtgttcgctggcaccggtagagtaggtatgggggttggcctacttcgcccaattggtgggtctgctcctgcccattttgatctgattttgcaatgacgaataggttgccttggttttttatgctgtgatgcttgctagattgcatattttatactctttattttcatgtttcttgtggtacatcaatgacccgttcaggattcctctttgtattttatggaacagtcagtaaccagtactagtataggcagtattgattgggtgtttggggttagttctataaaagatgagcaagttcttgctggcaagtggtatcttggaacagtttatttaatcttcttgttgtcaacttgccacgtccatatgcatgctacatcaaaatactttctgcaacttggtttagatttactgtttttccccaagccataagaaatcattggaatttttctgattcttgtgcatctggttgtggacttacatatggaattgcaatcctttctagatgattgaacttgataacctaatatatgcaagaaatatgcggaatataatcacttcatttaggataaattatttcttgtgtttttgtgggattcgtatttgaaacagacttgcaatatttgaacaatacttctacagatatataatatgtggttttgttgtgatagagccaaaaccaagcaaatccctaagcaccaaaagagctgggatttgcaagaacagaatactgtcgggaacttcttaagcaaactccatacctaacaagcaactaagcaaagagaaaaacaaccatatttgtgcaagatagtggtcctaacctcttatagaaaatgttcttgggatttttttttttggttctacacagtttgtgcaaaaataaaaagtttgatgcacaacaatggtcttttgttccaaaacctcgtagcagttgtcagttgatagctgatgagagtgatggcacttgagcctgagtacacagagctcaagcattttacacaatttcttgagggcacctccacttaatgtttttgtgaatggattttccatggtaaaatgcataaatgtgacgtagatctttcaggat

SEQ ID NO: 58825 - DNA, 987 bp, Oryza sativa
ttagaaattattcatagttaaatattttgaagttcgatcttagccttgtccaaaacgatgaatattataaatccagatagagtacttgtgttagtcttttttcactttgcatatatgaagaaatttatatttcaaaaaaattgagcaaattttatttgtgtttactttttcctctgctagaacaagtgcgttgcctttactgcgagcatcaagggattaggattgtgcatccatcggtggagaatttccatgggcgtgaggtggaatttgagaagatggtatgtggaaaagatccctgtgaagacgattttgatcttttagttgatgaagaaccgttttacaccaacgatggtatcgtcaacaacctcgagtatgcaggtgctatggatggttcgaagaggacttcatttatcgagatagcgatgaaggcaccgacgaggaagaaggaaactctgatgatgatatcgattttgtgtgaggtttacatgactgtatattttgattgatggagctgtgtacatgttcaatgttcatgttcagcccttataccggcatgtttagggagagtttagttccactgggccaaagttttccgaaccgtaggcgaactactcctacctattttttggaattttgttttattttcttgattgactatttgacgtaggatattccagttcaagaagggtctaagcaagagatggcaatggttccccgtcctccgattccctgcggtgaatcctcccattagaaggtgggggtggtataaaatatgtctccacagaggataaatagagtaaaaacaccttccatcgggtctggcaggggcaggtttgtttcagcgtccctcgtccccgctctccgtggaggcccgacataatagtgtatgtgtagtattatcatgtatatttggcccatctggcccatagaaaccaggcccaacacctagagcatataaagcatctgcaaaaccctacccattccaat

SEQ ID NO: 58826 - DNA, 704 bp, Oryza sativa
  unsure (1)..(704): unsure at all n locations
gtgcgtgcgtgctcgctcgctcgctcgatcgatcgaaatgaaaattcaagctgagcgtgtgcgtgtgttcacccatgccccattattgctagctagcagcttgtttacaacaacgcggagtggctccctcactgtgacgtgccccgcatcaaagcatgggtagaaaaaatggcagcgtcgtccatccctttcttcgcaacgccgggtcggtttccccgtggcggacgtacgccgctgcgaaacggccgaggaagcggaaagggaaacgggcgatcgtcgtcgtcgtggtggaccagtagctgtagctgtagcggcacaagctgagggggagaagtagaaatgagaatcggggggggcggcggctaatggccacaggaatacgcacgcgagtaggagatcaagatcgcggccgntggcgggtcggggcgtatagtttaaaggcgtgggtcgtggcgaggagcgccccacgtcgcgccgcgccggagccccggagcgccagcgccgcaagggattttttttttgccctctcttcacattctcatttgtgtgcgggttcgccgagcccgcgtcgcggctgcagctaggggagggtggctacgacggctgttcatggagattaactgcagcttgattttactggtatggttaatttggcgtgaggcgttgagcagcctttatcatttcctcgcttggggctgcaggaa

SEQ ID NO: 58827 - DNA, 1615 bp, Oryza sativa
  unsure (1)..(1615): unsure at all n locations
tgtgtgtcttatttgctctatatctctctcccacatatcaaggagacaacggaaagctctagaacatcatcttttatccaatgactaagatttattttacctgttttgtttgtttattgatttaacggctattattcattagatgatgtggcacattcttgttctgttttgggattgtcttttcaagagttaaaataagacttgaaagatttatttatgtgacactgatattgcctatataatcacaatttaacataatgcccaaccaaataagataatcacatatttttacataatgtctgatcacataagctaccttcaagttactacttgggagccatcgtttcttttattcgtggaataagcggaatggcaaatttacaaacgaaaagtgatttataaataaaacttttatataagtgttcttaattaatgatctaaaagcaaacgctgaaaaataaacttcgatgagaaaacctcaaaatcagctctaaatttaatgttgaaaattcaaattttggttgataaatataagcataagcgaaaagatgaggccccatgattacaccgaaaaaaaaacctctcgattaaccatgcgtcatgtccaaaaagaaaaaaagattaattctgcaagaaaatgcttgcaggttcttgaggaagtgaggaggctgatggagttgtacaaggacgaggtgacgagcatcaccgtcgtcgggcacagcctgggcgcgtcgctggcgaccctgaacgccgtnncatcgtggccaacggcgccaactgcccgccggcgagctcgtcgtcgtcgcagccgccgtgcccggtgacggcgatcgtgttcgcgagcccgcgcgtgggcgacggcttcttcaaggcagcgttcgcgtcgttccccgacctgagggcgctccacgtcaagaacgccggcgacgtggtgcccatgtacccgccgctgggctacgtggacgtggccgtgaagctgcgcatcagcaccagccggtcgccgtacctgcggtcgccggggaccatcgagacgctgcacaacctcgagtgctacctccacggcgtcgccggcgagcagggcagcgccggcgggttcaagctggaggtcgaccgcgacgtcgcgctggcgaacaagggcgtcgacgcgctcaaggacaagtaccccgtgccgccccggtggtgggtctccaagaacaggtgcatggtcaaggacgccgatgggcactgggcgctccacgatttcgagcaaatttaagctctcgatttcgaaaaatttgcaaaatggattacgtatagaagtgctcgttaatgggcttgacacgtcgaataaatgggatttccccctcatatcacataattcatttgtaaataaactcttgtccagtcaaatgcatgtgttgatttggacattgttacagatacaaaggtattgatttggacacgttgagatgtccagtaattatttcttgatgcatatgcgagttcatgctcatgcacattgatacactccatccaatcatttactctgcactatcctcatcttcctcgcggtccatcagagtccagcggccatcggcgcctctcaccatgcccctgttcgacgggatccaccacc

SEQ ID NO: 58828 - DNA, 1589 bp, Oryza sativa
  unsure (1)..(1589): unsure at all n locations
tatgttgcagtcacactaggtactgcaccggatctaaatccgtctgcatgtgtccaaagggaaaaaggcaccaaattacttgcagttgcaggcttgctgtattttcttaatcactggttgattcagtgtaaggaataaacatggtgactgtttggagtactaacaccgtgtttagttctaaaccttttttcaaactccatcacatcaaaacttttctacacacataaacttctaattttttcatcacatcgttccaatttcaaccaaacttctaatcttaacataaactaaacacggccttaagttaataatcaccgaaaaggacatcattagaccagagtttttggacttggtgatttactctagtggctctcctttgattttttttagagaaggttattttctacccgacctccatatccaaccggatatatacagccattgagatagggaacttagccccgtaaacaacctaatctgaaattcactccatagaagattttaactcagaacctcgtactacttttgtactactcaggctctcctttgatggggcagtatattactctctccgtttcattttaagtgtaaccatgagtttacatgtcaactttgatcgtccgtcttatttgaaattttttataattagtatttgtgttgttatgagatgataaaacatgaatagtattacttgtgacttatgtttttatatttttttaaaaaaaatttnnncagacagatgattaaagttaggcgcgtaaaatcatggctgtaataagacggagggagtatcactgtatcgtatatttggacacaatcaagcaagtcagtactgagaaataaaaatgatctgtactgtaaatgccaagttaagtacatcagcacgatgtagcacgttgtacttttgtaccgcggatcaggtgcagattcagggaatgattgagtagtctgctctacagccattcactggtgggctgggccgtgggcttcccaacggtccaaggtcgtgcactgcaggaaatggggcccagcccgaagcataagtgcaaacaacagcccaggtaggtggcacacccgcgccactggactgacagcaagtgtgggtgaaacggaagaggaataagttcactttaggttcctctatctgtcggccagtccaattttcgtccctgaacctcagaaccgggtacgacccgtcccccaacttatgaaaaccgggcacataaggtcctaaggcggtttggatagcggttttggctgacgtagcgcctacgtggctggtttgactaggtctccatctcacgtggtactgacgtggtgcttacttggcaattcaatttggaaaaatataatacccatgagacccacatgtcaattacataaaaaaataattaataaaaataattaataaaaggtgggctcgcgtggaccccacatgtcaatcccactcccatctccttcctcctcactccccgtctccccttctcttcgtctctctccgactctcccccctctcctctctcttctcctctctcgggtgcgacggccggcggggtggacggcgtgacaggcggcgaagagatgggtga

SEQ ID NO: 58829 - DNA, 1376 bp, Oryza sativa
  unsure (1)..(1376): unsure at all n locations
cccaagattgcattatttgtaacaccggccccccaaagcctcgtcgcgctccacacatgtcaacgtcgagcctccagagctcgagccttcggacatgtcaccagtgcagcagcgtggtgttcatgggcgcatctcgtaccaggtcggccccgtcgtgtctctttgactcgtcgtcgacaaggccactggcaaaccgagggccttcgtgttcgtcgagtacctcccacaacacctgccgcaacctcgaccgccacgcctattgcagccgcgtgctccgtgtcnnntcgccgaactggaagtagcagggcgctcgcgcggcagcggcgagccgcacgagctggtgggcatcgaggactccacacacgccgcatcgctcgtgaagggggcaccacccagcgccgacgacagctgtggagacggtgggcgccgtggaggcccagggagacgtcacgcgcaccgctggccgcgtcgccgttgtcccccgccggagccggtcgcccccgccgccgggctaagtgggtccctctatttggtcgcctgctcggccgcccacccgcgccgccggctgcccgggaaggagagagagaggggaaagggaagaagagatgaggaagatgaggaggctgacacatggagcccacgtgggccccaccattttaaaattatttttatgtgcagctgatatatggggccacactttttattattttttcgagatatacttgccacgtcaatgccacgtgggacggagaactagtcaaacaagccacgtaggcgccacgtcagccaaaacagacttcaaacccgttgagggacctcgtttacccggtttacataagttgagggacgggtcgtacctggttttgcggtcagggatgaaaatcggactgggcgacaaatagagggatccaaagtgaacttattccaacggaagaggagaaggcccataattcatagtgggccgtacttgaggactggcccaaattttgccgttcgtctttgcattgcaggtttttctctgaacctgattcggctcttgccgctcacagatccagccagcttctttcaaggcgaaactgatcaatggtactgaccaaaatatgaatattttttttattttttcatgaagtaatgaagagaaaggtaaaattaaataggtggactagtcgtaattggttaagatgaaagagtaagtaaagaaattaaacaagagatacattgtgtttgattgagatgaataagtatgccaagaaattattatattttgagataattttaaaatgctagaaactgctatatcttcggacgcagagcagtagatcatttgtcagattggatggattgtgctactgtacatgcatagtgtttcagacttt

SEQ ID NO: 58830 - DNA, 954 bp, Oryza sativa
  unsure (1)..(954): unsure at all n locations
cagcgtgcaacgcatggagatgcgcgagcgcgagccgagcaagtcaagctattttttttttgaaaaaaaataatacgtgctcgtgcaacggtgcaacgtatttcatccgtccttaaaaaaaagactcgttatatatctagacatatatcatagcatttgcctctagctatgtttattttttttatgtatgttcagatatatagttagagtttgttttttttaatagagaaagtacatttacggtagattacgtgaagcgatgtgcgattttgggctagggtttgtgtcaacttcatcggtggccgtttgggttggcgaaaggggtgagctgcaatcagggtttaccttatcgtttgggtcggggttatcgccaccccgcggtagcgcgataaccgtgataatcgcacgataatcgtctaaaatcgcacaaaaatcacatccaaaaatttgaattcaaaactcaacggtttcgcggtttcaccgcgataatcgcacggtttaccgcgatattcgcacggttatcgcgggctgtgtagctgaaataatgtaaatgtaaaataaatagggtaaaaaaaatcaaaaatacggttgaatatgtgtagaaaactagaaactgagaataatcaaaaatatgcaggatacttaaggccaatatcctcttcatttttcaattnnnaaccatttttggttttgtcctcaaatttgaatttatcttactctatttaaaaaaattcttcaccattggcaattacaaatcaagaactacatccatgaattttttcagttttttttgattttttttcggaattttgaatttggtcaaaattcatccaaaccatatcgccggtttcctctaccgtatccccgcaataagcgcgatactcgcccgattatcgtgcgataagtgaaaccctggctgcgatgcgaagcactggtgtgtgtatacagtagtcg

SEQ ID NO: 58831 - DNA, 1232 bp, Oryza sativa
  unsure (1)..(1232): unsure at all n locations
ccggcggcggacctcgacgccggcctctgcttcggcttgctggatcccgtctccaacgccatcgtcaacgccgccgtcttcgccgaagcggaagatgggaacgacaggacggggcgatctctcgacggcgcggtcaccttcctcaccacgttcttccctcacctcccggactgggaggccgtgcgctacctgctcgacgccgacgctgacgtcctcgtcgcggcgcgcctcgtcgtgcgggaccgtggactgaggagattcgggttcgcctcggacaccgccggcgccgccgtaaggttggccctcagatgcgccgcgctggccgtgaagcatccgcatcccgaccggctcgtccacgcgtggctgtccctgtctcgccgcctcgacgaggccgtgtccgcgctcgccaaccacgacgtgcgcggcctcgtcgnnntggtcgtcgacgaggcggaggcgccggcggcggccaacatggagagggcgtgggagctggcagcgtcccgatttctcggccgggacaacggcatcgccgcgccgccttaccggcacgccatgcctctccagaggacgctcctctacgcgatccaggggttctacctccgggcgctcgcccggctgccctccggcgagctgcggtctcactaccaccggagcctggtgaaggccggccattgctacggccccatggaccccgtctccaacatcatcctcaacgtcgtctggtacgacgccgcgcacccgccggcggaggagctcgagctggccatgatcccgcccatgagcatgttccgcgtcgccacgcgttcgttcctcggcctcgtctccttcctctgcacccgctaccccgacctcccgctccatgacgccatttggtgtttgcttgccgcggacggcgaccttggcgccgccgcaagagaagccgagcggcggcagcaccgtccctcctgccnntncaggaggcctacgccgccgccgctgccgcggcccggcaccccaaaccggacgaacaagtggagctcctcagctcgagcagggccatcacgacgacgacgacgacgtcgctgctcctgcagaacggcggccagctctcctcggaagacgttcgccgcctcgccgccggcttactgtccccgaatccctccgccgccgtctcaccaacgcagcgcaaaccaacgaaaccacggcagcgcgggaagctgaaactgcagtcgcagttcatccgtgatcag

SEQ ID NO: 58832 - DNA, 707 bp, Oryza sativa
ctcgccgccggcagatcgtccacccttgctttttttccccgggccgatcgatcgatacaaccaaaaccggcaacgtatacctgctagccagccgtgcgtgtggtgtgttcgtccatatgcgtgcaaaagctcaacgatcgaacggagaaatggagcaaaaaggcgcttttttacgcccgtctttaatcggaaagaaccgcccaaattgcgacgtgcttcaacacgcttatgtactggatctatgctgttcttttttttaatgcaataatttctaatacacgttaaccacattcttctgattaaaaaatatgttattaacatttattttgttgtcgtctgtttctattattaaagttacttttaaacatgatatttttttaaaaaatctatatcttgactttgaaggcaaagtcttgttcaaaaacatggttcaaacaatgataggatagcagtgacattggtattgggaggacgcggagggtccctacttgacacataaaaaatgatataattaatcgtataatatttatctcctgttggtgaattctacccgatattagagtttggtggtatgatttttaaaatgtaccgagatatattatatttatgcttagagactgtaaaatttctcaatccggtcggttgtccggcaggaagactgaatgaatagtttggtccagagtccaacaacagtactcaacatgtgc

SEQ ID NO: 58833 - DNA, 1012 bp, Oryza sativa
  unsure (1)..(1012): unsure at all n locations
gacccctcggggagacagagggaggggcggccacatcaccctcgggcccgacccccccgagggggtcaggccacgtgggtgactgcagctgccccaaacctctagtcaagatacccccggtcccatgtcaccgacagaagtattactagttagtgtgttttcgtcgaaagaaaaattcaaagttcgcagtagttagtttgtgcatagactttaacccgagcaattcgtagaagcgccgtagatcaaaatgtagttgaacgtgtgaaacgtggctagttatttggaaaacgtcggcgatcatgcgcccgatcagcggcagaaaaatcggggcctcccgcgcctccacgccgttgcaacaaatcacccgcatattacagaaacgctctattaagggaatccgcttcatttttagtttcaccaacaatgtttcagtaagtgtactcatgatgtttcattatgtatggatcaaatgttgcattgagttaaaacatcctttcgctatttgctgaaatattgtttttatataaggagaaacagcgcccgagttttttggaaaccgtttttcatacgttgtagcaaatgtttcacaaggtgatttggttgtgtttanctttttaaaatactgagacattttcgatctacttagtgaaacaattccgatctacttggtgaaacagtgcttgatatgtaggcgcctcctagtaatttgagctatataggctgaggtggcatgtgaaacgtacggcaaagtgtacgcgtgtgtgagatatatggcaattgtgcataggattagcaattggtatgcaaagaccagttcttcttcttggcacactgcacacacgtaaagatggccagatggcccgagacctgacagcccggcccaaggcacaacaatttggcccaacccaagcacggcacagcctgactagggtcatgcccgtgccaactcacgcctgatagccgtgccgtgcctgggttgctacctcggcacggtgggccagcacgacccgac

SEQ ID NO: 58834 - DNA, 730 bp, Oryza sativa
caagcatacttggtgatataaataggtgcaaactgtaacaacttaagtataaatacaagcttaatttgagctatgttagcaatggacttctcttaagaaacagaatgaggtgatgttcctacaaagtaaaatatagtgttagtttgagtgatcacgcaacacgttataacttgttctctttcttttttttttttttttgcaaaacaattcataacttccaaatgtttctgaatcatccttctggtttggaaatttattacctcctagcaattgtagttagtgctaaaggggacatcatcattagctctccatgaatcggtgcttgtaaagagtatgtcccatcttttcaaatgaactcctatggagggaagaaattcaagccactggagtaatggaatgccctctcagaacaaggattgcttggtaaaaactagggacacaaggcatatcgcttgctgtctgctagattggcattttaaaatggtcagtttgatgaccgaagctgaatttgaggaatgatgtccatttttacgactatgcaacatgttctctgttaccttatctgtctgaattgccaagtttcagaagtattcgacgcttaaacatctgcattcccagtccttgtatattcagaagtttgagttgtcagctatacttgatgtgctcctttggttttgtttttcacatcagtcacaggaaggttcaggatggaatactgggctgcaggaat

SEQ ID NO: 58835 - DNA, 1760 bp, Oryza sativa
tcagttttatgtcagtgtacgatccgagaccacaaataaacgctagatctacacgatgggcaatgaagtgcaatccccaagccgtgaccagcgcaatcagcatgcttcacaaccagatccatgaacctcactgcatatctaaactctacagtgtaaatcaaagttagggtgcttacgttggggcagtacttggagatggcagtgcagaggcccttaacaatgccggcgttgatgttgaagaggtcgtccctggtcatgccgggcttcctcggcacaccggccgggatgattacgacgtccgaaccctccaacgcctccccgagctgctcctccccgacgaagcctttcacctgcggaggagcagaatccaaaacccagcatcgtcacacggctagatccagccaggagagggatgcaggcgggtgggtggagacgtaccagcgccggcgagttgatgtgggagacatcggcggcgacgccgggggttccggcgatatcgtagagggagagggacgagacgagcgggttgagcttcatgaggagcgcgagcggctggccgatcccgcccgccgccccgaggatggccaccttccgctcagcggccgcggcggcggaggagtagtcgcggcggcggagcgcctgcgcggcgtatctcagcagcgacggcctcatctcggcgttggattcgtgcgtgcttcggctcaggtgtgcgtgtgtgtgtcgcggcggtgggtgggagtgagagcggcggatttaatagaggagaggtggaaggggtggatgggatctagagagagagagagagagagaggattcgtcgggggtatcgacgtctccgcccgccgcgccgaggcgattttttttttctgttgctgtgactgtgtggttatctggccgaggccacttgcgcactagagttcgtagtgacgcgcactacactggctggacctgccgcctgcaccaacgatggatttggcttgtgcctttcggaaggtgatttcggtgcagtatcttttcttcgagagagagtgacttctggagtgttccagaaacgttgctactttattgtactcgtattcatcatcgatgacgatctctctttggtttgctgttctttttctgccaggactaatacggtgtactcctatgttgtttgagcaatgttggcaaagtttgaaatgaggtcgattaatgctgtttgatgatttaatcaatgtcggaaacgtttggaattgggattaattaagtgatcacttaatcctgatttcctgtccatgtgcctccaggttcgttccccatcaaagctcttaatcataacttcacgcccggttcgttctccctttggattttaattttttagagttgcagtaagatgatgctacattttctatcgagcatatggtaagttggtaactggaagagcttactcattttcagttcagctttaccaggtcgaatgaaatggtgtattttagttgagcatacggtatagtgagtaagttggtagaggagctgtactactatactgccatcatactcactatatcagtatatcgccaccaacgacaacgaggaccagcagtcaaatgtgtccttgtttaccgatacagggacaccggacacccaccagtcaccacccctgttctcaagaacagttgagcctagctttcatcacagatatacaaaacttaatgcgatgcgaacattacataatcttgggcggtcagcactcgcagttagggcagtgaagaagaatattg

SEQ ID NO: 58836 - DNA, 1757 bp, Oryza sativa
ttggcaacgacgatgcggcggcgtcccacgacggcgaccacggcggtggagcccaccgtcctgaaccccgacggctcggtgccgtcgacgcggggggcggcggcggcgacgctcccgacgacctcgccgtccatcctcgcgaagctggccaacatcgcctccttccagcgcacgtcgccgcccgacgcgctctgcccccgcagccgccgcaggctcacctcctccgcgagcacaacgtgcatccgcttcctgcacgcctccgccacccgcgacccgccgtggccgtcgtacaccgcgaagaagtcctcctcgccctccccgccgcccctgatagcgcccgcaccatcccccgtcgaagccatgaacgtccgctcgatggccaccgcgtcctccatctccctccgccgcccgatcaccgacaccgagccgtgcgacacgcacgccggccagctccggggaacaacctccgtcgacgagtcatcagacgacgacccgtccttcaccgaccggattctcttcgccgccgcatcatcctccgccgccagcccgagccgccggagctcgagacgtcggcgccggcgtgccgccgcggccttgccgtcacctccggctactacaacttcgcacgcgtgcccctcatccgtcgcgcccgtctccctcatgtcccacgcgtagtagagagagcaacggaggaatcaaagggaaaggctcgccgaggagggcgaggcgggctttaatacaagcccacggcgaaaggtaggagaagcaacccgagccgtcggatcgcgcgcggacggccagatgcgcgccaccgccgcgtgggacgtggacggacgagatcgccggtggcgcgtggcgtggccgccgtctgggatcccgggccgggagagagaccacgctgcgcctggtccaccggtacgctctcgcgcgcggtccatgtgggcccatgttttcagtgacataggcttaggtggaatgggtccacgtagcgttgggatggttgggccattaggtaggggagtggggcccaggaaggggtttacgtggagggagagagtggaacgaggaagtgtgggggcgcccgctcccgctgcggcggggacaaatgttaaccagcggcaaggcaaaagggcgcggcttacgtgcaaggaaacgagattctacaggagcgagcaaaactgcaaaagccctctgtgtttttgacccaaaccgcgccaaaaccaaacccacgtctcacacacctggattccggaaaaacagtgttgggtcaaacaaaccacgccgcgaacagccggcggatgaacgaggtttcgtttcggcgtttcgaatggcggagatggtcgatggcgtacgcccgatttggagcgtggcgcgggggtgagggccgcgtggcgggcgaggtggacacgcgcggcggatccagaggcgcaagcgcgagagggagctcggctcatgccggggtggaagagccagcgccatggcgcggcctcgggctccgtttccggcgcagcgccactgctgctgctgagtgggggcgacgtggagacgacccgggccgtggtctccgcttcttcgtacgagcagtggtgacgtggtccgttgtggtcaggcactcggtgcaggcgcgggattcgaggggtgccacgacggcatgcgggcagcaaccatgggagggccatgccgttgctagctttcaacttttacggcaaagcttgttcattcatggtgatgcgttggatggcgcttttgtccggtcg

SEQ ID NO: 58837 - DNA, 14556 bp, Oryza sativa
cgacctgcaggcatgcaagcttattacattgtatagtggctacatattggttcttaacgaaatcagcatagcttatggtgtattggcccctgcctttgtgtgattatataactcaacaaattgtttgtcattttacttgcttagaaggtagagggttggagatatatcacttcttgtttccaataaattataagcgaatgttatttgacggaatcccatccccacaatattaacaaatattaacaggtggcatatagctcccaagtccccaccaccggtgccactatctgccgcaactcccaaagtccccatcaccatgctgtttagggtggaaaataacatctgagatctcgtttgtttagagatacatatatgtgcgggcgtgccagtgtacctaaatacacaatgtaaacaaaacatagggaacatgctctttattaatcttaaatgatcataaatacaaattcccaatgtaatatatatgtatgcgcgctccataatctgtcattggacagatctgacttgtgcgatatggtctcctgattcctggggcctcgagaagctcccagttaattacctccgtaggtctaggcctgcaagagaacctccgattaagctgcttgtggtcgtctcgtcgtctccgcttcacgttctccatgcatggttgtgatgatgatgtagatgtgtgtgtgtgtgtgtaagcgccggcagcgatccatggcctcgtcggtccgtgcgctggtgttggtcgcccaccctccgtcgtctagcctcgtcggtcttgaacaacgtgtcgacgtagattgttggtgaagacatgcatggagttgcatagcttgaacgacttgacgtcacagcagttgcgtcgagattagattagagaagaatcagggaggaattattgaagatggttgatatagacggcggccggatttaatcaaagctcggcatctcatttgggacaaataagaaaaaccaacaggacttcttcagcccacgcattggtttgtgcatggcactgtagcagcgatgacatgtcatcctccaattggttggccacgttgccacaataatttacttaatcaacatgcattagctagcttgttgccatccaacagcactggctcaccgtcctcccgtcgtccttcctctgtactgcagccatacttgcctccatcgtcatccgctggtttcgacgctatgcgtgatgcttgacctccggcatgagaactgatagaagtcttggcagtcggcggcagctccggcgatcctcggcgcgctccggcagggcggcttcccgacgacctcctccatggttagcccgctccagtgcggtgaagcttgcaaatcaaggatgtctggtatctcggcgaggtcgcagcttcgggtagatgcatcaccagcggcttgaattagcagcgtcgagtctagggacaagtagcactacgtcggcttgaacagacgccggcatcgatgaggcttctgtgacgcgtagatgaatcggccaccgcaagttccccggcgacgacgatacgcgcagatggatccctatgcatggatttgtgcgtgctgtagatgaaagaaaacgaaacaatcttgctagcttttacctggactagccatcaagctcctctcctgcgcttgctgatgatcggatcaccgcgcgtgccctctcctgccggacgccgggactccggccgaagtcgctcgccgccgccggtgcgtgtcgtcgatggatggatcgccgatgagagttgatggatggatgtgttgatgctggatgggtagatgcgttgatgatgggtggcttgtggatgctagatgcgttggtgaatgaatgtgtggatgagttcgtgaatgcccctagctgccgaggggtcgacgccttatataggggtctgaggtctgtgctcgccacgtccgcacgccgtttcctccgcgtcaagttcgttgtagataaggcttgatcgatcaatttgttatttgttcatatccttctttgattttatctcttagcttctcctagcgtcaaatatctgatttgtaattcgctttgtttctctactgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtcttcggccatgggccgagcccatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatttatttgcgtgtatatacatggccgagcattgtgtagaaatgataagctagccaacttacaaactgcttgtttgctttgtccatcatgagtaagtcttgtgtacacatataatcgccaaaataccatcaaacacatgccccccaccaagtaaattttgatcgtggagcgagcgaaattaacttggtgtcgtgtcggctcatgcgatacatgtccggtagagtttagtcatgcgacgaaaggactcccatgttgaagcttatctccggccgtgcgttgaaagaaaaacaaagctagaccgtcatcggccaggactccaaatccttggcagttacgagtaatttggatgaagcctatatattgctggtcatgcctgtgcatcgattatgcaatatggcgcctcaggtgtttaactccatcgcaggtatatatccattgtcgattctttagccaccggaattaggatgcttcttgatcatcctgtactttttcatcaggcaaccatcttgagagggccagggaagacggagtatccagggttgcaggcgagcgtggcgccagcgaccggggcggcggagagcgtgtcccacgagacgggcggagaacgggggacaggcgagtaacatgagacaggcgctcggcaggagatagacacactgtcgaagataagcgcccgggaggatccggcggcaagcaacagaaggagaccaagggtgacgacccttcccagcatatcacgaagatcccggtccatagagatgatcgaggaggatacaaacgccacggcgagtcaatcgaattcctgcgtgactggcgtcataagaaggagagaactgctcgtcctaacagacttccattgccgaaatcttctaaaaagggtctgcgtattgaagattctccacaccccgagctggaccgcaccatgcgtgagaagcgaggaaaaaaccccgtagtttatgagagggtatcatccacggagtcttcaagcgatgatcgtcgccgccgccgccgctctgtggttcccgacacggagcttgatgctgtccagttgagtgactcctcctcctcttcttcttcttctgatggcactagcaaggtatccgtgtttccccaattctttttttttctcttaaaattctttgtcatagtggtttgataacctgtctcttagaacatacttgcaactcaggatactatagagcaggcaactgcattgggtggacttaaagctactgcctcttccgatgttgctccggtacctattgacgatgtaccttcagttgtgccggctgctaatgctcctgtccgctcttctccggtgatgccggcggctgatgccgcttcagctccgggatcctcgactcaaaagcatcaagaaggtaaggatgattagactcctaatagaggtcatattctcctttgctttctcttgatgtattttcttctttctttgctttttctgagaaaagtgtactatacccattgtagaaacttcaggcaatccatccgacacagcttgccagatgaacgagttgatggagaagacgtcccgttaccttgctgagttccggacgggcggtcgctatctccaacttaactctgtgagttcggcgaaacgtgtgctttctcatgagaaaatgatttcaaatgctattccaaattaacctaccaaaaccaaagtgtgaaaaatgattcaggtgtttcttcggaatatccctccaaaaaagggtttatatctttttgctgcttgtaaaaagagaactattttcaaaagtgagctttagagactataacaaaacccacctcaaatagttttactggaatttcgttatacagattacaaactaaaagatttctttcaagttttgttttcaaagttcttcaaaaacaaatcccttccaaagtaagctgtgatgagattcaattttagttacagtctaaagtttttcttgaggactggattgcagaaactgtgcttaaagcgtaccatccaaaaataaattatttcaaaagcttacgaaatcgttaaaccaattttctatgaaacattgctatttgaataaaacagatctcattctacatattagcaggggtgggcccactagtgattcaaggatattcagatgtatacccaagatttttggacaaaaaatacgtatatgtactctatacttcatatatgtattcaaaaaattaaagaagctttaaactactcatcttgggccttgtttcaccatttattctcggaataagttcaccagagatccccaacttaacaacgagattttttgaggtcccttaaccacaaaaccagaaatgtgtacccctaaactctctcaaaccgtttaccggaggtccctcggcagtatttttgcccagttttgctgacgtggcatcctagtcaacaaaaaaaatttaaaaagtacgtgggacccacaagtcagctctcttcttcagtgaggcggccgggcagatgagggcgtggcgacaggcggcggtgcgggcacagcggcgtgcggggaagaagcgggagaggggagaggaggcgggcgcggcgtcgggcggcatggagcgagcgcgccagcggtggcgggagagggggagagaggcggctgggacggcgggagtggcgggcagggcagcgggcgagagtggcagcggagcggcggcgctcgtcatgctccagctcttcaccaccggcgttgtcgtcgtgttggttgacctccacgagcgtggtaggcggagtagtggtgggcggagggcggcgagcgattacgatggagcggggggcttggtcggcgagcgggggggagggggggcgcaagtgtggcggcggagcagcggcaagcggtcgacggcgacctcttcgctgatgcggagcgccaccccttctcccgccggcctcatctccgcccttgaagacaaggttgataggctcctcgtcgtcgtcgccgtccccgggtgggagcggcggcgtggggggctcgtaatcgtcgtcgtcgggcagggcggcattggcgcccttcttggcttcttgccggagaggagagagagctggccgagcttcactcgcgagcttgtcggcggcaatggcgtccctccgcgcacgagagaagaaaggccaaaagcccgtgaacgcatgcatgcatgcagtagagagaaaaagaccaaagcaaaagcagcttgtgattgatttgcaggctacacgggttgaaagtgacaagatcgatcgatcgaatatatatgtatatattcatgaatgaatgcatactctaggcctcgcccacggcgacgacgatgggggagagccgatgacgacggcggccacggcaagcggctgctccgcccgcagcctccgctccgccgccgcgctccgctgcctccgctccgccgccggacggccgcgccgcgtagcctcgcccacagcgacgacgacggtggagagccgacgacgagggcggccacggcgcgcggctgctccgcccgcagcctccgctccgccgccgcgctccgctgcctccgctccgccgccggacggccgcgccgcgtcgcctcgcccacggcgacgacgacggtggagagccgacgacgagggcggccacggtgcgcggctgctccgcccgcagcctccgctccgccgccgcgctccgctgcctccgctccgccgccgaacggccgcgccgtgtagcctcgctcacggcaacgacgacggtggagagccgaagacgacggcggctacggcgcgcggctgctccgcccgcagcctgaaggaggagaggagagagaaaagaaaagaaaagagaagaggagagaaggagatgaaaagagaagaaaaaaaaaagatgtgcagctgacatgtgagtcccacgtatttttttaatttatttttgctgactaggatgccacatcagcaaaaccgggcaaaaatactgctgagagacgtctggtgaacggtttgagtgagtttaggggtaaacatttctggttttgtggttaagtaaccttaaaaaatctcgctgttaagttgagggacctctggtgaacttattcatttattctctattaggcccaaatttcccactcccctccccctttcatctcagcccgtactcagtttgggccgcaactcagcccatttttcctccccggctaacccaaatccccaaaccggccaaccctagacctagaggaatgagggggagaggggttggagcggggaggcgggcggcggtggccggcgattcgcggctttcacacggcgtgtggcggtggcgactgcggcgcggctcgtcggcgcgggcgtggcttggcgccagtgcggcaggaggcggcacgtcggcggcagctgcggcgtgcgcgtcggcggctggaggcggcgcgtcggcggctgcggcgtgcagttgccgacctgccgccgagatcagacaccgaccccgatcacgaccagaggtaggagcaggaccggtgggcgcgctagtccaccgaccactccttcagcatcaatgaccgcgaggagctccgtttcgtcctccttccccagctttcccacctcctctcttcctttctctcttgccaattgccaattggacataaggatctctcggtagagctaaacagaggaaacctgttgtgtggtgaaatggatctatgactgggaaggaaaacaaattgtcagggggaaattagtggccgattgacactggctaaaataataaatcttcggtttagacctcttggcatcactgtcacggtcacctgtgaattgcattcttatcttcatacttgcaatgaagattttaggagtgggaactactttctccgttccacaatgtaagttattctagcattttccacatttatattgatgttaatgaatctagtctgctagaatgacttacattgtgaaacggagggagtacaattcattgatttagtatacttgcttgcttgcttagtttgtagaattgtagttgcctagttaagtatctgagtagtggtctagtggacactgcacaatagttcatagtttataccatattatcatatttgtttaattttcataacttatgattaattttatgttatatacgctatatattataattattagtgtgttatactacacaagctattttttaggcttttaggcgtatgaacattttttttacctcttcccagtttgaatacacaagttcaaaaagctgggcccgccactacatattagctggtctacgttagaaaaggacgcactcacacgagacaaagatattggagaaggaatctcaaatgttcctagctatggactgctaacatatccccaacagatacattgcacacgaaataatattatgaagggataacatatctgacttttttcttgtattgtttagtcaaatgcatttatcctctcatgaacaataagctcagatatcttgctacctcgtcatcacctatttgtttcgacatttatttttttttttttttgatatagaggtacaatgatgagcatctaatctactgacgtggaagattttattttgtaagaaataggggtattttttgcttaatatatcttccatacatcagcccaatctgtacaatatagatttcaccaaaggtcagcactagatatatcaaacaaaagactcgtatctctacaaaattctcgtgtcagaaccaatagcaataaccagacataaaataggaataactcagagataagcagccatttcagctgacttaacacagtttttccgataccctctgctagtggaagctcatgcacaacttttgcaaaacctgttaggagatttgaacatctatactaatataaaaaaaaggagttgtacccctccaatcctactagccaaatcactcggattaatccctaccgtccatccgcgtgcacgaattcaccaccgcatatactaatataaaaaggaggggttgtacccctccaatcctactagccaaatcactcggattaatccctaccgtccatccgcgcgcacgaatttaccaccgcacgattccacacgcaaacttcgctcctcctccacacgcgaagacttcgctcctcctcctccacgcgtggacttcgcttctcctcctgcatgtagcgccgccgcatcctcgccgtcgccggagctcctccccgcgcgtactgccaccgcatcctcgccggagccgctgcccacgccgacatcttctgctgccgccgccagatccggcttcttccctaccgttgcggccggatccgacctcggccccatccgccgccgccgccgaggtcggcccctcccgtccctgccgccggagtacatccatgtttccctcctcgctgtcgtccacaggctccgccaatgcaatggcctctaccttccctcgaccaccgtcttctggacaaaaaacattctttaagacctgtcaatatgaaaagtacttgccattgatgttctcattttttacaaccaccaaactataacagacaatgagaacccagaaacgacttaacataattttctgttctctgcactacgtcactaatgtgcacacataattaaataaacaacttgaagcaacttgttggagtcccaattaataagtgcggaactcactaccgatttcatatatatgcagcatttccgatcccttccttgctcatggcaaatctcatatactactcattgctcatcattcttcctttcctactcctgattaatttctacaaagctatgttcagctcccgcaagcaagccggacggcttccaccgtgcccatggcagctccctatcatgggtagtatacaccatttgatcggtgatctcccacaccgctccttacatgatctatcacgacggtatgggcctgtcatgttactcaagtttggacaggtaccattcattattgtttcttccccggaggctgccaaggatatcatgaagactcatgacagcatatttgcgatgagaccgcaaagcgagataatgaagatcattacaaagagaggacaggggcttgtgttcgcgccctatgatgatcaatggaggcagctccgtaagatctgcatccgtgagctcttgtgtgccaagcgtgtccagtccttctgcgccatccgggaagaggaggctgcacgccttgtgaagtccatatcaagtgatcaagcacatctagtgaacctcagtaagaagcttgccgactatgctaccgacgcagctattcgcatcatcactggtactaggtttgagaatcaagaggttcgcgacaaattccagtactaccaagatgagggtgttcatcttgcggcaagcttctgcacagccaacctatgcccatctctccagcttggaaacactctgagccgaactgctcgcaaagcagagatatatcgggaggggatgtttgcattcataggtgggattattgatgaacaccaggagaggagagcacaagatatgtatcataaggaagacttgatagatgtactcctaaggatccagcaggaaggctctcttgagtccccagttagcatggaaacaatcaagttcttaatttttgtaagatttttgccattagctacagcaaaactacatgagttttctcctcatttttctaacctaatgttttttttccaaattcaattttaggatattttggctgggggaagtgagacagtgacaacagtattacagtgggctatgacagaactaatgaggaatccaacagtgatgtccaaggcgcaagacgaagttagggaggttttcaagtggaaaaagatggtaagtaatgatgatataaataaactcacttacctgcagtttgttattaaggagactgtacggttacataccccggggccacttttcatgagggagtgccaggagcaatgtcaagtgatgggctatgacgtgccaaagggtacaaaatttctactaaatctgtggtcgatctcaagagatccgaaatattgggatgatccagaaacattcaaacctgagagattcgagaatgatgcaagagatttcaaaggaaatgactttgaattcattccatttggtgctgggagaaggatgtgccctggtatgttgtttgggctcgccaatattgagctggctcttgcaaaccttttattttattttgactggagtcttcccgacggagttctacccagtgaattggacatgacagaaaactttggagttactgtccggaagaaggaagatctcttgttgcatgcttctctatatgcacaactttcttgctgattatttccatggtgaataattcaatggttgtaattttaatgatttattattttgtcagtatcctcattgtttgaggctttgatgttgtggttttctttagcagaatatacatctgctgcatatagtatgtttaaaaactaatatctgcaacagttcccatccgtccaaaatataagcatctttagtttagtttttttatggagattaaagtgaagtgaaaaaattacaatacatttaattaaaatacacacatatcattattataaagcccatctataacaggtcaaaagataaggacaagatttccttatagcctccacaaggagtatattcgactcggagaaacattcttaattaaaatggtcagtgtgttaggataaggacaagatctctttgtttgaagattgcactttgcaacagccgacacaccttgtggagtatttttcagatctttctcccagtcatttgtgatgttcatatgatgactttagactgaaattagagtgcccagatggtattattgaagcccctcaatgagaagtgataaaggaatggaaatgcgtttttgtttataatacttgacttgcagcaaccatggacgactgcagctcccataatgtgtttttattaaaatatttgatttgacttgcagcaaacattcacaaaactgcagtttaattgactgcaaaagaggcaaacctaaaccaagtgggagtccatctagttaatttggactacttaggtgaagtccttcatgtttgccgcaaattttatgggtagcctgttaatgtgtacatggacaggataaacttcctgtttttctaccatgtgacccatttgtacaaaacaagcattatgatggttttcataggactcattcattactaaagtacatgcatgcgccatgtcctcagggtatcgcaagtagagtggaaaattcaccacaaaaaatgattttcgatcacagttgattgggagtagatttatctcgtttttagcgcgcaagcttcccgaactactaaacggtacgttgtttgtaaaaattttctatatggaagttgttttaaaaatcatatatattatccaccttttacatttgaaataattaatactcaactaatcatgagctaatgtctcagctcattttgcgtagcttctgatcaatcttcttgttttcccttctctcaaacaatctattaaaactatacaggtggtttatgaggaacccatgcagtacgccaggtgccgtgtcaccgtttgcatgtgaaaatagccctactttcatcatctcgggtgactgcatccaaaaatattttggaagctgagaagcataagtcaactgcctagaaaatattttgaaaggttcttgtgttaagtcaagtctgtcgcatgtgccaacgatttccacgagcaatcgaattatgtttcgaccggcggcacattcccatccatagaaatacatcttccttttgttagatccagtcgcccaaagtgcccatgcaaatacattttagaagtctctagaaactgttggacaaaagtctattttacacacccaaactattttattggatcgcttaatccttcaaactattctcttgctcattttaacctgtaaagtattaaaatagttcactttagtcatttattctttgtttctgtttgtatgcttgtatttaacttgattttttttaagaatattactgaaaccattatcaaatttataagatattttaaatttttttatgactatttgctcgaaattataaacctcagtatttaaatcagtcatagtgcttttcgacttatgtaaatagtgattgaaaaattctaataaacattaataggtatgttgtaatgcatctatctatcctaccaaattttggtgcaaaatactatttagagagaataaattaagagaaatatgctggcggtaaggtgaaccctttttaataattggaggtgtacaatgcttaaacaatcatgtgtgttccagcaaaattattccgggagtacaatgaaatttttttctaacctttcgatgtgatgatttggttgtatgcaaactcatacattgaaacttacaaacaaaactcaattattgcttgcgtagtgtgtttctccatatttttttctatacctgctctgcttctacaggtagcttacaagatggaaacagggggtcctagctaattagattggatggagtacacgcatgctcacatgctattttatacagatgttgttttcccagactgcacactggagttatttatacatgtgatgaagtctttatttatcatgattcataactacgattgttaattaggcattagaatacaaaatttctacgtcgtcgtaatggaatatgctgtttgtcaagttgttgagacgtcttatttcgtacaaatagctcgatagtaagcaggttgttactggctttaatatcctaatgttgcaaaacaaaaaaaacagagtacacacaaacatcacgagtgtttcactaacctcatcaattgtacatgtacgctaaataaattggccgtctatttcacatgttaatttaataacaatttcatatttcacggacttctgttgttattcagtcacgtaaataaattggccgtctatttcacatctgattaagactttgggttgaaattgttacgcaagcaattcgatcaatatcatatactggaaccatatgtcaccggttcaaactatgacgggcgcgcaaataaatgctagtagcatcttgcgagcacacattgatccttattttatttttatcacaagtttaattaattagtagcgggcattagttagaagagtgattgatgcccaggttgaatatattggctctcagtactctactctaaacaactattttaactcaacataaaaaaaaaaaactacatccacggatagaatgataccttccacacgctagctaggtattcgcgttagtcaattggccggtagaaaattcattattccataacgataagctgacactagtgagaaaattattatcttaaatatcactaatagtagcctaattaaggctattaatacataggctaacgactactttctcgagtatatgcacgagtatcaattatcaaactttacaaaagagtaaaatgaatggtatacacattctcaaacttggacctatgtgtcatctacgtcaacttgtaaaataccactactacagaaacccagattggtgccggttggaaacaagccataggtaccgaatttcccaacaggcaccccgcagacggtacgatgaccaaagtcatcggtgccggtttagaaccgacacctataacaaatataggtgccgattgtggggtttcaaaccggcacctaagatgttttcacgagccaaaaaaaccggctcaatgcatcggcttgattcgagccaatgcatcgagcaacttccaatcacccaaatccgagaaaacatccatcaacattcctgtaccaagattccataacacatttctcacgatctcaccgtccatccaacaacaacaaagacgggcagtggtgtataatttaataaaaacaacaccacatttcttgccgcatccaacaacacattaaacaacaacaacaaaatcaaaaaccaacaaggaacactgttgtggaggcagccactgcatctttgtggaagcctccggccacgcccggcctccaccacagccaacgtcccctgtgcccagcctcctcgaccaccacccccggatctggcctcccccaagcgccagtggggaggggcgatgccggatttggccgtccctgagcgccggtggcgatggggcatgccgga

SEQ ID NO: 58838 - DNA, 12170 bp, Oryza sativa
aggtggtgggacgaagaggaggagggacggtgccggtggccttcccacgcctctgccgcctccgccgggccgttgcccggcagccgccgaggtccgccgcctcccctctggctacatcaggcagacgggagggcgctatcaccgctgctgccgcctccaccgggccactgccaccgccactctgccggccgccgcctagaccggtgagagagaacgagcgagatagagaggcgagagagagacggaaagaacgagagagagagacggagaggataaggacggatctgatgcgcgcgttgtattgtaaggccggcgctcgatcggctcggcttggtagagatgcaggttctagggtgggccccgtgccaactagtccgatgggatgggttctaaaagatgccagttttttttttacaaccggcctctatatctgacaggagtaaaaggtgctggtaccttttaggtgacaaaggtgccagttcttgctcgttttggcgtgtgggcgggctggtgggcgggaatggcactgtaggggctggtttttaccactttcagtacctatagttccgacttatattagtgtttctgtagtagtgtacatatatgggactaatcttgatttaatgtatcacgtaaggtccaaaatgcaattgacagctcaatgctaatttggccatccacaatggaataaaatcgcattcagcggcgccctctgctatagcatgaccaagatcagctcagtccgctagtgtgcttgttcaagaggagacaaagaaaccgcgtttacagcggtggatctcgtcggtgatatgatgtcctcggagcaaggatggatgacctgatagcacgagggtgataccacacgttgtatcgcccatctcagctccaagtagctcacaggttgcagtgatttgagtagcactctaaggtcctgtgttcaaatctccatagaagcaaattttagattgggttatttatgggctaaattccctatttgctagttcctagtttaataaggctgcatatatccggttggatatagagccggtaaaagaaatacccatctaaaaaaagagattttctaaggtgcttgggatataggagagccgttgatttcttataatctaaaaaaaatatcggctccaagtaccttcttttgttgtcctccgggtaccccctttgccccctctttcacgagcgtgatgggagtcgatctggaggcataatgtagtggaggggcttaaatacaaaattctcatcaacgtagatggccacatcaccgtcagagctacatcatctacatttgaaatcttgggtgataaaccaagattaattatctatatgtgtagttcacaaattcaaaaacctagatgacaccctaatctaaatttatgtcctgctcatgtattttactcataatagaaaaagtcccagggttttgcaacccgattgcataaaaattttgagctccaccgagatgaacgaatttcgaaaaatttggacaaagttgatcaaatagtaaccatatgaaccaaatccagacgaaatgggagttaaatgttgtctcggagctcaccgtagttgatgaaattctctgaatttccactattaggaatactatttttagtgacataaatggtcttcgcaggcgaacggccggtctgcctttacacaaagacctgtgaaatcttccatttttgcaggcggccggccggtccatctaggaagatgaatcttcgcaggcggacaacctaagctgtccgcctacgaaaatatttcttgccatgctgacagagtcagaacatatcacctacgaaaatatgattacgctgcttgcaaaaatacgtagttcgggtttcatttgagtaggatggccgccggagaaaatattcgagccaaaatataaattttcatgtcaaatttattaatattaatttttaatcaataatgatgcaattaattaattcatcaatacataaatacatccaacagctaacaaggatataatacacatatgtttgatgcactaattacagtactattggccatcatgtgttggccatacaataatatttacaatactatcatttctaactatattgttaattacacaagcacgtagttccacttccaaatggatttgtattctccgttcatcgctaagctaccttcggggtcgaagaaaaatccatctttatgacaacactcacggtagatgaagtggtagaggtcccactgtatgtttctaatgccttcgtagtgaaagctagttcgacgttcgattgtagacaactgcatacatgaaagcacgagaatataatacaatatcaatttgatatgcgcattccactattagagttatacgttcagtcaagagacttacatcctctttattggtcctatacctcccattaaccctatgaaattcgcatatgtactatccgtaaaggacactgcctttaggttgcttgtaatacttcattataacacacatatagaaggaattagttatacattgcaggaaaaagaatttaaatagagaagtgtgcagagtagtaccggccaatatatatgtatgcacttgcaacttctcactcgtttgcggttgttccctgcactttactttgtagtagttgtacgcactgtacgtataggatttatgattcatattaatgaacagaatgtaataattatgaacattgcattagtacacatgcatagatcagaatcacttacattcttaggaattgttctgtacgtcatatgatcataatcgagggggtgaataactgtaatggtcacataccgttaggtgtcacctagaaagaattatcttcggaggcagaactcttaagtggttcacctggaaatatcctcaatctttcccctgctggacctcttaaagctccgtctataaagatgtatctttccaggtggcaccttatatcgtctgtctaggaagattaatcttcgcagacggacggccatctcaccccacattttcttcacctgggaaaactgtaacacctcgtcggcaatagttttgccagtagtatccagagttcagacatttcaaagcgaatcccaaatccctattctgtaccatactttggagtaggtgtgttggcgttttgcagatatcgatggtaccattgattaatttaactaacgacctgtttgtagcataatttggctaatagtttgttttatttgggtaagccagattatttagtttagctgtcatgatttggagtggttggtttgagagccaattaattgtgtgcgcggctggctagggagggttagcatttatcatggaatggaaatattatggattagctgagcttaaccatagtcaaggaaggtttttgcgttaataagtactatttgcattagcatgcagatagagatcagagaggtgaagactcgtgcagctggttgcaagtggagattaatttgctatagtcgacaagcttctggccgggctgatgatcacatacatgcaggcgagcagaaatttgccgtgctctcgcttggctgttttgtgcggctgcgtatttgcacgaaggttggagcagtggcgttggtttggagatgatgaggcgtgattagcgcgtacggctgttaggaagataagagatagatagattttctattttatcagttagtttccttttcggttggaccatggtatctgtatatatacaggtctacggtcgattgaagaaaccccgatcacaatttatcaatctactatttttctcgttctttacttttcctgttttttctattttgcttttatggctgagttctagcaaccctagaatttggtttatctttgccgttttgcgttgaaaaacggtcgtgcttctccacgaaagcgaggaggttatcctttgctagtttgctcggaaactagtcgttcgtcgtcacgtaagtacgatatttatcttctttactaatttgcttgtaaattagtcgtgtgattccgcgaaagtgaattaatctcgaaatcggtttcactagccgattttgatatatcgattttggcgactctattgtttacaccgcaaatcgttaggtgatcttgtgttggccacgaaaaagcgtcgacatattttggcgactccactggggacgagaatttcgggcatattaatttgacggaaatcaatcctgtaccatcgatctatttggctgtagttcggccgaatattttgatctactatttggtttttgtcgtagaatctttcggccataatctatctgctattcttctcatgcgcgcgctgacggttatctgatcaatctgacgcggttggtcattgccgtgctggagcggtggagccacgccgatctggaattctgctagccgcccagtcaccgcttgagataaagtgtacgctaatctagaaacacaacagcagcacacttgcattaacagaagggaagaaagaagccatcaggtcagtgcttgtctgcgttttattttgataaaatttggttgatgtacagatcaattgcacaaaaaaaaaagacttgctggaaaatacatggagtcatacaggagtgctacaccgctgcctcattacgtcaattgcgaggtacaatctgcaaatactttgcctgttccttcaaattattttgctagtacagtgaattctcatataaatattgctagacctatttttaatggacatattgcatttggtagtgattattcaaataattattcgagctctttgaattacgaaaataatatgtcactgcctatgcaaagtacttcacatactttaaattttagtaatgctagcaatatacaatatgtacacacaccttttaattcatcggcaattatttcaccacctgtcactacaccactaactatgccgatgaatgacatgtatagttatggcaattatcctactaattctattaatacattacatgccatgtcaaatactgctaaatcagagattacttctcatgctcatgttcatgcttatggttcaccttatacagtgtctagtagttataattcggcttcatgtgatgttaatgattatggccgaattagtgaaaattcagcaagcaagcatttacctccatataattccacaacatatagtttgtcccctgcacagccacagagtttcggcatcgagcatattccattgccgaaaccaagtgttaataattttcaacaaaatgggtcatttgtgcagtcgacaacgcataaagccgaagacacgcatagaacaaatgataccaaattagcaagttcggttggggggcaatttgtggatgattttagttccaagatagataaccttattgaagaaatatatagagatgtggaggagaaaatgaatgcatatatcttaagcaagggatcaaaaccaatttttaatcaacaatggaagctgataaatttagatttatcggctaatgaaaaggaggtagctatgcttgatttctctggaaacataggaccttttgttttgccagctgaatttcgtgctaaggaagatgatgaacatcttgacgatggagcacgaaatcatgacgacaaggtgaaaatattggagagccatcaaagaacgaacctagacatcgctcaggtgaaaaaattagaatgcttctccaacaaatcagatcaggtaaagtctgcaggtaatgtagttatttcccaatttgatcatttatctgaaaatcatacctgcatcagtaatatcatcatgaataactccaagggatcgattggggaggttaatgttcttattggcaatagtaaagtgcttagattttccatatcatctttgccaaagtttatgtctacatggtttgcttataataaatctagagctagaagcacaaaactaaaattggaaaatattaatgaggttgatgctaatatagtggatagttctaaatcaatggataagggaaatataagcaattatgtagccgaatgggttgatggaaaatctgaaccatttgtttgcttagctttaaaaccatctccgcagatgtgtcggttaaaggaaaagaagtatacttttgattggactatgtgcgatcatatttttgatgatttgctaaaaaatggttatattaaattgcttgatcactatgtcatgcaaccgcttccagatttaaaagaatgaatttattgtaagtggcacaattcatccgatcattgtactagtgattgtaatatttttcgtcagaaaatacaatcggctattaatgaaggctgattgcgttttgcaactccaagaaagtcatatgccaaggatgaccgttttgataaaagaaatcggtctaggtggtctagtaggaagtcttcggcacaggcggaaggtagttcaacaaggaagcaaatctgggtgccgaagtctagaggtcaagaaaagagcttagctgctggtgcacatgtgagtgtacaaaatgcttcagttcagaaaaaggctattgaacctggggggcatgcgcgtatacaacagttaggaaatgtacaccatatgaatatgaagcgagaggcatcttcggcagagttagtaacaagtcagaatccgccgaagagctcggggggcaatggcagccaactgagacactcacatggcttgtcaaattggcgaaagaagcagctccacaagctaagtgcagaaaagctgagggagagaggtatggcatgggttcttaaagcaagtgttcaggtacagaatgaaacagatgttaaagttggagtgggggcaaaaaatgagaagggagttaagaggtgtgcgccaaatcaacggtttgcatctaatcatcaggttctttcgccaccatattatacatattcttcacctatgccaccgatacctatgtcatggaatcaattctcaggtatgcatgtttatccctcatggttttattcttatccttggatatcatatgggtctttatattatggagggattttaccgtatagttttacacattgactattagttgtaggtgttgttatcacttttagagaccgaaatatttaggtgctagaaataaccgtgattttttataactctttagaaattatttcggtcgtatatagtttgtgtgagttggcaaggagctggtgctgttttaattttactaagtaatattgcttatgacacatcggtccctatcagtccatttagagcatgcttgcactttagaccgagtagatgctctattattcggtttggaaagtttagtcgatgttggtgtgagggatgtagcttttgatgatttacttttaatagtccgatagagtaataggaagttttagtgtttcggtggactgttaaatagttatttcgaccaatgtttagatttaattaaattgctagatgtcttaattgtccatcatatggctgacttgaggtgtgttttatagtggataaaccggctataattagcagtgtttgttcggataataaatctatgcaagccggtttgtttaatggtgaaggtactgtggtgcatcatgtgtgtggtggtagcaatgtgttaatgttatgtttcacggcggcgttcctgatggtctatatttttatttggctggggtcacgcatgctgcagttgatggtagtagtgttcatatacaaactgctggctggtcggttgagcacagaaaaggccgagcagggtttagaagattcggtacggaggtcatcagggacaaccgagtcaataggaaagtttaagccaagtgattggagggatccattcgttgattatgtaaaaacccgagttaaatgagagatagaaaagttcggcgacaagttttaagatatgctttattggatgatgaattatattgccgagctataagatgagttatttttaacagtatcgaagtttagatgtgttatttttaagatattttgaatctaagaaatgttaagaatcaagctaattcggttaggtggacattagggacaaccgaattagtggtgaaatttgtactacatgagaaatatttgaaaggttattatcattatgtactacaggaaacttgattgtctcaaaacgagtacttatttgagtatcgttttaagaggacgactgtggatgggcttagaactgataccatgtgtggagtatcgttttgagaggacaactgtggatgggctcaggaccgataccgtgtgtggagtatcgttctgagatgacggttgtggtttaggttggttagttttatggtgttttcggtaaagcaaaagttacacgttctacttataccgaaaacaggggggcatgtgtttgtagcataatttggctaatagtttgttttatttgggtaagccagattatttagtttagctgtcatgatttggagtggttggtttgagagccgattaaatgtgtgcgcgcggctggctagggagggttagcatttatcatggaatggaaatattatggattagctgatcttaaccatagtcaaggaaggtttttgcgttaataagtactatttgcattagcatgcagatagagatcagagaggtgaagactcatgcagctggttgcaagtggagattaatttgctatagtcgacaagcttctggccgggctgatgatcacatacatgcaggcgagcagaaatttgccgtgctctcgcttggctgttttgtgcggctgcgtatttgcacgaaggttggagcagtggcgttggtttggagatgatgaggcgtgattagcgcgtacggctgttaggaagataagagatagatagattttctattttatcagttagtttccttttcggttggaccatggtatctgtatatatacaggtctacggtcgattgaagaaaccccgatcacaatttatcaatctactatttttcttattctttacttttcctgttcttttctattttgctttcatggctgagttctagcaaccctagaatttggtttatctttgccgttttgcgttgaaaaacggtcgtgcttctccacgaatgcgaggaggttatcatttgctagttttctcggaaactagtcgttcgtcgtcacataagtacgatatttatcctctttgctaatttgcttgtaaattagtcgtgtgattccacgaaagtgaattaatctcgaaatcggtttcactagccgattttgatatatcgattttggcgactctattgtttacaccgtaaatagttaggtgatcttgtgttggccacgaaaaagcgtcgacacgaccatcgagcgttaatctatatccataataatgccgaggttgaaaaaaaaaagtcatgtagtccaaaacagacgtgccacagctagttttgtagttgcgatgctctcacgccttctccctccgctccggcgaggcgttggcgtctgcgggggatgcttcctcgccggcgcctccttatcacagctgtatgccgccacaacgacggaatgcacgcagtgctcctgcatccaccgcctctggtggtggagcctccaactactccggcgatggggttctacccggccgcgacgacgacactgtccacggctgcgcagtgcgttcttgtcgtcggaggcattcttctcgctcgagccacagtccgccaggagcacggtcagaggccgctgcggttgccatcgggaagcggtcgtcgccagctccggttgtcgtctaacgtgcccgccgggaatcagctccggcgacggcagttacgtcgtgaagatcgtgcccgccattacgtctggggtcacggcgattctgcccacttgctcggcggcggcgccattgcaattccagacgtcttcctcgtcggcggccttgatgaaagatgcatcaaaccggcacagtgccatccatcggctagctaagccatcctaaacaagtttgtttaatgctagttttgttcttaatttggctctggtggtactactttggaatacagtagctgtctgtgtcattcaataaaggctgtgtttagttcacgtcaaaattgaaagtttggttgaaattaaaacgatgtgacggaaaagttggaagtttacgtgtgtagaaaagttttgatgtgatggaaaagttcgaagtttgaagaaatattttggaactaaacaaggcgaaaggctagatttcacaaaactacaacagttgtatcaaaactatcattttgctgaaatttgtaggtaggagtttcagtaaattgctacaacaaaaattcattttatcatagaattatagactctatttaccttaaaggtcatatcccacttatcaggcacacatgtaatacattcatccttcggacccatcatttcacttattcatggaataagtcaaacggcatatttgcaaacgaaaataatttataaataaaacttatatatatatatatatatatatatatatatatatatatatgttcttagcgatctaaaagcaaaggctgaaaaataaacttctatgaaaaaaccttaaaatcagctccaaatttaatgttgaaaattcaaagtttagccgataagcataagcataagcaaaaatatgagatcttttatcagttagactcacatgtcaaccaccgctgtgggtgaaaagttacgattttctgactcaattgtttgctattgttctagttttgtgaaaatagtagcacttaacagtgaaatttggtaagcctcgaagtcatcattagtctatagtcagtatcagcttcagagtcctggaattagccgatgggaattatcaaggtgcaaatagtcggattcttaccatatctagaatagaccgagttcaagggagatgcagcatgacagtttatctattaattaggaatagtacattagtttcctgttatctttaggaaagtgtgtttagtgtctgatatgcactttatgttttccatttatccttaggaaagtttctttcttgtataaggacaagtatctatccataggtataaatatgtacatccgaggtcattgaaaattatctctcgatcaatacaactactctcggcgcatcaccaccctctttttcgaggtttttagttatcatcggcggaacatcgcacctgacgcagggctgcattggctttcgatcactacaacaaatctgggcttctatgacgattacctgatgacagaacacatatctgtcataaacagaggctgtttatgacgactgttcacaggatgacaactgtttatgatcaaaccgtgtatctgtcataatcatcgtcacaatatactctgcatgggctctgtgacgatagcacgatgacaatagtggatcgtcataaaatatagaacaattatattttttaaaaacaaaaaaaatcttgttatactacattgctcctagaccataaatcatttgtcctaggtgtactcttcttgtctacttcaattctagtctctcattttaggattttaggattgaagtcatctctagtctcattttatgaatgaaaaaaaatcaaaattatggcgtttcattttatgattgaatgaaaaaactaaaaaaaaacaaactaaaatggctataagttggtttgaacctgcattactacaagaaatatgaccttctgtgaagaattcctcgtaacatcggagttatttgttattagcacattccattttatgacaattaattagtatgagatggggaggcttagtgacaaaaacatttgctttaaaaatcatggccaaaaatatttttttaatattctacgtggtctaaattattctttgaaatttttcgtgaattttcggaggtcaataactaattttaataccacaaagttcatttaacctattaaaataaatggaaaaaaattaaaattcctctctctatccttgggcctttttcggcccaagtattactctccctctctcagcccgcagactccctctccctcctcctccctctatgggccgccggcccagcccttttaatcctccctcgccgagaagtccattttagctccctcctctgaattcaaataactttttgcgtaataaatgatttcagataaaaaagttatcaacaacaaaattgtataaattatcaagatttacaacttttattttgttcattttactatataactttgtttcaataatttgaatttgaatttcaaattatgacaaattcaaacaacattttcaaatactaaatgatttca

SEQ ID NO: 58839 - DNA, 6302 bp, Oryza sativa
ttaaataaaacttttaaaatataaaaaactataaatgttaccctacaaatggtaattgcacataaaaaatagtacaaactaatatgcaaaatgttgagtgcaattgttcatcaatttgcgatatgatcacacatcgccttacataccaccattacataactactaacttcttagatgcttacatgcgactcaacaatcattaccctttaacatttttttcccacaccgtccatgcgcatgtaaggcttcacggtcttctgagtagatgtctcgacattcttaatcttctgtacaaactgactataaagtgtcatactatcgtattgattgtaatcttcgacatcttcaaccccatccactcccaatatcttttgtttcccgggtagcactatatctttcttcaaatttgaagggactttcacataaaacacttgtgccacgcgattggcgagtacccaagggtcatccttgtgacccacactcgccaggtcaacaacaataagaccgaacttatcaacattgaccccgttcgggtatttttgccactggcacttaaatatggggaattgcattgtgtgcccatagtcgatttcccatatttcttcaataaacccgaagtatgattgtttttccctggcttcatcaattgcctccacacggacaccgatgttttgcgtacaggttttattatctcgggctcttgtactaaacgagtatccattaatgtcatatccttgccaagaatttactgtagttgatggaccacaagccaccgtttcatagttatttcatctgtagtttgtcccttaggtaagtctaggtctctcaaccaatctatgaagagacgcttgggttctttcattatccactccggggtgcgacccttattgttagctcgtattagctcgatatgttgatcgatgtaaggctcaacgatagcaaactgatgaaggacactgaagtgagcttcttggaatgatttgtgatcatgggtgacgaatctcttctttcctatcgttcccctaccactcaatctgccctcgtgtcggggcacaggtactccaattgcatatccatctttgaggtaatcgatacagcactcgacaacctctccagtactataaccctcaaccattgatccctctggatgtgcacgatttcggacgtaacccttcaaaaccgccatgtaacgctcgtatgaccacatttgatgtaggtacagtgggccaagcgcaaccatctgcggcactatgtgaacaatgaggtgctccatcatatcaaaaaatgacggagggaaacacatctcaagttggcactgtgtctcatgtgcgaatgtacggagatttcctaactcttcgagactaatgaccttctgtgacactgcgttgaaaagtagcactaccttgtgatagcaacctttaaatactctggttttatggcccttattgtaattgcaagaaacacggtgagcaagacatgacaatcgtgtgaattataaccagataccgacaaatatttcatttaaactagtcgactgatgtttgacaagaaacctatgggcactctgacatcacggagtgacttgcaaaatgacttcttctcctcaggtgtcagtgtgaaacaggccggtggaagatatactttgccattcttctctccttcttgagggtgtaactcttccctgattcccatctcgactatgtccatccttgattgcagaccatctttagtcttcttcggcatgtctaacaatgttccaactatgttatcaaacacattcttctctagatgcatgacgtctatggcatgccgaacctccagatctttccagtacgggaggtacttaaagaatatggaatgctttttgaatggggaagggagtttatcatctgacttcgaactatcatcttgcttcttactatcccacatagtcttctcgggtttcttgcgctttgtcccctttgatggtttcttagtcacatttccaaattcgcaaacaattttctgtcattgcacacactttttcccccgatgtaggttttggtgcaggatcaatctcttcagtgccctcgaactccgccttcatcttgcggtacttgtgatttgtgcgtaggaaccgccggtgccgcatgtacacaagcttgttggaacccgggagataccaatagtatgttccattcaagcagatcacacatcctgttttacctttaatttgacctgaaactgaaaacattgctggataatcgttaatggtcacgaagatgatggccttcatcgtgaagtattcccttaagtactcgtcccacactttcaatccctctttccataaatcagcaatatcttccaacaatggttcaagaaatacgtcaatatcaataccagattgacggggtccctgtatgaggatccagagtagtacgtattttcgcttttgacaaagccaggtaggaagattatacatggtgacagcactggccaagtactatgtgagctgctcatgtctccaaaaggattaactccatcaatactcagggcaaatctaatgttccgtgggtctttagcaaactctctatactgagcatcaaagtttatccactgacgagcatctgccgggtgtcgaatcatcccatccttcttgtgcccttcttcatgccagcacattagttccgcatctcttgggtttgagtatatccgtttaatgcggtctttgacaggaaggtaccacatcacaagctgcgggatttttctctgtcttccctcagttgtgtcagacggttctaggccagtattgctattcgatttgtactggctagcattgcatgttggacattcatcaaaagaagcgtactctttcctgtacagtatgcagtgattaacgcacacatgaatcttttccacaccaagtgaaaggggacatatgagtttcttcgcttgatatgtgctggatggtagtgagttaggcctcaggagcattttctgcagaagttctaacagactgtcgaaactggtatcagaccatccatgtttcgcctttaacctcataagttcaagaactgaccgtagtgttgtgaactcactgtcacagccctttgactcatcgtacaaaacttccttagctgccttctgtaaagctctagccgaccccatcagcacctcgggttctgcatgacgtaacatttcctctaggtcgattttgtcctcaacagaaccatcgtcatgcaccatgtcttcaacttgtgtcggaactacattttcaggcccgtccacttgttcttcgccatgacgtgtccatatttcatacttgtccataaatccacgagttactaagcgctccttcactttaaaagcatcgtcgaagtcccaggctatttcattcttacagtcagcacatggacaaattatcttcctcatattgttcttctcagcgtgtgccttggcaatagcaataaatttagacacttcgtttctatatggagacaaaaacctcggccaatgatacatccattcccgactttccatatctctaaaaaatgaacataaattatttgcacaattaaaaccaaatttgtagggtttattgaaaaaacttatcgctattaaaaactaattaactaaaggttatttgtaaattaataaaaaaacaaagtttatttcaatttttttacacagacatgccaaattagtatattagaaaaatctaacaaaatcatatcatcggcatattactgatggaccctaagttcctctcgacactcaagactgttgttggcccgatctttcggtgagttatgataactacgatttggaagaaacgttgacaatccgactacaaccgtacgagacgttgtgttgcgccttagcgatcgatacacctctccgtgggttattgatcttgtcggtgcagatcaaccctattcctacaagcaaatcgaagaaacaagcaagaacaagataaaagcaatctgatattgcaaataggaattttatacaaatgataagttggggttccgaagaacaagcagacggacggtctagccgacacgcgcgctgcaagcaagtagcaattgctaaactttaatctatcaaaacccgagaaaccctgaaggggtacctagctacttataggatgtgggagaatgatcaagagggtcctagggtcatgctccactagcttggggcgcaccccacatgggccccacttgggccggggtcccaaacaaagttacaagcccataggcccattattcctgtgattctggccacacgagatggaattcggagaagaagctggatccgttggaaagagggttccgagaactttccatcaagtactcacgggccgaaaacggaggtcgtatgcagattcggcggccatttgaagtcagcagtgtagcaggtggccgaatcggattccagcacttggaggacttgatccttatatctccttgttcatccatgatgtgagcaatggttgtatccgtagtagccatggtaacatgcttaaaatcagcgcagttagtattaacaacaggaatagcatgttcattcactagttgtggcatggatataagtgaagcattatcgcacaactattctttatgacaaggaacagcaagtaaatcaacttgtgacaaaggcaactcagcaattgattctactaatggttgctctactatagcatgaaaagtggacaagtgtagctcaccttgagaatactcaccttcatttctctcagcaccatttaatttaccttgcgaactttctttagacatcgcaggtgcttcatcctctttcttctcaagtataccattctccttttcttggatgtgctgatcttcctgcaaaacgttagtaacaggggagacaaaagattgctcctccaatgtttgcacatcatcattacataagtatattggggattcagaaataggagataaatcacattggtcatgcatcctcgcctttgatatgatctgactctcaatgctacgagcaagcatgaataggtgcccaatatgattatatgtcacattatcaagcaaaacctgaatttcagaattaagcccattgaaaaatctacgcattgtattttcattgcactctttgagaccactgtagatgatacagaccttaaattcatgaatgtactccctaacagttctatcaccttgtttcagatgttctaatttctcccgaagagtacatttgtaataagatgtcacagagcgctttctcatcatggttttcaattcatcccaagtttcaggtttattactaacataagtccaccaaaataatgcagaagaggtaaacttattactagcagccttaatcatttgagtatcagaaaaatcatatatatcaaattcattgtctactgctagctcccaatcaatgtatgcaacagaatcgtacttcccatcatagaatggtaacttagatgcaacttgttcaaaattatagtcatgtacctcatatgcatcacgtggagaagtcgtgatatctcgtcgaaggtgtagaagttgatgttctcgtattcccttacgcaatcctgccatggttagtagcaaacaagaaacacacaaaaatatgcacgctcctatcaactactaggtagtggcagctcaaatatcacacacaatcaagcttttaaccaagctcttacaagttcttaccaaagcaagcggaatggtaatgtacaccgactcaaccaagcaccccaatggaggttgggtgtatcgatgccttggcaaacacttgcggtacggccgtaatcaaaactgtgcagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacgataccacaagatagcactaggaacaactcatgcacaactctgatatatgaagttcagctcaatgataacaaaatgattttctccttttcttctttctttctttctcttttttttttttgtctttcctgcttttcttttctttttcttttcttttctttttttggtgtggcttttttttcttcttttttttaagcacctttctgccttttttttaacaaaaaccgactcaaggacctcaatataaggtcatagggactcaaatgtaaatataaaaattacagggactcaactgtaaaagtgcaaatccaaaattaaaattatacaaaaatggaatgctaaatttatactggttccgtttttccaaacggatctac

SEQ ID NO: 58840 - DNA, 36240 bp, Oryza sativa
catctctaggagtccggatttggtgagagaaaaagggaaactgatcttcaatcaatctgatctactatttctttccaaattaaactctcaaacttccaaaaacaaatttggaaattcttcttcctcctctcagcgccggcaacaagcacgagcgatctattcacgggcaaaccaaaactcaagcaaaagctagatgcaactccaaaactgaccgataaaaacttctgaaaactacaaaaatagaaccgtggcagtgagccaattccatttcgtaggtcccgacgacaacagagacacggaggcgacgacgactgtggtataaaacgtgactagaactcgaaactctaaacgaactagatgctaagaccagcaagacgacgtgacgatgcaacacaaaattcaacaaggcaaaaatagaaatgaacaattcaatggcacaatatggctaggtaaatgatacaaatttttttgtatggctattttctggttatgggtagataaaaactcaccgagcaaagaaagctctgataccacctgatggaccctgagttcctctcgacactcaaggctgttgttggcccgatctttcggtgagttgtgataactacgatttggaagaaacgttgacgatctgactacaaccgtacgagacgttgtgttgcgccttagcgattgatacacctctccgtgggttattgatcttgccggtgcagatcaaccctattcctgcaagcaaatcgaagaaacaagcaagaacaagataaaagcaatctgatattgcaaataggaatttaatacaaatgataagttggggttccgaagaaccagcagacggacggtctagccgacacgcgcgctgcaagcaagtagcaatggctaaactttaatctattaaaacccgagaaaccctgaaggggtacctagctacttataggatgtgggagaatgaccaagagggtcctagggtcgtgctccactagcttggggcgcaccccacatgggccccacttgggccggggtcccaaacaaagttacaagcccataggcccattataggtgacgcaacaccttgttcctgtgattctggccacacgagatggaattcggagaagaggctggatccgttggaaagagggctccgagaactttccatcaagtactcacaggccgaaaacggaggtcgtatgcagattcggcggccgtttgaagtcagcagtgtagcaggtggccgaatcggattccagcacttggaggacttgatccttatatctccttgttcatccatgatatgagcaatggttgtatccgtagtagtcatggtcacatcaattacaaactaatataattattttttgattgcaccaaataaatagaaattaaaaattttattctctctctatatattacaagatctagatctagatctggaactaggaggtggatgtgatagcaaaataaaaaaattgagaatttatgttaccacattaaaccaatacaacaagaggcatcaagtttatagctagctaagatatatccgtaatcaaatttattttttcttgcaacatgactgtcgacgtttggtatcgcgactacggtatttggatggtatgggatcgttggtaccaggatatatgcgagattaaagtaaaagagacgaagacagggatttttatacaggttcgggccccttatctgacaggtaatagccctacatcctgtttatatgggattgatatagaaaaccacagcgtacaacaattgggataacctatctagccatcgtcgacttggcggcgtgaacaccaactcgtagtcaacgacagggtagttttccttctcgagtatgaactcgtcgagattagagatggcgctagatccctcttgccgacttccgtaggcaccggatggggtatgtctaggcttatctctaatgttgatatccggcggcgtgtgttggcttgtggctttgtggcgtgtcaccactcctcctaggggggcttgtatttatacccatggatgcccccttgtccaagtaagactagggagataaaaatggacacaattggagtaatccttgtcgtttccatatagaactctatttgtcctttcttatccggaactccttctatatacgaggtttgtttctgtataagacatggtatgtggtgggccctgcggagtttagtccactactattaggtatgtggtatccataaccatgacagtagccccccgacttcaatgcaaatgatgtgaccatgctaccatggatgcaaccattccttacatcatgtatgaacaagaagatatcgagatcaagtcctccaagtgctggaatctgattcggccacatgctacactgttgtattcaaacggtcgccgaatctgtatacgacctccgttttcggcccgtgagtacttgatggaaagatctcagagccctctttccaacggatccagcttcatcaccaaattacatgtcgtttggccgcaattacagaaacaaggtgttgtgtcacctatattgggccaatgggcttgtaacatcgtttgggaccccggcccaagtggggatcatgtggggtgtgccccaaccaggtggagcatgaccctaggcatccctaggtcatcctcctacctccataaatagttaggtaccccttcagggtttctcgggttttgtttagatgaaagtttagccattgctactttcttgcagagcacgtgtcggctagaccgtccgtctgcttgtattcgaaaccccaacttatctcgtgtattcatttctatttgcaattcagattgcttttatcttgttcttgcttgtttcttcgatttgcttgcaggaataaggttgatttgcatcggcaagatcaacaacccacgaagaggtgtgtcgatcgctaaggcgcaacacaacgtctcgtacggttgtagtcggatcggtgatgtttctcccaaattgtagttatctacaactcaccgaaagatcaggccaacaacagccttgaatctcgagtgaaactcagggttcatcaggtggtatcagagctttcgttggtcggtgagttttcatctacctattcccagaaaataaccaaaaataaataaactcatctattacctagccatattgtgctattgcattgttcttatcagtttttgccttgttgtgttttgcgttacatcgtcgaatcaagttgctggttttagtgtctagtccgtttagagtttcgagttctagttacgttttgtaccacagtcgtcaccgccaccgtgtctctattgttgtccggacctacaaaaacggaatcagcttgctgccacggttctaattttgtagttttcataaatttttgttggtcggttttgaagttgatgagttgcatccaggttttgtgtcgtgtgtttgaaccctctcccgtggtcgtgctgttgcgcctgaaaaaggaagaaggaagggggcgtctgtttgtagattagatcaatcaggttggtttgtttccatccaaggctgacctttccaatttggccgagtcctctccctccacccccacgtgtgcgtttctttccatgtgagtaagtcctacgtgcccagttgccgaggccaaagtccgactccctcacctttcggtttccttccccaccgtacctccaccaggcacgcctaatggcgtccgccccctccctcctcagatacactcctccctcctctcccccttcctcctccctcttctcttcctactacagtacaccacaaattttttttaaaaaaaaagttagaaaattttatgtataggaatactatatataaaaaattgaaattcaaattcaaatttgaatcggctatataaacttttgacttataaactttggatctataaactttaggtgtataaactttagatatatagaaatactatatatagaaaatatttgaatttaaattcaaatttaaatcggatataattcaaattcaaatttgaaacgggtatataaacatttgactataaactttgggtctataaaccttagatgtatataaatactatatataaaaatatttgaattcaaattcaaatcggatatagttcaaattcaaatttgaaacgggtatataaacttttgacagatgtatagaaatactatatataaaaaatatttgaattcaaattcaaatttgaatcggttatataaacttttgacttataaacttttggtctctaaactttagatgtataaacttgaggtgtataaactttaggtgcataaatttactaaaataggaaagtaatgcggtgccaaaaaagaaaaccaggtggagggagaggggcgcctcatgatcgctagccgatcaccatggcgatcgattacctattagaggtttcgacctccaccgtctcgattacacttttgtgaatttttgttttgcgtcggtttcgagttcagtttgcaaaaacagaaccggtataaactcagcattccatttctgtataatttttaattttggtttggacttttacagttgagtccctgcaattttcaaatttacatttgagtccctatgaccttacattgaggtccttgattcagtttttgttgaaaagaaatagagaaaaaggcagaaaggtccgtaaaaaaaagaagaaaagaaaagccgcacaaaaaaaaagaagaagaaaaaaaggaagaagaaaagaaagaagaagaaagaaaaaaaatcagttgtatctttgagctgaattttgatatatcagtgtgcttgagttgtttctcgtgttatcttgtggtatcatttatctctaggctcacatctctagtacattctagcctagaaccggcgcggtacttgactttgaacaactattcaactttgcattctctgatttgagcatttgctattcatttgctacatatttaaggctatctacagctccacagatttgattgcagctgtacaacgagtatttgctaaggcattataacatacccaaaatttcaggacttaaaatttcttgtcaaaatagttagaggttaacttatccaattttgagagccaaaaatttccgttttaatttaggtgatgaccaacttaaaccattgcatgattaaaatttgagaacaaaataaaacattttcattcccaacattagactagaaatgtcagcaagcatttgagcatatgtcacgcccagaaattcccgaatagaattccaagcagaatgtggccggggtacacaaacaacaaagttgacatacagatccacaccttacaaacaccataaaagtcttacataaatgcagcggaaaattaaaagataactggagctaagccttgacttggagcgcagcgggaacaccactccacaggcatcctcgacggcacggacgaagcctactcctcggagaaaccgccatctgacgcatactcaaactctggggtttgggaaaaatagagcaagactgagtacaaccaccgtacccagcaagtcataccggaatagagggtatgatgcaaggtataaccaaaggatagctagagcggttcatttgcataaatcaagcatttaaaaatagtagttgaaagcagtaaaacagttgtattaattactcaatattatccatccactgtccaacgctaccccacgttgcaacaggcccaaccatccacctgaactaatcaattccattagacttgactagagtgagactaatcacggtgaatctggttgaccgtccataaccgagggcacggctattcgaatagttttactctgatcagaggtgtacaactgtacccacaagacacagccccacgacacgttcccgtgcgccgacatgccaccacgacataccggatagaggccgtgacaggacccttcgcataaccccctctaaccaagcacaccacacctcaggtttcacccccactcctcgcaaggcagcgggcagtcccctctcgtgcctaggtgaatcaggaagccgcataggccgtcgcagggcccatccaaactccatcatgcccacccttgcctggatgcgtcagctagagaaaagctacactacaagcccagccgttgcccacgctggcttgtggcaagtacgaggaattcttccagggtttcctatgaaccggtctttaagtgccatgggtgcgaccatcaaaaccaagcacccacagcccaccatatgttatattttaattgactaacaccaggacggtggctttaatccaacaccaacactagaacctgaagtctaagcattaatgtgatttcccccattgtgtgctagttgaactaagcatggctaagcaatccctagtccaatatctagtcatgttatatcctcaagctaacaaaggaacaaggtacaaaaatagcatggctgtaacagtaggtaaacatcccatagtaacattataaaacaatgcagtatttaagggaaaacggtagagcatttgcaatttaggatcaacatgttcaagtgacaagcatgaattgccttgctctactgctggaggaacctcggcgactatttcaaagtacaccggagcgtcgggagagccggaatttaagcgacatacaaagcaaatgatacaaacaggctataagattactgaaacagagaacaaaaccatttttaatggattctatgcatttttcttgattttctgagacttgaatgggcttaaacggagctcggatgaattagatatgaattttagaagattcactgtgtttttactataaacagaaaaatccaaaattgatttattgcgtaataattaaaatccgggggagagagggggtggcgccgacatgcgggccccacttggcagtgactcggggggggcggtccacggtggaccgggtccatggaccggggaggagcggcgcaccacatggtgcacacgtggcgccgacttagcgcacacgtggcggccacgtggcagccacgcgggtggcggggttggacggccccgatctaccgcccaatagatcggacggcggaggcggctcgcgggcgggcgctcacgggcacggctcaagccgacccgacggccgtggcgcgcggcggcgcggccccgagcagcaaggcagcggcgctaagagggagagggggaaagacgacggggagatgctgaccggggttcggccggcacgaggggacgacggcgaaccgcggcgaggaatgaccgggggacgacggcgaacggcggacggtctccggaaccacctagcgaaaaagatgagaggggttacagggagggaggaaaatgggaggggtgagaacgccggccgaaggcggcggccatggcggtgctcactggcgcatggggcggagagggttccaatggcggattctgacggaggagagttggacgggacggcccgcacgacggtgagcgtgacggcatcgacggcgtggcttggcacggcggctagcggcgaccggagcggtggcggcggcggcggagaggagggcgacagcgctagggcgatggagggcacgggagcgggtggttgcaaaacgaaaaagagagaagaggaggcggggacgctttatatagacccgcgggggtcgatcgtggccgggatggccgcaaattcgccggcggagtggggagaagtggggaggagagagaggaggaattcgaatttcgagagcgggagcaggcgggggagagagggagtgggcgcggggatcgtggggagggcggcaacgtgggcggcgtggcccggaaggcgagggagaggcgggagcggcagttgggagaccggcctcctccggctgggccgtggccttcgaccggcccagcggggagggggaggaggaaaagaataggccggcggcccattcgaaaaagaaaaaggggaaaaagaaaaagaaaaagaaggaaatgaattttcctaggattaaatattgcttgtgctcatttttaattgcttaaaattagttctagagctctaaaaatttcactaaaaatcttgttagcatatttcgacatatagaactcaagaaaaattccacatgccaattccgattattatttgcattaatttattagggtttctctctttcttttacaccgatattttctctaggtgatttataaattcaatttaggcttggaaaagaacttcaaggtgtgacagcatacttgtgcataacgcatgcctagacttgagtccattgtgtatttggattttggtctcgctttttataataggtctcatgagtataacatgtggacttaatattaaattctattatctttttctcagtccaaaagaagtttaatgtaatccctataataatattaggtgcaattatgtagtaggaacacatatacaaagaaaggttattcttattctttaaaataatctatgcaagatgaaatcatggaaaaatttatgtaaactatgtttagcataaacaattcactataatcttggtacaagttaataactaagtttaataccacaaattaatcagtcaaagcagaaaaaactaaaagaaatcaaattaaattttaatcggctaaagccatacttcatccaaaagtacatttaactgcacataagtgaacatggaaaataatttattcaaatactagattatttgtcatgcctaaatataatttttctagaattttcctcctctgtttaggcttcttaaaaattcaatctacctttctaatagccaatctttgtttaatttctgtgagcagtctatccattatttttgagtgaaaccaaagaaaatggaatctaggtgtaatcatttacctccagaaaaataacactaattaatttggtccacacattaagttatgaagctacaaagttaggggagagaaaataatctaaaaattcgtctaaaaccgtgttcacccagaatcttacccacacctctctcttccacctagagcacttcgtcctgggcccacttggcagcctctccagctcgccctttctttgtgcctcaccctcagccgaccaagaacacagacacggagagatcgagcgagccgacgcgtggccacaacgtgtcgacgacctcgggctttccttttctcgctctcttctcctccagtctgagtcgccattcctcactcatcactcagagccgaagaagccgaggggagcaggtcctctgcctctccttcaccagcgacctcaccactggccatggaggtgacgaccatcgccatctccgtttgagtcaaggtcacctctatctctttcgcgtttccatctctccacacaatgccgaaccacttctctgttgaccacctctcgttttgtgcatcacagccaccggaacgtgaccacgccaatgacgccctggagcacgcaccggagcgccgccgcttcgacatcgttgtcgaccggccattcttgtccatcccgaagcaagccgctgtgccaagaatctcgcctcgaccacctcttcaagacgcctcaagaaccctagccggagttgtgaaggactcggagaacgcatcctttgcttcccggcgccgatctaggatcgcctccgccatcatcgtcgattaccgctgcctcggtgagccattgttcgattcctcgcgtatacaccatctccataacctcacgaacatcttggacatgcatgcatggcaggtccttgagttgttcgagccgtcgccgttcccccgaggaggagcgctgccgtcgaaccgttccaaccaaagccgctgctatccaagcttcggcgatttcttcctacagcttggtgagcctcctggacctcttaggaaacacatgcatggatgcatctagcaaaatcaaagccctaggcaacatgcagtaacagctcatgtataccttccgctcaccctcaccatcggcgctactccgatgtctcctagccaagaaaactagaggaatggaatcgtgagagcattctcttcattttatcttttgacctcattcccaatcgagccaccaatcgtcgccgactagctcgccaaagccatggccaagctcccagtccatcgggctgctggaggttgaagatgaggactttgtcctgtaaatgattaaaaacatagggttcaaactataaaacttcagccgtttacatgtggacctatggacctaaatgcagtttatataaagcccagggacctttttgtatattggttcagccaccgatcagtggacccatgtgtataaaaatctgaaaatgcaaaggaaaaataactaaaacattaaatgtttaacaggaaaacacccaaacttgtaaaatataactcattttgagatgattctagttgctgtagaattcttaaagttatgaactctattttagaaatataaaacttgacactcactatacaaataatgtttctagaatttatctaagataggtcatacataaaacatgtacaaacttataaaatacatagaaaattcatctcaactcattttgaaacaaaatcaaattctacagattcatcatcatgcactctctgattaggtgaaataaaagtaattacttactttgcatcaaatgcctctaaaactattatctctagaatgattagtgtagataagctaaagtttagaaattcatgtagaacccaatttagcttcagtttgagtaaacttaagttctgtaggatcaccaaaacatgtatttccatgtttatgaaataagattatatacttactgtgtagtaaaagtctctaaatattcatataaagatttactaacatagagtagcctttaatttgtaaaacttgtagaaaattcatttttagtccaaatgaaatgaacaaagtttctatagaaccagcaaatagttagcttcaacatagtgaaataaaatttggcaccttttgtagagaatatagatcaaaaccttaacctagtgaaataagaatttaaacacatagtgttgtttaagtaatacataaacatgtataagtatatatacactttaggtctaattaaacctaaataaaaacttaattgaccagtgaagccatagttccatcctcatccactaaaacttagaagaacttagctcatataacaatttctaggttaatataatatattgctagtttagattagagcatctctagtttataaaatatgaaccatagtagtaaagaccataaacatgtgaactaaaaatgttttagttaaccaaattattccttttattcaacttaaacaggaagtagtatgttctgaacctacaacttgagagtcatgcacatataaaacactatatgcctaaaacatgttgtaacttgtaaaatctataagaaaatcattataactccaaaaattgtgaaaccaaatgagttagtcttataaaacacacctctacacctctgtgaagtctaatataataaaaataactttacaaaagtatttcataacactacctaagactataatactataaccgataaaacttataaaattcataactccctaatgaaataagataaaataaaaattctttcacctaaattaattttagaccagtacctaatcactgtgcataaatcatgcattttagagcattttggattttcagctcttttggtgtttaattgcataacgtgtcctttatctagataattgcataattggtgaaggagtggattaggtgctaacatttctctgatcaaggcaagttttctcctcccatcctttgaacacattgaatcccatgatttgaggaatgaaaatatttgtttgcaaagttgcatgtgaacttagattatatcagtatttaaaattgggttaaggtagttatgacctatttgccccaccttgaataattgatcttcttgctatttgaacacttagaaatggttagagtgcactctttgtgctcaaatgggtttatatatgctctatgtgcaactacttgcttagccatacttagaactatgcaaatgctcattccatctataattaaaatgtgattttcatacatgaacctttgctggaataaaatgaatatgatgggtatttgcgaactacaatgtgtaaaatgtgattttatacttgggcggcaagtggtgtgcatatggtgttagttgcataccgatagggggagtatttgcccaagtccataaggaccgaacttgtgtcacccatttaaagatattcgtacatccacatgtgctagtatgggatggcctaagctgattaatctatttaggactagccttgcattctggtaggccggtgtgtatgagttcaaataattcagaggagcttcctatttaccccgaagtggtagtttaggtgactaagcgtgtccaatacaacggtattgtgccacgtggtgggttcccgttgtgtccgccaccacggcgttaagtttaaggcgtgggcccgccacttaacggttctaggtcatataacgtgtacggcttaggatggagtaacacgtatcgtgctggtgcaaggctaggctctaagtagtgtaaaggcttcgttgtgacctctagtccgcactcataatgtagagtgtggggtgcttggccggcactgaaccacctagagtgtagcctccgggcttctatcacatcatgtgggtaaaggtgtacaaactctgcagagttctttaaactaatcgattagccgtcggtcatgagcgttttggtgatgtgtcatgagtatagactttatgttttaaaatgtggtcatgtgacattagtttgaaattgataaatgtgttgagttgtgtgtgtgaggtgacatattatgacttgttgtcaaaggatgacagcaagagattgattatgatggaattatgatgaacttaatattgaaacttaaaatttgttttgttaattgaagcatcaactcttttactaaagaattgcgaaacaaaacttgctttatgctgaaattgaactacatattgccttcatttgaatatatgccttacatgtagtatggtaggattgacttgtgcttgccagtacgttaacttgtttaatgtactgactcttgctgttgatataaccttttgtttgcaagtttagacttagtttttgagtgatgcgggttccgattgcttcttctaggatgagaacttaatggggtaaacccctagttggtgtgcttgtgattgggtagtcaagcttccgctattctctaataaatccatttggccgatcagcctatgtaattattaagttgttgtaagtcttaagtttctttcatcttacttgtgtttgctatgtataatcatgcttaagatgaaagtatggatctagtgcacatcctgggaactagattcacatgagtatgagttaggaatatttgagaggttgtagatctttagctatttttgtcaagtctcctgaatgtgtaacacatctggtcgccgccttcgagtggttgacaggcacatctcaggctgaagttgactggcaggctaagggcctaacaatgtctccaatattcctctctcgaggcgtcggatgtttcattatgcttgtttgatgacttgaattattcacttcatctctcaaatataatggaaggtccgaagagcctacgacaggcatcgatatatccaacctccattggggtgcttagttgagtcggtgtatgtcaccattccgcttgcctcggtaagatcttataagaatttggttaaaagtttgagtgtgtgtgatatttgagctatcactacctagtagttgataggagcgtacatattcttgtgtgtgtttcttgtttactactaaccatggcaggattaagcaagggaatacgcgaccatcatgctcaacatcgacatcttcgtcgagtcatgaggaatgatcaacatgaccaagatgaggtaagtgacattgttcttggaaagatcaaatatggactaccttatttcgaaggaaattataatcctcatgtttacattaattgggagctagcagttgatagcaaatttaaaaagcatggcttgtctgagaaacaaaaggttatgtgtgcctctagtgttttaattaatcaagcttctaatgattggaaacatctttgtaaccataataaaatacctcaatattggaaagacctaaaacgatatttgagagatatttatgttcctatgtattatgctgatattttgttcaacaaactgcaatgtttaaaacaagaagttacagaagctacagaatacatctctttattacgttgttcaacgaaacatcttgttcaacaaaccgcaatgttcaacgaaacatcttgtttattacgttgtggtttagatgaatgcaaagaaactacagaattgaggtttttacgtgggcttaacaaagaaatttaggacatgcttgattgtcaaagatatacatctctttctcatttgttacaacttgcttgcaatgctgaaagtaaaatagaggaggtcatgaagaagcaacatgctatgtttttgtcttctattactaaccatttgcaggaagtgcataatcatgaaatggaggagagagacatgaaagagccgatagtcccattgttcacactcaaagtcgaggcacctccatcatctgaagagggcatcaaaggtaaacttaatggtgctgaaattaattaaggtgggtgtgttgttaatgaattgaatttgtccactttttatgctatggtagagcaaccattagtggaaccaactactgagattcctttgtcacaagttgatttgtttgttgttccttgtgataaagcagagttgtgtgataatgcttcacttatatcaatgtctcaactagtgaatgaacatgctattttctaatgttagttctttatgtgatgattttaagcgtgttattcacattgctaatgaagtagaggaacgtgaattaacatcttctttaaatactttgggctatgttcagtgtgatgatttttgtgagctcaataatttgaagaagaaattatttgctaagtctgatttgccatgtccaaccaatgttatattttacatctttggtaaatataatgatcttggaatatatttcgtgcatagagtttacatttgctcggatttagagcttcctgtacatgtgtataaaacatgcaagctagagagaaatgttattgctaaccaaattgtctcgaatttgccttgttttgattagtagaaataggttgttgtaaatggactatgcaaacagcatcatatggaaaaatcgaggatggttttccgtgaagaaggggaggatgatgtgaccaaggctaccatggatgcaaccattgctcacatcatggatgaacaagaagatatagagatcaagtcctccaagtgctagaatccgatgcggccacatgctacactactgtattcaaacggtcgctgaatctgcatacgaccttcgttttcggcccgtgagtacttgatggaaagatctcagagccctctttccaacagatctagtttcatcgccaaattccatgtcgtttggccgcaattacagaaacaagttcttgggtcacctatattgggccaatgggtttgtaacttcgtttgggaccccggcccaagtggggctcatgtggggtgcgccccaactaggtggagcacgaacctaggcacccctaggtcatcctcccacctccataaatagttaggtacccctttagggtttctcgggttttgtttagatgaaagtttagccattgctacttccttacagcgcgcgtgtcggctagaccgtccgtctgcttgtattcgaaaccccaacttatctcgtgtattcattcctatttgcaattcagattgcttttatcttgttattgcttgtttctttgatttgtttacaggaataaggttgatttgcatcagcaagttcaacaacccacggagaggtgtatcgatcgctaaggcgcaacacaacgtctcgtacggttgtaatcagatcgtcaacgtttctcccaaatcatagttagctacaactcaccgaaagatcgggccaacaacagccttgagtgtcgagtggaactctgggttcatcagcaaatgaacgagttaaggttctcgatcgaagacgttggaacaactattgccgtgctcgcttgaccgttctcggtgtgttcagaaataaggctagatctcatcggcctttgtaggcactttattaggtttgtctaggttaatctccgatgtcaagcgagaagatatggagcatgtgactaagtctcccgccttgctgtaatcgagaatttggattgaagtcaagaaattccatctcggcgggtacaccatcgctttgtttcatattccttgtcgagccccatcaaccgttctcgagtaatcgagtaggcgtagagtctgcgacaaagccttgaaatctgacttgattgttctgatgtctgattttcctgaaatcaatactcagaacatttgccgtactcgcttagtcgatcccggtatagaatcgtagagacagggagtcttcaacaatgttgaaatagccccccgagcgaacgctcaagggtaacatgacatgatatgtatagaaaaattgaaaataaattgaatctgcatgttacaataaaagagtactctcgctagagtcgccctcagcaatcggagtttggtacccttcctagcccccagctgtttttatggaaaagccattttccacaaagacagcttgtatcttataacaaaccatgcagaagcttgacaaatcctagctcccagtagtgaagttggaaaaatcattttccaactacacggcttggttaatacgcgtccattgagcactcttacatgaacagtgtaaagggatagtaggaccgacttcaggacgaaggcaatataagaaaagaggatcatcggacgaatattgcacatataaacacttacagaagttgacgtataagacgtgatgagacgacttccacaccgggtgaagaccaggtgtatagttatactcaacaaatcgcaaaagtagtgggagaatcgctacaccgctggtcaaagacctattgtagtcataactcgaccactagaaaattgaggtacgagaaccgctacgctgctggtcggggaccagccgtagtcgtaactcgaccattagaagtcgtggtacgaggatcgctacgttgctagtagaagactagtcgtagtcgtacctcgaccatttgaagggaatccagagtaatagatagacgacgttcttgtgacttcgagaactgcctcctgatgatgacgaaggcaatgaagaattaccgtagtcagaggttcggctcctggacctactacctcatcctcgggccctctagaagtctggggatctcgagtttcgtcgtcgtcgtgtgatgtcgtgatgtcgttaaccttgtctgttgtcgtcctgatgtcgttaatcctggacgttgtcgtcctggtgacaacgatgatctagtgggtcttggttgtcgctaccacgacaatgttggctgttgcgttagatgtcgagatattgctgtaaccgattggtcaaggaccaggagtaggcgtatctcaatcacctgaatatgaatttttagttggtgagagatcgctactatctattggccaaggaccaggtgtagacgtatcttgatcacctggagaggcgctagagttggtgattacatgtgtatctcacgtggctagcatgactcacataaccaacttttagcatatccgcatgtctattcgcaatcatgtcgggtgatcaagccgacaacgttcacgaggaattatccgttaacaacattttctcaaatagtccatccgtggatgtctattcgcaatcatgtcgggtgatcaagccgacaacgttcacgaggaattatccgttaacaacattttctcaaatagtccagccgcagccggcgctatacatgagataagtcgtcagtcttcgttggtaggttgggtgtgacaactcagcatttttcaagaacgttctcaataaagcggtgtactcgaccgcatcctacaagagtgctcaattgttcctgaaaaatattttctagaagacaagatatatagtagagaatatcgagtatgtacttaaaagactgcgcgaatggatataacgagcagattaaatattagacattgtgtaaaccgtaaataagcatgatttgtataaatattagaccgtagtcggcctaacaccggaaacacttgcacaataatattgtataaaaaacatgctctaggtaaacataataaattataaatctgacaatattttacagtctaaatatagatacggtaaattgtatataaaatattgcgtatctttgtagatacatgccaaaattagtagattaatttaagaaactaatccaccaattacctttgttgtgtacatgtgtaatgacactgcttgtgcattagttctgctttgtgtccacgtgtgcacgtgcttgcttgatgtagtagtccgattgtttgtctgttgcacagggacacggtaggctctatatgtgtacacgtgcatgaatcggtttggtcagtgacagtcctgatcgagtacgtttaatataagtaagccgatccagactgcttgcgttgttgccgagttgggttcagtgctgcgtcctcgcgccggttgatgtcgtacatgtgaaggaattggtaccggatcaactccggaatttgtcgggtatctgcgatgacaatgccttgaagcttgctcgatcgtgatagataaaacagttggcgatgatgattttgatctggttggagaacgcacatcgatgggattgtaactcccacagtcaaaagacgttgagtagttgaaaaatccacgtgttgaacccatctcgtcgaaaaccttaaagcaccaaaatttccctatctgacgcgccattgtcgacattaatttggtatcacggctacggtatttggatggtatggggatcgttggtaccagggtatatgcgagattgaagtaaaagaaatgaagacaaagattttatacaggttcaggtcccttatatgataggtaatagccctacatcctgtttatatgggattaatatagaaaaccacatagcacaacaattgaaataacctatctagccatcgtcgacttggcggcatgaacaccaactcgtagtcgacgacagggtagtcttcctccttgagtatgaactcatcgagatcagatatggcgctagatccatcttgccggcatctgtaggcaccggatggggtatgtctaggcttatctctgatattgatatgcggcggcgtgtgttggcttgtggctttgtggcgtgtcccctctcgtcctaggagggcttgtatttatatccatagatggcaccttgtccaagtaagactagggagataaagatggatacaatccgagtaatccttgttggttcaatatagaactctatttgtcctttcttatccggaactcgttctatatacgaggtttgtttccgtataagacatggtatatggttggccatgccaagtttactcaactactattaggtatgtggtatccataaccatgacaatgaccttgtgtatttgtgaagtgatatatcacatattaatctttattgttaatgttttctaaaaaaaatatttatcaccatttgaatatataatatacaaacaataagtatatacatgtatgagtctaaaatagtttataacgaagaaatcacatactctttcttcttctttttgttgtatgaagttattgatcttttatagttcgttcgatcatttctcatattatgaaaattatatgattataatctattttgttttaatttattttgtctttaaactagtttaacattagttacgttttctggtttatatacctttaataatactactaaatcatcagcatccggctttcaatgcagatagtgatttttgttgacgtagcactagaaagtccaattccaggtcaaagaaaaagatctaggaaaatccttaaagcgatctgcaaggcagagcaaccgatggcagactgccgagtagcattccacagcgatgctgaaagcgccggccactccaacgccatcactcgttcactcctacccacgacacgcgtcgcgccgtgtcatcttccacaagcatctaccacccaccactcatccgcaaccacaagaccaaatctcacatcgcttccaataccacctccttcgcttgcatgattgcctccaaaatatatacgaccagcgatcgatgaagcagacacatacacacgtttgtagctcgctcacatggatgagtcgagtgacctccagtggcggcagggatggctcgccgtcggcctgccgccggcgccggtggtggcggtctccgccatcgtggggttcttcctctacctgacgtggcagatggacgagtacgaggagcagctacggcggcgcacgcaggccgggctgtgggtgctgctggtgctcggggcggtggcactggtcctgctcgggagccacgcgctggtggacgccggagggagggtcgccgtgccggtgtcgtggcggtggggcggcggctacggtggtagtagcggggacgacggcggcggcgcgtcgccgtgggccgtcgcggcggtggtggcggtgctgctggtgttggcgtcgcacaagccgtcgttccagatgttccggccgccgtggcactacaagtagctgcttcgcttcacttcctcaccctccccggctggcttaccctcgtcactccttttcaattttctgtacagaaaaggatttagttttctttttttgagaaggctaccacataattaagagaatacacgtgtaatagaagagttcatcttattttgcgtacgtatttgtagcatctagaatgtataatattattgttaccgataagagaatgcatatgttttatcgaatttttttgcatgtatttgtccatttatggtgttatgaaataaatagatgatcaatctcagattggtaaccgaaggtttggcatggcgattgtaccgtgccccgccccttctcatcctctcgatacttggcaacagatcctctcgacactcctcggcaacaggcgcgatgggttgccatcgcgcctatggttgctctaatcgcatctaatattctcatgctggcggttccgtcggctgccgattggtccagatggcgaaatcagtttttgacgcgtgttacgctaaggcgaagcttcgagcaaacaccacggcgcggaaaaagtaccatagacagagacttgtcttcgtgcttgaaccgcaaaatcggatacagcgcatcctccaacttgtaaaactagtacaaacaagatcttttggtggtattgtctctggttttagctgacgtgatgtctacgtggctcctttagctaggtattcgtcctatatggtattgacgttgcgcttacgtggcaattcgattgggaaaaaataccatagggacccatgtgtcagttacactagataataattaaaaaataatggcttcatataggaccctcatgtcatactcattctcattctcctctctgctcttttctcctcgccacactgcgccggtcggagcgggcgagcagtggtccacggcgacaccatgcacgctgtcgctcgccacctttggggccatgtactctcgagcgccccgacgaacgagcacgactgctccgtcaccggcttgcccatgaactccggaggcgccaccgaggcacgcagcctctacgtaccgccgccgcttgaaccggaggagaccttagtagcgtagaagtaggtgaagggtaggggaagctgtgggagcgcatgcggtggcggagggagtggaggtcgccggcgcacactccccagaccaaaagaaatgataaatttgtcatgcatggtgttgaaaagaatttcaatcggcatgtcacattgcatatatcgatcgactagccaaccaggattcaggaccaggacgaacaacccgtctggttaaattggaattcgtcagaaaacaaaccaaacgggatcacgtcgcggttgacgacgacgtcgagtcctcgagcggcgtcaacctgaatgaatggtgacgagagctagctagctcaaggctcaagctcagccccggccagaaggcgtcgaccttcccggatacccatgcggctggcaggcatcatccgctgcactgggactcggcgccgacccaactcgaactggatctcaaccctctcgaggaagttggcatactccaagcggcagtggggtcgaactttagcttttcgaattcgaaggaggcggtccgcggtcgtgggtaggtgtgtaagtgggtcagccgcgaacccacttataggtcaaaataagcgggctcgcggcttattttagcttgtaagtgggtttcgcaggttagcaacttacacccttagccgtagggtccctgcctctggcgacgcggaagacttcgtcccggattgcggcagccacctcgggatggttggaaaggagcaagaagaacgcggttagacctgccggcattactggcagaaacgagacggatgacgtcgcggagcttccgctcctccccgatgttgagtagccgcttcaacttccacccgctgcatctctctctctcgctttgtcttcagctgcatataacgcgcgaagagggaggagacggtgaggccggcgaggaaggcggggaggccggcagcgacgcacgaagagggatgaggcagggccggcgagctcgctgttctgctccgcccggtgctgtgtggtgagaagaaaggagaaatgataagagaggaagggagaggctagcgtgcagacgtggcatcctgacatgtggggctcacgtgggtcccacgctgacacagtcgccacgtcagataaaaccgggtcaaaaccactaagagattaagtttgcactggttttgtaagttgggggatacgttgtatcaggttttatggttgggggatgatcttggaactcgatgacaaattgagggaccttcagtgtacctttttccccacggcgcatacacggctctacgcggttgcttgcttgcaatatgctcgtgcagcatcatgggccatgcaggcatgcagcaggtgacatgcagctccaatggcccatccaagcccatctgaatgtgggaagaatggaaagaagagtgctgatcttaagattagtggtgcattgttaggcgtttaaaaaaaatgcaattccaaaatgaattcatgttggaatatatatatttcttcctaaaaaaatcgttcattttttgaataaaacaaatccacagattccgagtgctaaaacataaaaacgtgaacgtgcaattttattaaaaaacattttacttattaactcgatatcccctagctaacgtatgttactactttttccacaacctttttgcaaacacaaaagtaaaacctgttgaagggtttcgtggaatgtatggtttttataaagtactcatattaattgaattttctcaggacagaaaataccaacagctctgccagcaaattttttgtgtgatcatcagtattttaaacccaaatttaaaagcccttcaaacgatattacgggctataaaagttgggcgtgccaactggcacgcaaattttctagttaatcaataaagcacacaacgttatattctctcactcttacaatctcaattgccttttcaacacgttatcagtactttgatcttcacgagaaaaagtgatgaagaaaagaaggtatacctaccttcagttccatgatcgacaccattcctggccttcttcatcgccttcttcgccatctccaccatcgctcgacgaggagttgccaccatcagcatgacaggcgtcggactagggttggtggccaccaccaccaccctcaacactgaattcttgtcgctgcaattccggtcactcctcctccttctccgccagcccctgcctcgccggtcgctgggggcgctccaccgcatccaagtctaggggtatagttttgtactcaccatggatgaaccgcgatggtgccgcccaccgatgagtagtgatccctcccgcaagagatggaatagccaccggttccgcttgtcgtcaccgtgccaccaccgactgcacctccaccatctccaatgaccacacagttgccaatccgatgctgttccccaactcccgtgccaccgggtttcggctggaccggaatcctagccacgtgcacaggggagccggcactcttcagtccgtcctcgtcttgctgtcaatgccggagccattgcagcacaccgccccggcctccgcgttgttcctcatggttctgcgagccgcacgctccggacggagtggggaacagcgtataggtctgaccggactctgactccgatgaggagtgggggctatcggcctaacttcggccagcaagccgctttcggaaaagggggatgctgcagcggaggaaggtggagcgacagtggatgcgaacagcggtggcgatgcactcgaaggggaagcggcggtggatacgggttgtgacggtggtggactcggcggcggtggcgaagtggacttgatggcggcagcgaaaatgggtggtgacggtggcggtggcggagaaaccgcgggatggttacgtttctaaccctaaccagcctggtgggccgcatcatgttgatttcggcccaccacccctttacatgttttcttccttttcgttaacgttagttttaattaaattagcaaatttaacttttagtccccatccttttagataatttagttaagtagatcatgagttgtaaaaacaattatctatctaatggtccattagatctctgatgtgttattggacatatgtatttattaatacctgctttactaaatttacttgttgtcttaataaactgcctattgttgtcttaataaactggcttttgcatattatttaaagacacaccctgcttactcgctctgttaatttgtaaaattattttaatttaggaaattctcttaattatatataacatgattaatggagaatttaatgcatgctcacctgcatactttgacttggaattaaacacatgttggtggagccctatacttgtaatgtcccgagtttcaaattagtatatttcgaggaaaattggaacaaacacagaaaagttcaacgtttaaaccgttgttcgaataggcaatctcaaaaaccgtggatgcatagaacttgttgagtactgcaaaatagactcgaagtttatagtaatcggagtccaaacgatgttccggggattgaaaccgttagatctccttttagtctctttatataaaaaaaagggaaaaaggagagaacgctacagcctgccctagccgccacactcctgtgctgtggccgcggccactgtcgtcctggttgccgccgccgtctttccgccgccaccacggccatagctggaggccgcagccgtcgccatccatcgcaaccggttgtttctttctgttttgctttttcccggtgagttcctgctgctgctgctgcttcttcttctaccgtttcctgctgttgccgatctgatctattcctttctgctgctgctaatgcatggtttgctgctgctgctgatgtgatctcttcggccttgctgctgctgctgctgcatcgatcagagagaagggtccagagagcagaccaggaagcagttgaacatgaggaaggagaggaaaaggcagagcaactttgaggaattcagcgatctcgtaaattagggaaatttgttgcaagttagtgttcctcctttgcaagggtaacttgttttcagtccctagacgtaagagatttgaatagaaattaattcgctggtcgtttgtacaattttttgaggtttttgattatgcactggctgtattatcaaaactggtagcaaacaatcgggtttcaggttagttgtcctaaatgaagtttgtagtcatcgctcgaatcctacaaacggtttaggagaaacaacaaaaaaaaaataatactgctgccgggtctgaaaataaagacaacagttcgtttttccttaatctgacaccaacagatgcataatctgattctttgcgcaacatgaaagttgaagacaattttgtctagatggccgaagttgtattggttgccacattctgttagatggtttatgagttacgcataaaacagtaatagaactgctatggtttaagacaaatcggtaaaaggtttatacgtaggtttcgatttcagtaaatatcccttattacgtgagaagggagaagggagaagtagatgaggacaaaactgacatttttacatggtttctctgtcattaattggatggatattgtattttaatgtgtttggtgttctatggtaaattacatacttttgaagtgtcctcgagcaaattcacgttcttgtggtgtctagcagcaaaaaccatactttttaagtgtcatgtagcaaatttgccattacatatttagttctgtaatcttggtttgatatagcaccatggttcaaatcatctttgactggtctcgggtgctgatgtagcatctgtagtcacaaagtgcttcacgaggtccttcttgcagcatcatgggtgtcgcgtcccgaaacgactctaaaatacattctcgaaattatgcatagaataagtaaaatccatgtgaaagcctccaacaattaaaatgtgctaagttaaaagtcaaataaggcttggaggatttttgtatatttcccaaaagcctaaaatgcgtaaataaattttagtggaattttcagagcaccaatgataattaagaagaaataaacaaagttaaaatggttttataaaaagaaaaaccctaaaaagtctttttccccccccctccccctcttgggccgtctcggcccatctctctccctctctcccctctcccccgcggcccatccggcttcctccccgcgcgcgcgccgttgacgggcgggcccgcccaccaccctcgctgacgggtggggcccacccgtcatcccctacctcccgccgctcccgccgcctcgccgtgccctagcgccgccgccgccgcgaatcccgccgctcccgtccgtcccgcgtgcaatcaagaggggggaaatattccccgtgattccctccctctttccccccatttttccctcctctctctccctcggattcgttcgaaatctttccccctaaacctcgccggcgcatcaatggcggccggatcttccgcgctcgtttccccctcatccggccgctctctccccctcccaaccctatataaacactccccgtgcctccctccgccgttttcgccactcgccgctctctctctctccgccggaatcgagctcgcgccgtcgctctctctctctgccgtcaccgccgagctccggtccgccgccgtcgtcgccccggaccttctcccgcttcggcgtcgcctccttcggcttcgccgcatccccgccgacctcgtccacctctccgtttcggtcgccgaccaccggaacgccgccgtccccgtcgacccgtgccgcaccgccgcctttctccgctccggtcgccgttcccgtcgtcgccgtcgacccggggtgagccgtggaccgccgtttcgtttcccccttccctcccctctctcggccgccgctccgccgtgcctatggccgccgccggcgaccataggggcgcgggcgcgccgcctcccgtcggctgtgccggcgtggccgccttcgggcgcgtcccacggctgccatgtggggcccggccgtcagccgcccgcgccctcgggtgcggctgacgcatgggacccacggcgccggccggtgtgagccgggtgcacccggtccaccgtggaccgtgaggctgccgcgtgggccccactcccgtggacccggtccgcgcgcccctcccctcggctgacgcaataaatctaattttaaattaaaatttaaatgaagaaattcgcaaatatccatttaaagagcatataaccttcaaatagtcataacttggccatttgaactcggaattggaccgttcaagtctctaatttttccttaagaagtcaagaacccatttttgtgctttgtttctgcttgttatatagagtttattagagtaaaagctttttcttttccgttggtcgtgtagacgctgcagcttcggaagatccgctcttcgtggaagtcgaaaccgacgtttgggaaagcgagcaaggcaagtcacatcatctttgaacatattgaatcccagtttataaaattatgttgctttaaattattgcattatcgctttatttaaattcccgcgttatcactgttttatctagctatgcccatttacctttgttatgaccttattattgttattgttattattaccttgttcaccctagattaaacaaaaccccaactagtggacactctactcatagtaccactagtataattttaggtagatgcttcgcaatttaattaggtaacattaggcggttttacaactctagactttgggaatgttcataacacctggacactttggaattgttggtttattgtggaactggcttcacaccgccccctctattcaaaatccccaaaatgattttaggctgggctcagggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctccagggcaaatgaaggctacacgagctgcggctcggtagtcgagatgtcatggcacagggccggtgtcctgctgctaggggctcagtcctgcctgcctgtcccgggggttacggccgtaggtgggattgggtcggtactcttgtctatagctaggatgggttggaaactatgtcacgtcttccgtctgtataccgtggtggtatgtggcacgtggctacacgtgaggaagatgtgtcttgtgggtaaagatatacacctctgatcagagtataatctattcgaatagccgcgccctcggttatggacaagccgagcaatgtacccaagttagtgttttaattctaaaaacctgcttaacaactaaaatgtggaatggttggcctgggttggcttgggacgagctgggaccctgggtcgggttgccagttcggtctgaatcatcgtaggccttgggttaaggcaggtttgtgtgggttcacggccttgataaataatattgtatagttctagaatcgtgtttaccaaatagctttgagcaactaaatatctttaaatgctgtttaccacaaccctaaccctttatattgtaactcctttgttctcccttgcatttattatgcacttgtgggtgtgtcttgttgagtacggtggttgtactcagtcttgctcaatttttcccaacccagaagaggatccccttgaagatgaaggctttggtgtctagctcgtgcctgccgtcaagcgcctgtggtggtcgccctagtcttccgttgcttctcgtttgtctttgtgtgtgttgggccttcgtcgcccatgtaatgaattaactatttacgcttccgcttgttaaactctgaattgtatcaacctttggtgtaccttgcctcctgggacaaggattaatgcacgcacgtcaggaacgcccgttgggttatttccggtcgtgacaagttggtatcagagccacccttgaccctaggacgagccgtagatcccaagccttagcaatatcttcaaaaataaaaatcctttgtatttgtgaaaatcctctagtctctctctgtcttgctgcttcatttatcgccaaaatctgacctttaaaatgttgtttttctttttgtttttgtttgtagatggccggcagcgtcagccgtcgtggtttggacatgactggcttcgtcttggagctgcggggcatgtgcgttgtcctggggtatccgcatggagtggactaccaggccaggccgcttccggagcaggagggtgacgatgcagagccccacgctgcttgggaggttactgcagtgatcctcactggctctcccgagcggacttcgttggcagtcaccgcgggtggagattccttccccgccgcttgccagagcgccgctctcctcgccatcggcactcttcaccagcgctacccggacgagttgcagcactcgccctaccgctaccaccctcgtcgcggaggagcccgcgactacgccaccttccgggatgctagctcggaggatgacgctaccatcgtgcacctagcgtgcatggtggaggcgtacgacgcggctcgtatcgacttccatcagatggtgcgccgtgggatggtcgagaacaacatgaagatcctggagctgcgtcaggagaatctgcagctgaagaaggacctagacgcggtggaggcgcagctgcatcagctcaagatcgcccagggagaggtctgtcgccccaagcgccgccgcgtctgccgcagccagaagatcaccgcccgcaagagcacctccaggcccgagcttgttcgtcagtccctggcgtggacctgcttcatggagacccctcgtgccgagcccgcgcccatggttccccaggagggggaagcctccggcgttggtagcacggaggatgcgctgttgctcaccttccgccctggcccgtcgcagcggtagacgagctgttagtaggcttgcgcgtgtgttctttctcgtttgtcttcttgttggagtcgtgtggggcatggttatgccggtgtgtggtataattgtgtcggagcctgtctttatttaatttgcctaagcaatttgaactttaatgaaccaatttaatagcagtaataaatttaagaattatggtagtcgtgggtggttagctttaattgtcagctctctctgtttgctggttatgtgtggggttttcagatggtgacgaccaggagaagtgttaataccggtgatggcaaccaacccgagggcagcaaccacaacaaccatggcagcccacctccacctcctcctccgcctccaccaccaccaccagataccaacgccattctcacccaaatcctcgcccagcaggccaacatgatgactgctttcctccaccacctccaaaatccgctacaacagaatgctccaccaccacccccacaacactctaagctcgccgagttcctccgcatccgtccacccaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtggtaccatttccaggctacgcagccagaggggcagcctattacttgggctcgcttcaccgccgctttccggagaacccatgtgcccgctggagtcgtggcccttaagaaaagggaattccgagagttgaagcaaggcaacctctccgtgatggagtatttgcatgagttcaacaacctggcccgttacgccccggaggatgtgcgggaagatgaggagaagcaagagaagttcaggaatggaccctgagctgtccgtccgtctagtctccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcgtcctcgcagcagcaacagcagcaacaacctcgctccgcgccccgacctcaattcgtggtgcgcgtcccacagccccagcaacagcagagtcagcaagggactcgtgcgccccgtccttctacgccaactgtgcagcctggtcaaggccgcagggacgctcaaggcccgcagcgtctgtgcttcaactgcttcgagcccgggcactttgcggataaatgcccgaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaacggcttaggaaccctctcctcatcaccacccctggaggggttatgacagcaaagtattatagtcctgccgtccctatagaaattcaggggattccttttccctcggatctgattctgctagacaccaagaacttggatgtgatccttgggatgaattggttggctcaattccaaggagtagtggattgcgcgagacgcactgtcactctgtaccgagggccggaacaaccggttgtattctttgcacccccaacctctgtcagtagttcagaacttcatcagataggactgtcagaaatccccatcgtcagggagttcggagacgtgtttccggaagaactacccggtatgccacccaaacgagagattgagttccggatagatcttgctccaggaaccactcctctgtacaagcgaccctaccgtatggcagcaaatgaactcgctgaagtcaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttcctcggatcgatgatctgtttgatcagcttaaaggtgccacggtattctccaagattgatcttcgttccggatatcaccagttacgtatccgcgaagaagatattccgaagaccgcattcaccacgcgatacggactgtatgaattcacggtgatgtcgttcggtttaaccaatgcacctgccttcttcatgaacttaatgaacaaagtgttcatggaatacttggataagtttgttgtggttttcattgatgacattctggtatactcacaaacagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaggcaacccaagaccgtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgttccaaactctcaaagaaaagctggtttcctcgccagtgttaatcttgccagatactcgcaaggattttatggtgtattgtgatgctgcgcgccaaggattggggtgcgtgctcatgcaggacggtcatgtggtggcctatgcctcacgccagctacggcctcatgaaggcaattaccctacccatgatttggagttagccgctgtggttcatgctctaaaaatctggcggcactatctcattgggaattgctgtgaaatatatactgatcataagagtttgaaatacatcttcacccagtcggatctgaatcttcggcaaaggagatggttagaactcatcaaggattatgatgtgggaattcactatcatcctggtaaggccaacgtggtcgccgacgctctaagtcgaaagagccattgcaacactcttaacgtccgtggcattccactcgaacttaaccaacagatggaagccctgaatctaagcatagtgggtcgtggattcttggctgcgttggaagccaagcctaccttgctcgatcaaatccgcgaggctcagaagaatgatccggacatgcgtggactcctcaagaatatgaaacagggtaaagccactggtttcacagaggatgaacacggaaccctatggaacggaaatcgggtatgcgttccagataacagagaacttaaacagctgatacttcaggaagctcacgaaagtccttattccatccaccctggcagtacgaagatgtacttagacttgaagaagaaatactggtgggttagtatgaagcgggaaattgcagagttcgtggccctgtgtgatgtgtgccagcgtgtcaaggcagaacaccaacggccggccggacttctccaacctctccaagtaccagaatggaaatgggatgaaattgggatggatttcatcaccggacttccaaaaacccaaggtggatatgattctatatgggtagttgtggatcgattaaccaaggtggctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgcgtcctagatttcgggaagacctgggataagagtctcccctatgccgagttctcctacaataacagctatcaagccagcatacaaatggcaccctatgaagcgttgtatgggcgcaagtgccggacaccgctatagtgggaccaagttggggaaagccaagtgttcgggactgatatcctgagagaggctgaagcgaaggtcagaaccattcgggataatctaaaggtggcacaatcccggcagaaaagttatgcagataaccgtcgccgtgacctggaattcgcagtggacgattttgtgtaccttcgggtcacgccattgcggggtgtacacaggtttcagacaaaagggaagctcgcacctcggttcgtgggtcctttccgtatcattgctcgacgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccaatggagcaaccacgccgaagaagaagctacctgggagcgtgaagacgagctgaaagcagcccatcccgatctcttcgccagttcttccgaatctcggggtcgagattccgtttaaggggggtaggtttgtcgcgtcccaaaacgactctaaaatatattctcgaaattatacatagaataaataaaatccatgtgaaagcctccaacaattaaaatgtgctaagttaaaagtcaaataaggcttggaggatttttgtatatttcccaaaagcctaaaatgcataaataaattttagtggaattttcagagcaccaatgataattaagaagaaataaacaaagttaaaatggttttataaaaagaaaaaccctaaaaagtctttccccccccctcttgggccgtctcggcccatctctctccctctctcccctctcccccgcggcccatccggcttcctccccgcgcgcgcgccgctgacgggcgggcccgcccgccaccctcgctgacgggtggggcccacccgtcatcccctacctcccgtcgctcccgccgcctcgcccgtgccctagcgtcgccgccgccgcgaatcccgccgctcccgtccgtcccgcgtgcaatcaagaggggggaaatattccccgtgattccctccctctttccccccatttttccctctctctctccctcggattcgttcgaaatcttccccctaaacctcgccggcgcatcaatggcggccggatcttccgcgctcgtttccccctcatccggccgctctctccccctcccaaccctatataaacactcccagtgcctccctacgccgttttcgccactcgccgctctctctctccgccggaatcgagctcgcgccgtc

SEQ ID NO: 58841 - DNA, 9588 bp, Oryza sativa
cggtctgaatcatcgtaggccttgggttaaggtaggtttgtgtgggttcacggccttgataaataatattgtatagttctagaatcgtgtttaccaaatagctttgagcaactaaatatctttaaatgctgtttaccgcaaccctaaccctttatattgtaactcctttgttctcccttgcatttattatgcacttgtgggtgtgtcttgttgagtacggtggttgtactcagtcttgctcaatttttcctaacccagaagaggatccccttgaagatgaaggctttggtgtctagctcgtgcctgccgtcaagcgcctgtggtggtcgccctagtcttccgttgcttctcgtttgtctttgtgtgtgctgggccttcgtcgcccatgtaataaattaactatttacgcttccgcttgttaaactctgaattgtatcaacctttggtgtaccttgcctcctgggacaaggattaatgcacgcacatcaggaacgcccgttgggttatttccggtcgtgacaatggggaccgtatcgatggtattccggccttctctcctccggcaacttgaaggtgacgtgttgtttagggaagccatgagtggtgatggcacacttcgctgcttccctcccctcccctctctggccacaccccgcacaaccctacctcgctgtcacaccctcccctcactaagggaacgggttagggacaagggtagctatgaaggaggttaaaatgcacatttgttgaaacggtgggtcagctagggaggtggccaaagttggtttggatcatgagtgctacattgaaccaagattatgaatctaaatttacgatttacaatatcaccaacataaatgacatcactgtccgtgtttaagaaccgtccatgtttttttttctgttttttagattaaatttcacaaaacttttaaatgtcgtatgaaaactatcaatttgcaagaataagtactggagggaaattctgtgttggttccaacctggatattgcctaatttggaaccggtactacgttagtgctactaaggcctagtttttttcgacttcctcattttccgttagcacacttttgaaactattaaatggtatgtttcttgcaaatagtttctacataaaagttgtttaaaaaataaaataaatttatttttcaagtttataataattaatatttaattaatcatgtgctaatgatctttcttgtttctcgtgcggtaaacgcgagaacattgataaatataaccacaatgaatagatcaagaagtaatgcatcggatcaactgtaattatcatcaaaactcaaggcaatgacattatttcctcacaaaacggatctagaagaaaagaccgacgagagcggatgtagatgtgggtgatgcaagtgagccaccccggcactgctgaagaggagggagccaccactgtatcggtgaaggggaaaaggccatgttgttgaatggggaaacaaaccgtggccatggttgggtcgggggagagaaccgccacagtcaaacagggtacactggctagatccggtcacccccaagctcattgcaaccagatctgactactcacgacctcttggtggctagatctggcagtccctaagctctagattgcttccacaacatgggagtggataggaggtgccaccaaagttgatatcgcgatgaggatgtggggggtggtgaggatgatggccggcggagccacaatggtaggagggggactagtggttgttgactgtcgttaagtaccaaattcgaacgtcaattaccttaataaatagaagagaactagcatttcttatgcgcatattagttacaaataatgtagttccacttatccttggagaatacattgaatgcagggattatacaataaagtgtaggagaatatgtgccagcatgcaacacctccggtgaatcacgtgaaagcacatggactgaagggcccaaaagcgagaccaaaccaacatattttgggtgaacccaacgtgcaccatcataaggacccatgatgaggacacaactagctcggatataaccatgactaccctatgtattaatcaaccaaagatgcatatgttctacattagatttacttgttatatatttgaacaaacgttactacataatgagttttgtgtgtttgtttgcagaggtacttgcttggacgaaggaaaagaggccgagcataacgaatgcttggatgatcaaagaagttgattgaggaccaaaccaagaccttctccatgtcttttgtatctcaccacgtcacttttggtccatagaagacaagagataaagttctacacgttttggattcggattcgggcctcctgatagcatcaacttcaaacggacctagccgctgatctagaaagaatttcgaggcccatgagtacttgttggaaagcttatgtagctgactttcagatggttttattactacatcaaaattcctactgagtttccaggaatctgaaaaacaagccacgtatctcatccagtccgaatctgatttgggtttgggccttgtaattgtgtcgtgggcttagcccatcagggtgtgcaccctagggcaaccataggatgtccctaataatacttaaccaatagccgtcatcgcttagagtcgggttttgcttagattactctgtcaagaacagtttcgctgctagatcggtttgtggaacccaaattcgagtgcttaatcattcataagcaatttggttgcaatctatcttgttcttgcatgtgttcttcgattcgcatgcagggattagccttctcggcgaggtcaaccgggtttcagcacggttgataaccagaggagacgtggtgctgcaattgcggggcttagtagcgtgttcgtttataagccggatcgagttgtgtcgcgactctgcccaaatcgtctgtttatcaatacctatcggaagatcggaacctagcatccctcatcagttggtatcaaagcgtggttgcccgttaggtaagttatcttcccataaccagaaaattgccacacaaaaatatttattctttacctagacaatttgagccgttgcgttgttctattagattttgctttgttgaattctggattgcatcatcgtgtcgagtgctggtttagttttagatttcatttttagttttgagtattgcatctgttcatcacttaggtctaggactcatcactcaagtctgtgagttgtacgtcagttttgaatttagtttttcatcccgtcggttgttgccgggaccttgaagaattgaatcgtctcgatggttggtttccgttttcgtagtttggagaagttaatatccaacggttttggagttgctcgatttttagagttactgtgttggggagttagtgcgcatgtgaggggagaggacgagccccaactcttccgtaagtagtttctctccatcgagtattgaaagtgttaaagttccagatttgagagatatttttgtaaaaacggaacctacatgatacattccatttttgaggagatctaatttagttttacactttgcatttgagtccctgtaattttcatatttacatttgagtccctattcgaggccagcgatcagtttttgttaaaaaatagtaaaaaataaaaaagaaagaaaaggcagaaaggtgcaaagaaaaagaaagaaaaagttgcacctaaaaaaagaaaaaaaaaagggcagaaaaggtgcttaaaaaacccgcaccaagaaagaaaaaaaaatcattcattctttgagtatgttttcataatgcagagttgtgcattgattcatatctagtccttagtgttgtcaggtgcttgcttgagctagagttgagtctaggctaggccagcacattgactagtacttttaactattattcaactttgcattttctgattagcacaattgcgttcctttgctaatatatatcatgcctcccaagctgcacgtatatacttctggtcagcatcgctttgatccttgcaatcgccacatcacgtccttcaaggtgacatgaactagccaccggttgtaccgtccttagcattgctgataagacacttgtaagagcttgataaggtgctccatttgcctaagttgttgagaggcaccactacaccgtgtagcagagtttttatgtttgcaatgataggtatgagtggcgctcaaaatcagcgataccaacaaggtgacataatcgtgtgcccgaagatccttatgctaaggttaagtttaaaataccatctttttcaggttattatgatgctgagaaatattttgattgggagatgatagtagagaaaaaaattagtacccaccttgtgcccgagcaacatagagttcgacaagctactagtgagtttaaagagtttgcttatatttggtggactaggttagatgtatggagacctttacctactactaggaaagaacttaatgtagctatgcgtgatacatttgttcctccatcttatcttagagatttaaacaagaaactgaagcgtttagaacaaggggataaatctgtacatgattactatggtgagctacaaaagggattgaagcgatgtagcgatggagcgattgcaatctatcttgttcttgcttgtgttcttcgattcgcatgcagggattagccttctcggcgaggtcaaccgggtttctgcacggttgataactagaggagacgtggtgcttcgattgcggggctcagtagcgtgttcgttcagaagccggatcgagttgtgtcacgactccgcccaaattgactgtttatcaatacctatcggaagatcgagacctaacatccctcatcaacccacatgtcagcctataggggaaagccagtggagaagggtggtgcccctggttgggccggaacaaggtttggcaaaacagactgaccatacgtcatctccaccttccacgtggtgactcatcaaccctccctgccgatggtcacagataaaccgaccttcgcaaccgccattggatgatttaaaatggagggtgcattctccctttacaacacacactcaagaagcaatctctctattttatacttatatactctctagattagttagtttaggctttgaatagttctttgtttcctagtcgtgttggagatgcgggtatgtcttcattaatttgctctctttgtaagactatgagcttagtaatgaaattatcttctttatttaattgtgttcgttgttcatactttgtcaattgtatgacctatcattagtttatagttctttcatgaaatataaatgtttaggctagtcgatctatgccaaggcatcggtccaacaaacttaacggattgtactagttctaacttgtccatctgaagggtaggagtcagggggaattattgatattattaagcaatataaacatggtgcttagattcattaaatgccattagataccggtatgccccacggaatgtgaattagatgacaggtggtgattgccatgtccgtcttttgtattccaccacgttcggatatgacgtaagagttcgtaaaatgccttaaccacactggcaaactaacaggaagtagtatctcggtagtacttgggtgtctacaattaagttctagccatgtatatgtatatgattattgtaacgattaagcatgataaatatataagtacatattaaatcgtagctttcctttgtctttctccacttgctagtttatttatagattttaattttctgggtgccacactacccaagtatcattatttttatcacttttctctgttagactatggcatattaattatagcgtaattagaatatatcggtctatattttacactgtcgccttccatgtagaaaaacaaataaagacacccatggaatactcttaaatgaaatgctacagtgctatccacgtgcttgcagatttatctattaccgtatcaaatagcaatatgggtggaggttccgctggtgaggaggatgacaggcagtggtgtagcagggagggagagagagggagacgtaggaaggatcaagagagatgaaagagagccatggaaggacactccgtaaaaaggaaagagatgagagacaaccgagagggaccatgagagcgagccagcccgattaggtattcttaatgggcatcagtgctctttttaagaaaaagtagcattgaaatttgaccagcgtgggcctaagaaggcaagaaatggctcatagatgaacaacacatatgaggtttcacatatttggggttttgttgtagtcaacgtggtgatgaaaaatcggcgctcggccgatagtgccggaactgtgttggtacaaactaagttgacaatagcaatagcctgggatatctgcttagctccaatgtaggtcctagaattgatgagatgggggcgtgcctgtcagtttgatcctgcaactgacaagatatgtaaacaacagatcaaataaccaattggctgacaagcttatggagcaattccagctgatgccgatagggttataagcaatcaactatatttccaatgtatattatgatacttgagtaaataatgatatatagacaatcggctgataataatgtaattaagcaacaatataatctagtagaaatcaatcggctaataacgatatgatagaataagcaacgatccgaatgttaaagcatacatcggctgaaggtccgatgtcattaaatccaaacgattagataagtaatgaaacctttgttgcaatcggctaaacccaacttgtatataatctctataagccgatacaacgtccatataactcatcggctaaaaccccgatgaaacccttattggcaatcaatggcatgttagtttttatggttataagcacgactaaggtcaatgcaactaggagtttgcaaacaaacataaagtctaaacaatcaagcctttgactgatttttaagagtggtagataccttagctaatctaatctagtaaagtgatttagtcgataccgacaaaaaccctaaagtagatcccagccaatacaagtaaatcgagcaatcaaactagattaactaagatacatgataggcaggtcggcaaatatatcaatcaaaccagagcgatccaagaggtcgaagcgatgcagccttaaacagcaccaatatagttgacataattgccaggcccggtggaatgtaggacttaccccttcgccggagatccactacaggaattctgggcttctgtgacgattacattatgacgataacagcctgtttctcgtcactgcctggctgcaataacgaaatggctgtcatcacagaaggtgggtcactatccagcttctgtgaccaccagaggacatcgtcattgatactgtgacgatagttctcctgtcattgatgaatgacgagacaaattcgtcataacaaattgaaccgaataacgccacgtgtatgatgacatctaatgttactgatgacaaggcggatgatgtggcaaatgacatggcaattcacattcagcccatatagcgtgggcttttttattttcaattacaatcagcccaattggcccaaatatgtttttgacccagctacaaatttgcttttacgtttttttcactatagcccaacaatacaattctagcccatattatgggccagcccaattaaaaagcaatcacaaaatataaaccacaaccatttgcataattatattataatcacattccagccataattaattttctagcccatacaaaagcaagttccaaaatacagtttccaacatatttccatacaaaagcacaaaacatgaatacaaaatgatccatccaccatccaactacacaagtcccagctgactacaaagttcctacaggtagtgccaagttcctgcaccaaaaaattccacctagcagccactaagtttcggcggcgtgcatcttgccagtagccagcaaaaaaattccaccaagcagccgctgcacttccggcctgcatcctgccagcagtcagcaactagtgccaaaaaatcctgcgttccagcaaccaacgcaaaaaaaaatactctggccactaaaagtgccaacctgcaagcaaccaacagatatcacatttggtttttggcacatttgtcctgcacatgacgcagttacatagcataagtaatagaaccactatgcatctgtcatttccttgcaacgccattttcatttgttttcagtggtcactattacattaaaaatgcaaatagagctgatccaaacagagctataaactggattatggaataattattttaccacctgagaatatcaaatttatgttgatgtatcttaggaagctatgtggttaaataactcaggaagattacatgaattatcttatagtcaatctgaaaactgctataataaatctagaattatcagatgtagctggcatgttccaattcctcctgacagaatcaaaagatctcaaatgtacctcatatccaatatgtatatacctagccaaacatgaatttgtgctcgaatcaaagtaataagctcacacaaaatgaaatctgctaaacatcacctgcctcacctactaaacttttttaagataatggatcaagttagtggcacaaggttttgtgaacattttgattacatcactgtaggtttaaaggtaatcaagcccaatatatcattaaccaacaattcccaattacccaacaaggcagctgaaactgtgaaatacaaccataaaaaacaatatagaaacattgtgatagtctcatgatagcttaacttattcagaatgcaatcactctactgtactctggaatccaaggatatgcaacaggccgagaggctcaccacgcataactgatgctccgggaagcggatgcattcgccgcagacaggaaccttgtgcacgaagcaataaacccttgtcgcctgcaaagcaaacaaatacagccataagcatgaaattcagctggcacactcataattttgaactataactaatctttctacttgttagataaatcaaaatatttatatcctattagttacacatgttctacagctgaaattattatatggtccttttactaattcagagatgctcttgttcatattctaatggatgagaatgcaactcccaactcctacacatactagtatatgcatcacacaagaatcatgccaggatatgatttcaatttcattttaatctcctgattacctaccatgattttagagtggctgatatatggttactttctctggtcctgcagccgctcctctggacttagtttcaaggattctcctgatgagacagcttcagcctaaatcaatttgaatgtatcagtattttctgcagagtttttaagtactaatagagaacacgatactattttatcttagtcaatgcttacttaggttttcatatagtaatacgctacagcatacaggagcaaaccacccacacattgcaagaacaagtgtgcacaacatatgcatctgcagacccaaaaaaaattcttgtggaaccaatgtagagagaacacg

SEQ ID NO: 58842 - DNA, 1537 bp, Oryza sativa
aggggaggggaagaggaaagagagaggggcaagacaacctcgtacttctgcttccttgaaatctagaatcccaggtggaggttgatgtggtcaaaagggatgatggcggcgttcctcaggggagctatgtgcaggacccgggttagatggctggagggctggaggtagcgtggatgtaccagtagagggctggaggcagcgtgatcgtggatgctagggaggagaataacaaggagcaggaggaggcgggggcggcgtcgatgaccgcagaagcagccacacccacccacccctcatcctcccagtcccagatctagcgcggcggcgagctgctgcgtgctggtggtggtgggcgagagcgtagccgaatccatggcggcgctagggtttaggcgactgagcagtggttggggaatcggatcttggaagggagttgagtgcggattgcgaaggggaaccggggaatcgcttgaggggagggggaatggatggatcgctcggggtggggagagaacgggaagatgagatagcggcgcggaggccgtcttgcggtcgacgtcggaggaggccctctcactgcgcctgccctcccgccggatctggcggaggggagggcgtggttgccgctgccgcctttgctggccagccgccgaccgtgggcaggcgccatgagacggcttgagaaaagggagggagagagacagcgagagagagagagagagagagcgttgggagagagccgcgagaggtcgagaggggaggggctcggctgaggtggtgggaatggaggtgcagttcccggccgttcccggagaaggacgacgacggcgtggtaggcggcggcgtgagtgtggggaaagagaaggtgaaggagatggtgatgagcagcggcggccgcggcggcgggtgggaggaggaggaggaggaggaggaaggggacggtggtggcggcggagtggatactgtggatggagtttaggctagggtttggagaacaaggtatatatggataagaagcattccgacgcgaatttaccaaactgtccctggtgtgttctcagtagttacaaaattgtatggtcaaaatgggcatttcaccttaaattaatgagaactttaaatttaattttaggctgatttttatgtttcaaatgcaaaaatcataaacaataaaattgtaggactcatcgagatctacaactattgtattgctcctttttacaaataagttcatttgaacaattcaaattttgaattttcaaaatttgacaacttcaaacaaaaattgggttaataaatgatttcaaatggaaaagttgtcagaaccaaagttgtagaactcatcgagatgcaaaatttttattttggtcatttctccgtctgactctatttgaatagtttgaaatttaaaattcaaagtttgagaacttcaaatagaattttttattagtgaacgacttcaacttaaaaagtcatcaacaacaaatttgtataatccatctagatctataatttttattttggtgggctgcaggaa

SEQ ID NO: 58843 - DNA, 8916 bp, Oryza sativa
tgcataggataacaaaggatggcatagtatagcttatgtgcataaacaacatttaataaacatttgaaagaatagtaaaacagttgagtaattaagcaatattaaataaacactatacaacacacccgtgttgcataggcccaaccttatctgaacaaccaaccccggtgtacaaatcaaacctcataccaagaatataccattccaaaccaggagtcaaattaattatcacagtattatcattaatgagtagtgtgagactaatcacgaaaaacaatcttagacctacccataaccgcgggcatggctattcgaatagttttactctggccagatatgtacaagtaccactgtacccacaagacacagctccacgacatgtaaccatgcgcctcaataccaccacgttacctcggaaaggaactgtgacaatacccctcgcacaacacaactcaccacagtgcaccatacctggatcacaatcaccccctctacaaccagaggcatggactccccagcgacccccacggacttctcaccgcttctcagtctggcacactgtaatgaaccatgctatacaaaagataaagccgtagcccacgctatacaaaagataaagccgtagcccacgctggcttgtggttggcatggtaaatgtttcacaatagtagctcgcgaaccggtccttaattgtcatgagcacgaccatcaaaaccatgtgctgacaacccacctttaatcaggttttaattattaattaattatcataacacgattaaccatcgtgagctaccattaaatctaaccataagtaactagtaatttgcccgtgctaacgctacggagaatgcaaattaaacaaccaaaaagatgatattatttgtgatcattggtttacataaattttgtgttgaagcataaatttgtagatacaaatattgaaacatccgccatcagcttgctgatcttcacatgattctatagatttttccacatcgttatgaattctgtagattccgagatgaatcatattgtaagattcaaacaactttgcataagaaaacagcacaaaattgtatagttatcaatctccatttttattaatctggcattaaacatgtacatgctgcaaaatgttctgctcattcaggtataacttagcaagtagaaacaattagttcacattacttatcagattatttccagaacaattgcaagcaagcagcaagccgcaacatcattgaagtgcatggcatccctgcagctccacttccatcttgtcctgaaagttaaatatgatgtcatcagaaatagcaaaagcacattctttagcacatctatatttaacattttagactgatatgtccggagcggtaaggaaatgatatataggaataatttgctgtatgaaataggcttcattgctacagaaacaccagaattaaattccattcaacagtgcgtatatgtaaatttgagcatggagaaatgcataacttgtccctataatgcacaagtaacaagaatcacctcagaaatgtagaactggcctctatcgtgaaggcttccgcagcctcccctattcagtaaaattaagcattttagtattgatcaatcgcctaactaacacaattcataagcccaatctatttttagatacctattatacttgccaaatttcataaatcagtataacgtagtcagataaaaaaaatgcaaatagacatggtacataccatttaccacataaacatactggagcgaagttactatacactgcaacaactacatgtatctcaatcccatgatacgaccactgatcagcaccttaatcttggaataccgccaatttgagtgtagatgtatgtcaacctagttttcccaaattgatccgtacttatatattgtccatgcttatcttacatgtggaatatttctgtaagaaacaatcaaaatctgccatatatataatccctctaacatgaatgaaaataacagaatgacaataaaaagcactatttagcctagtattaactacagaaagcaacagcctagtgaatacaaacctgaaagtcattaagctccacatcactgtgtgcttccctgtcatggtcacatagactaaatatctgctacaaagccctcacaaaccgtcgctttagagattgtgcctcttataaaacaatggagctattgggttaagcataaccttttcagcatagtagaagacctccggaacctgcaaatatccataaattatattatatagttaatccaagccttgcacaatatctggaattctatctcagggaaggcactggttaaaattatcaagtgcatagtacagtagatgtttgatcaggttacacaaaaaattatcaaggcagatatgggcaatacacgtagtacattgttagagatggacagcactgtgttctcaaactgagcatcaggaaaattagtgatccaaatttattactaaagccctgaaaatcaagtattaattccataagactacagagcatttcatcaagctgtagcaatcaagttgtgtacatcaaaatagcaggcaatgcaattaaccatgcataaatgcaacagtgggatttagcttgcacaacaacatgtatcttccatcacagtatcaacacagagtcaggaatgaaaaaaatgggatttaacttgcacaaccaaatcattatagcttcatgtgccaactctttccccttagccttctatgtaacacatgattggaaatatgtgtaaatagaaaaaaaaaatgtcttataccaaggaattttagtgcaagtattttttttacaaaaatgtggagtaggaagcattcctttccttccaaatcacagaaaaaatatacactctcctgctgaggattttatacatgaaggaatacaaaggaatgttagaaatattaacaaatataatgccgagttgatgccaggagtgtatcgatcttagaactgctttgatatatcgggttcccacccacctagtacgcgacaactgtttagaaattagaagagtatcaaggtttgacatccaccgagaattttgaaaacaaattacaattacagttgatagaaaatattagcctacaggatatcaattattaactattcactcttgagagtagttcaaaaaatatttgcttaatctcctgtcttagcactttgtcgagcacttggccggcagaatgtactcaagcaattcatcaagtcctgcaaggaagaatcaagcaattcgtgaagcacgtaccaataatcaaggcggcccggcccgttgccgatcacgatcatgtcctgcacgatgtcatcccattggtcccgtggccgcccgtcaccaccaaccaatgacctgggcgaagcaactgagggcgtcgagcagcaggtgttcggggacgaacgccgccaccaccaagcacgccgccgcagcacggccgccccgggtcttcgcccgacaccgcccaagcacacgggcgtccgacggcgcccagccagccgccagcctcaccgctagccacgccggctcttcggccggtgtcatcaaccgctgccacccgcgtcccaccagccagccacgccatcgcccgcgtctcccgtcggccgtctctcccgccaaacgccgccgtcctcacgacacctgccgccgtcgtccgctccgtcagctcaccggccagatccggtggtgacgggccggatccagccacggaagggccggatccgacagcggcggcggcggatccgcagccacgcgccgcgccgctgcgaggccttcccggcgcactgtgccgcctcctcgcgccggagacgggccgtcgccgccatcccagcgtccacgcggtttccggcggcggcgaggcggtgagaggaggggagggtggcggcggccgggggctcgcccgcacgtggacgaccgaaggcgcgtgaagcaaaatttcagtgttccttcatacaagaatgtctcggtcgtcttctttgcctgcaggcgtcggcgtcggcctccttgttcttcttattcctccttcgcgtcagcagtagggtctcgacagtcgacggcggggcgaggagatcatggcgaaactggggtgggggtgaggtaggcgcggatgcggtgcggggagaggcggatctgggagggaggtgagagaggcgcagatgcgcaaatccagtggtgccgtcggatgtaatttgtcgtatgattttgcaccgttggatatgtgatatgataaatgatgaatgagtaaaaccatttgttgaactatatggtagataatgtaatatgattcatcccattaatgagctaatgtttctaagcatggctaagcaattatatataaagcatttagttgaaccaaaccaatatataaagttcaagctaatcaatttattacccataggaaaataaagtcatctttggccattaattaattgggaaaggcccaccacccgatgacattcaaaattaatgcataagttgaaataaaacattaactttaaacaagttcaacatgctcaaagggttgtttgggatctgtgtgactttccttgagcttcttcaaatgcttttgaaccttcctcaacgtaaacgctctcctccggaacgtcggaaactaaagcaaataaacaaaatcaacaaaacagtaaaaaacaagcataaacagtatatgtggatatttttaacatgtagatctcgattttagatgaatttagcaactcgaaccacttgaatctgagttacgatgatttagttatgaatttctgaagtttaatcagattttcatctaatacagaaaattattactatttaaataaaggatttatgatgtcaggatgacatcatcgtagccatggcactggaccacgactccgccagcgatagagagctcgggcgactaaaccgaaggcacctacacaaagaggacgacgagacgaactcaccgaagcaaagaactacgacaaacgacggcgaacgaagaccgacgacgaacttgacggcggcacggctcggctcgatgttgacggcgacgctccggcgaattgcagcagcggcgaaggagcggacgggacgctcctccacctggcgaacctgacggtggcgacggaaagcggcagcgacgaccacagcggcaacgcggcgcggccgaagcggctacggcggcgacggcactagggtttacgcggtggcagcggcgctataggcgacggctgcagcttggacttgaggcaaacggaagaggacgactaggggatgctttaaataggcatggttgagggagatcggactccaatcgagaggatttgagccggaaaaatccgatggttagtttggagagataaactcgaaaacgaatccaaattcgcatcgaactcaaagggataagatcggatttttgggggaagggagagaagaggataagggaaacaaatccactcaactaattttagaaatgcacgagaggaaaggccagatttggaggggaaaaaccgagccaattcggcctcaggtcggctgcctgaggtttgaagaagaacagtgcacagggaagcaaagtaaactttcagtcttgggccggctgaaaataaaatagagaaagaaagagaagggggaagctcggctgtgctaactgggctgcacaaccgtgctcccaaaggagggagatgggctagaatcagtccaacggcttaggggaagattaaaaactttttcaattaaaataattcgtaaaatgatgtttcatttattaaaaatactttccttgctcaaataattcacagaaaaatctagaaaatagataaacaagcaaagtatttaatgaaattttatctaactcagttttatgttgctatttttcctagattattagagtttaacttgtaagcctttaaaataatttctaaaaatgtgttacagaatgaattattaaattaggcgattttcagggcgtgacaagcctacccctcttaaacggaatctcgtcctcgagattcagaagaactagcaaaaagatgagaatgagctgacttcaattcatcttctcgctcccaagtggcttcttcttctgaatgattgctccactgaaccttacagaaccgtatgatgcgattcctggtgtttctcttattcaccacaagaattcggactggcttctcaacataagttaaatctttttgaagctctatatgctcaggatctgcttcctccgtaggtacacgcaaacatttcttcaactgcgacacatggaacacgtcatgtattcccgccattgacggaggcaactctagttgataagctacttcacctctccgactcacaatcttaaaaggtcccacaaatcgcggtgccaatttccctttggtctgaaaacgatgaactccccgcagcagcgtaacccgtaggtatacataatctccttcttcgaaagtcaaatccctacgacgattgtctgcatagctcttctaacgtgactgggcaatacgcaacctttcttggataatcttcactttttcttctgcctctcgcaatatatctgtcccaaaaacttgacgctcaccggtttgatcccaaatggagcggtgtacgacactttcgaccatacaatgcttcatatggagccatttgaagactagcttgataactgttgatataaccgaattcggcgtacggcatattcttatcccaacttccaccgaaatctagaacacaggctctcaacatgtcttctaaaatttgattcactctttttgtctggccatcagtttgagggtgataagtagtactgaaattcaaacgagtacgcatctcttcttgtagtttccgccaaaacatcgaagtaaactgactacctctgtctgacactattttcttgggaacaccatgtaaacatacaactcttgccatatataactctgcaagcttatttcccgagtaggttgttttgacaggtataaaatgagcaactttagtaagcctatcaaccactacccaaatagaatcttgtcctgccgacgttctgggtagaccggtgatataatccattcctatttcctcccatttccactctagaatcttcaacggttgcagctgacaggctggcttctgatgctccgccttgactcgctgacacacatcacatagagccacatattccgctatctctcatcgcatgctagcccaccagaattgttgcttcaggtcttgatacatcttagtgctcccaggatgaatggaatacaaagtttcatgagcttctttcatgatagttgttaacagtgaaatttggtaatcgcaaagacgtcatcggcttagaatcattatcggttgtagcatctcggaatcagccgatgggagttatcaagtcgccaataatcggattcctgctatattggttaaggaaatcaatctactaaaggaagcttatccctaagtgaccgagtttagagaggatgcggcatggcagtttatatattaattaggaatagtttgttagtttccttttatctttaggaaagtgtgtttagtgtccgataaggacttcatattttccttttatctttaggtgagtttctttcttgtccgacaaggacttgtatcaacccatggttataaatatgtacacccggggtctatgtaatctatctctacgatcaatacaattcggctcatcgccaccctttttacttctacttttgttttttacgttccggcggaacttggcacccgacgcggggctgcatcgtcttcgatctccggcgaagggataagtccaatgttccgtcggcccaggcaattgtctcatctacgtcggcgtcgttcaaggctgcatcagtatattcgacctcttggattgctctggtttgaatgatatatttgtctacctatttattatatgtctctgttaatctagtcttagcatatcaatttagctctatcggctgcttctcgttttagggtttctgccggtatcggctaaatcgcgttgctagattagattagcttagatatctaccaccctgaaaatcagtcaacggcttgattgtctagatattgtgtttcttttcatacttagtgctgcatcagttaagtttgatctactaagtcgtgcttagaaccataatctctagcctgcttcttgattgccaataggggttgggtttcagccgatgagttatctggatgttgcatcggctcataaggatttcatatacatataagttggatttagccgatgacaacaaaagtttcattgtttaatctaatcttgtggatttcatggcatcggaccaccagccgatgtgtgctttaaccttcggatcgatgcttatctatcatataaatgctagccgattggtttatactggactatattattgttatattttattatcagtagccgattgcctttatatcatcatctacattggacatatagccgattgcttaaaccctatcgctatcggctggtatcggcatcggctattatcggctatcggctggaactactccatcggcttgtcagccgatcggcttgtcagccgatcggctgttttgatctactatttgcatatcttgtcagttgcaggatcaaactgactagcacgcccgcatctcatcaatctttggacttgcactggagctaagcagatctcccaggccggtgtgttcgattttttttcgtcaacaatagtatccttcaactccttattatcgggcacgcaaattctttctcctagccacacagttccttgctcatcttctatataaccgatggtttttcctcttctcatgttcttttcaatttcttagatatcaagatcattcacttgagcctctctaacttgatcaaaaagagtaggttgagcttctaaagcggcaacaaaacctttattgactattcccaag

SEQ ID NO: 58844 - DNA, 15305 bp, Oryza sativa
  unsure (1)..(15305): unsure at all n locations
ctgacatatggcagtagcttttcctgctgagagcatctgctacaacatttgctttacctggatgataatgaatttccatgtcataatccttgatcaactctaaccatcttcgttgacgcatgttcagattaggttgagtgaaaatgtactttaaacatttatgatccgtatacatctccgtacggttatcaaaaaggtaatgacgccaaatcttcaattcatgaaccacagctgccaactctacatcatgtgttggatagttattctcatgagggcgtaactgcctagatgtataggcaaccaccttcccatcttgcatcaaaacacaacccaaaccatgtctagatgcatcacaatacacctgaaaacctttccttggatcaggcaagactaacattggcgcagtcactagccttttcttcaattcttgaaaactctgctcacactcttccgtccacttatacttcacatccttctgaagcagtcgagacattggtctagcgatctttgagaagttctcaataaacctgcggtagtaccccgcagaccaaggaaactacgaatctctgagaccatcttaggttgcttccaatttagcactcactccacattgcttggatccacgacaactcctccagctgagatgacatgactaaggaacttcacttcgggcaaccaaattcacatttactaaacttggcatagagctgatgctcacgtagtttctctaaagcaagacgaagatgctcttcatgctcttcttttgtcttggagtaaataaggatgtcatcaataaacaccacgacaaacttatctagatattccataaacacgttgttcatcaagttcatgaaataggccggggcattagtgagtccaaacgacataacggtactttcaaacaaaccataccgtgttgtaaaggcgatctttggtatatcctcctcacggattcaaagttggtgatatccggaacaaagatctttcttggagaagactgtagcaccttccaattgatcaaacaagtcatcaatcctaggtagaggatacttattcttgatagtgacctcattcaacgctcgataatccacacacattctttgggtatgatctttcttctccacaaagatgactggtgctccccacggcgaagtactgggtctgatatatcctttctgaagcaaatcatccacctgtctctttacctctgctaactcaatagctgccattctgtaaggtctcttatggatagggttggttccaggtactaagtttatccggaactctatgtctctcttaggtggcatacctggcaaatcctctgggaacacatctggatagtcttgtactattgggatctcttgcaaagcaacttgatttaatgtcaaaccatgagatctaggggaggacacaaagaaagacactgtttacccattgctacttgttaaagtcaccttacggttagcacaatctataactcctctgtgatgggttagccaatccacccctaagataacatcaagatctttggattctagcaagataagtgtgatgggaaaggaatttcttgtatttctgtagtaatggaaggacagtactgcgttgaggatacttgattgcctggggtattaactagtaaaggcctcccaagactaataacttccattccatgattgctcgcaaaacttttagacaaaaaggaatgtgtagcaccgaaatcaaaaagcacagttgcgggtatagagttaacaggaaacgtacccaaaaccacatcaggtgcattctaggcttctgcagctgcaacgtgattaacacgagccttcggtgctggagcattggagttgttctggacaggagcattcttcacacgccgaggctttggacacttatcagcataatgtcctggatcaccacaattgaagcacacccctggcttgattccctgttccttcctgacaggctgattttgagttggagctgctacaggacgagtgaccacattacgattgtcgttgctgtgattaccagtgttgttgttgtagaactggcgttgagggcgagcaactgaagaggatcctccctatgggtatggtgcagcttgaggtcccaaagcaatgcgcggcctctggctattaccctattgagccttgaaataagcagccctacgcttcttctgttccatcctattgtacttgtcttcttggcgaatcgccttgtccaccaactgctggaaattccggtattctatagccatcaatgcataagacaactcatcattcagtccctctaaaaacttctcctgacgttcttcatcagtgcgaacatcatctgggacataatgagctaggcgattaaagtcatggaggtactctgtgacagaacaggatccctgattgagtgctctgaaatctctcttcttaagtgccacaacacctgatggtatatgtgtcttcttgaaagtagcagtaaactcccgccaagtgataggctctcccgcagctctgtgtttgacaaaagtgatcccaccactcagcagcaggaccatgcaactgatgcaaagcaaaggaaaccttctcctactcggtgcgcagaatcaaatctaacttcttttcaacagcatgcagccaatcacctgcctctactgggttagtggtgcttgagaaggtaggtggtctcacacgtagaaaatctgccaacttgttctttggaggtggtggttgattgttgttatttgcctgctggttctgcgcttgctgcactagtagattaatcaactgagtttgctgagccgaaacttgggcaagtgtgggatctccttcattgtgaccacttccacttccagtgccggtgttcaccatctgaagaaaagcacgggcaaaaggaaagattacatttaagtatgattacatttaagttgaattaacactatctcactagctaacttactctttgacaagcaaaagaactaaactcatgtagttacatcccaccaatgatgtaagcaacacgcaaaacccacacacgcacaagcaaactaacacatcgaactatggcaacggtctaactaggcaactaatcccgccttgcatcggaacgaagagatggatcttcttcctctggagtagctggctctctttcttctgggtcttcctcctcttcatcattacttaagacatggatgataggttcagcatgatcaggcacaacatctcccaccacacgagtcttcgaagccaactggatacgaggtggtggacgggttctcttccttgcggtgaggcgaagtttgggtgctggcggtggtgcttctcccttaagctcggccagttccttctgcagacggtacaccttgctctccaacttgcaaatcctgccacggttccagttttccctgtcatcagctgttttctcccgctccacgcctactgcatccatggcgctaagcatatacacagcatgcttcagagtggtgctatcttcatcttcagggcagtggtaaactccatagtcttgaccatgaggcttgtgtggatgatactggaaagctgatgactctaactcctcatcaaagcgatgacgtagctctccaatggccaccaaggctacctcctgacaagcatgactatactttcttcccccagcttcaaactttatcgacagaaggtcttctcgatcactagtcaacgtcacgcgaacacgacacttctcctcgttggggtcatagggaatctggcgatactcaggggcaacgtcgtagcctacttcaaatgccatcattctcagctccctgacgaatcctaccgcattgatcaagctttccggcggatggggcggcgtctaaaggagcacagaaagaaggaattaatgcatatatttaagttagctgcacaaactagacttaattaatttgacccaaaaagaaaaataaaagaaaaggagcaaacagaactaatttttttatttttttaattaaatttcgaatttttcttatctggccgaaacataaatttttagaaaccaattcgttttattttttcagaatttttttcgaaaatttttatttatacaggggcatagactttggaactaaacaaaaagaagcaaatatattttcttcctgtacagtactcgtgggaacagaattaaacaaagttttgtttggaaaatgaaatcaactttggacagacacaaattgctttacacaaatgaataaaataaaactaaaatacttagtatctaccataagaacggtacagtgtcaccattatatattttcttcctgtacagtactcgtgggaacagaattaaacaaagttttatttggaaaatgaaatcaattttggacagagacaaattgctttagacaaatgaagaaaataaaactaaaatacttagtatctaccataagaacggtacagtctcaccattaacaaggatgagtagtactggtgctatcttgattgaatcgataccataatagatgataatagatgtacagtgccggctaaccaatgaaattcataaaatcaaactacttaacaccatgaacagtaaagttttttttttaaaaaagaaaagaacaggtttctgttttggtaaagtaggatttagtaaattttgtacataaccttgcatgtgctgcaaacttaattaatttataagagaatagagaaaagcagtcctatttttcaaaaaattttgaaggctacttaaggtttaccatttggcttgtcctaaggtcaaggtggctctggtaccaacttgtcacgcccgaaatttctatccaaaattccaaacgcttacatgtgcttaaatcctcgtccaggaatcagccgaggcacacaataacaaattgataatagagtactatcaaactactaattaatattcgcaaaataataaattattacagagatggatagttcctctcaaaagaataaaattctacgcagcgaaaaaacacaataacaaattgataatagagtactatcaaactactaattaatatttgcaaaataataaattattacagaggtggatagttcctctcaaaagaataaaattctacgcagcgaaaaaaaaacaaaagactaaacagctatggcgactccactccgcaagcaacttgacccaaacaaagcctactcctcctgatcatcaccttcactgaagtactcctcctctgaagaatgaatattgcaagaatgagcatatgacatactcaacaagccacacagcaaatatgcaactgcacaggatagcaaaggatggcataataaagctcatttgcacaaacaacacttaacaaatatttgagagaatagtcaaacagttaaataattaagcaatattaaataaacactatacaacacacccgtgttgcataggcccaacctcatctgaacaaccaaccccggttgtacaaatccaacctccataccaggaatataccattccaaaccaggagtcaatttaattatcacaggttatcaccaataatgagtaatgtgagactaatcacgaaaaacattgttagacccgcccataaccgccggcacggctattcgaatagttttactctggctagagatgtaccactgtacccacaaggcacagctccacaacatgtcaccatgcgcctcaataccatcacggtacctcggaaaggaactgtgataataccccttgcacaacacaactcaccatagtgcaccatacctggatcatcatcaacccctctacaaccagaggcatggactccctagcgaccccatggacttctcgccgcttctcagtctggcaccccgtaatgaaccatgctatacaaaaggtaaagccgttgcccacgctggcttgtggttggcacggtaaatgtttcacaatagtagctcgcgaaccggtccttaattgtcatgagcacgaccatccaaaccatgtgctcacaacccacctttaatcaggttttaattatcaagtaattattgtcgcgtcccaaaacgactctaaaatacatcctcaaaattgtgccgagaataattaaaatccatgtgaaagcctccaacaattaaaatgtgcaaatttaaaagtcaaataaggcttggaggatttttgtatatttcctaaaagcctaaaatgtgtaaataaattttagtggaattttcagagcacaaataataattgagaagaaataaacaaagttaaaaaggttttataaaaagaaaaaccctaaaagtcttcttttcccccccttcccttcttgggccggctcggcccagttctctccccccctctcctctcccccgcggcccatcggctctcccccgcgcgcgcgccgctgacgggcgggcccgcccgccaccctcgctgacaggtggggcccacccgtcatcccctacctcgcgccgcagccgccgccccgcccgtgccctagcgccgccgccgccgcggattccgccgcatcccgccgtccccgcgcgccataaagagggggaaatcactccccgtgattccctccctcttttccccctctttcccctctctctctccctcggattcgtccggattcactcccgcgatcttcgccgacgcatcaatggcggccgagatttccgcggccgattccttcccctccggccgctctctccctctcccggcgctatataatcgttccccgtgcttcgctcctccgtttccgccactcgccgcctctcctccccgtcggaatcgagcccgcgccgtcgcaccttctctccgccgtcgccgccgagctccggtcagccgccgtcgtcgctccggaccgtctcccgccccgacgccgcccccttcggcttcgccgcgtcctcgccgacctcgtccgctcctccgtttcgcccgccgaccgccggagcgccgtcgtcctcgtcgacccgagccgcgccgccgccttcctccgctccggtcgtcgtttccgccgccctcgtcgtcccggggtgagccgtggaccgcccctttcgcttcccccttccctcctctctctcgggtgccgctccgccgcgccgttggtcgccggcggcgaccatcggggcgcgggtgcgccgcctcctgtcggccgtgccggcgaggccgccttcgggcgcgccccgcggctgccaggtgggcccggccgtcagccgcccgcgcccgcgggtgcggctgacgcgtgggacccacggcgccgaccggcgccagccgcgtgcacccggtccaccgtggaccgttcggctgacgcaataaatccgatttttaattaaaatttaaatgaagaaattcgcaaatatccatttaaagagcatataaacttcaaatggccataacttggccatttgaactcggaattggaccgttcaagtctctaatttttccttataaagccaagaacccatttttgtgctttgtttctgctgttatatggagtttattagagtaaaagccttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcgttatcactgttttatttagccatgcctatttacctttgttatgaccctatgattgttattgttattattaccttgttcaccctagaataaacaaaacctcaactagtggacactctactcatggcatcactagtttaattttaggtagatgcttcgcaatttaattaggtaacattaggtggtttttcaattttagactttgggaaatattcatatcacctggatactctggaatggtctggttattgtggaattggcttcacaccgctccctcttttcaaaacccccaaaatggttttaggctgggctcggggtgcatggttttgatagtagcacctcggccatataaggaccggtcttcgggcctctgttgcaaagcactaccgtacttccacatgtctagtgggtaaggcttagtttatggctcagtctggttataaacaaaagtacacagattggagatggatgaagtcgggggtcgatggacattctccagggcaaatgaaggctacacgagctgcggcccggtagtcgagatgtcatggcacagggccggtgtcctgttgctgggggctcagtcctgcctgcctatcccgggggttccggccgtaggtgggattgggtcggtactcttgtctatggctaggatgggttggaaactatgtcacgtcttccgtctgtataccgtggtggtatgtggcacgtggctacacgtgaggaagatgtgtcttgtgggtaaagatgtacacctctgatcagagtataatctattcgaatagccgcgccctcggttatgggcaagccgagcaatgtacccaagttagtgttttaattcttaaaacttgcttatcaactaaaatgtggaatggttggcctcggttggcttgggacgagctgggacccagggtcgggttgccagttcggtctgaatcatcgtaggccttgggttaaggcaggtccgtgtgggttcacggccttgattaataacattgtatagttctagaatcgtgtttacaaaatagctttggagcaactaaatatctttaaatgctgtttactgcaaccctaaccctctatagtataattcccttgtactcccttgcatttattctgcacttgcgggtgtgtcttgttgagtacggtggttgtactcagtcttgctcaatttttcccaaccccagaagaggagttccttgaagatgaaggctttggtgtctagctcgtgcctgccgtcaagcgcctgtggtcgtcgccctagtcttccgctgtttcccgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtcaggaacgcccgttgggttatttccggtcgtgacaattatcatagtacgattaaccatcatgagctaccagtaaaaataaccataaataataatgtagtatgattcatcccattaatgagctaatgtttctaagcatggctaagcaattatatataaagcatttagctgaaccaagtcaatatataaggtccaagctaatcaatttattacccataggaaaataaagtcatcttcggccattaattaattgggaacggctcaccacccgatgacattcgaaaataatgcataagttgaaataaaacattagatttaaacgggttcaacatgcaaaaatggttgtttgggatctgtgtgacttgccttgagcttcttcaaatgcttctaaaccttcctcaacgtaaacgctctacttcagaacgtcggaaactaaagcaaatgaacaaaatcaacaaaacagtacaaaacaagcttaaacagtacatgaggatatttttaacatgtagatctcgactttagatgaatttagcaacttgaaccacttgaatccgacttacgatgatttagatatggatttccgaagtttaatcagattttcatctaatacagaaaattattacaatttaaataaaggatttatgatgtctggataacatcatcgcagccatggcactgaaccacaactccgccggtgatagagagctcgggcgacgaaaccgaaggcacctacacgaagaggacgacgagacgaactcaccgaagacaagaactacgacgaatgacggcgaacgaagaccgacgacgaacttgacgacggcacggctcggctctatgtcgacggcgattctccggcggattgcagcagcagcgaaggggcggacgggatgctcctccacctggcgaacccggcggtggtgacggaaggcagcggcgacgaccacagcggtggcgcaaagcggctgaagcgtctacggcggcgacggcgctagggtttacgcggcggcggcgccataggcgacggctgtggcttggacttgaggcaaatggaagaggacgactagggaatgctatatataggcatgggtgagggagatcggtctccaaacgaaaggatttgagccggaaaatccgatggttagtttggagagataaactcgaaaacgaatccaaattcgcatcgaactcaaagggataaaatcggatttttgggggaagggatagaagaggataagggaaacaaatcccctcaactaattctagaaatgcacgagacgaaaggccggatttggagggggaaaaccgagccaattcggtctcaggtcggctggcagagcttgaagaagtacagtgcacagggaagcaaagtagactttcagcaataggccggactgagaaaaggcagctcagctgggctgactgggctgcacagccgtgcacacaaagaagggagatttaaaaactttttcagttaaaataatttgtgaaatgatgtttcatttattaaaaatacttcccttgctcaaataattcccagaaaattccaggaaacagataaacaagcaaagtatttaatgaaattttatctagcttaattttatgttgcactttttcctagattattacagtttaacttgtaagcttttaaaataatttctaaaaaagtattaaagaatgaattattaaattaagcgactttcagggcgtgacaaactcggatatgccaaacacaacatactgtgaggctagcaccagggtctgaccagctggagggtaagactccaaaagagattgctaaatacaagaagggcttgcacaaggagaaattgattattgtcgcacagaacattggacgaggcttcttgcactttcaaaacaagagagtcgtcatggctgcttataattttaagtaagtctggtacatttatcttgtacacatatatcttattttagctggtactaactaactatactgttgttaatatgtagcgatcaattatatctgtttactcatccaccctaaagacggaaccgtggtagtcttggaccctctcgattacggtcacaagcaatacaaagaatttctagcaatcttacggtagtaagtgattatgactcttgcatttttatatgaatgtattataaataaatatcctccttaatgtgaaacggtacgacatccatacaatgcgtaccaatactacaagttcaagggtggagaatagacccgaacaagggagaagctgctagcacgtaccttttggccggtaatactccactcacttaatgttttccaattgttttactaattgcaaattttaactattcttttctatgatatgtcctgaagagtcacaagtaaccgcgaggaatggtcctttgcgggtattatgtgtgtgaatttcttagggttaatgggaggtacaagattaacgcggaggatgtaagtctctatactatgtactagacagcttcacatatttatgatactaatatattgattaacttcaatgcatgcagttgccaagattagaacgtcgaacaagctttgacgatacagacatcacaaatgtccagcgtgatctgtgccatttcatccaccatgagtgctgtcatgtgaaaggagatttcttcgacccagagggtgccctagcgacaagtgacgaattcaaggatctttgggagtggaacactgctatgccataatgtaactagacggcgttatttgaagtgacaatgtaaaaaaatattgtaatatatatatatatatatatatatatatatattggcaacactttagatttctcagtactataccaaatgctcgataatcttctaatatatgtacataataatctacctagaagaatttctattaatgggcaaattattattaaattttaatattttctacctattttcgcaggcggattttttttttgcaggcggccgattcctattttcacaggcggaccggacaagccaacgtccacctgcgaaaattatcttcgcaggtggacggccgccctgtctgcgaatatcggcgatcttcttcacagtcgttggcttataggcggacggctgccccacctgcgaagaccgttttggcccgcttgcgataatgcttttcctagtagtgggcagccccatgcacggccaccttgaagttgtcgtgctcatctaagctgtcgatgtgctcctgcgccgtcttcacaaaatcgctcaccacgccgcctccaaagtgcctagccaatacatcctcgtgtggcgcgcacaatgctctcgccgcgaacgccgccttgttctttgactgggaggagctgctgcgctgctgcccggcatggtcacgaagagctcccgatacacaatctcgaaggagccctcggcgctgactgcctccaccacctcctctgagcaaggctcgtaaatgggcagattgaacatctcgagcttctccttgtcaaccattccctgattagacatgtatcgtaccattacatcgaaatgaaatatggagatcatggaggtacctctattttttaacgttgttcatagtcatatgaaaatatatataagtcatgtctaaaatatttttatgataaaaaagtcaaatatttttaatatattttttttaaaaaaataaaacgaatgatcacatattattttacctgagctgccattttattgaggatgatggagatgtgatcccacatacgtgtgtctccgcttctgaggttgtctatacatttcctcccttttacggagattaccagccatcctcccgggatgatctccttgcctcgtgactcgagaaacaatgtgaagtcgttcataaactgtagagcgtatgcgtcacatacttccggtgaacatattttgcccgcacatatgccctccttgtttgtcagcttgccgatatgcacttcttcagggacctaaatcagtaatcacgattaatttcaagaataagtttctctgaaatcattgtttcttctgtgacagtaattaagtctctgaatatcctgaggacggcaacaaatgtgttaggaacgactcctaacttaataccatctgcgttacaaaaataattgacattttggggatagcaaaatggtcaccaggatactattttgattattagttactcgtaaaaagattattgttggcatcgaaaatcatttcagcaccaacatatagagatcatatagctcccttctgtaagcgtcacaccaagaagtgtaaaatcaaatgtgtttttgattattattctgtgatgaacaattgggcattggagattattggttttgttatttgtaatttattcacgaagtggttttggagatgattggatttcacaggtgaatatacaggaactgctgtggttttatgtggaccggtcagaccgggctctggtagccggtcagaccggcgtgtaatgcacggtcagaccggcgcagcccgtggtctgaccggccgatactgtgttggtttcggtttcgggttgtttatttggatatccgagtttatttcatgattatgacttctggatggatactatacgtatgtaatactattgtttgctgctaatgagtcaagttggagatagcttggtctcggaatatggtttctttgtttgttccatgtgtaggttactcgatgtctcgggagagtatttgcggtgatggaccgggagtcggcttggggataagacgacgtccgtggtggtcagagatcatgcggaatacttaggctagagttgttgcacgtggttgatggagattccatatggcatacgatggaggaattgtgtgcgtatgggatgcggagtcgaatttggaaggagtccaaatttggtacgtttggttatgtaaagtttatttcttcgatttgtgtttcaccgggtttcggcggtctaaccggcggcgcaccggcggtcagaccggcagcgcaccggcggtcagaccggcggcatctcggcggttcgaccggcgggcacacggcggtcagaccggtggctacaggagtcagcaacaggcattttcggcggttcgaccgatcgatctacatcggtcagaccgacgttcatcaggcggtcagaccggcgcaactacttcggttagaccgtgatccatcgatttcgagggtaacttttattttcgctaaaagtttttgatttttgggtataccaaccattcacccccctctggttggcttagttcctgtgattcgatcctacaagtggtatcagagcctcgttttcttctttggatttttatcgatctaaagtttttttgccatggctactcccgctaggttttcaactaagcctcatgttttcgatggaacggatttttcttattggtgtagtaggatgcaatcttacattatgtctgaaaattatgatatttggaggaaagtttctcatccttatgtgattcctgaagccattaatactgatgctttaaaaactgaatttgaaaataattgcaaagctcgtaatattcttttgagtgggatttctcgttctgaatatgatcgtgttgcacatcttgaaactgctcatgagatttggaatgctttgagaaattttcatcaaggaacaaataacattaaagagcttcgtcgagatctttttaaaaaggagtacattaaatttgagatgaaatctggaaaggctttggataactatctttctagatttaataaaattttgagtgatcttagatctgttgattcttcttatgatgttaattatccacaatctgagatttctcgtcactttttgaatggtctcgacatgtctatttgggagatgaaagttacatctattgaggagtctgttaatatgtctactttgactttggattcactttatactaaattgaaaacacatgagatgaatattctttctcgcaaagttgattctaaatcgagtgttttggtttcttcttcttcttctttgattgttgatgcttcttcatctatgccttcttttcttgctgcttttaatgccacatccgattatcaactcgaacaaatcgaggaggaggatttggctttggttgctaacagaattgctcgagctatgaataatgtcaggaacaggaaaagaggtggtccaaatcgttgctttgaatgtggttcaattgattatcttcgttcgcattgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58845 - DNA, 1614 bp, Oryza sativa
aaaatctgttaggggctttctgtggcatggatggtgattctatacttcattgatgcacagaacaacacacttatactcttaatgttgatggtggagtcattgtggctatactttctgttgtcgccatattttatacagcattgttctaagtcatgaactcatgaaatcatgatccctagagctgcacattttcctctgaagtattcaggtagcctagccagttgtatataaaggacattaactacatagcacttctatcaagccattgcgctgtatatgtgcttaaaggttcgattaattgggctaactgctgaccactaaactccaagaaactgccatctcgtatttttacaatgcttatctggatgttttctcttggcagctaattcatatttttggaatggtaaacaatatttcagttgataacaattatcacttctccactgcaaaataagagtgtcttattctttttattcggagccacattaacagattgtgtgatatactgataggtgagggatatgcttggcgatggccgcctcataaaacggcgtgtagttgatggaaaaggtatgattgcatgtttatactgatttatggattttttttcccttgggttgaaacttttcacatgttcctggtatgcaccttgatattataacaaaatttatctttcataaaaattaactagaaatcttgtggtctttcccatccattcaactactgactagtgattactgaaacatgttgacttcttatcatttgggtccttgtgatacttgtgtttgctacaagtttacttttagttctttaattatttaccaggaacagattttctaccttttacttttattagcagaaaagatattgagtacataattaaatgataaaaaaaggagcaaataataatagcaaaaagtttctacacagtgaataactaccctgttgttactttaagagcatttttctattgccttctctgcatcgtgtcatcatcatgaaaatggaatgaccttagacttagagtcagatgctctctttatccaacttatagtggtaaaaagagttgcaaaatttagatgaagggaagaactcagaggtgtgaattacacaaaatgattcatcatttattcagctatttttatttcaaaactacaaatcttcaacaagccaacctttcacatggaattgttgtgggcgtgatgaggtacatgttttgattccatcatgtgatgtgcttgatgtttatacctcttttcgttccttgaaaatatcaggtgaatttcctatggactgtcctcttcatgatagcttgctaagagtgcattataaagggatgctccttgatgaaccaaagtcaatattttatgatacccgagttgataatcatggtgaaccattggagttctgttctggagaaggcctggtaaactttcacttaaatctttattgctgcaattattaactgcatcagttcttcatgtcaggtcataagacctgaccaaagtaaagaacggtgccctgcggtttcgtttaatttttcttggggaacctcgcattctcctaaaatctgttcccatttcttataaagttaaagcttcctggtgaatctgc

SEQ ID NO: 58846 - DNA, 4549 bp, Oryza sativa
tgattgcaacaggccagcgaatgttcctgaaggagctcatgttcaatgggaaattgaattacttggatttgaaatgcccaaggtagtgactaaaaaacagtcacaaaccttttgtatttccatgttgcttgtgcagtgttagaaactagaatgtttgtgatgctattcctgctctctattgcggggaacacttgggattacaagtagctgttaatttcaacccgcaatcggatcggtttgaaagttgtcctggttcttgtgagtctgtagctgtgtcccgtgatcctttattgcttctagcttttcagcgaacttgcattatgttttcatgtattgaatagcagaagaaagtaataagcattacatgtcattctgaatatttcactagatgaacaccttgtcttgtgtggttcaacactatttcagctatggcttctttatgattatattatatcttttccctttcgtttttttattaagttctgtctgacaaatcttctgacttctcatataatacaaatgtaggattggactggtttcaccttccaagaaatcatggatgacgcagaaaaaataaaaaccacggtatatcgattgagattgttgagtgaatcattacattttgttttgtttttggtgttttttccacttagtatctccctgaacctatcatgaatgcatttttccagaaatgcagtgcacttcaagaaactgttgagatgtctttaattgaaaaacataaaactacttttatttgtgttctatgtgtgcaagctgtgtttctcaattgtcaagatggccaattgtttagtatgatcatatgaaaatcctggagttcccataatgccatcatctaggtctaattttgtggtgatgtccaattccaccttgtggaccactgcaaaattgtgatcataggccccttttgaaacaaaggaaaaaccattggagttttagagaattttatcctatgggaaataatcctatggagccctttgaaacaaaggattgtttcctacccattcctttgaaattcctatggaatgaggtctaacctcatgttttcctcttcatgtgtctagaattcctgcgtttttcaggtgtgctaatcaaatgacagttttaaaactttcatgtgtttcaaaatcctgtaggaatccaataagtatgacattgtattcctatgtttttcctattactgtgttttctcaatcctgcgtttcaaaggggccctaaatatctatacctgttgtccacttggctggttttgatgtgtcttttttcactaataattagctctaaactgaagttctctctcagggtaatcgactgtttaaagaagggaagtttgagctagctaaggcgaagtatgaaaaggtatgcccttcacatgattcagcattcaatattaagggcaatctcggaacattttttttcttctccattgctatgttggtctggatattatctctttcccgctattgttaccactccatatggttaccaatttggcagtctatactatgaatgattttaccttataatttcttgtacatgtaaagggcataaatttacacgtatccatgacttcattctgtcaattttttgggtgcacacgtttttcttttatttatttttgtgcaaggatatgggtgagatgttttcaaaccttctctgcctgcaggtgcttagagagtacaaccatgtgcatcctcaagatgatgatgaggggaaaatctttgctaattcaagagtatgacagcactattttcaatctttttttccctaacaatagcatagatgcctgattagaacatttctttgaaacatgtacctctgattagcactgcaattcaacaattgtttctgctttctgaagcatgtgtttacctttcatttttgtttttcttttacacatgcagagttctctacatctaaatgtagctgcttgctaccagaagatgggtgagtatagaaaatctattgacacatgtaacaaggtatgtttccaaaaagaactttgtactctcaaagaattttcctagggtgtctatatcaaagagggtggtgcatgcttgtatgggggctgtcattggacctcttccgcacatgccactggatgagccttgtaatggatagatctggggatccaatcatccatccaaggggaagatagatgtaaacttttgcttaccactcttggatcaaaatttcgaggagggacatcacatttttagtttctcctagtctgatctgctgaagttcacgcaataacctcgtgaaatcttgatgatagatagtactcacatatgagtttgcacaaggcaaccatataaccatgaatgtgctggctggcttgttttgtacacattatggtacttggcattgatatcattgtgaagtgagcaattattccatttactctttgagcaggtgctagaagcaaaccctgtgcatgtgaaggctctttatcgccgaggtatgtcctacatgttattgggggactttgatgatgcaaagaaggattttgagaaggtgtgtttcccccatactttagtacctgcttattttctttttttatgtgtcatggatgattgtttgacctctacctaaagcactatgtcactacatcttttttagatgatagctgtcgacaagtcctcagagcctgatgctacagctgcccttaataaacttaaacaaacaattcaggtatgcaacattacatcataaggtgagacccttcagaactgttgaactaacaggagttgtatatatatatataatttctaaaacaggaaactgaaaagaaagcgaggaagcagttcaaagggctgttcgacaagaagccaggcgagatttccgaagtaggtgtaggagagccagagggcaacaagactgacacgacaggctcaggcgaggcagcgtcaactgctgacagagacacggatgcaaaggaggctattccccgtgcagattcagggttggccttcgaggaagagaggcccggacttctcgcccgcatctggccttcagcgagtcggatcttctcctcgcttgggctcaacaggtgcacaatcctctgatgcaccaccagtattcaaaccactacaaacagcagccagaaaagtcgcccagcaaagccctggaacgcattacacacgcaaaattatcaccttggatatatatctctaaaaattatactccattacatggtgtaggctgatgacctataaatgaggtaggcgtagtagtaacgagttagttaaggacatacggagtattactgtggaaatgcatttgtgcctgccatgataagaatcactaccactgccacctgatagagtgttgatgatgtggtgtgggccccctgatcctgagcgtgcgtagtgtaggtgtagtaggtaagaatgagactggcttaaccgggtgtctcttccatggctgtggctgccgctggttcttctggtcttctagaacggtgccacccgtttgtcggccaacgcgtagcagaggccatacttatgtgacatgattgaattgccattacctaacacctctgataatgatgtttcccataaaaattaaacctagaaccggatattacacatcctaatataacgaatctaaataaactcggactagatgtaatatattatagtataattaatgtggacaattacatctagttctaaatttattttctatgagacggagagagtcacatctgattttagattttttttttttttttggaacggagggtgtacatagattcaaggtggtaggcgtgtctacagtggacgtgcaggtaaaagcatatgctaatgcggcttggcctgctgctgctgggattccggtagatttgcttgtttcatcgccatattcagcccatatctccttgttggtgttggtgatggctattagtaacaacgtgaccttttaacaaaatatttcttgttctcatatcaatctctctactatttgaggaacttgcttggggcctttgagaccatgttcaattaatccctgtgagggggcctttgagaccatgttcatgttcgattaatccctatgaggaaggattaaagggaatttagtccagagttattgtggtgtgaaattatttctctctcaatcccctcaaatctttttcaatcactctttataccgaatatgaggcataaacaaggacttagggttatgtatccctcatcccttctagaaactccaggccgatatgatgaagcactgcaaacagatactttttcttttagggactggctatatgtctgttgatagaaaatcccacctcccatctttcaaatttttgaccgtcagatatgctttaagattcgtgcagatgtattaaccctaactctcctcccgttcccctcccctcgctcattccaccgccgccactccctccgatcgcgcattccaccgctatcgcccgatcctccaccgccactgacccatcgcaccgccgcccgcctcgtcggctggccgaaaggcgtcaacagcgccagcaaggtccccccccccagcc

SEQ ID NO: 58847 - DNA, 6819 bp, Oryza sativa
acacacccttttgctttgccccatagggtcctctgccggagtctagggtgttagtcaatggatcaatttaatatagcttagctgactgatattaaagccaatctccaagcatcaaagtgcctaatcccgtacgaatatatatatcatggtccagctattttatattttagttaaccagtttgttgtaaccaccaagcatattaagatacgctgatcgacatggatatatatgtaagttcccattgcagtataatttacaacaaatgctgtagtatcactgtctgaaggcgcccatatatagggtccaaattaaagatgaactcactaccttggggtccactgtcatgcagaaatagtgagatatgaacactttttaccatgtaaaccttggatttaccaatcggtggcatgttgaagctactacattttactccaacttacaaagcaatatgcgcaagtaattacggccttagatctggttgtgcagcttttgaagtttgcatgtcttattttaaagcaagtaaaaaaatgttataaccttcaatttgatcttatcttattgatgcaaattgatcccacgttatatgaaactttttctcgaaaagaagagtattgatgccaacgctgtcgtcttctatatcaaagataactttctccaaattaacggcagataattttcaacaagtgcgacatctcggcaggacttcagtaccactccttttggtttttttttagtgtgggttggtgttcttggctaagtgtgctttatgcacaagttggatgattcaatgaaatgtaaatctcaactggatttgacactgggcctgtgttagtggaaaaactgtctgatcatgactcatgagacctacagtacacacctaaaaaagaagataaatattgtttgcaagggtgatctttcaaaggaaaaaaagaaggaaaaatgaaaggatgaattgataccgaaataaccatgaaattggaccatgatatcgtcccagataataacgtcattccagccaacctctactgatcccctgcatatgcatatcgatcgattgatcgactactcaatctgtcaactatcaaataatttaaaacctgattaaaaactactagatgtgcctttcactgttgattagcaaatcaaatcgtgccaacataatcccagttgtcatgtccgtgggattcgatccatggctgggcttatgctcattttcaaatagattattgtgcgaattgtgctgtggattatctaagttgattactaaaataagttaaatattttgataaataaacgtaataaattattacttaaaacaaatggtctgaataactaacacaattgagagaaagatttatttttttaagggtggagccatacaatgagtttatttttctaagggtggagtaaataatctattttaacaatataaataatgatgaaaaaaactaagcctagtggttaagctcaacaaaccaagacagggacacactgtcgtccatggatggacgtactactgtttatacttagtaggagtatgtagtactagtacaatatgctgtgtagatttgcccatcgttctccttcacctaaccccgtgaaaccgtcacaagggtcgtacaaccaatttcacgcaagtccactgtgactagttttctatgttatcactagatccaattgacaatcctatgattaattcgagttcacttaacttatgttaaatggaaaaaaaaagcgtctcatttccattgcctctttgaaaatctatgggccatgaaccgccgaacggcaatctacttattcctaggactatgttatgtttggagagctcatgggtagctataactattcatataatcttcaattttctcaaacagtttagtttttttttttacatacttcaaatctcagtaggtacaaaatccaaaaagaaatttagtagttataagctgaaaaacccaggttctttaaatctttattagatatttcctgcaatcttcagcttcccaaaccaagccataaaaatatttgtttgtgtaattttaaccacaataattgttcaggactatgttttaggcttatagaaatagtataggccaggtgtatcataatttgtaaaagtattataatattatatttgtttaaacttttcttttttatttgaaaggacttatccaatcaaagtcaccctttgttgaaactttgaaacatccaagaccaagggaagcacaagtgttgtgttggtggagtagctccattttcacaggaatttaaatcctgatatccacaaatattacctagcacggtatcaatatgaatttagtgatgtcatatatagatttgtaatcgactttcgttgctgagtgtgtgaatgtggtgtgtgtatgcattttctatgtaataaaaaaaagcaattggaaaccatatccttttatatcagaaggggtacatgttgtcgaagaagaagaaaaagaagaaagatacatgcttttttccaaggataattaaggtgacttttgctactttccgttgtttttaagacacgttgaatttagatcatgctttgatagtggacgtgatgagtaaacgctgagggaaggcagtacggctgcaatgaagcatagtatttagtacaaccccactgctccaacaaaaacagtttaaatataattaaataacatggcacataggataaacgatgcttcgtctgtgtcaagttagttaaatgagaaattatgaggaaactctaggtcttacatgcatgagacttggtcatttatacaatattcaagactacttgaatatgtaatgtgaaatgaatggtattaaattagcatatatattgaattaaagtttgtgtatttcagagtttagtatacttgtactaattaatttctagacaggtggcgtgaagggatatgaaaactgccgcgccggtagcatatcttgcactacagcacctttaagagcatcttgaacggtctctccaaatcccactctccaaatatctacttagctaactctttatttaatttggcaagttaaattcgttgtttattccaacagcttttctattcatcatctctattctgagtctatgatagtgggacccacctgtcagcctctataccactttcttcctcgttatcctgctccccctcttccccaagccctttttttcttgcggcagtggtggccgtgcgccgcgacggtggggtggcggtctttgtgcgcgggccagcggtcttcatgcccgacgacgacggggcggtagtggccgggcgcggcaacgacggggcggcgatgcggcgacgacggggcggcggtggccgtgcgcggcgacgacggggcggcgccgccctcgctactcctcatctgactccagcgatggaggccacaggtgcgtgccttgtggagagagagggggaaacaggcgtgggtctcacagatggctagccgactttggctggccaaggttggctagcgagggaggcaatttggctagctggacttggccattcgaatagcaagtctgttggagtataattaattttagcctaaaattgctaaaatttagtttggagagtgggatagcaagactcttgagatgctctaaggccttgatcctcgcatctgcacacactagtgcggaacaactcatctgtgtcggcgagaggcttctcgttacgaactaatgattagtgatatgaaaagtcattttttcgagtcgatcaccgtcactgatgactattatctttataaggccacaacatatataagtccatcacggataaatatcattggtgatgggctcggactaaaggtctatagaaattattggtaaatgtaaatctttgtcggtgtttattccacctgttaaaggtgtcgacggtgtgacggatcgcgagttcccgacatagataaactgtccacgataaaaaaaaactgtttattaatttttaattgtactaattattaatttcaccaccttgctatcccagttgattcctctgtatattcacgcacatgcatggttcacttttgtaatatatattatatcacgtgttgtgtttaatacacagcacgtacagttactaacttgcgataagagacaaaattaaccaccaaatgattgtaattaagatactaattaagatgtgctgaactgatatggatgcccaatccggcccagtcgccatcagtgatgtacaggttgtcggttattttgattttgcaccggttcatttgtatatgttccttatagaaatatggctgtaataaagaaatgacacaacgcaaaaaatagggcacgttaaaaatctttagagacggcgattaattatgacatcgatacgatcttcaatactcatgttctatcactaatatttactacacccttcgtccccgaataccttaaagcttttaatttggatgggttaataaagaactggtgtacaaggtaaaagaatatcccccattatattaaagccctttttgtttaggtttataacccaacttataagccgaaaagtctaagcctaaacaaataagcggctttttcgtttggcttttctaaaactataagccactctaacactattaagccaaaagctaagtttgagaagcttttttttggcttatgtgaggtagatgcataactccaccattaaacttaggacattaaatctaccggcttataaatcatataagccaataagctgacttaaaagtctaagccaataaacctatgcctaatcaaagagggcctaagtaggtgcagggctactctcgttgagatagcatagaccattaagggtagaagaggaagttttgtgcaaaaattcatctctttaggttgttgtatttgtgacaaatttaaatatattttgtaacatagggaatacttatataatagaggtttttagaaaaaataaacatatatagatatttttacgacagacgtaataattaatgtcattttcatgtattggtgagttaaaatttattagatttaattatatatgctctcagcattatctgttttttttatctccactttatctgttttagtatggatcggagcaaatatgctacaagaacctttcccagagtgagttaaagctcagctcccaccttggttaaaagcaaggtcaaagaaaaatgcccacatggccacaaacacccgcatagtatatcgtaaattaaatcacgtgcttactactccttccgtcttaaaaaagacaaatcctgagtttccgtgtccaacgtttaactgtccgtcttatatgaatttttttataattagtatttttattgttgttagatgataaaacatgattaatactttatgcgtgacttgtctttttaattttttttcataattttttcaaataagacggacggtcaaacgttggacacggaaacccagggtttgtcttttttttgggacggagggagtactctctaactctcactggtctttattttttttccttaagtaatactagtgttattgctaacagcgcaaatcttatactaccttcgtctcaaaatataagaaattttattcatttaacaataacattttaaaaaaatcagagctagggattttgccaacattttttaaaaaagagcggagctaggaattctgccaacattttaaaaaagagcggagctaatgatgcgtgctaccttaatttggttgtgttagtgttgctaatgatattgaatctaatcacctgaaaacaaaaatacaattaatgtgagatatatggaactccctcggtccatatatatatatatatatatatatatatatatatatatatatatatatatatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttaagttgttttgttgataggtataggtatgaatcgaattcttataactaggtatatactcacaatttgaaaattttgaaaaatttgagtgattttgtgcatttgaaaccatggtgtccgggcaccatggtgccccatatgaatgtcctatatatatatatatatatatatatatatatatatataaagaaattttaggttttaggttctaaatttgttctttgttcttagtttgtccataaatatatagacatttggagtattattttcccgattcatccaaacactagctgtactatcttaattaatttgtccataaatagacattatgttcttaatatatctctctatcttagcataaactatatatagagttaaatcattcatattatctattatatagcttgaacttgaatcagtcaaagattgaatcattcttaacagacaagcatatataacaaacagtcgtcccgacataagcacataattatgaattgatcgatggggatgactttgctgcaggcctcacacatcgtagcactaattaagattaagaaaatgcatgcaagtgactactactaagcacaaaaatattatatcacacgctatcggtaccatgttgtcctacttgcatatgtaactttatcttcttgatatcatgaaaaaggcattttgcgacttaccacttattatttata

SEQ ID NO: 58848 - DNA, 13575 bp, Oryza sativa
cccctctttttcccctccccctcctcctctctgctgtagagagcttctttgtacaagcataacggtggtgaagcagagtagcagaccctcgaaaatggatctagaggcctaggccctcctcactgctagacctgccctgagtgcacgttggctacaagctggtcttgtagcctcctccttcatctcatgcttgtgaggtatggcaacacccacaagatctagctcccatgataaaaggaggcaactagcaagtagggaggccgttggaaaggatgctgactagcgtgggctccttggcctcctgcttctaggcgctttgtcaatggtggaggagggacgcgatcaatgaagcttctagatttagagctcatcgccggagtgtgtgcatgtatgtcatgcgatgtatcatccgcaactagtacctgtaggtaccatatctggtacctatggtatcaagggtgatacctaggtatcagacccagtacatgtagataccatgtttagtacgcatggtgtcatgggtggtacctataggttttagacctggtatttgcgaggtatcaagtatcatgcaccgcgcgcctcctctcctcttcttctttcccctcggctcgaccctgtcccctactactggcgcgaccaacgtcactgcctatgtttccacaagcgttggttcaagactcggcgacgcgaacatctcgagtaggggcgggatgactctagacttacgaggagaaagcaagcatgtgggatgacatcatcctctataaagtgtcttgttcgaatggtatctcgtcctctagcagctctctattatatttaagagaatctattatataccactgagtttgttcaagttcaacgatttgccatcgacattgtctctctctacaatataccgacgactttatcaattattctatattacactattgggctgaaccttcctttcaaaaatacccaaaatacccttagacattcaaggttaacatccttacataacacgaaaatttgtatagaagttttaagttttctttgcattcctatttttttagaagaaatataacttatatgttatatgctatataaaatatttttatcattgtttttaatataaacaatctttcataccctacatacgatatttttgtgctattatatattgtataagcaaattctctttcatataccacacaaatatatatttttataaaaccaaaatataccagaaaaaaattgaaacttgtatacaaacttccatgcatgttgtgtaaggaggccacacaatttttttatatttttttgaaacttataatgaaataaatcaattcttaatcttatatgtcactaagggtattttgggtaattttgaaaagaaggcccagaccaatggcgtattgtagaacaattaataaagtcaccgatatattatagaaagagacattgtcgatggcaaattgttgaactcaaacaaactcagtggtatagaatagattctctcattatattttgggtaaatttcataaaacccctcattttaggtcaatgtttaagaaaaaacataagtattatatatgacttttggcatataactatttataggttttatgatctaaatgttttattaatccccacctttatttgaattttcaattgattttagcatatctgaaatatttttttttgaaagtagtgaagagttaaacgaacaaccttaatcaagaaatcaacaactaaagatttcatatacattctctgttctgaaatttttaagtaaagatttgtcaaatatgtatagaggtggggttttgtgaaactttaaaaccataattgttagggttatatgccactagtcataatgccttagggtttgctaaattttgctcttatattttacaagaatggcattagagggtttgtttggcagcaaggttgctgcagccagctgcttccgcagttgtgtgaaataatgttggcgttggcggcaaccctgcaaccaagcagctgaacagatgcagaatgactggcatcgattttgcggcaggtttgtaatagcttatttataaaacggtttcatatttacagtgttgccctaaagtttggcacttttgccgtgggatcaaccatctcaaatttgaggaatcagagtaatttcccaaccgttggtcttgcgttgagattcgtgctccggtggatgttgacggaggcaaaggcagccccaaaacgggatcgtagatatataaaggcgtcaagcgagcgcacaccccttgggggcttgggcagcgcgcgcgcaaaaccgagttcgccgcccacctcgccgccatggccatggagctcgccgcgctctgcaccgaccccgtcgtgctctccgccgccttcctctgcctcctcctccacctctccctccgctcctaccgcccgccctcccccggcggcggccgccgcctcccggcgggacccccgggcctccccgtcctcggcgcgctgccactcgtcggcccggccccgcacgccggcctggcgtcgctggcgcgcaagtacgggcccgtcatgtacctcaagatgggcacctgcggcgtggtggtggcgtcgtcgccgtgcgcggcgaggtcgttcctgaaggcgctcgacgcccggttcgcgaaccggccggcggtggcgagcgccgtggacatcacgtacaactaccagaacatggtgttcgccaactacggcgccaggtggaagctgatgcggaagctggcgagcgtccacctgctcggcgcccgcgcgctcgccgactgggcggcggtgcgccgcgacgaggcccgccggctgctgcgcggcgtggcggaggcgtccgccgccggccgccccgtcgtcatcccggaggtgctcgtctgcgcgctcgccaacatcgtcggccagatcaccgtcagcaagcgggtgttcgacgtgcagggcgacgagtccaacaggtgagctcgccgccgcgccggtggtgccattactatctagcttaattagctaattatttcctatctccactatagtagtagtatagtttcatcttcgttttcgatctttttattctttttgaaaaaaggaagaaaatgaaatggtgtgcaaatccaatgcatatgaaccttttttgtaaaaagaaattggaactatgaatgcaatttaagttgtggtggaatagagccgaccactagtgtgtagttatcatgggataggtaggagagcatgcgtgcgcaagtcagcactagcaatgagtcacacgtcaacaatcatcgatcacctataaaagaattaccgaaagcgagacaaaatccactaacctttgttattcgtaatattagtagacatcagcatcatctaaatgcataaataaatacaaaaatatatactccgaaatatagctatttcttgtacaataccttatctcgaaatatacgtacctaatcctctcaaccattcaccaccattctacttcatctattttctcttttcaatcaatcatacaatttctctaattattctcacatactttttttaatacatatgccattttttacaatgtcgatatcttagaacgagaacggagtaagtactgattaatgcatcgatcgatgtgcacgcgcatgttgatcgggtcgatgacatggaaaatttgcagctataaggatatgatcgtctcgctgttgacgggtgcggggctgttcaacatcagcgacttcgtgccggcgctggcgtggctggacctgcagggagtccaggccaagttgcggcggatccacgaccagttcgacgtcctcatcaccaagctgctcgccgaccacgccgccaccgccgacgaccgcgcccgcgccgggcgcaccgacttcgtcgacaggctccgcgccgccgtcggcgtcgacgacgaggacggcgagaccatctccgaggtcaacatcaagggcctcatcttcgtaagtccttagttacctcaccttgtaatgattaattaactgcattatattgttaccactaattctgttttataagttatttttttattataagtcgttttgatttttttattaaactttttaggtttcactaagtgtatagataaataaaagtgcactacctacctaaattagttttaccattgaatgtatattgataatatatttgttttgtgtttgaaatagtgttatattttttataaacttggttaaaattttaaaaatttgactagggaaaaattaaaatgatttataatataaaacaaagaatagtggaataatttttagcgtgctgcatacgtatgcgtgacataggcgccacgtaacagtgaaaaccgtacacgtgtcagttctgctcttttccctttcttgggtggaaggtgccttgcaatggtgtttgtttgtgggggcagcacattgagctatggatggtacttgatttcattcattgcagtggagttgttggaaagggatactatatcataagcacttgaaatgcacatgccaacctaactgaatgttttttcccaagggaatatatatctcccatgataagtgtcctctagtatctttcagaaaaataatatatgtccttgcagggtacctacacttgatcaatagtaattattagggatccaccgaattttctatgcttcactaaccgcaaagaaacttgtttgtttcctactaattgtagaaaaacataaacttattttcatcctaaattataataataaatttaaaatgttgtaaataactatatatatatatatattctcaatggagagatatgaatttactacctccatttcatattataaatcgctttagctttttctctaataaaaattctttaaatttaaccaagtttatataaaaatatattaatatttttaacacaaaacaaatataatatcaaaatatatgttagttttaatgaaaataatttagtgttgtaggtgttactaaattgttctatgaacttgatcaaacttaaagaagtctgactaaaaaaatcaaaacgacttataatataaggagtagatgtttccttttgagggaaatgataggggctctgtagttcgctatattcatttatatgttaatttggagcaagcatcccctgaaaaagcttgaaaactgtaccaccacaaaaaggaattttggtgttttacaacttgagccaaaatattaaatacgtaagttgcttgacaaaaaacctaccggagttgttataacatcctaccagatcgttacatttggtcgtttgtgctctgaaaaacaacaaaaggaaaaaaaaatcaactataatcaggattgaattgtactatggctagctagctagaaccatatggaccgatctttttagcttccatcagtttctgaaaaccacgtacacttctgaattcaattaatctcggcgatatatgatatgatctgcctccactccacacccacctaaccacttcagaaaactgcatgagtgagtgagagtgatgcttcaaccgcaatattcttctacctatatatctatcgctccaacacgcgattgattaattaaccacttaattagctcgataattaagctggctagccttcagggttagtggcaggtacttgtgagtcagcagtgtcaacacgaagtaacacgcaatctgtagtacattgtccatatggcagcatcattattggtgccacaatgacttgatgcttcaacttaacttcacttaaactaacggattagcggcaccagccgggactgatgatgaagggtaatcaacatctctgcttgacattgcaaccaaattaattgcagctagctagctactcctacccccgatgcagctatctgaagttcctctttagcttaggcaataatgttcagattagtataagcctaaacagactaatcaaaatgcatgtgcatgcagtggtagagtacttgttatgcttatgcttacacattctgcttattagcagctgaaaataatttgtagataaattttttatatatgtatgtctttagcaattgaaaataaatattagcttataagtataagcataaatgaaatggtgagactatcgtgctctcaattagatgattgaagtatatacgtacatacgagtgttagttgcaaccaaatgtttcccgctactcgtgataaaatggatgccttaattgggtacagaaactattgatgacttgtcgataactaccgtaccttggccagtatatatttcctgattgtacgactgcgacatgtagacgtactgacgagacgaactgaacctaccagtctaccacactgtactgtacaagagtcaaattaagatgactgaagcaactcataacaatgatctgcagccgtcactagcttaactaccattaaaagtttagatatagatgacagctgataatatggatggctaattatcatgctgccaagttacatctatatcgatttcacttgccttccaagttccaacgcactgctgtttcccactggaatctatcgatttcactttcatttcaacgcactgctatttttccaatgaagaaaaaaaattgtcggtataggagatcaccgttttcaaatttcttgaccatacttgaaagcaactcatcgttaaatatatatatttgaataaattgtgggcttgatatcaacaggacaacaagtatattaattagttaagttagtcctttttgggttggcgagaagtccacctacggcacacttgatcgatctctccaagtagtgccccatcatcggttggtgcagtgtggctaccccttgctttgcttctcttaaaatgatggacacatacatatctcagtagctagcactttctctgtgcagtaataataaaaacaatttaatcattatgaaaaatagcactgcctcaaattagtgatgttttgggcatcaagtttatatcttcttttcttatgtgattggccatgcatctgtctgaagacacaggaataattcatactaaaactaaaattccccttcaaactgtggtgaacttttcatcatgaccaacaagtgcaaaattgtatgaatgattattaagactgtattttcgttaagcagtttgatctaagtgacatctttccattacgttgactatttcttttactatttatcaatcaccttaattttgcacttcttccgtttcatattataaatagtttaattttttattagtcaaatttcttgaattttgaccaattttatagaataatatactaatatttttaatacaaaacaaatatattatcaaaatatatttaattttaaattcaataaaactaataaggtgtagaagatgttgctattttcttctgtaaatttagtcaaacctaaagaactttaactaataaaaaaataaacaacttataatatgaaacgaaaggagtaacttttttatcgtgttcgactacctccgtcctgaaaaaaaaagtcttcttgactacttcctctgtttctaaatatttgacgacgttgattttttttaaatatgtttgaccgtttgtcttattcaaaaaatttaactaattattaattgttttcctatcatttgattcattgttaaatatacttatatgtatacatatagttttacatgtttcacaaaaaaaatttaataagacaaacggttaaatatgtgctaaaagtcaacggtgttaaatatttagaaatggagggagtataaaaaaaatgtagtacaattttcacgcatgttaatttgatgtatgcatgtatgtacgcaggacatgttcacggccgggacggacacgtcgtcgatcatcgtggagtgggcgatggcggagatgatgaagaacccggcggtgatggcgcgggcgcaggaggagatggaccgcgtcgtcggccgcggccgccgcctggaggagtccgacatcgccagcctcccctacctccaggccgtctgcaaggaggccatgcggctccacccctccacgccgctcagcctcccgcacttctccttcgacgagtgcgacgtcgacggctaccgcatcccggcgaacacgcggctgctcatcaacatctacgccatcggccgcgacccgtcggcgtgggaggacccgctggagttcaggccggagcggttcatgccggggggcgccgccgagcgcgtggacccgctcggcaactacttcgagctcatccccttcggcgccggcaggaggatctgcgccgggaagctcgccggcatggtgttcgtccagtacttcctcggcacgctgctgcactcgttcgactggcggctccccgacggcgaggacaaggtggacatgtcggagacgttcggcctcgcgctgcccaaggccgtcccgctccgcgccctcgtcacgccgcgcctcgcgccggccgcctacgcgtgacggccggccggcgacgacgaggacgacgccgtgtatgtgatcgatcgagttcgccgcggcggcggcggcggcggcgatctgatgttgcggttgtctgtacgtaaatatatttttcgtttgttggtttcgaaagcaaaacacaattaagaacgcccaaatattgcaagcaaatacgcctgtgaattgatttcttctatgatctgtttcatcgatcctagctaacgtgttttatcgaggcaagttaattagaacgaattgacggattgtaattgttggggttaacttaggacaacgtacgttgataatggtaggaggacaaatgtcatccaactttgaaaaatgaaaatcgagtttcaagaaataaagtttattgagtaaatttcagaaaattgtacttttattgactaaattatcattttgctgcaatctttgcatcacatttcagaaaaactgcaaaagtagcgttggaaattatcacatagctgcaattccgtcggataccccgttaatgacattctgggcccacgtgtcatacatatatatgcttgagagaggaagaaacggagggccatgtcagcatgccacctcatgtttttactgcagcaatgccacatcagtgcatgcttgggcgggaaaaatacgtacgtagtccggctgcaccactttggcttgttcaggggcacaggccgacaggtccatcaaaatacacctttaaagtccacatttccttggctatcctaccaagttgccaagaaagagtgatatttgcatttgaacacagcaggaatacgatcgtcaacaaatcacatccctaaccctagaaaaatcaccctccaataaacccgagaaatacaccaatcggacaacaaagaaccattatccaggtgcaaaattactcaaaatctaagttattccctcgatttcgacaacttcagctcctacctgtactaacatcattgtactccactcaaaatatgtgacaaaacgagattcatattgaatatattgaaacattttattaatttaaaagtaatttattacatgttagaaagtaccttccatgttatcaggaagtaactattacatcttatacatggttaattatcattagttattgcatcaatgttatttacaatccatcaaaggttttatcttcttttctcattttacatgaaaaacaaaaatgaaaggaaaaaaacaatcggtgattaaacagatttatagagttaattccgaaccatgcaaaagttagttccaattaacattgaagttacttttaaaaactgttaaacttacgtgtgttgatttatactgattaaataaagttttctagataaagtcatatttttatccctacaacgaatttacttctaatgtcgtgacaaagttactttcgttttattttaagttacttttataatatatgtaaataacttttaaaatttattggatttacttttatatgtctaagaagtaatttagtcgaatctaaaagtaacttatatatatatgataaaagtaacttacatatatgataaaagtcatttgcaaatataaatattttttcatcataatataatcaagtatgatcttgttgtgaagatttaattgttgtgaacacaatggtgtaatcggataagtaatttgagagaaaactttatatttaaagaggaagaagacatacatgtctattaaaaaaatgcatgcatgtagtagacttctccacgtgcatgagacggttcggatgtcgctcgttaaggcaaaagcgagatgcctcttcaaatagattttaccaaagaagcctccacgtttgctctcatggcctaaaaattcctacgttaatcggagaaaaggaaaagtagagtctatataggaatacaatttaaaaatagctgaaatacagaattaaaaataaggaatatggaaagaggagactagggtccatacaagtatataatgtagaattaattaaaattcggaattaaaaaatatgaaaaactaaaagtataaggtagagtccatatagaaatataatttagaaataactaaaattcaaaatgaaaaaaagtaagattgggagaaaagtctagagtccatatataaatacaatttataaatatctgaaattcaaaattttttaaaaaaaatattagaaaaaaaagtctagagtccatataggaatacaatttataaataacttaaattcaaaatcaaagaaatacaaaatattgaaaaataaatttagagtccatataaaaataaaattagaaataacagattgggaattagaaaagtagaaatattggaagaaaagtatattgtccataaaggaatttagaactagctgaaagtcggatctaaaaaataagaaaattaaaagtagagtttagactccatatagaaatacaatttataattaaaaaaattgaaaattgaaaaaataaacaagattgggagaagagtttagcgtccatataggaatacaatttataaataactgaaattcgaaattaacaaataagtaatattgggaaaaaaattctagagtccatataggaatacaatttataaataactagagtaaaatttttaaaataagaaatattggaaaaaaatgtcaagagtcaatataggaatacaatttaccaataattcaaattcaaaatttaaaaaataagaaatattgaaagaagagtttagactccatatagaaatacaatttataaacaactaaaattcagagttaacagaaatgaatattggaagagtagtctagaatccatataagaataaaatttatgaataaaggaaacatgaaatttaaaaaataaggaatatagaaagatgagtcttgagtccatatacaaatacaatttataaataactataatatacaatacaataaaaatatcacacatttgttaattagttcaaccaagaatttaaaattatgttgccattttaatatattttaataataaaatgtaaaaatatttaagctattatatgagaaaatataacaatgctagccgcacaatctacgcggatcaccatgctagttatcttaaaatatatatatatatatatatatatatatatatatatatatatatatatatatatatatatatatatatatatatatatccgtgtcgtgtccctagcttcaactttgggtgtgccttgccaaccagcacgcatatcgaaagggaagcatatagtagtagcatgtgggctacgactgtattcgttggtgagagtttggatgtaaactctccgtacggaaaatagagtggtctcattatgcaccgtggatttataattcctaaacctcttagctatttttttaaaaaaaatggatcaatatgattttttaagcaacttttgtatataaactttttacaacaaacgcaccgtttagcggtttgaaaaacgtgcacgcggaaaaagagaggggtgagttgggaaagggggattcggaacacacccctaagtacatatatacggagagaattaatgccaaagtcacatgcaaattaatttcagtacactataaattaattaatacttctaaaattatttcacccggacacaactaaggtaaggaagaacaagaaaactctactcctcattaataatattgggtgcttggcaatgccatgcatgagcttttgaggttgttttcgaatgattaatccacctttgggtctaaaatattgttgttttcgaaggattaatccacctttgggtctaaaataaaagagtaaactgcatcttgggctactttttattatctatgttgcaatttggacccgggtaaataaaacttttcattttggaccgggtatctttacacaaggttttaatttggactctcttcttctgtacaagatgtagcactagcggaggtcgagcatgagcttgagcgtggctgtctgctacttggcttagttcttatcgtcagttcagtaagtagcaacagttgtctatcattgccagtcagcttcttcatatgctagttgctactagtaagaatacttgttgtgcaccctctgttgtccttgaaattaagccacaagcactagctagtcgatgattggaaatgcaaactaccctttgaattctttggaagactttacagactaaagggaagaaaggaggaagagaattggaggaagaagacgggagtccaaattgaaacatcatgtaaagatatctggtccaaagtgaaaagtttggctttagcctagtccaaattgtagcaatgataatcaaatttggctcaaggtgcaattcactcaaaataaaatcaaatacatgtattagatagtttgaagcaaatctcgacaaaaaagtcaaaaaatttaagcaaatctctctcaaatatttttttttcaacaaaacctaattgattggacgcgcaaagccatcttaggactagggttaaagtatagcacgcccgcccagctagtcctagtatatgggacaagaattttctacacctaggtgccatggcacccaacattcgtatgcgacttaaatagttataaaaaaattaaaaaatatatagtaacatctgacggagcgtggggctcctcaccgggagaccgcgcaggcccccctttgccggttcggccggggactcagggtgagattctaagctctctgtatgtggaaggttcgcgagacaggaagcacacaaaacgccggcgatgtatacaggttcgggccgctgagaagcgtaataccctactcctgtgttttgggagatctgtatatgaaggagctacaaagtatcagtcagcctctcccttcttctgggtttctaatctccaaaagtcccctccctaagtgggcaaggtcctccttttatatcttaaggggataccacatgcaccatttctccctttttttttgtggggacttcccccaccttttcataaatggatggagatttgtatcgttgccgtccgagtcaccttctgatgggacggcccacaactacctccactttcgccgggagcagatgcgacgtggaatcgtggccgccagctgacgacatgaccggagtcagaccagtcacgtcggtcattcttgtccaccacatgtcagctttagcaatctacatgttcgcccttcttcacacaacatcttgcttgtaacggttaggataaa

SEQ ID NO: 58849 - DNA, 5597 bp, Oryza sativa
ccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcactgcactgcgttacatgcggcgtgacgcgctcgtccaaaccgcaataaatgtggctaggtgagcgccgctgcgctcacctaacccatacacgcggcgcaaaacccacaaggggtcggggcgcctcggccctcggggccgaggcgggagcggtccgaccccctcggggagacaaagaggagggcgaacacatcaccctcgggcccgacgcctcccgagggtgccaggccacgtgggcgattgtgtctgcctcaagcctctagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgtcgaactacatcacccagagggcggtgtgaggcagctgcgatgggctcgagctggcctcgggggcggagacgagctcgggagctggggtccactccaccacaaagtcggcgagggcctggctcttgatcgcgtggcttggttcaaagcgcaaatcgaattcagagagttcgattgcccatttcaccacccgtccagtaccctctcgattatgcaagatttggccgagggggtaagacgtaaccaccgtgacccgatgcgcctggaaataatggcgcaacttcctcgaagttatcaggatagcgtaaagcatcttctgggcctgagggtatcgggtctcagcgtcccggagggcctcgctaacgaagtagacgggccgctgcacctttcggcggggccgatcttcttcgtcaggggccacatctccagggcgctctcctatccgagaggccacgcggggcgtactcggcttctgtgccgacgacctcggggtcagagggcgacaggcgcggcctcccgcagtggcctcggggccatcctgggggtcgggggcgcctggcaccgtcggacaagcaggcggagggccagctccggccgtcgggggcgttgggccgccgttcggctcgggggcctctcctccctgctctctctctcttcgggcagaatcccggcggtcgcaaatcgcgcgcatcagcaagggaaaaccgaccgacaataatgagcggcccctcggctcgcgtttgccttcaactccgacgaggagtgcggtgacgacggtgcagacgacagcgacggcaaggccggctacccgggcgcgtcggagtgagcccccaggcctccgccaatcttaatagcttttccttcttcttccgaggcattcgggcccccttcttgttataggctgatttaatctacaatcaaataaagaggaaatttttgtgtcaatttcatttgttctgtgtatgagacgaggatggtctgtgccacggtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattcccccccggagttcaccacgccccggggcacggctcggttctgggccccgtttggcgattttagcctgacccgagcccccgagggtaggattgagcacgagtgacctatttcaagtcaagattcttcaaaaggaaacaaaagcacagacacagcctttaggaaatcgaaaatgcttttattgaaatacggaagagaaaaaagataagcccccggccaaccctgcacgcccgggggggtgcggggttggcccgagcccaagacctgacacccgatccccttttaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcgaagggccgcgcgccaccttcgctcttccaagtagccgaggtcagggagcgtcggcttccttctttttgtcgctcgcaggcctcccctttcgggtggccagcgaaacgccttcgacggcgaggacatgaccctcgtcgtcggaatgggccgacctcttcttcctcctcctgtcctgccgccctgaccgagcggcggacccgggggcggccgaagctgccacaccggaaccggaggggttccaagtccaggcctcctccttgcgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtacgagcgaagtgactcatcatcccttcgctgtactacgtgcaagtccgcttcctcacctgggcgcggatatgtgccttgaaagttcatggtgaactgttggcacaaatcctcccaagagtggacagatgcgggtggcaagttcattagccaaccccgcgcctgtcctctcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaagactcgccacaaaggctctacagccgacaccaccaaccgggggtacggagggctgattcccgcgtccgtgttgaggtgacactctggacgaggaagcgccctccgttgcgtgggtagcacgtcggccattacgccgccgctcgatgctagtgcgggcgtccggccccccacgcagatcttcccgggtcgaaggagtcgacgaaggagtggtggggcgaggcgtgcgtcagaccgcctgtcgccacctaacccgcgatctgaccggtctgtgactggtcacagaccggataaatgagtgcactgcactgcgttacatgcggcgtgacgcgctcgtccaaaccgcaataaatgtggctaggtgagcgcagcggcgctcacctaacccatacacgcggcgcaaaacccacaaggggtcggggcgcctcggtcctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggtcccatgtcaccgacaacatcgattgcgatgatataagtctatatacaaacatgcatgactaaatttaatctacaataagagaaacaaaaataataaaatcagatagtgaatacctgtacagcgtagataaaatttattatttttgtttttcatatgtcgatcgaatttataccttttttttttcaagtgtcttatattattatagtctattttatcaaattttttgaaatttttatataactgtttaaattaacagcaatccggagataacaattactactactaagcagcagttaatgcctgaagcgaagcgaaagccagcaaatcgagcttgtcgaatcgaaggaaggagttggaggaagcaagcaaggcatcgaccggaccggaacgaacctgcgtgcggttgtcggagctagcgagcgcggatgccatgcgcgtggccatccgccgcgtccgcgcgctgatgcggtggaacggccccacgatctcctcctcctccccctccatcccggcaacggcgagcgaagagcggcggcggcggcggatggcgagagagatcctcgagcggagaggccgtggggagctttgcgtgcggacttgggctggtctgctgcttcggcccattaactaacctgcccaccgaggcccggctctccgcctgctcatgtgaagcaattgggctggtctgctggctcggttcggcccatcaaccagaccaagacgacgacgaagcaactgtttcgatctccataaatctcgcaactattacctgcatgcgcacaagatcgtgagcgtctccacatatggacaacgcggcgccgccgccgtcatctggagcggcggggaaggagatggccacggcggaggcgctaccggacgacctgctcgacgagatcctcctccgcctgccggcgcgttccatcctccggtgccgcgccgtctgcaaggcttggcgctcccgcacctcccacccctacttcctccgagcccacgccgcccgttccaggataatcgccgccgccgtggtggacactactgtaattcccgacggcgaagtctgcaccaccatcagcatcagatcttttggcgacggcgacggctaccgctcgggggcggccgtgtcgtcgtcgtcgtcgttcgcctcggtgcggttcgattcccggccttttgtcctcggctcctgggacggcgtcgtgtgcctggtgccccgtcctactgccggtttcgttcgccctcgcaatcccatcgaccgatacgtgctcgtcaatccgctcaccaaggcctgcaccagcgtgccgccgccggcaacccgcggcatcgtcatctgcggttacgcccacccgaccacgtcgcgctaccacctcctgcacgccgacagcttcttttcctacgacggtacggcgagggcgaccatccagattctgcgagtcggggagaagaacaacgtgtggcgcaagatcgcccgccaccctgcgcctgcgggcgtcgtggagtcgaggacctacattcgattgggcggcgctccacccgtcagcctccacggctgcctgcactggctggtcgccccgtcgtcggcacggcctctcctatcggtgttcgacatggaacgggaggagttccggcagatggacacccccgaacaatgggctcgccatgggaacctgccgcacatgatgagtgtacagatcgctcggcgctccggcaagctgtgcgcgttcgtccacgagccgagcgccagcgcgttggggatgtggatgctcgaggactactccgacccgagcagctggcggctggagcggaggatcgactactcgcgccacggcgccggcagccggaacgtcgcgcgcacgttccgcaacaagttctcggcggccaccaccgcggtggaggtgctacccgatggtgtcaacggcggcggcggcgaggaggagatcatgttccagttcttgatcaaccagttcgacatgagggaggctgtgtacaacgttgggcgcggggcgtggcggtggcgtaggattt

SEQ ID NO: 58850 - DNA, 1785 bp, Oryza sativa
gatgtggttgattctaattatttaggtttggtagaaatgagattaagagttgaaggcattaccgctctatttggctcatattacgcaaaacatgcgtgagtgctggtaccattcagccagaaagaactcagaacatatttgccacgtgaaggttcagtagacaccactttgtttggagatggattctaatctctcgggacatgtccacccgtttcttgcatgccacttaaatgattatgaaaaaatttcaaaaaaaattagaaaataggttaatatgtaatatatcatttcacaaacatgtaagttcaaatttgacttctacaagttgtaaaaaaaataacaaattaaactctaactagtatacgtatattcacagtcaaatttgttatttttgttacaatttgtagaagtcgaatttgaacttgcatgtttgtgagatgatatatcacatattaacctatcatgtcaatttttttgaaaatttttcataaccatttagatgacatgtaagaaacaggtggacgtccacccgagtgtatttggaggaattccacatcaaagaacaatagtttggacgaaattgatggtggccaatgaaccagagatatatctcaagttctcaacaggtttcagcctctttcattaaaacagtccattacctggttccattgcaagaagagaagcacggtgttcggtaaatgtgccaataaagagtagactgacaagtagacaaccatacgggtacacttcaaactctacgatgaaatactttttttttctcttaatctctagctaatataatatactttttaaaaggctttgttaagttatactacaagagatatatcaacatgggatcccctgatactgataagaatgaaatgccaagaaaaatttagtttctttgcgttccatagtgtcgaccactaaattgctatcaagtgttaaacaaaacatgcgcaagagtaaggagcaaaaaacgaggttcagagtgttaatcaggattcaggagataattaagtaattagtactccagtttagtgctactactaagaagcgacagttgctgccagatgcgaagctcgatcagcgagcgaatcgaatcgaaggaacctgcgcgcggttgtcggagctggcgagggcggaggccatgcatgtgcggcttcaagttcagaaactgaagaaattgagtcttggtttttcctcatgaatcatgagggaaaaaaccagttgtgattgtgtttgcttatggtattactgtgttcaaaaacaccatgaacattccgattttagatcctgtgaggtctcgagatgttgtgatgcatggtcatcaatcaatttcgcagttctgaaaagtttgacgatattcggcttggcggcggcgatgccaccgtctagcaccgtggccggaggcaacatggacgggcaagggctagcaggattgatcatggtcatgcattggcctcgtgaggacatggaactggaagagatgggggcattggaggaaccagatcctctaacgtagaggattctacgttagagggacgtagaaagcagcagcgccgtttattacgcatccgacgaccgtgctcgttttcctttgatcagtccagaagcgcaatgcttcgcggcccagttgcgaacaaaatgaaggggagaaacgacgatcggagaaagaaaacgaagctgccactagtcggccatggccaccggccactcgctgtcgctcgtcgtctcccttgaacgcgtaacatactaacatgtgtgcaagccggcgtgggaacg

SEQ ID NO: 58851 - DNA, 2729 bp, Oryza sativa
ttgagcatggcgcgggggcggttggtccgcaaatttctgaagcccatcgacgtggacctcaacctccatgccggggcagcaaaaccgcgcgggggaggacctgggagcaagggatggggaggagggcggcggaagaaggggcttcctcggggatttgcttgacctgtacccgcgtagtgggaggcgatgatcgacgaacggcagcaagtagccggcggccatggccgactaggggcggtttcgttttctttccatgcgtggtttttccccttcgctttgactgcatatgggccgaaccatcgcgcttctggactggtcgaaagagggcggaggctagagaaaaccggcgctgccgtcagatgcgaaataaacggcgctcaagccttctacatccctctgacgtagaatcttgggaaactattctaatccctcgaggggatgttccctcgtttgctcaaaaaccatctaaatggttatgaaaaattctagaaaatttgacaacattcatacaacacatatatacaacttcacaaaatcgtaagtccaaactcaactcacacgttgagatataaaaaagacaaattcagcgtatgaatagtagcatactgtttatatctaaatttgtcttttttgtttctcggtgtgtagatcgaatttgaacatgaattttggtggactagtaggtatcattatgctctacattgtcattttttttagattttttcacaactatttgcatcgaatttaaaagaaaaaggtatacgaggggatatcccctcgagggattagaatccaccccctagaatcttctatgttagaggatctggttccggcattggaggggaagaagagactatttgcattgagattcgtactggatcagcctcgtagccgaagcgcgatgtgattctattcacatccaaattaatttcagaacactataaattaattaatacttctaaaactatttcacccggacacaactaagctaaggaagaacaagaaaactccactcctcattaacaatattgggtgcttggcaatggcatcactggtggagaaaccctttgtagtcccggttcgtaacccccctttagtcccggtttccaaaccgggagtaccaatccgggactaaagatcgctatctttagtcccgggtgaaataaccgggagtaaagatcgatctttagtcccggttggtgttaccaaccgggactaaagatcgagctgaccatttttttttgcatggccctgttgctgcatggtttatatatatatatagtttatatatatatatatatatatatatatatatatatatatatatatatatatatatataaaccatgcatatatatgtttcaatacatatatatgcatacatatatatatatgtatatatatatatattatattatattatatgtatatacatgcataatatatatgtatttatacacatatatatgttatgcaaattaatgcatatgtatatagatatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatatagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcaatgcgacgtttactctccgagggtcgatgaatccagtatcgaaaaccctccgccgtcgggccctttgaatctccattctacaacgataaaagggagtatattattttctatagtctacttatatacaaggacctaatttattaaaggagacgtatagtaagaaatctaaccgaacgatatacttacaaaatccagcaact

SEQ ID NO: 58852 - DNA, 784 bp, Oryza sativa
tttcactccggcttttcgattggtgcgactctagcaattgatccgtagttagaccggtgtcagtaataaattgttctatcgtcatttctttaccggtaaccaacggctcgatctcctgttttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttgtcggcgtcaactttcgccttcttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgcccagggaggatgatgtacgcctgcgccatagaataatggcatggcttgtgtctcgtagatgcgtctcaccgtctcctccagggtaatccagctcgaggtcctcgtacgcgccttcgaccaactcaacttcaaccttcgagtat

SEQ ID NO: 58853 - DNA, 2875 bp, Oryza sativa
  unsure (1)..(2875): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactccggggagcttgatgaaggggcttattcggtctggtgggggtgacgcgacccctgcggagggagatcaggtcagagcattgtgtctcttgttttccgttgctaggctgtggctgtgcgattgccaattgtgcttacaagttgcaaaccgaacaaggattgtttcatctcacaaaattaggatcgttcatcagtgaataaacggaggcagtatatgttgtgcacatgatgttatggtattgcctggcattggacatatagtatgtaattggaaacaagaaaagctaagcaaattcaattaaagagcgagcatctagtaggcgatttcgtagtaatcaacaaatcgtacaatgacttaaggctgttcttgtaggctgcaagttttgattaccaccagtgttctgcattgggtttttaaatgaattttccagtgagaactgtttcaagttttacattaaccatagaaagtttttttccttgatggaattctatatgttggaattctaagtggctctatttgcctgcaatcaaaacttgcacctgttcaacacaaacgggtcaatttgaactgaccatgtatggataagcttctcatctcagagtatgtcagttgactattgtagcgactacactgcaaatgtgttattgtttctggaagcgactcaccaagctctgcttggatcattgttttgcttatgatttttctaaaatgaggatcacatttctggtttcaagttttaatggggatcacatttctggtttcaagttttgagatgtggaacaatcaatctactgcaaaagaaatataaccttcttgatactgcactgctgtctaaccctcataatagctatgttgacctttcattgggtgatatctgacttcatctgtagcctgtagggaactgaggggcctctgggtggtcatgtttttgctcattcaaatcgttttgcaggttatagttcattgcacgactcggacaatagatggcatcattgtcaattctacaagaagggagcatggaggtgattatcaacttcttttcacttttcagctcttttgactgtcaagtgcttacgtggtgtgtattttgtttctgaacaccaatatgtcatgaggatatttctgacttgataaattcgtatctgctttatgtgtatatataatgtgtcatgtgtggatagtggttccgtgttcacaagttctaaatagctgcgaatatattgtttcttaaattgaacatctttatatgctggtatcctatttagtggttttaatcagggatggggcatagattaaggtaactgggctatggttccccctagtctttgaactatttgcattagtactaaactactaatgaatatgtaaagttgaacatgcccatccacccggtttactctagactcactgtctgcatgttctttggaattgaccaaattaactagtggttagtactgcctactagcaaggctgagccttgttcatggacggttcattctgtgtgtgcaatagaaaagctgaacaatatttattttttgtttgctaatcatcccaaaaagttttcaggaatattcttatctttcaattaactgttacatgaatttgtcattactcattatgagcaatattattgtttcatttgtatcagtaatcagctcgtctcctggagttctgaagttctaaaccatcttctgttttactgttacaataggtaaaggggtcccgctcaggtttgtcttggggaagagcaaaatgatccttggctttgctgaaggctttccaacaatgctgatgggtgaaattgcgatggtatttctatacagctagtttaaaccagtgggtcaaaagaacaacaacattctaacaatgagccattactcttcttttgggtgtaacaattaaaaatgtacaggtcgtactacgcaaatatttatcattctctcatagtatcttttcgcagttcaaaatgaagcctcagatacactatgcagaggaggattgtccagttacagctcctgacggctttccaaaagatgatgaacttcaatttgagattgagatgttggatttcttcaaagccaaagttagtcttgttgaataatggcttcagtgtgacttaaatccttaaattgctgtatatttgagagctattctgtgcaagctgttaggacaaattctcatgagctttgatttcatttttaataatttctttctggtacagtatggattctagaatattagccaaatgtttgactagaaccttgtgtccaagatagcagacgcttactacatctttttttttttcggacacgcaggagatcacttactacatctatcaccatgtgttataaagtgtttcatatttcacttcataacccaaacaatacttgtggtttctgattctttagcatctatgctgttgttcaggaatatatctcctcaagtacagcaccactataatgcatatatcataagaaaatgtttgacaacaatattgatttatttcatctttatgttcgtgaataatattcatctggcatcgtgcctgcttgttgtgatgtatctcagattataccataagtttgaagcctaaaattcaaaaaagcaaaatgtatctttgcataaaaaagtggcagatcaacccaatactgcatatacacatgttcttagaatgcagc

SEQ ID NO: 58854 - DNA, 1072 bp, Oryza sativa
cggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagttcaaatcatgtatatgctagttatatgtgatacttacaatttttaaaagttttaaatcacacaggtggcaatttcatatgtacgttaattagagtttttaacatttaatttactagcattcatatgctaattataattgactattgtatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagagaaaatcatatgcagtgctataatctttagtcccggttcttaaccctaaccgggtttaaaaagaatttcgaaatagcgggaaaagatatttactccc

SEQ ID NO: 58855 - DNA, 37442 bp, Oryza sativa
tatgcccttaaaatttgattttgatcccttccatacccctctcgtcagttgaccgtctaatgtctataaaaatgaccatgttaccctttggatgaacatacaaatttatgaattacattattgaaaatgtaaaagattgacacatgagactataatagttatgagtttgttgtgcgatatattatttatgacaaaattatttttagataatgaaataaaaaaatatgtatttattttatttaggagcattcatacaaagataggactaccaatgctcaccatatatttttatgaatgctcttgataaaaaaaatccattgtcctattgaaatttcaaataaaagttttaatttattaaatttgttttactttcaaaatttatgtcaaatttttttgcactaattatttagtgtcattagtttcataaaatgcacatattgtgcactcaaacaaaattttcaatcgtttttcaagcttatattcaaatctaaatcatcaagggtataaaagatattttcaaccaaacttaaaagtgaaatgaaggaaaatgtaccggcaggggcatggaaaggatcaaattgaaatttcaaaggtacaaaagggatttaaatttcaggaggttgaaagggattggatgagttttcaagagtataaagagaatttactctattgtttatattgatgtataatgaaatatttcagtgccttctatggccttacttagattaaatatgtggatgggaattgggaaatattgggaaaacacactatctttcatccctaaactttttaatcgggtttgttaaaactatgatgccacattttcacataatttcagtcactttttctctatgtgattgcgctctctccgatatgtaactatgcttatatctcttgtatcttctcttccaaatatataataaatcacttttaatcctaatcatgaattctcttaattatacattgtatattagaaaaactctaatgtatatatattataaattacagtgtaaagttttaactttatattgttattataacgtgagtgtaggtaatttaaagtgtaaaaacgatttgattatttttttaaaaaataaaatgtggcaccataaatataagtgctcccattttattagttaggttaatttgttgtcaaagctaatgctgtccctttaacaattaatggaaaagtttacatatcagtcagaatttctcctaacattaataacaagtgtgatccttgtggtatctccgtagtgtccgtaagaaagttattttattatattcaaacatgatacaatataatggtacataagcctcatttgacttgaaatgaaatcagtggaaaagaaagaataaacagacaagatgcagcagttaacgatagaacatagatatgcatgaataaattaattaaacatgcatgctcgtaaatttgtatgagctagtgattgacagcccggcagttcctcctgatctcgccattgccgccggtcttcacctcgatgctggccatcttcaccatggccttcgtgaacctatcctcccaccacccggggatgttggcattgtccaccaccatcttcgccgtcgccggcgacgccaggagcgacgcgtcggaggtgaagagcaccctgtgcgcgagcacgttcttgtagtactggttgtccagcttgttgggcgtcacgacgtcctgcaccaccgtggggtcgttgcctgagctcggcttcgccgggcactgcgtcctcagcatggcggcgagcgggggctccatgtcggaggggacggcgaggcggtcggggacgaaggacgagcagtgggagtcgccgacggtgtgggcgccggagagcaccaccatgtcctccatgccgagccccttggtggcgaagttggcgacgagctggccgaggttgaacttgggcggcgggaggaagtcgagggcgcgcgacgcgttggagtagcgcccgtcgaggcgccccgcgggcatctggaacgcgaccctgctgttgctgaggaagaaggaggcgtcgcgcgcggcgaaggcgacgatgtcggcgcaggagacgacgcccgggcaggccgcctcgacggccgccttggcggcgtcgatcacctcgtaaccgcggaggctgggcatgttgggcgggctgagcttctccggctgcgggttcgccggcgtcgggtcgagcagcacggacgcatcacatccctgcacattttcggcattggcggtgtaaacgtgtcatgcatccacggccacaaagctgagaaactcgtaattatatgtgggttcaatcccgttttcggtccaaaattcgaaacaaaatgtagtcaaatttaaacaaatattatcagaattcaagaaaaaataaaaataaataaaaatttcatgcaaaataatatcatatcagagggtacgaaatgaccgaaatttcgaaaatttcagttcgaaatgtcgaagccttaattgtataccactccgcccgtttcatactattataattcgttttgattttataaattaaatattcttaaaagtttatcaaatttatagaaaaatgtagtactatttttaatataaaacaaatacattattaaaatatattcgatggttagtactttcgtgctttacaaattgtcgaatttttctataaattataatataaaataaaacaagtatagtacacatgcatatatatatatatatatatatatatatatatatatatatatatatatatataggaatgtacctcaacgaagcagtcatggaagagcatgcggatgaggccagcgccgacgccggggttgtggaggatggcggcgccgacgacgttcttgacgatttcctcggcatgcgggcacttggcgtagtagtaaccgaccttgagcccgcacgaagcagggttgggtggcccgtaagctgcttggcacgtcgtcgtcaccgccgccatgagcaccgcgaaggtgacgacgaccacggtggcagcgagcttattaccactacccatggcaattaaccagcttagctagctagcttaattggcttctcttgctcttcttctgatcagtggctactgagagagtgagctgagatagctagctagctagtgagatttgcttgatggattgcgatggttgaggtgatgaagtgatgctgatgtgcacgagtatttataggtgaagatgagctccagcctccaggtaagatgagatcaggggagcgttcggttgatagatagcttctggatcgcaagcttttttaatcttggagcggatgcatgttggcaaagggtaaggtggtggcaggagaccgcgcaatatgcgcgtacgtttgtttgttgcagcacaagtgtgtacaactctgcggtttgacccgcgacgttggttggctcgctaaaccacgtgctattcggaatcgttcctctaatccgagcttataacgggcaattaactggacaaaaagcgtagtgatggacataagcatgctttccagagcgagcgagctagctagctagtcagggaatgcaagtcaaactaagtctctcccaaacaccttttgtgctctgcagttaagatgtgagtttaattattactatttcattgaaatggttaggtagcaaagcttgcgtggcggatcaatcaacctacaaatggccttaaattatctagtatttagctagctccatacacaagattgtatagagtatggttataaaaagtagctagcttgtacagagcaataaccggatgggtcaccgtagttcttcttcctcctccttttcactgatattttttttacctctagctagttgcacatccatgcattttgcacaacggatcaaattaacatctctattaaaaaccaatatatttattgaacgacgaggtcaaacaaaaagatcgataacttccttcgaatataagatagatagcaatcaaggacaagctaacacataatattctagttaaatcctctatgatataattgcatggggttgacaaaatcatcgcacaacgggttgacaattgaagtagtgaatttatctttcactaatatataattaattatatacttacttcagtaaataaaaataattcacaaacttaatcaattattttaggagcatcaaatgtttgatattacagttcaaggggtaaatccttgtatcacgttagttgaggggtaaatcggacttaatcctttatttgaataagacaaataacaaactatcatatctaaatatcaacatcgttgtatatcaaatggacaaataccaaatttaataacgccatataaaaagtatagtccccgaagaaaaaacggagggagtactcagcaagcattattgaaataaagcatatgcgcgtatacttatgcacggcaggtactagctagtgtcagacaatgtctcttaagcagttgattatgcgttgcagctagggatgaacctggttcggataggttccgtccgtccggaccatttttcggattcagatagtttcggtcggaattatccggaaattttcagattcggaaacgaattcggatgttttttctcggaaacgaaaacgaatacattaagagtactatccgtcggaatcggaaaacggtcggaaactatccggatttttttccggatatccgtacacattgagcaaattttagaaagaacatgtatatacgtatatatgtataactttttcatatggaatcagatgaagacaaactttatatcaacattgtagagctcgatgagatctataactttattattgactattttattatttgaggtcatttaagggtctaaatattcattataatataccatattaatttttacaaaatctcagatctacaattcaaacgacatctgatggagatgtgttccatatcaaaattgtagagcacaatgggatctaccactttgtagtttataacatttgtatttaaaagtatttaaagtataatacaaatattacaagtttcgaagacgtgaagtaaaataaataacatctccaatttatacactggtaagtaagttatacatctaataaacggtcttgggaatagaaaatgataatcatatttgcatatggatctcttagaggaacagccatgaaaatcgattttcacatacagttgtgggaccgtctacaaaattgacgatataaatgttagagatgttgaactaaaataataagcgatatctcttcatttatcaagaaactcaatttgaggggttttttatatgccggtaaatattcgctaccgcatttgttccgtctcgtattcgctccgtatctgtattcgataatattcgatttcatttccgtatccgagttttcgattccgattctgattccaaaaaaaatatgaaaacgagtatgataaaactagtttccgtccgtttccgatccgttttcatccctagttgcagctggattaattatgataggtcagggttacgtgatgaaaagttctctcggcaagtgggcagaaattaacaaattcttttcagaatatgtagaaggagtgaaaaccttgactagctcttagtaattaacaaatacagcaggttttattactgattaataacagcactagctcttgttcaagcaactgctaaaaaaaggaaaaatctaccaactagctggtgcgcatatcaaactaaaaagttcattgtattagattgattgaaatagcttcatcatccagtccaccaatatatactccctcttttttttaacatcatatatatactccctccgtttcgttttatttgacaccgttgactttttagcacatatttgactgttcgctttattcaaaaacttttgtgaaatatgtaaaactatacgtatgcataaaagtatatttaacaatgaatcaaatgataggaaaagaattaataattatttaaatttttttaataagacgagtggtcaaacatgtgctaaaaagtcaacggtatcaaataaaacgaaacggagggagtataaaggagggagtacaatggtgttgctactttatttttatatgtaagtcaacatttttttggcagcatatcgagaatctgtgcatggcggaagcttcgttcaagcctgcattttaattcagaattgctatatttgtgtcgccacaaatttgttagttttatagtcacatctcatacgaccatccatgttttgctaatattttgcagtcgattatcttcaagatttgttatagtatttgctttcacttagagattaaactatatcactggtggataaattattcatactaattatattgtacttacactataattacatactgattacatatgtaaatttgggacttacatatgtaattttgagacttacatatgtaaattttggacttacattgtaaatacgctaaaattacatatgtaatttaggaacttacaatataaatacatgcccactattttttgtgaaaaatatgacgccataaatatagttacccttgccacgttaaatgcataattgacaaatgctggataaaaattggtatatatacagatagagatatatcacctaaaagctcattgtactctagtcaaataaaatcacccatcctatcatttgtgaggtttcctcctattcttagaaaactatatataattcctacatttgaaaggtggaaaattaaactaaaccgcttgacatcattagaagataaattcacaattggcaatagagagattttttagtacttaagatactcccttcgtttcaaaatatttgacaccgttggctttttagcacatatttgaccgttcgtcttattaaaaaaatttgtgaaatatgtaaaactatatgtgtacataaaaaatttgtgaatcaaatgatatgaaaagaataaataattacttaaattttttgaataagatgaatgatcaaatacgtactaaaaagtcaacgatgtcaaacattttgaaatggagggagtatatagctatacatacctcacagtgttagttaagttaggaggtgtttatatctgccccagaagggatatacctactcccccacaaaaaggggaaagttaagatcatatataaaagatgagttttcaatattattctaatcggattagattagttttggtaactccctttatttagaggtatcttctgtatgaggaggtatacaaatacaactatcctaagataggagaaaacctcaccactaattaatacatagtttttaagtttaggacttccaacaccgtatgttaacgacgggaagggaaaggtattttttttcataataaaatctatcaaatgtcattgtagaagtataagggagatttcaaggataagattgagaaatacacatagagtgccaaaggaaaaaacaaaaagctacatcagtggctcaggaaggagtaaggggtgcccacaatatgatgggactagaatatctacaatgcttctttccaatcgcgtagtagtacaactacattataaacacctatatatatagtgggaagataaggatatgatacaattggctcatgttctgcaacaaggatagaagactcaaactaacagttcacaatgcaaaaaagaaacacggctctcactagctgcagtttggcaaattggcacatgccaccatcatggacgacaggacgacggtgcacaaaatatagtaatatgaacaactttagacgaaaatgtaagcaccgttaggactggccacaggacaaaagtataagcaactatatatctaattaattaagcagcaacagaaatcttgaaaacgacttttcattagagggatgcatcaaattaaaggctcaaactagtaatgctagagcaattcttttgttatcaaactagctattcgtgcccggtagccaaatacctccaactcaaccaacgaaacaagctagctgccacttggcagcattaacctctcccattacatccattaatacatagagtatgttaactaatttaaaattatttcctattgctatccgctttgagtagttgttttgttggtaacgtggaaaggtgtcttgacatcaaatcgcaccgtcacacttttagtacgtcatgtgcaacccgcggcggtacccggagatgcgttgccgcagggacttcacttggcattttgctactactgtaatccaagatcaatttgatccctcgaggctcaaattgcacaagaacaatgttgaataatgttaccaagcggaacaatgccactgtcattatgacttccacgtgtagatcaagagggagaagtcatcgccatgctgcatctcggtctccttggggttcaccctatccatgacgatcgagccgctggcccacaacaccattgatgaggccacgaatcctaacaaggaggagctcgtgttgtcgtcgtcccttgtcaaccaccgcctagatatggacgtttgctcaagatcgacgtcgtagatgccatcaccgagcgttggttgtcatcgccaccaccatctcagagccacaaacctagttaccatcacaaccaagagtcggggtcgcagagccatcgctgaggacagctggtgtcgtcgaaaagcaacccttgttattgccgccgctagatctggcggtcatgaatcacaccaacagtaaccttccctgtgtcgtcatgtaactccttgtcatcctctcgggcgtcatccgctcgggccaactggattcaccagcgaggaggtcggggtcaccaaatctagcggccttggcctcctcgttggctgatgcggtagcggttcgcgacagtagtgcaacgcatctcggtgacgatggaggaagtgtcagatgaagggagtgagagaggcagaggggcatggaaggaggtagatgaggtgatcgagggagccaagggagcgagggtttggttggcggtgggacttttgaataccgcagaaaagatttcgcgagtggtgctcttagatactgccaataaaaaccaattttcgttgggctctcatgaggttcgcccaaaaaaatagagctattttttttagtgggacctcctaagtgagtttttcgctgacggcttgtgacccagaatccgccaatacatttttacaagcatttatttcattagtccatcaataaaaataatagggtgatgccatgaaaaatcaattttttatagtgctcgagcatttgtttatataaggtaatcaacaaattagtaaagcttagtggagtttttgggtttacagcgtcaaacttaatttcaccgacaccgtaagtttgttagatatgcttgtacgtactccctatggctacaataatactgtgctaaaaaataatttgaagtgttctttagttcttgaagaggcttaaggtattactgctttaattagtgctaacaaattaaacttgctttccttcaagcggtatagatatttcctcaaggaagtgaaaatgaaacggaattgctagattactttcgacggatttttagggaaactttcgacttttagaccgtcatatttgctctaagattcgtgctagcaaggatgagaaaaaataaattggtaagcacaattgttgggatttgacctcgcggccttcagtttgtggagggagtgcactgcaatcgcgccatacatgttttattctagttacatataaattatatatgcatctagttatattgtagttatatatatgagttgtaatgtagttatactatagttatattttaaagttttacaaccaaaaaaactctcgataatttttaagatagtcgcaaaatgaaataactactccctttgttttcaaatatagaatatcattgacttttaatatatatatatatatatatttgaccgtaccattcttttactcaatgtaaatatacaaaactatatgccatacttaaagtacctttactagatgaacatatcacaaaaaagttaaataataatagaagaaataataaccattcatctttatttacatagtaaattaataagatgaatggtcgtatgcttaaaagtaaacagtaacacatttaaaaaatacagtaaaaaatacagagggagtacttgggttgacggtaagtagccagccaattgaccctatatatggtagttctagtaagctgtttttcttttaaaaggatatgatgacatatacccatttcatagatgccaactgcaaagccatcaaaattttgttgaaaaatggtaaaatagatcaaaatatgatatttcactatctacaaatattcaagttaaaattcgacacatataagtagaaacaaaaataacaaatctcaaccgtaaatagtacacaatttcttaattatcatcattttttgttatgtttgtttctgtttgttgtgtaggtcaaatttaaacaagcatgtttgtgaagcgatatatgatatattgatctattttactattttttatgagtatttagttgatatacataaaaagagtgtgtatgcatgatcggctttcccctaacatacaactatatgaattgtgtgttataataatctatctatctattatattattaaaacagctttgaaagaagtcgccacgttcgctgtgagggctagaaatttccacattaatcggagaaaaagaaaaagagagtcgaagtagaaatacaattaaaaatagctgaaattcggaattaaaaataagcaatattgaaagaagtgtccatataagaacccaatacgagattaatcaaaattcaaaataaaaataaaataaaatccaaaattagaaaataaaacgagagagtcctagtaggaatataatttaaaaataactgaaattcggaattagaaaaaggaatattgagagaagagtccatataagaacccaatacgagattagttactattcggaataaaaataaaaataaaatccgaaattagcaaaaagaaaaaaaagagttcaagtaggaatacaatttaaaattaactgaaattcggaattaaaaataagcaatattgaatgaagaatccatataacaatccaatacgaaattaattaaaattcagaataaaaaaataaaaaatatcaaaaattagaaaaactaaaagagagttcaagtagaaatacaattttgaaacgaccaaaattcaaaaataaaaaataaaaatattaaaagaatactatacggtattaaataaaagtttaaaaaattaaattctgaaattagaaaaagaaaaaagatttcaattaggaatacaatttataaacaactaaaattggtgataaaaataaagactattgaaaaaaaaagactatctaaaacacacgatgagataaattaaataacaagcctataaaagagtagagtggtggcggttgatacgacatataaaaactattagtaaaacaacagatagaatcctaatgatgattaaaaggagggacgacaggcaagccgtgaagcaaacgggcaaggcggttgccgggacttctagaaagtaaaaaaaataaaccttattgataatcatatttgatttttaaaatctcaatgacaataaaaaggagaagcagcgggtggggtgtataggagtatagttgcagagctgctgacggttggcgggacttctagaaaataaaaaatgaattccaatgatagttatatttgatttttagaatcccaatggcaataaagagtagacggcggatgggtcgtagaggagtatagtggcattgtttgacgtgacttctaaaaattataagaaataaaagccaataagataataaattctaaaaactacaaggtccaatttttaaaggttcggaacttctaaaaagtaaaaaaaaaaaacccaatgataatcatgttcgattttaaaatctcaatgacaaatgacaataaagaaggtagacagcggacgagtcataaagtacaatggaaaagccgctgacggtttggcgggacttatagaaagtgaaaaatgaactcaaacgataattatattcgatttgtaaaatcccaatgacaaaagagaaaagacagtggacggaccgtagaggagtataatggcagcgtttgacgggacttccagatattataaaaacgaaacccaacgagataatgaactcaaaaaactataagatccaattttgaaacgtttcaagaagaatgaatagaaatagtgatagaccaagcaagcaaataaagaaggatatgatagaagtaaggggtagcagctagtgtgacttttaaaaactacataattaggaatacgggtatagctatttaataaattttaagtaaaatcatactgaaagatatatgattttgtttgggtgctagccgcgcaattgtgcgggccacccatctagtttgaataagagaataaatgaaagtcatgcactcacacatctatatcattacatccatgggtatctcgagccatcctagatttttctcttttcaaatttcagataaacatcaatatatagcgggcacttgttgcaaaaaacttaacttacaattattccaagtacatatgaccttattacacaattaggtcaaaacaaagaaatccatagcatgtaaaccttggggttcacaaatgaggaattaaggaatggtaacaaaagagggagaacataaatgtgaagcaaaagtcacatccaatcataacatcatcaacacgtacgcttgcgacttgatcaaggagggtgtgaaactatcaaaccgtgtacgtcgtcatcgttgagcacgtacttcaccaggtaattgaatcacgcagctaaacttgtagattaatcagtagttgatgaccctgcagttcttcctgatctgcccctggtacccggtcttcacctggatgctcgccaacttcaccatggccgccttgaacctgtcctcccaccacccggggatgacggcgttgtccaccaccatcttcgccgtctccggcgacgtcaggagcgccgcgtcagaggtgaagagcaccttgtggtcgagcacgttcttgtagtactggttgtccagcgtgttgggcgtcacgaagtccagcatcaccgtgggatcgttgccgccgggcgtcgcgtcgagcgggcactgcgacctgaggaaccaggcgaagccgccgtcgatgtcggagaagacggaggcgttgaggcggtcggggacgaaggaggagcagtgggagcggccgacggtgtgggcgcccgagagcaccaccatgtcctccacggagaggcccttgacggcgaagctggagacgaggtcgctgaggttggacgtcggcggcgggaggaagtcgatcgggccggagtcgttggagaaggtcccgtcgcggcggcccgacggcatgtcgaagtagaccttcccgccgctgaggaagtaggtggcgtcgcgcgccgcgaaggcgatgatgtcggcgcacgagacgacgcccgggcacgccgcctccacggcgtgcttgatcgcgtcgatgaggtcgaagccccgcatggacgggttgttcggcgcgctcagcttctctggcgtcgggttgaacggcgtcgggtccaggaggatcgaagcatcacaaccctaacaacaaaacaccatgcacatctaagtacacatagctcaagtcgatcaatcgatctcgccggagaagaggaagaagctaacgtacgcacctcgacaaagcagtcgtggaagagcatgcggatgacggcggcgccattgccggggttctggcggacggcctccccgacgacggccttgacgacggcctcggcctggggcacttgtcgcggtagtacgccaactccagtggccagtaagggtgagcctggcatgccacggccagcagcagcagcagggcacacgtcaccaatggcagacttggtgatgaagccatggctaataagcttgcttagtgtgtagctagcttaagcttactgtaccttttgtgcttaagctaattaaactggttttgcttataaccggaagaaaaaaaagtgcttcaagaacaaggctgataaccttaaggttaaaattggggttaatgaaaccattccccttgggcctgccttgccaattaaaagtttaaccagagtaatttacatggttgtacataaattatgcatagtgtacaacgattccctgttagctgcgatagttttagcgtgttaatagctacatgtttgaacagtagctattttcattttttttatttttatcgtttaccttttagtttggtgttctattgttttccaatgtgaagctgaacgattgggattttttgttagacacaaaatgttgtcacatgttggtgttatctcttttaggtgaatcagtactcttcttcacacgccacacatgtccagcctatttaggccctgtttctttcagcttgggattattataatctagattattgagagtaagctgaaagaaacagacaacttattgaagtagcttattataatctggagtccagcttattataatctgataagctcatttaggtgagcttttttcagattattgggtgaaaaattacccaccatgccaccccactccctttttagacttgcaaacccaataatctaggctctaataatctaggaaagaaacaactaaccgcttagaccctctttgtttaggcttaggcttattggcctagacttttaagtcagcttattggcttatatgatttataagccggtggatttaatgtcctaagtttagtagttgagtcatacatctacctcacataagccaaaaaagcttctctaacctagcttttggcttaatagtgttagagtggcttatggcttcaaaaaagccaaacggaaaagctgcttgtttgtttagacttagacttttcgacttataagttggcttataaacctaaacaaagagggccttattctactacagattataacaatataacttatagtaatctggctcaataatttagattataataatcccaagctgaaagaaacagagccttaatttcatccaaacctttcggtcaaaatatcttcttcttcgataatagaaaattcaggaaaaataaataaggcattaagtgacaaacagaacaacctcaaattaagttttgctaaaatctgaaatccaaacgattgaacagcacctaaatttgaagtagttaaggctgttgttaattatatacattgcaccaatatggacagtgcaggttcactgacccttgacagagatatggggtagcacgttgactatgctggttcggtgcatacatgaagaggtcgtatactcgtatattccagctactagtagttcttaattaagaaaaagagttaattaacaattagaagagatagatgtcccgtgtttcttctctctttacttttctatttgatatgtgcacttcagtctaccggttgcagatggcgatggatcttctcacggtcgttaagatgtcaggatcgttaattagaacgtttcgtctgacagacatcatcagagcacgcgctcaaggaattaacccgcttcatcatatgctggttatattttatatattagttcatctatctatccatttatctattatatactaaaagtttattaaactccctacaaatactctcaagctatcacgtagcactaccagagcttgtgaagctgccgtgtgcctcaccctgttaccgggagtttttgctagtactcggtgacttaccgagagtagcacgttgcacccggtaacattgcaaacataccgtgtgttagcgacgaaaaaaactcgggaagataaaaatacgctatgcaatgccaaaccgcttggtaaccatgggatccaccgtttctaccgtggcttggcgaggattttttttgcttggcgggcggtgatttccgttggcgcaggtggatggcgcgcggtgttttttttttggcacggggtgttttttttgttgacgacgcgtgaaatttctattggcggggccggggtggacggcgcgtgaaatttctttggcgctcgacgatttccgttggcgcaggcggatgacgcgccacgatttttggctgcacagtaaattttcgagtgggctagtaaaaagttggcccaaatagaaccacaaaaccctacccctaaactactcccccttctcttctccagtctccccctccgccgccgcctcgctctcctctcatcgcctcctcacatttcccctctctgccggccttgtcgcaggcagccatcccaaccatgcgaccgcgcgtccctatcctcatcccttcacacggctggcgagcacggccctgcatgtccacgtccatccattgcgatttatacgccattgtctagctgttcaacaaggcgcccaatcatcatcgagctgggtattgaggcctgctgcaactgcttcctcccaatctgtgtggtatgcgtatgttgagtggttcttgcatctttatgcaaatatagttcttgattttggaaaaatacacttcattttctctttggatctagtaatatggtgacatcctaatgggcgctatgctgcatccaggtccacgacgccgtgacgcgccccatccagttggaggctgcagctggtgctgtgcatcccctttcctcccggagggacgcaacatttttcaggttgtactgatttctctatgtgcctgcaattttaatttacatgagagatgctctgagcggcacaactagcagcacaggaatgttgcggcggcagcagtcgcgaggcttgtcgaccggctcagggagttgctatgagcagagcaaagagaaagaatgcacaactctggtttcttaacagcaaagaaggatgtaattcttttcctcttttattttctgttgcttaatctttggttaagtgtttccccggtcgccaagtttagaaattgtggttagaaatttcttgttctgtagtgcacatatgtacttcaattatcacaagtgaagtttctgaattctagctcatcctatttcttagttaatactcaattattatttctctgtcatcaaaagaacacagttgagataatttacaactaaaaaaatattattacagaaaaaagaatagtttatttttcacccatatcagaggcttacattctagatgaaatcttaaatttcacatccatatactttggcctagtttagttcccaactttttcttcaaacttccaacttttccatcacatcaaaactttccttcacacataaacttctaacttttttcttcaaacttccaattttagtcaaacttccaatcctttgttgattgagtgcggacaatgcataatcatgtccctcgatacaaatgtcactacttagcctactggtggctgtagaccatgcatatcctcatatcatattaggaaatctagctagcttcagttctgaaactctagaatagtaatgcaaaccaattaattacttgataactttagttctgaaactcaatattttcataataaacagtgccttggtcaagaacttgacaatgattttgagaaggttgccactagcaggaatactgaagaaatttgcaatgacaaggacttgaagattattctcaatgaatcttctattcaacatgatgacaatgactgcaaaatcctactgttctgattcatccatagaaatatcttgtttgacgaatatttctaaggtacacacttcacgtagttggagatcacactgcaaaattgttgtaacctgcctcccaagtcccaaatgaaaatttattttgtgaactacccacaaatagtgacctctaaataatctagttgtgttgtaatcttatttggcactaaacatgttttttttttataatttcaggcatataacaatcatggcaaaacactaaagagttgatatgtgatgtcaatgaacacatttggttagtcagccactagcatttgtctatatattgcctcattgggagaggttgtaagaattgagaatcatatatttctattgcatcatgtgcagagagtttgtagatccattaatattttgttattgtaccatgatgttcctattaatactgggagaatttgcagctaatgttcacatgacatgttcctgtgatgtatccttgcgctctgcttttcatgtttgcttgttgctgcgtttcagtgttgtacgataatgaatttatgaaatttctagaatcacgtattcaatgttacctagtgttaatagctctcggtaagttatgtaacagtaccgtgtgtttgactacaacacacggtaacattttattccttcccgtgagttcgtacctctcggtaacacccccgttccgtttccgcaacctgtcctgtgctggtcaatacattgttaccgagaaagtgctttcacccggtaatttttcttgtcttaccgagtgtacaagcgtagtctcacgggaaatattgcacggtaaaggtgtgaggccgctgagtgtctgttcccgagagtctgttctcgggaagctctgttcccgtgttttttcgctgtgttaccgagagcttttggcacacagtagcttccctctccctggtagtgtagcattctacaaaacgcttctaagacgccatgtgactatctaataaattagaaaaaaaatcctaaatattcctttaaagaggtggacccactattttcaaccattagatcactcaaaaagaaaaatccggtacccacgcccaccgtgtgtgggtatacacgtatagtacgtactccatgaaccctcctactttccttggggatcctactcccctcttcttttttctagccaacgtttcccttttttctagctaacacataatatataaaaataataatctgatagtttctcaaattatttgatttgttgtgttatttataattaagtacataattcaagatccatatcgtccatatttactatataaaatgtagataatctagccgttctgactacaaatatttaagcaaaatttgcattgtgaaaacatgaatgaattcaaatatgtgagtctaaagtccaaattcaataaccaccaatgagcttggaaccatgatgcatactctgggcctgaacccgatggaggcggagctgcaagatattattaggccatgttcgttagatggggttaggagctaatctcctacgcacgtaaaacgaaacgactcaatacattagcgtatgattaattaagtattagttaattttttaaaaatgaattagtatgttttttaaagcaattttccatagaaaacttttagaaaaatgaccgttcagtagtttgaaaagcgtgcgcacgaaaaacgagggagctaacttgagaagaagggagaagaacacagccttagcgaggcggacaccgacggaagtgccaacatcgactttccatgacttcctgagcctagtagcacgctagatgattagttgaagaatatgattgagagaagaggcaaaagaagatgttccgtgtcttcggcaaggacaaggaaacagcttcatctccgctgccaagccccgccacgtcatgtccaatgcatcaggagatcctcactgatgaggaggtcgatgagatgttccgtgaggctgatggtgataggcagaccaactacaagggatttcgtaattgaatttagaaaaaataaaacaagaaatttaaataaaatacacattcaaaaaaatcattaaaactataaaaaaaggtaacaagattccatgtagaataaaaaatatcaagagtccatataaaagtataaaaagtttaagttataaatatttgaaatttggaataataaaataagtattaaaagatgagtccaaatacaatatgatacgagattaattacaatttaaaatccttcaaaagacaattgagaataaaacaataatttgatttgaatacaaattcgaaattgattcatatggagtatatgcaattcgttatggtaaaagaacatttattaacaataaaagtttattgagatgttttgagaaaaaagagatacaatgaacactcaaatagaaatagaaaacaccttactttaatttcaatttattttgttagaattattttcaaaataaattactccctccattcactttggtcgtcatattttggttgtgcagcgataccaagaaacccattaacgtttcgattactgcgcatgtcgcgtgtgcctgctggccccacctgccctttgcgctgctgaatctataggctttggttggccatagcaattttcatgcacaagtctgttaaatactccttgcatgtggatctatagagtacgttttcaatctgtagagtacgttttcgtgtgaaccaatgacaagcagtctttgcatgtggaggagtaaatgctgcatggaaacaaacgaccactccatcccacccgaaaagaaattgaatgcgacgatcagaatgtttttaattttaaaatatgacgattaaaagtgaatggagcaagtacgtagtatgtatacctgcgcgaatacatgggctatgctgattgaattaatggatcaacatttgcatgattcactgtaaagttagtttggtacgtagatactgctagcccaaaattaaatggtgaaattcgttcttacaagaatatactttggaatataattaagtttttgggcaacttgttattagcagccatccgcaggtgtaacgtactatcagaaagcgtcacaaagctgctactagtatttgcgtcgtctttgacctaatcatttgtcacttttgagttagctgaacatgttaaagttaactaatcaggcgtgtaccggcgctcgtaaactatatgcactaacaacgcatgtgatgatgatgatataaagtagctggtgttgcgttcattcttatcgcttccttcgagaacaaacgtacgaatgatccaaactatgctatctggaacaatataatacgtgtgtttttaaaccttaattatgtgcgtaaacatgcactaggcagctaattactttttttcagaaaaaaaaattaaaacccggcctctacgggctactagctagaaggttggtcagggttaaataagaaaagaactgatgtggggtactaacaattatatgttttcgataatgtaggcggccaatcaatatcatgtgttcttgttcttgttttatttacttttgatcgattcagatacttgaacatggttgctgcatgggcgttgaagacgtagcaggctatataatttgacggatttctcctatgaatatttggcccatctttcatttcggcctgaaacgtcagttagcgtagatgggccgtgctttgtagcaggctgtacagtattcacacgcaacgcagagctgggtcgcattggaggccttctgggtcgtgggttttgccgcggcggaggcctgctcgctgtcagcctttgaggcaaagggtcgagatactctctagtcgaagtcaagtgacaaaacatgtggatccgatcttaatcattggaactatatgtcagtgacaaatgtacatttaactgcaaaggatctcaatctgagacaaagatgctggacagaagcaagcagcaatggcggcttcgttatcccctctgatctgcaacaacattggctggagatgaggctacgacagcagcttgggccttaaggaagaagagagcccaagtcaaagatagcttagcttgagaaatgcagagttcatcgggctacagaggagtgatggcgacaattaatctacacgtttgctggtagccggcgactgggagcacccgcgatcacactctaaggcactgttgccaatccggcaagtttcagaagggagtggaggaattagcaatgttcagaggaacttgagatgaagggcatccccaacagcatcaccatttgagttctcagggggcaaaaaaaataaattaatgtaagtttgcagcatcggagatgaatgaagacaataataatgtggctttcaggctggcttagctagcttgttattagcctctctattccgtttacaggcatgcattgtatacttgtgcgaactatttgtgcgtgtttgatcgatgaattgtgtggttgtgtttggttttgaaggttatcaagtattggaatataagtgaaaattgttcgtctttgctcttctgcttaaactttcgggttgatatagttagtgtgcacaactcaattagtatatataagagagagagaggtttcatgattgaatcctagttgacatataattaaataactattatctccaatttaatattatataagttgttttgattttttttctaagtcaacttctttataattgactaaatttataaaaaatatacaatatcttcaacacaaaataaagaaactatcaaaacatattgaatgttagatgtgatgaaactaacatgatgttataagtgttgctataattttaatgaacttagttaaaagaagtttaactaaaagaagaaggtcagaacaacttataatatagggggagtagtagggtggcccacgtagttacgtggctagcaccgaagttaaactgtatcatgatgtaaaattatctacctcctctatttcacaatataagtcattttagcatttctcatgttcatattgatgttaatgaatctagatagatatatatgtctagatttattaatatcaataagaatttggaaaatgttagaatgacttacgttttgaaacggagggagtacattgttttaacttgatttttttaaaaaaaacacaaattagaatattcgagtcgttggctatatatagacatttttctatataccccatatcatcaatcatactccgtatcatactgcatatatatagacatatttctataggacaaagtgagcttatattgattaaataaatgatatgcttgctatgaaaaataataaataaagtgttagaataggtgttgaatatactagtcctatttgattacagttggacctagagttgtaacagatgttagtgggtagagttagaatcggactctgtaacccggtaactctcttaaataaagagggaggcgccacaatgtaaccatggcgactacaatgtaacgtagacacgcagggagatgatggcggcgtggccatggactcgaagcgcctaggagctatattggttggggatgagcgcccataatcagagccccaaggatgtaagcttcggctgaacatcgttaacaaatatcgtgtgttcctgtgtcgtcatctggcatgtcttgggtgatcaatgactgaagcgatcgggaaggttagtcgtcgttccgctatatcgactaacttttataacatgtggtatcagagcagaaggtttcagcattggattacgaagacatgtggtagaggaaacacgaggtggggatcgtgcatcgataggagatcgtcaatcgtggcgatgagatcgatggcagaacgtgactggaagacgaggccgagcgtggccgaaggcgttcggtgagatcggaggggtagcgccacggacagtgcgcccgacgcacgcggcgatcgcggatctgcggcaacagggaggccagtgacggaagggtgaagctaacgagcgtggcacggcacggcggatgtggaaggccgagacgatgaagtcgaggacggtgaatacgaaggctgcgactgcggtgcgtgcgagggcacgaaacagcatgtatggagtacgtgctatacacgcacatatgcacacgtacgacgagcaagaaaataaccacagggagcacgattggtgttcagatgcagagacgaaggcagaagcagggagatggccaggttggactcgactcggacacgggttttaggagcggggcaattgatctcggccagtatggcgtgtccattatggattggactcatctagcactggttactggttgaatcggcaacggtaatcggcacggcaagactcaagcttcagtgaagtctcggtgaacaagcgattcgtgacagtaaggcttgatccatgccgcttggtttggatgggcccacgtggttgagttcgtaggcatgcatgaaggttgtacgttgagtggacacatgcatgcacagtcagcatgtagtacatgtgaggccattaaacaagtactccctccgtaaatgtacgaagccgttaacttttcgaccaacgtttgaacattcgttttattcaaaatttttgtgtaaatatgaaaatatttatgtcatacttaaagaacatttgatgatgaatcaagtcataataaaataaatgataattacataaattttttgaataagactaatggtcaaacgttggaaaaaaagtcaacggcgtcatacattaaaatatggaggtagtacatcaatgtatgtagcaaacagcaacaaaggtgcggctcagtttgagaatgcagcaaggcgtgtgtatgacggttaaactgggccggtagggtggtcagaccgatgaactggttagactgcggagcttgtacggttagaccgggttcaacggatagtggttcgttgctggaacttgttaacagatctagaaaaaggacaagaaggttctacagatggatagtttacaggtgtgaagggcgagtagactagcgacaacaggctagtcaggtcgcatatgaaattatctggtgaaaacatgatatatgtggaacttgatgaggagttgagatatatggagttagtccagaactgaagaaaagtcccgggcaacagcgggtgaaaatcgttaagggcgtcaacgggctgtttggcagtacaggatatatccaggatctgccgggattgcatgatagggatatatggaatctgcgtcactgaagagtaagagcaagcgctatggtggtaatttcttcggatgattcaaagcaacagtgattttctcaaattatcggatattcagtctacggatgcgggaaagcgaggatgttgaattcgttagctcggttcataagacaacaaggaagaaaaggttcttttcatgtctagcgagtttttgatttatctatttggtgatgacatcggttatctggccatggattagatcaagtcaaatcaaagacggaagatgaaggtgaacatggtcttcgaggagtctgtgatgtgacagctaaggaggagttcaatttcgcttggcaagacgactgtaatgatatgagagaaagtggagcactattgtagctggagtccagaggaataaattacagggatagcaaagtctcttaaaggtggcgggtttggtgcaggctcgtcgggcggcttacggtgaagctgcaaaagaagacaacccaaatctggaggataggtggatcggcatggtgattctacaacttctaggtggcgtatattcgccaaggtggagtttgttaaaataggtgtcaaatatacttgtcctatttggttacaattggacttgaagttgtaataggtgttagggggtagagttagagtcgggactttgtaacccgataacactcttatatagagagggaggcaccacaatgtaatcatagcgactacaatgtagcgtagacaggcagggagatgatagcggcgtggccatggactcgtagcggctaggagctatattggttggggaggagcgcccataaccagagccccggagatgtaggcttcggctgaacctcattaataaatatcgtgtatttctgtgtcatcatatgtcatatcttgggtgatcaatgagtgaagcgatcagaaaagttagtcgtcgttccgctatatcgactaacttttataccataaagtgactaacaattttcctgttttgcctctataatgatcgagtatctccgacagactcattatgctacaccactaaattacgattttataaaaaaaaatcattcctatatgtgtatagtttttagaaatcctgaccggccgccaccatctttctactcacctgtaccatgtcctccatctttatttctattgttgcctctcaaatcgccttgcaataccgttgtacttccctacccctttaccacccctcaactcgattgttcaccgttactcttctttaggcacattataaaatcaaatcttaccattatatcgtggctttgcttatatatagttttagaagctgtcaagggaaatgggttccgaacccttagtttcaaacacagccaattcacttatggctggtttggtttgtcgtctaaattggccttacaaattttatcaatgtcaaattttgacatggttaattttagcaaggcaaagttatgtttggattgaagtcaaaatagtctaagttaactattgaaatggcctattttcttaggcatgctaaaatttggctccaaactaaatagacactaaacactattgaaattatcaaatattggtaagatcaatttagacctcaaaccaaaccaacccttatattctacgtttgagatgggagtgttggtatatgtgtgattttctgatgtccagagtgactggagttagctttgtctggttagaacttaggagcaggaccaagatcaggaagaaattaatttttacggaatttgaagttcgcaaagagattattatggaaggacagaataatgaaattgcaaaaaataaaaaaaatagaaaaaagatgaaggggcaggccttcaccccatggttgggcgcgatagaagaagtggcccagaagagagacggtccacggcccatccgggggagcaacctggatcaaggagcagacagcccagcccaggccgggacagctcggagtcagagcagagtgcgcgcgaattcactcgtaaatctgattttttttttctttttatttttttttgagaaaacttgtagtaaatctgaattgctttgcacgctagcgatcatattcatacgcagatacgccggtcatcactcatcaccatcaacattttgaaatagatgcacaacgtaaaatcaacaaacaaaatatagtagtactgctcacagttttattcatcagaaacatgaaatgatcgtacaagccacacgtagaaccacagcaaaataaatcaacaaatcgaaacaacaaaacggtaagaaattattccaccgcataatcaatccccactaaccacaccatttctagaagataaaacccaagtcccataaatcaaaacaagcaataatgtggatggttgcatccgattgaacaaaaagttaaagttgttctgaattctgatacttctgaatcatcattttaattagttgaccaccctgcagttcttcctgatctcgccctggtagccgtttttgacgtcgacggcggccatcttgacgaacgccttcttgaacctgtcctcccaccacccggggatgttggcgttgtccgacaccatcttcgccgtcgccggcgaggtcagcagcgccgcgtccgacgtgaagagcaccttgtgggcaatgacgttcttgtagtactggttgtcgaacgcgttgggggtgacgacatcctggttcacggtggggtcgtgcgccgtggtcgggttggcggggcacctcctcctgaggagcccggcgaagccgccgtcgatgtcggaggcgacggcgaggcggtcggggacgaaggaggagcagtgggagcggccgacggtgtgggcgccggagagcaccaccatgtcctcggcgtcgaggcccttggtggcgaagatgtcgacgagctcggtgacgttgaagaagggcggggggaggttgtcgagggcgtcggaggagttggagtggcggccgtcgaagcggcccgccggcatgttgatcttgaccctcatcctgctgaggaagtaggcggcgtcgcgggcggcgaaggcgacgatgtcggcgcaggagacgacgcccgggcaggccttctcgacggcgtccttggcggcgtcgatcacctcgaagccgcggaggctggggaagttgggcgggctcagcttctccggggctgggttcgccggagttgggtccaggagcaccgagccatcacatccctgtaaaatatacatgcagatgtggcgcgtcaagctcactgatatgcaaatatgtacaatttttctttggtttgttaatacattttgtagtgcaaaatttagtactccctccgtattttaatgtatgacaccgttgacttttcgaacaacgtttaaccactcgtattattcaaaatttttatgcaaatataaaaatacttatgtcatgcttaaagaacatttgatgataaatcaagtcacaataaaataaattataattacataaatttttttaataagacgaaaggtcaaacgtctatcaaaaagttaacggcgtcatatattaaaatacggagggagtaacttttcagtgtttaggtactaagttaattaccaaaactaatttaaataaaatttgtttaaatttcaattggtcctacattaccgaaagcttaagtctaccgctgcttaaattttttttttcaaggggttttccaaaatagaaaagttggccagaggtatctcaaattaattaaccaaatattatatctttcagtacctcctcaacaatcataaaattatttttactcaaaaagatacgagtatttttaatgaaccgtaagaaaattttgggaattatcacattaatataaaaaaattgtcatttcataataactcgggtaccagaggggcggcatgacaattcacatttatagaacaaaaatatttctggtactcgaaccgtaaatttcaaaaaaatataaatgcagctgcccatatatcttgctataggttcagccatgtatgtacctcgacgaagcagtcatggaagagcaagcggatgaggccggcgccgatgccggcgttcttgtagacgaacttcttcacctcctccctcacgatggtctcaacgcgggggcacgacttcttgtagtagccaacctccaagccactgcacgcggctgcaaggagcagcgtgcaagtcaccgcgacggcgagcttaattgtgtgtgcagccattagcgcgcagctcttggtaatcagttcttgctgctgctgcttaatctgctaattaaagagctagctcgctaagatgagggtgatggtgtgttagtatgtagtaatgatgggtatttataggtgtgatgcatgtgcatgatggttatatgcattatccggactaagtcttggggcattcatagttacttaattgaactcatcaatgaatgatggagtataattattatatgggagataatagctgtgtttatgaacatggaagccataatccaactacaaactgggtaaagcattgagcagagtatatatgctttggagtaaagtgtacctagctagatattgctctcccctactgttttattttctttttcttctggaggtccgtcactacataaatatgtggaggagtagaaccttttttttaagacagtttaaaagaaatcaacagactaattaagccagctactccattttaattgtgtcctgctttgaacagtgattgtgcagctagatactacaatattctttatgggcataaatactccagtaaaacaatcaacaaaactgctgatgaattctttaatactccttctgtccctaaatataaaagatttttggtgtatgtgacacttcctacttcctagcgcaatgaatctggagagggagtctgtctagatttattgtattaggatatgtcatatccactcaaaatcccttatattttggacgaagtgagtacttcactcgagatatttagctgaaaatactctaccaggctttgtgcgggaatactctacaattaacccttcacatatatacatacctcccacaatgcacattctcatctagttaactaaatggttataaagtttcattgcatgagttttttttgttttttttttcggtggtcattgcatgagttgctgggctgatatgaggttcaattaatcgatctgtacgcagagcaggtcagtttattgttcttagctgaatgttagggcatgttcaacaatatatacatagctaggctgtcactttgcaaattgccatatcatataagatcctagatggcatatagagggtaaagagagaatgtaccatcaattatacaagagacgacccgggcaaaaaaaagtcaacatacagcaatgaggattgtgaggggtggatgtgatagataaaataatactgaattataattaatggcaacgggatgataaagaataactactggaaataataatgttacaatgtagctaagatttttcactccgatccctttcatcacttataattgttggttttgataagaggtagacaaactttgagcgctactttttaagtcatatgaaagtgaatagatttcaacataatatgcattagtaagttagtttcaattatagtttgaggctaaatagttagattattttaaaaatagttggtcaaattaagcaagataactcaaaatcaaaagcgatctatttgtaaatggagcgagtatattcctataagctaagaacgttgtctcttggtacttggtagtatctagtagtgagaaataaaagtaataaggccgcattcgggaggtagagtttggaactctatatccccgcacgaaaaacatgatggtttattaatattcgaaaatggattaatatgatttttaaagcaactttcgtataaaaatttttttaaaaaaaatatcgtttagtagtttgaaaagcatgcgcgtggaaaaggagggaagtgatgagaaagtagacaaaagaaactcaacctaagttgtggcaacttgcatataattaatagtagaagcatattatacacattgttaatttgatctcttgcaagtcaatttgcggcaggtcgtggttgtcaccaacattccctagcttagctttctgacttggcaacattcatgttccgatattaattagctaatgccaaagcttgtggcgtatagtactcccttctcgattcgtcctgtctttttatcttaaaattttctctcacgaactctgtattttagattcgtagccatcaaacgagtagggctccgtcctctctcattttctctccacataacgaagattatgaaagtcttttaatcgcttgcttaattagatgcctttgacactttatgagacaatagctttttaggaacggagggagtagggtgctatagaaaattgggtgctttagttttcacgtagtggccccttcacttttgaataatgacatgatacccatttcgtccttcctaaccttcgctaagatgtttggtctcaaaatcaataactcattgttccaatatggcataaacgaaggaaaacagatgagaatcactttatatatttagaatgataagaaaagtagtttgcatgtcaagagtcaagacacaattaacataaaactagatgataaccccatgtaccgaaatgctaaatatgtggaaaaatatattttttaatccataagaaaaataacaagtctactttaaatatggcaagacatatatcatctgcctggatgttacaatgcaaggacaagcacatataaataatcagtgaatagaagttataatccagttgactttgaagagtttctctcagtgagcataagaagcagctccattttttttctcttttttgaaagaacaagtggctccaaattgcagtagaacaacggtacaagatcaggtcaatgaaatgcctgcggctgttggcattgtgtatgagctcaaaatgggtctagaactcagcccgctttctcatcttctctggaaaaggaaggccttcttgggtaggggagtctattttgccttctctcatatctttctcctgattgaatcacctctctcacccacaaaactagctataacacctctcatcttcgaaaaccggtgtaaatcgacttctttaatagtttgggaagtggtttctgttgacgtgataggttgactgatgttgacttgctgagttagcgggaggaaccaacttatcatcgacttctcatcaaatcttcttcctcacccctcttccttctctctatctctttcctctctttgctcttcctcctctttcaccttccagcagtagtagaggcagggagggtggtggcggtggccagtcggacctgaggagggcggcttggcgagtcggacctgaggctgaggacccaggcggcgctccgcgtcgtggaaggcggtggtttcatacggcttgcactaccgtcgctacggtggaacttgggctccaccaccagctgctgctgctgaccaccatgattccatcgccgccgcccatgggagctcatccatctcgtgtctcattgcttgacaagaaaaagagggaaagaagagggagagctaagccttgccacggacggtaggagtgacgaagatgttgctgttgttgtcactcaccccgctaccaccaccactccatcaaacgccgaccgaagatcttctagccacattgcaatgggagacatcccggccgaagctctcttcttcccgaagctctgccaatgccctcaccagctgcgggcaccaccttgctcctcccatgggataccctccgcacgtgttccaccgttgccaactaacggggtgacgaggtcttgccagtggctgatttagtcatgcagagggaggggaaaaggaagggaggagagggatggcgtggttgccgtcggcgtcttgttgcttggggcctcggccttgctgagctcccatcattgcctagcgagagagatatggagaaggagagatagggagggggtggtgaggaagaaaatgaaatgaggaggaagtcattgatatatgggccccacctgttgaatgagcgagtcaaccagtaatatccgtagaaaccacttcctaaaccaccggaagagtcaatttgcactggtttttaaagataggggtgatgttatacctagttttatggttaagggaggtaagggtgggtagaataagactgaaccaaagaaccgaaccgaaaagaccgagaccgagaaattcagttagtaattcggtctcagcctgtcaaagaccgaaatttgttcgggtaattcggtcattgggctcgattaaccgaattaactgagaaaaccgaattgtgccccaataggtacaggaggctcaataagtccaatacaccactgaaccttagaggtcacccgctccaacccacatccccatccatcctcatcgcgccgccctccacatccccatccatcccgcgccgcctccgcctctgcctccgcctccatcgcgccacgctgctgcctccacctccatcgcgctgcgccgctgcctccgccctccgccctccaccctccacatccccatccatcccgcggcgcctccacctccgtctccattgcgccgcgccgccgcctccgccccggccaccggcctccgcccttcgcctccatctcaccggcgccgtctccaccttccgcctccatcgtgccacacagcctcgccggtcgcaccggccaccggatccatcctccacctccaccatgacgcgtcggcaccaccgtactcccaccgaccaccgccgcatcagcgtgtgccgcttccagccgaccccaccttggcgcctccgtctccagccagcgcacctccacctcggctcatccaaattcggtcagaccaagaccgagaacgaaaaagccaagaccgaatttaccggtcctgactttttttggatgaaattcgatcctgacttttcaaaaactgaaatgaccgaaagaccaaaaaccgagaccgaaattttcggttagaccgaacgcccacccctaaagggaggcaattcaatctggagcaagatatgagggacgcaaaatagacttattccaaatagaaaagcagaatgactaatgtactgggctggttcacaatgctgggctatactgtacggactatggtggatgcagactgagcttggaaaaaaaaaacgcaccaatttagccatttaaggcaattccaggatcgagcctgccctgcagccactttgtttcagaagcaggggaaaaacagaggctcttctgcaacagatgaaaggaccaaccatggggcaggttaaatcagttggttcagtttcaaataattgtctgcttattaatcgatgaaatccaagtgttcaatcagaaatcacccacgcgcatcattgcgtgaaaaaaactccaacttatcgagccttcttgtgtcgcccctcccccacgggtgaccgggaggcgacgacctcgccggcgctcgtctcccccttccctcctcctctgcctcgccgccgcccagcatgggaggaggacctgctcggacgaagacctgcgaggacgaggagggaagggggacggcggcggggcttcgtcctcgcgctcgggcatgggaggaggacctgctcgggggcgttggaaccggccagatccgtgccgcccagccggatctggcggtggaccagccgacggcggggctgagcggtgtggcggcgatgtctggtggtggtggcagcggcgtcgaggcgttggcggcggcgaaggaaaccaccggatctgcgcctggacggcggctggcgggacggtggccggcggcggcgtctggtggcagggatggcgatgacggcaagggcagcgaggggatggcgtcggtgaggtgaacctggccgcgccggcggcagatctagcgcccggaggtctggcggtcgcgacggtggtggcgacgagttcacggcgacggcggcgcgggctaccacggcgggccgtctgtgccgtgtgtcgtcggagctcgacgacggcgacaaggtgcgggaggatggcgagatggcggcagggatggaagggcagcagtggctgtggttgtggcggtggaggtggcgaggggatggtgtcggtgaggcgaacctggccacgccggtggcggatccagcgctggaggagtctggtggtcgcgatgatggtggcgacgagttcgcggcgacggtggctcgggctaccatggtgggtggtctgcgtcgtgtgctgtcgaagctcgacgacggcgagaaagggcgagaggatggtgagatggcggcggggatggaagggcagcagcggctgtggtggtggcgaccgtcacaacggtagggggggcatggcaatctcagacggctagccaggggcgtggcagacttccgcatccggccggcgcagtagtgtttggaggaggggttggaggccggcttggcgcagagaggcgcagccgatggcagcggaggccggctcgacgcgagaggcgcgagcggtggagatggaggctggcttggcgcgagagacgtggccgatggagggaggccggattgacgcgagaggtgcgtcgggtggaggaggccggcttgacgcgagaggcgcgaccggcggtggaggaggcgacctctgcgcgaggagctgccggtggatgtgggtggtctttggcgcacgaaggctggcccgcggggagcgccggtgtagtggttccacatggcggcagaggttgaggggtggtggattgctggtctagcggcggctggtccggtgctagtcttctcccgggcttgtgtgttggcgctgtcagcgtgtgggtggtggtttattttttcttttttcttggttacgaccctccaggttgtaatattataattttttcctgctctatcaatagattttcgtaccgtcttgtgcgagttgttcaaaaaaaatcagaaatcactgaagcagaagccctgtgcatcatctgacatgttacagctaaaatgtttggaagtcactgtctctgttagcctgtaagcctgtgttttaggacgaagatgaactgatgtaacaacgattccagcagatatttctctcaatggagtagtaatgatttacaagactaatcccccacaaagagaagattcaaacaaaatttacaagagagacaaagttcctacaacacactgactctgcgtagcaactgaaaaatcttgccaatcagtgccctgcccatgcacggtggtggcgaggatgtcggcgtgcggcggcgcgccgccctttgttcagcaggacggctgcatcggcggcggaggaggacaccacagcttcctgaggaacgcgtcgctgtcgcggagctccccccaccgccgcctcatgccgcgcgacgtgcggcagtaggccgccctgctgatgtccttccacgaccgctcgccgtcgccgtcgcgcttgaggaggaggcgggcgagctcggcgtcgtcgtcggcggtgaaggggcggtggtacacgtcgcgggcgaggtggtcgcgccacctgtcgcggcactgcccgggcgagcggcgggggcggcgccccgagcgcgccgccgccatgccctcggcgacgcggcgccagtggcggaagccgttctccgcggcgaggcgcgccaggcacgcgtcctcctcgggcatccacgccggcgggatcctgatgcggaggacgatgcgcttcccgccgctcgtcgggctcgccgccgccgccgccgcctccgcggaagacgggaaagcggccgaggcgggaggttgccctgctgcttcttgctccatgccttgcaacgccatcgcgacgatgatgacgtcgatcttcttctccgttgctggttgctgatcgatcgatgggtggaaatgacagaattcggagcgcacgcacgctgctacttatggtgatggttacatgatccgactcggagtcttccttcgtttcattcttcacccaaaaaaagaacgccactctgcgcgccaaattcaaatgtccgactccgactagtattccaattactcaaggcattgcaaacacacacaaatctaacactaggtttaccaataaaaaagagatgaggcttgtattaattattatgagagatgaatttattcaagtacagttcattgtcatggtggttttagagggataatgcaagccgtaccaacggccaaaagaaccaagaaatgtagtacgtcatgtcgaatcgatcagaagaacaaagtcctggaaaacaaacgaatgaacgtatagatcgatgggtttgcattagtcggattgacccgatgatgattagttgacgaccctgcagtgcctcctgatctcgccggggtagccggtcttgacaccgacggatgccatcttgacgaacgccttggcgaacttgtcctcccaccaccccgggatgttggcgttgtccgacaccatcttcgccgtcgccggcgacgtcagcagcgccgcgtccgacgcgaagagcaccttgtgcgccaccacgttcttgtagtactggttgtcgaacgcgttgggcgtgacggcgtcctggttcaccgtcgggtcgttgctggaggtcgggttggccgggcacctctgcttgaggaagttggcgaagccgccgttgatgtcggagggcgcggcgacgcggtccgagacgaaggaggagcagtgggagcggccgacggtgtgggcgccggagagcaccaccatgtc

SEQ ID NO: 58856 - DNA, 28371 bp, Oryza sativa
tacatgcatatgatgatctgtcacgctcacattgatctcatctcactgccgccatggattgcaaatgtgtgattcagaaatgcaatgcgacatacctcgacgaagcagtcgtggaagacgaggcggatgagtccggcgccgatgccggcgtccttgtagacgaacttcttcacctcgtccctcacgatggcctccacgcgggggcacgactgcttgtagtagcccagctgcaggccgtggcacgccgacgcgagcgccagcgcgcacgccaccgccacggcgagcttcatgcccgatgctgccattgctcgtttcagctcctgctgcttttgctctgagatgatgatgtgattgttggcgtgagatggatgaagttgacacgctaaatcgaatggatatttatagatggagagatcgatttaattatatggcgtagctaaggaacgatggcggattcgatgttgctactgcgattcgttagattggcacacggcgtatggagagaaatcgatcaatcattggtgatgagaaatcttagctggcatgaacatggctgtgcccacagttaacgaactagctagctagctgcgcgcgcgcggcttcttgatttgatattctgcatggatggagcctattctctctttgtgaactgtactgattttcctttgcctcttccagagaaagtgccatcgcatgatttgttgcagggaagtccacttgcttgttgttttcttagaattgagctgtgtagcattgctcattatttgatttgattataaattgagtcaaaatagtcatatactctttaatttttttttagaatggagctgtagcattgctcaatgttggattcataaagtcaaaatatccatatgatcaatagttttcttttgccacctctcagtcaatattcgggaggagaggttccctatgcaagtaaaacggggttattttttagcacatgattaattaagtattagcttaaaaaaaactttaaaaatagattaatatgattttttacaacaactttctaatagaattgtttttaaaccacattgtttactagttcgaaaagtgtgcatgcgagaaacgaagaagcgaaggttgggagcctcgagttgagaacaaaaccttatagtagcactagtacagaattcatttttgtggacgagcccctcgttaaatttcagacggtccataactgacccgtctggaaaaaattgtcctcccatttttccgtgcggacccttaataggatcgcacacgaaaatcgatttcgcatgcgggcatgttaagactaccgcatgcgtaaataccctccctcccttttccctctcaacatttcaaaaaattccatccatcccctccaactctctcacctcttatccttatccttaccctcatcctttttcctcaccccatcaccccacctctctctcctctcctctcatgcggtggcaggcgggcgcgatggctcagtgacggtgcccgacgggaggagcggggccctaatcgcccccaccaccgccgacgaggtggccgggagtggcgctgttggccccgcgcgaatccgcgccgcccccgccgacaaggaggaggtggccggagcggaggcggacggcggctgtccccgcgacctctccgctgcccggatccggcggcggcgcccgtctcccgccctcccccgcctggatctagcggcggcacccctctcccgccctcccccgcgtgacggcggcaacgagacgagcggcggtggcgacggctacgaagacgacgagctgcggcggcagccagccccaccgatgaggacgaggaggaggaggtggccaggagcgccgccgccgccagatttagggttttcattttttttttggatttttgtttttccgtgcgggccacataaagcacccgcacacgaaaatataattttcacgtcaaaaataacgatttttgcatacacctaggtgggtgcggttcgcctacccgcatgcgaaaatccttttggaccgcacgggaaaaccgttttcgtagtagtgtaattagaattctatatttttctctaaaatataagcaaactgattcatctaactatcaactatgcaatcacatgtccagatctctaggaatttttagagttaagaatactcagtttaaaagaatcttggatgtgaatttgtttcaaacaaaccagtccaaaagaatcttggatgtgaagttgtttcaaacagaccagtctgcaggcagtgagctgaattgctaaaaggcttatttctcgggaaaagtcataaaaataaaatgactaataaaatttagtttcaaaaataaaaaaattgaaaccaatttaactagttccccgtttgagttaacatttgtttggtccaaaaccgctaaattagatctacgacgaccccagtttctggaatgtttcatttattatggtcagatagggattaattattagctaatgccgagtacgattaagataagggcagatttcactatctaaaaaaagaggaaaagacgagagagcaggtcgtcgaagcttgtgtgctctattctagtttatacctggcattgcaaccaacattcattccaagctgggattcgatcattcatttcttgggccgtacgaagggcagtcgcctgcctacccctccttcgcatgtggtcttgtaaatcaggagatagatcgttagctaatccctgcttaaaataattctgcatgtacctagggaacgtgtcctccacaagctatttttttaaagagaatttagtccttcacgtttggttattaccttgttaattcatccgtccatcttatttaaagtgtagttatggttttccatgttcaacgtttgaccgcttatattatttaaaatttttctgtgattagcatttttctctattagataataaaataaaaatattattttatacgtaatttatttttaaattttttaataagacgaacagttaaatttagacatgaatacccacagtaggtcgaaatcttcatcgtattcaccaaaccaccacgtggacaagctgaggctaagcacatgcacgccaggacaacattgaatcaaggattcaatcaatgcaaagatatggagtacttgtcacattttgcagtctcttttggaaacgggccggatacagcaggggtgcttttttctcacttgaaccgtaatccggcaaaatataaaaagatttgctgggaaaaaataataataaagattagatttcataaaaatcattcgagttaagaaaaccatggaaaatttgacgtgtgccacagatccgacaggtggatatgtagcgtaactacgcaaaatctcactctgtacagattttagtttatgctaacatgcatgttggaccactttgcaatatgacgtggcctaattaggccctgtttagttccaaagtttttttttccaaacttctaactttctatcgcatcaaaccttttatacacacacaatttttctatcacatcgtaccaatttcaaccaaacttctaaactttagtgtgaactaaacacacagccttagcttgtcatccaagctgcgtaggccagcaagcggtctctcagcatagctaagatctgtatagggtggggtttggtgaaactgcgatcgtaatatacatatggttgtgtgacttaaaatactcgtagctttctgtaactcggataataaaatccggggttttgcagaagggagtgtctagcaaacattcgaataatttttttttcatccatgtcactcagattttttcaacatctatccggacagcacgttgtcgagtgaacgactttactagttaatcgttgtacatccccatgggccgattgcttagtgaagaaaaaaaagaggggttttacagtgcttgggaggtatctggggtacctcctaagccaattaataccaaccgttgattctgaaaggataatttaggaataagaaatattgttaactagggtagattagtaattcctcaacccctgtacccatccgctggccagcggcatcctgtgccgatgctaagtgccggtgcatagggcgtacggcggttgatctgattgttgttgaatgttgcgtaatgttgctgctgctgctgctgctggactctggccattgttgatgattacagaacgctgaagcattgattcattgttgtgaagctgttaaatggaattgaaaagtttagagtaattgattccttgcgaaattgatgcgcttaatttctaagttgctagcatatgatcaaagaagatatttcgtggctaattattgagcatttaattaagcagatcagccacgttgagaaactaattaagcaccatgccggtgcatgctaatctcatccgattaatcgggtgattaatcagttgcagcctctactaaactcaaccagagatcgaaggatcaggaaacggacgtgaacggttaggtaaaagctgtttgtatgtatttgcccttaattgtacaactaaaccatgaaagtcaattactattttaacattccaccttctatacctggtccaccttttacgtaccttttccatagtactcctaccttttatcctgatgcattggattagcggcgatcaacggtgctaatcaattccaagcacggaagaacctctcgaaaaaaaaaatccaacacatcccttcatttatattgtccagaaaacccaagatgattaaataaatattactaatacacctagttaaagagtcagatgcagttagattgtagtcatattaactacagtatatataattacagtatagttacactgtaatttcataatagttacactataatgatataaagttacactgtaatttctgcaattaaatgatagtgtaagtttatcttttggagctgtaactactaatcaatatttattgtatatttattctttttagggaactactctccagcgttgcatgcttgctcggttctgtttttcattttcccacctgtacagcacgaatcttgacacaaattctacggccaagcgattgcgagagctcctaccacactttgtaacttgtatagtgtatagctttgtatcttttcccttttctgtgtacagcatgaatcttaacacaaattctatggccaagcgattgcgagagctcctaccgcactttgtaactttgtatagtgtacagctgtatatcttttcccttttctacccctagggttgtattttttttctgctatattcaatgaaattttctgctatattcaatgaaaaggcataatctcgtgctgttttcccttcaattttttttctaattgctatattctagtatacatggcaagaattatctacttagtaccgttgcattcgcgactgtctacttttgtagtagtgtgtgtgatccaaaactgcttttttttacatgcagtttataaggaagatcacatgtgaaaatagatcgattttagtagacatacatcttagaccaacaatctcaaaattgttgtttttggatgcaaactgcgtggggcatgcacctcttaaaatacagggctggcccacctgaccacgagcaataaattaatataagtatagtacttacactcctctcctttatcctgtcctaccccctcccccctcccccgagctctctcttgctgttccctacttgaggcacagattcaatactcaccaaaataaccacacatcgactacagacggctcgttttagagctctgcatgtgaaaaatgattttctcaaaggaccttctaatttttaaagagccatctataaaaattgattttcgttggctggtgtatattatcaaccaaatgataccacactaaaagattcattaaaattgccaacatattttatgttttaggagtgtttagattttaggtgggtgtcacttttctaatctcttgaattctcttggatacactatagaacaacgattttgtggatgcttctccttttattttacaagtgaaatataagaaattatgataatgttgagagggccttatatagtttaaaacaacctatgaaaattaattttcactagcgatcaataaaaccgcctgtgaaaataggatgggttttacggacgcttctattaagaaaacacataatagaaccgtccttggaaatacgagcaatacttttgtgtttaaaaaatcgtaactctttcatatggagttgaatgatgataaatttataacaacaaaactgtagttttaataactaaaaaaatacacattgcatatatggcactataattttagaatcagcgatgtgcaattttaggtgactggaacttagaaaatatgtctaaaaatgaaatgtagaaaatatccttttcttttaagggtgacgctccggtactctttacttgcagtattctactacaagtagaattaatctcaaccgtttattttaaagggcaggtaagtaatctcctaatatagtttaggagtaattttagcatgggatgttttgttcggttcgcatcgcatcaggttcagtggacggccacggcaggcaccaccggcgattgctgcagcacggcatcgtcgtctctcgccggcaagggccacagcgcggagtacaccgccgacggggcgcggtttgaggtgccattggtgtaccttggcacgatggtcctcggcgagctcctcgtcatgtctcaagaggagtttggctttgccggcgacgatggcaggatcatgttgacgtgcgatgcgtcggtgatggagcaagtcatgtgcttgattagcagagatgcctctgaagaggttgagaggatgttcttgagctgcatggcaagttcttgccacagtgtcagaggaatcagccatcagttttacagtgtcggagaacggcgggctattcgggatcggctgccacggccggccgaggtaggtctccatgctgctgccggcgggggcgccgcggaggaggtcgtcgtcggcgtagatgttgcagtcctggaacgagaagccggtggtgcgggattgggtggtgatggtgttctgctggccgcggagggaaggcgcgtgacaatgtcgcagtgttggaagacggcggtgatgcgcgtcgccgaagatgagttagatactgataaattacaataataccttacgcgaattattatccctggacgaatatacccttccacatttctactaccactaattttggtgggagtagaaataaatcataaccctacaattaaatatgatcaacggctcagattactttctactccaagtagaaagcaccggagcgggactcttcttttaattatcgcagaagtatatttcactgcaaagaacccgtcaattgaaagatcgcattgctctagaggaacatggcaacgtgccaaagtagttgattaggcaaccgcctggattaagatgctaaaaccatttgcgcgacggcgcaacaagaagcaaaacagcatcaccaagcccaagaatcccagccagtaatgttatcgttggagtctttgccagctaaatacagtgtttctagcacttacagcctttcacgacttattgatcatacatatatgttaatccattatgtaaaagaaatatatgttaatcccaacttggtactaataatcccaattggaccatacctaggaggaaacagcaatgcagctgcctgtagagacaatagttttccattgtcccataacaaataaataataaatatagttaattaaaggaacagagtgaagtcagaaaatcagaatatgaggcgaatgttggctggcgatagccgttaccgggtttggttattagcaatttggcagccgtcaaacactgatgtgtcacacacatggttttcttatagattagtaccgtgtggtttactcagtaaaatttggtcctatacaacttttttttggctgtgtgcccacggggcagaggcagtagatgtaatcaattttcattattaaaaaaaaaacaattttcgtttgcagcggtcgacatttttcttcagtaatcaaaaccggggagcatggttcagtttttgtttgtttcagcatgagcagactgaagctaagttgatcactttacgaatccaatagagatggcagatggtcagcaagcacagcagctgaactgattggtcaggaggtagttaccaacgactgaaatcatggaagcttctgcagaggagagataagaactgagcaaagtcaaatgctaggacacacataattgcgtcgtcgaccatgttccatcttccatgacagctagattaatttctgagcccctgattagttgctccttctccatgatcgttagttgttcgaatccaccatggatcatcccatgcatcaacataatctcaatctataaatagccatctctgtatacgatcagcagacagcagaagcagaagcaggcagtccatcgatcatctcttctcttccagcaaggaagcagcagagaagacaatggcagcatcggccatgaagctcgccatggcggtggcgtgcgcgctggcgctcgcgtcggcgtgccacggcctgcagctgggctactacaagcagtcgtgcccccgcgtggaggccatcgtgagggacgaggtgaagaagttcgtctacaaggacgccggcatcggcgccggactcatccgcctcgtcttccacgactgcttcgtcgaggtatgtcgcattgcatttctgaatcacaaatttgcaatccatggcggcagtgagatgagatcaatgtgagcgtgacagatcatcatatgcatgtatgtgtttgttgatagggatgtgatggctcggtgctcctggacccaactccggcgaacccgaagccggagaagctcagcccgcccaacatgcccagcctccgcggcttcgaggtgatcgacgccgccaaggacgccgtcgagaaggtctgccccggcgtggtctcgtgcgccgacatcgtcgccttcgccgcccgcgacgccgcctacttcctcagcagattcagggtcaagatcaacgtcccaggtggacgcctcgatggccgccgctccctcgactccgacgccctcaacaacctgccgccgcccaacttcaacgtgaaccagctcatcggcgcgttcgccgccaagggcctcgacgccgaggacatggtggtgctctccggcgcccacaccgtcggccgctcccactgctcctccttcgtctcggaccgcgtcgccgcgccctccgacatcaacggcggcttcgccaacttcctcaagcagaggtgcccggccaacccgacctccagcaacgacccgacggtgaaccaggacgccgtcacgcccaacgcgttcgacaaccagtactacaagaacgtggtggcgcacaaggtgctcttcgcgtcggacgcggcgctgctgacgtcgccggcgacggcgaagatggtgtcggacaacgccaacatcccggggtggtgggaggacaagttcgccaaggcgttcgtcaagatggcatccgtcggtgtcaagaccggctaccccggcgagatcaggaggcactgcagggtcgtcaactaatcatctatatattgaattcaacgtgtgttccatcaaattttctcattgctacgttttgtttttgtatttattcgttcattcttttgtgtagtgtattttgtgttgattattatatatgtcctctcctattatgtaattgtgtaatatgacactttatcatgtaataacattggaatatatttttggagtaaatttcacaaaactacaggtttaaggcatccgtaacctaaaacctcctcatgtgtttgcaagctgtttcaagaaacctcaggtattaaggcaaaaatgtttcataacaaccctaaattcatacataaatctttcgtttggctattatacttatacataacacacatttgtcactttctcaacaaaacatcgggttacaaattatattaagtttggcttcatgtaattcgtttgtgtgatgcactgatgctgccactaaggtttgtatttttcatctttttccatcatgaatggtagaagcgggaaggaaatagagtagatatatcaatgtgtattttcagcctctaatgtagagttttgtgaaaaaaaaattctcaaaatccaggattccttaaaataaattgtaaaacctggatcttgtgaaaatttctctaatatgaaagatatgctagacgttcttttatcaaagtttaggagttattcgttgatatgctagacgttcttttatcaaagtttaggagttattcgttaattcagatgaaatcccgtgtactcggtcggcttaagacatactccactttacaggaaattgtcggaagaactttagtgcaaactactcctacttaacaaaagaaggtacaggagagtgttgacaagaatcacaacttacagaactgacatgcagcaaatttttcatgttaaaagaaattcatttctgtaaagagccaactcctagcagctgtatgtagtgatattgagaattattcctgttccttgtgattctagaactgacatgcatttaaacataagcaaaagaatttcatttcacaagtggaaagagccaactaaggtagcagctgtattcagtgatccagattagtattatccatgttctaagtgcaacatccaccaccaaataaagcagcaatgagtatttggacaagcggaccacatcaccacaagaacagctctaaccagcctttttttatacacaatttggagcacaggcaatgtcatgaatgattttacaatcttattcactccacttcatcttcacagcaaaaggcgacgacggcctacagtcggacagcaaacagagcactagagaggttttgtcacttggcaacttcctaataaaattggaagaagaaaccttaggaagtagaccctgccccccatcaggttactgtgcatagttctgggaagcaagaacttcgaggagggttgcgacgaagttcatctgaacttcctcactaatcgtcgtgaagagggggaaatggacgaacaaagacttgataccgcgctgttctgcgaacctaagagattggtaatagacatagttgcatacgaatcgaccagcgtcatccgaaggcgccacatcgaagcccatctgttgtagggacttgttcacttcattcacaggcacagtggtctgcttgatcatacaaaaataaggacaagttgtggttaaggacttaagatggtaaagactacccaaaaaaatagtacgaaacaaaaggagtttagacaagaaacaattgtgaccatcacagcatagcgtggactgatgaggtgctgttaatacatgtcacatacttacagaagccacccacaattagcaattctttccacatactttgtgtgcaatagactttgccactgaactcttcagttcaagttaaaaagattttaaccgaccaccaaatttgtttgaaaataaacacctaaaacaatttggcatggcaacgatgaactatgaaccaaacctaacctacgatgacacagtaattgaaaatcctcgaatgcaaatgttgtggcatggcaaggcgtaacctaacaacagaggcactggcgcactgctctatcccactataaaagttcatctaggatccatgtgcatgtaaaaatgttgatcattaatacatgcttaaagtatataaattgactaattgaaatgggatttttcttgcagaatattttcatgctatataattttatttttttagtaatatatcatgacacaaaatcagtcaaatgttaagttaataaaagccaaaacagacttatattatgggttgagggagtatttgaaggtagattgaagttatatttcaggacgggtacattaactcaatgatgaaatactttcaggaaacaacagcaaaattctacctttcttaaatttgagatgcttccatcagatgacacaataggggccctctgcaaagttgaaaaagggaaaaggaacagataagaatggaagggctttttatgtatgcacatgaaaccataaaggtaaaaaggacaattaaggtaacctgtggtttccatcccagctcatcagggcaacggaaggtagcttcattaatagcttgattctcaagggcaaaccttgttgtgccactgttgactccaaaatggagctgaaaaaaaatccataaaagtaattggtttcaatcaaaaaataaaaggtaaagagaaacaattctttccaacacacaaatgttagacaaatagaaccttgacggacctttaaaactagaatataaaagcgtttcatattttcttatcaaacagtaaatttggctgcaaaataagtttcactatagcatccaattacatttaagggcaaatgaaacttgtcaagtcattactgtggacttctcaggataacatcatgaactttctaataatgtacaattgagtaaatctgtaaagatgagaactgaccagaatcacttgcccctgatcattcaacccatactctttgtctacgatggctgattcaaacacttcatacaacggaccaagcccaccctgcccagcagtctcaagaacagtgcaacttccaagtgttaaacctttaggcaaccctctcttttccataaatgactcaagattgcgcacaatcttctccgtcggattctcagcgactccatggaacttcttgaatccagtaacgtgaacggtaacaccagaaggtccttcagaacccatctatccggttatgaaacaaagttgaccaaggaaaatatgcagtcacacaatctgcatagagatagaggaagcatcagattatcagtaaaaaagcaagcagttccctgaaaattcagcaatgcataaggagtcaaggacaataaatatagccttaaaaccagctatgggagaatgttgccattaaacaaaaatgtactgctgattgctgacagtgccgacctcccaagaatgagatatcgacacatacaacatgcaagtagtactacttttgagcagttagtaacgctgacgatttagcaaatgtcattgtctaaaaataaacaggtgctttcgagtagttgtttaattgtgtgatcagcagaacgccgcgaagcagcagagccacgtttttagaccgtctgaaaccgattgaagcagagacgtcgccctcagcatttagcaggaaaagcaaaacttgggcaagcaaacgatcaatcgcatctacaggataatcaaactcttgattaaatcagtgtaaaaaaaaacactagcacgcaagcagtaggttcgaacaggaacaccgatataataaaattctgaaaggaaaggcatgtctgtcttgttacagacagctcccaagtacagaaaatatatttgagggaaaatggtttgccagtaaaggaaaacaaccgaaatattcgttcttcggcgttctagaatctaacgacctaacaagatttctgtcgagaaataagctgagaagtgattaagagaatcataagctatgaaatgacttgcagacatgacacgagcatacaacgaatgcagcacaatcaaaagttagttgggatgagctctatcctccacagtagacacaacaacactagccaaattcgtagcaggagcagcatcaagaagaaagccttcatcgcgcaagattaggcgctcgattattgtaggcttgtagcagcagccacggaatcgccacagtaagaacaatatccccccaacaaaaaaaaaaaaaaatcggcacctttgtgcctcaaaaagtcaaaatcccctcatagcccctccaaatcgttccaagaatcaaccaaaccgagcaagaacccctcgtcccccggagcttggccccctgagctctctcaccttggcgcggcaaccacggcgacggcggaagcaaagcaagctcctttgcgcgctccagcagaagaagaaagtggatggaacggaagagaagagaagaccggagaaatcgaaagcgaggtgaggtgaggttagcaactgtccatcctcctccttcttaaaggcgcaatctgaaatgggatcgatcgccgcggcgaggcggcttacctcatcggccgagagagacgattagagcggggaggggaggtgggccccgcttgacagcgaccccggggcgtgggcccacctgtaggcgcctcgtggctcgcgaggagataagccggaggaggggaagggggaaggggaaacggctgcgctgcgttgcgttgcgtcgccaaaccgaagtctgagtcttttttatctttaacgtttgaggggttgcgttgcgcggcgcctccggctttgggcttttggtttggtttggttggttggttttgttgcaggttttttgggtgaagtctctctggaaccggatgctctgcggtttcggtctctctgttttggtgatgcaccgccgccgcgtctttctctccttcgaagtgttgtgctgatagagggcaagttttgttccatttctcatgttataatggtgaaagatttgtccctcattatgtgtagtagatggtgatattatactgatccaattaataaacgtcgacacatatagtggtatttcttgtgagatagatgtatcaatttgcaatggatctaaccaattaaactaattatttttttaaaaaaacttcattgtagagctaaattaattgattgcaatgtagaaaagttgccatacatagaagcaagtaaaaataaaataaaatggttatgggtccgttatactcgagaggaatcctttgttgtacgacatgcagtaggtatcactgacatgtgggcccggagcaggtgagacccacatatcagtgacacctactgcaggtgcactaaagtagaggatttgcatccgttgtatcccttttatcgtggcttgtattagttgctaactattagggactatatatgaagcaattatttctatcggtatctaggtatgcgtttcatccttatttttatggagtaacattatattagggactatatatgaagagacagtttctaccggtatctaggtatgcgtttcatccttatttttatggagtaacattatattatggactatatatgaaaagacagtttctaccggtatctacgtatgcgttacgtccttatttttatggattaatgttatattagcgactatatatataaagcaattgtttctatcggtatccaagtatgcatttcatccttatttttatggagtaacatcctattagggactatatatgaagagacagtttctaccggtatctagttatgcgttacgtccttatttttatggagtaatgttatattagggactatatatgaagaggttgtttctaccggtatttaggtatgcgtttggtccttaattttatggagtaacgttatattaggaacttatatgaagagaccgtttctaccgatatccagcatgcgtttcgtccttaattttatgaagtaacaatagcgttttttagagtttagacatattagggaactctcatgttcatctcttttaaaaatttccctaagtaatgagaataatcaaggatgttgtcccatttcttggttcttttaaattagaggattaaggtaggaaaattggaggattctaattatatatatggaaacattcgtatgaaagctttctttaaaaaaaataaaggattaaatattatcgtttcctttaaaatttctatggaatggataattctacgatggttttggcggaagacaataaaaaggtcatagctgatgtttttaatcatttgtctcttacaatcctatgtttttactgcttacaatcctatgtttttactgcattgcaatcaaacatctcttttcaagttttgtttaatgtgggtagcaagcaagcaaggaacccaacctgattgtgatgcagggtttacaacaccagtggaaactagtctggatttcacggattttttggaccgagtaaaaaaaaaacacaaaccaatcgtttttttgtcaagttaaaaaatcaaactgaattttaatttttttacaaggattgcaaatttcattaattttttgtcggtttatcaatggattctgtgaaatccaaagatactgcttgtgagtagttttagatttggtgtcggcataatgaacttggtcttgggtcggcctactatgaattaggccaaaatttgaattgcatgataaagaaaaatgaatggtttaatagacttttggttctagacctcgggccatattctagataggccgaggcttgcgactgcccctaatgacatgtatcattgttttctgtccttaacataaggtacatttttctccgtccttgactacataaggtacatgtagtactagttaggatcagcatcttgtagcgtctagtgagcctgtgttgtccatgtctattttgacaattgacaattcatttaacaatgaaatcacgttcgggttctatgtgtagggattgtagccataaaagaagaaaaagaaagaactaaatcaacataacatgtcatgttattgtacaacaatttgctctcgtattttaaaatttaattaagtgttcctttcaaacgcaggattccgaaaacacaggggcggatgaatcacaagaataaagatatcatgccacaacgaatcgtacaagaaatataaatccttaggattttgcaaaaagaaaaaaaatagtagcaccttaggaaaagcaaggaaattttgagtcaagagaaaacatgaagtataccctcatgttaatttgcctccaaaattcctataaaataagcaattgcatagtgatttcgaaggattttggaagagtcattcctatgttctaaaagaccatgcaggaaaaatttctgatggatttgaatacttcaaaatcccttcactcttcctttgtttcaaaatagccctaaatgggaatccggacaaatagcttatatatttctcaaggctcccagactaatggttaaaagtttgtgctgattgcttctgagcattgtccggtcaacccaggcgagttcatcgccctggtcgcgttgcaagtgaattgacatgagctccttccatagacacacatatcctagttaactagtatgtggtgattggttaactgttacatccatatttaacacaaaaataatgtcctgtagagacccctaccattatttgagcattgctaccgtccagcaggttgtaccgggcggtactgggtaccaaaacaaatctaaccgttgaatcaggatgggtaggatcgggacagaaaagatgagcgtcaggagagaaatctaaccggcgttcaagtcatcgttcccggtggtggcagcgtcgaagtcgtcgttcccggcgacggtggcagcgtcaagtcgttgtcgttcccggcggcggcggcggcggcgtcgagggtccaggaggcggcgacggtcgatcccggcaatggcggagttgacgtccaggcggcggcggcgttgatggcgtcgatccaggcgtcagcgacccagatcgaactcgcggcgccggaggaggaagacgcggcgacggcgggagtgaggaagcacagcgtcgacagggcgaaagcacgtcggcggcgggggtgaggaagcacgtcggcgggggtgagaggcacggaagaagacggcggcggcgggggcaggaagcacggcgggtaggggcgggacggcacggcccgattcaatctagggttcccatagcgaagttacatttttgcctacgggcgggccaacggttagtagaattgggtaccgttcggtaccagtaccgctggacggtaaaaaggctcccattatttagagtttgttggattgtccacccttttcctctcactttgtttgtatgggcctcatcctatcctaacccaatccacatggataatccaggattaatcaatatccaaatacatggatggaccaggattagggcccattcaaacaagcctgagcggtttgccattctccagcagaataacttcacctgcaacaatcttcagacaagcccgtttcccattcctcctacacgatatatgtacagcaagcatctccatctttgaccagcaaagactgtagatttgtagtcagccatcacaagcagaagcagtatttcactgaacatagctacagctacacgagtacacatgcatatggagatgcaagcagatcgatcaggccacgaatttcaggcagcgggtatcgttgtgaatgacctggcagcggcacgagcagaacctcgtcccgcacctgacgcacgtgtagttcgccgtgctgccgcagaccgagcagtaatggcgccgggacgaggtgctcgggggaccaacggcggccctggagtacgttgggacatggggaggcagcgactccaggtttgcctggcgaacacagttcaggagtaagagatctcttgatcttggtcatcctactgacgcgaggtgcacggtggatgagaaatttgcgaaataggatcatgaatcttggttgagaatatgagctataatgagctgttccgcgtacctcctgtaacacgtccatgaaagatctcgccgccttcttctccaatgccttcccttgcctcgtcttgcgcttcatattctttgactgcttcctctgcatgagaactgtagaaaggcagatgacaagagaaaagaagattttcacattaacactagatcaatacatcatcatttttttctggggaaacttaaactctctagacaacggtgcattctaattgcacacacaaccacagtccaaacagcctaacacttctgcaaccttccaatttgtcgatattatcctaaataggaaaatgagtgcattgtttgacgaaatggtgaaaccttgactgctataggctacatgagaccacaaaaagtaaatccttgaccaaaaccaaaaaaatggtgggaatattatagcagcacatgcgaaagactaagatgttttagcgctatggctaaaaagttgtgctgtaatagcttgcctttgctaaatctcaagtgcttttccattgttttgcatttctgtgagacagaatcctgtttgaaatgaatcactttccattcaaacagtgtagagttgattggctatccaatatttgcatataagaaatctatggacttctatatatttatatcattgagttgtagcttattatagaacttattttattctgtaatctatcaagttaaatgatcttttgtcatacttggtcaaaatggtgcttattttttggtatgtgattctttaccaaattaaattatcactctaatgttgttatacttatatccaatttttaagctttaagagtaactgcagctgtagtcatttgaagttttatgtaacaccgaactttcttattaaaaacttttaaaacaataaaatatctatgtatggtagcttttctgacaattaagacagttgctaatctgcaataattttttaggacttcactacaaaggcaagaaaaaatgactacagatgctcacaccacattacctcacctagaatttgtcttaagtaatagatatgaacaaattgctttcaaaagactgctatatgaaatatcagctagacctcattcattaatttgtttgcaataaacaaaagagataatgatggctgtttctgcaatattagtacttgaaggagcaataccaccttaggcatttgccattttatgttaaagtattctgcaagataaactgattcagctgaaagttgttaacagtatatatctagacattgtattgtctaatcattctcacattgtgatgacaaataatgtcttcaagatcaatatgacattcataggttccctgaaataaccaaaataaaatgtgttacatgaaaataaggacatgagaaaggaactgaccatggtcttcctcatctgcagatccatattcatcatcatcgttaagatctacgacctcagggccagcattatcactctcaagcgcttcaagacgagctagtgcagcctacatgccatcacataaatgtagacagaaattagagaaactaaataactgggaatcagtaaatttcaaatatccatggataaccaagaaggcaaaattcttttgtactgaaaactctgaatcctaaacagaagacgagtaaaaatgaaattaagagtacatggaaagaattaaagctctatatcctgtagagttccttctttgacaaagggtcataagcaaaacattagtgctggtataattaaggcagagcatattcgccacatatatgagcagtagaaattctacacaaaactcttcatgcaaacatctgcagaggtcatttactaaaactaccggtcaagatggcccaatcctttcaattgctctattttaacacaaacaaaacctgcaatgtgtggcccttaacattggagcaataatcaagcaaagtctggagcaggcgtttgttaccatgaaggttcagtacacaagcccaatttgcaactataattcagaacaataatcaagtgtatttggagggatttcacaaaaaaggaaaataatatggagaaattagcggtggccactggcctggatattattaacacgtctctacctctctaaaaaaaaaagtccattacaagctttcattgcaataagagaaccacaatgttcagagaacgccccaataaagggttgacacaaaaccacattaggtacatttcaaactgtaaaaactaatttctttccttttcttaatctccatctaatactggtactacaccttctgaacggccgtgagaagtgacaagacaagtcgactactcaagtgctaaatcaagagatagtattgaatacagcaagacataggatgaaatggatgtaataatatctttggattccaaagtcgactaaatcaagtgcaagtaaggaagagataaactagggcaagagctttaatccggagacaataacaattactactactaagcagctgttaatgccggaagccaagctcagccagcaaatcgagcttgtcgaatcgaaggaaggaggggaggaagcaagcaaggcatcgaccgaccggaaacgaacctgcgcgcggttgtcggagctggcgagcgcggaggccatgcgcgtggccatccgccgcgtccgcgcgctggtgcggcggaacggccccacgttctcctcctcctccccctccatcccggcaacggcgagcggagagcggcggcggcacgggtaacggcggcggcggcggcggatggcgagagaggtggagatcctcgagcggagagggcggagaggccgtggggagcttcgcgtgcggacttgggctggtctgctgcttcggcccattaactaccagcccaagactcctccctaggccgcctgctcatgtgaaggaattgggctggtctgctggttcggctcggcccatcaaccagtccaagtttcgatctccataaatctcgcatcgcaactacggctacctgcgctgcgcacaacacaagatcgtgacttcgtgagtcgtgaccgtcgtctccacacctatggacaacgcggcggcgccgccgtcatctggagcggcggggaaggagatggccacggcgggggcgctaccggacgacctgctcgacgagatcctcctccgcatgccggcgcgttccatcctccggtgccgcgccgtctgcaaggcttggcgctcgcgcacctcccatccctacttcctccgagcccacgccgcccgttcccggataatcgccgccgccgtggttgacacaactgcaattcccgacggcgaattccgcaccaccatcagcatcagacctctcggcgacggcgacggcgaccgctcgggggcggccgtgtcgtcgtcgtcgtcgttcgcctcggtgcggttcggatcacggccttttgtcctcggctcctgggatggcgtcgtgtgcctggtgcccgccggtgtcgttcgccctctcagccgcatcgaccgatacgtgctcgtcaatccgctcaccaaggcctgcaccagcgtgccaccgccggcaacccgcggcatcgtcatctgcggttacgcccacccgaccacgtcgcgctaccacctcctccacgccgacgacgcctatccctacaaccatatggcggcggcgaccatccggattctgcgagtcggggagaagaacaacgtgtggcgcaagatcgcccgccaccctgcgcctgcgtgcgtggagtcgaggacctacattcgattcggcggcgctccacccgtcagcctccacggctgcctgcattggctggtcgccccgttgtcggcggcgtcggcacggcctctcctatcggtgttcgacatggaacgggaggagttccggcagatggacgcccccgaacaatgggctcgccatgggaacctgccgcacatgatgggtgtacagatcgctcggctctccggcaagctgtgcgcgttcgtcaacgagccgagcgccagcgcgttggggatgtggacgctcgaggactactccgacccgagcagctggcggatggagcggagtatcgactactcgcgccacggcgccggcagccggaacatcgcgcgcacgttccgcaaccggttctcggcggccaccaccgcggtggaggtgctacccgatggcgtcagcggcaacggcgatgtcggtggcggtggcgaggaggagatcatgttcctgttcaaccagttcgacacgagggaggctgtgtacaacgttgggcgcgcggcgtggcggtggcgaaggattttgccaccgccgacgaggcgcgtgatggcgcacaaggagtgcatgttgccgcgtgaggtgagcttcggtggggcggcgcattttgtggaggagagtgacatcggcggccaccgttgcatttgcatatgatagtagcattgctcgttgggtttgggcttccttgttttaagccgggtcctaagatgtgcttgattctaattgtttaggtttggtagaaatgagatttaaagagttgaaagtattaccgctctatttccttctttgacaaagggcaaaaaaaataagtaccgtgagatggattctaatatctcgagtagacgtccatccgtttattgcatatcaactagatggttacgaaaaattttcaaaaaaattaacaagatagatcaatatgtaatatatcactacacaaacatgcaagttaaaattaacttcaaaagttaacactttgcaactataattcgaaacaataatcaagtgtatttggagggattcattccacatcaaagaacaatagtttggacggaatcgatggtggccaatgaaccagatatatcaacaggtttcagcctctttcattaaaacagaagcacagtgttcagcaaatgtgccaataaaaagtagactgacaagtagacaaccatacgggtacacttcaaactctacgatgaactacttttttttcttcttaatctctagctaatattagtatagtacttgtatagtacttttttaaaaggctttgataataagttatagaagacaataagaggaaaattgaatatacaagagatagattaacatggaatccgatcccctgataagaataaaatgccaagagaaatttagtttctttgcactccatagtcgaccactaaattgctattaagtgttaaacaaaacatgagcaagtaaggagcaaaaacgaggttcagagtgttaatcagggttcaggagataattaagtactaattagtagtttagtgctactactaagaagcggcagttgccgccagatgcgaagctcgatcagcgagcgaatcgaatcgaaggaaggaaggaacctgcgcgcggttgtcggagctggcgaggggcggaggccatgcgtgtgcggcttcaacttcaggaactgaagatattgagtcttggtttttcctcatgaatcatgagggaaaaaaccagttgtgattgtgtttgcttatggtattactgtgttaaaaaacaccatgagcattccaattttggatcctatatgaggtctcgagatgttgagatgcatggtcatcaatcaatttcgcagttctgaaaagtttgacgatattcggcttggcggcggcgatgccactgtccagcacagtggccggaggcaacatggacgggcaagggctagcaggattgatcatggtcatgcattggcctcgtgaggacatggaactggaagagacgggggcattggagaggaagaagagactatttgcattgagattcgtactggatcagcctcgcagccgacgcgggatgtgattctattaatctattccattatcttaaaaaaatattttcgtgtcgtgtccctagcttcaactttggcggtgccctggcaaccaaagggagcatatatagtccctgtttagttcgcgaaaagaaaatttttaattgttacatcgaacgtttgactggatgtcgggagtggttttcggacacgaatgaaaaaaactaattttataacttgcctgtaaaccacgagacgaatttattaagcctaattaatttgtcattagtatatgtgggttactgtagcacttactgctaattatggactaaatagactcaaaagattcgtctcgtgatttccatgcaaattgtacaattaggttttcaatttacctatatttaatgttctatgcatgtgtctaaatactcgatgtgatgtttttgagaaaattttttttggaactaaacaatagtagtagcatgtgggctaagtacatatatacggagagaattaatgccaaagtcatatgcaaattaatttcagtacactataaattaattaatacttcaaaaattatttcacccggacacaactaagctgaggaagaacaagaaaattccactcctcattaacaatattgggtgcttggcaatggcatgcatgagcttttgaggttgttttcgaaggatcaatccacctttgagtctaaaatattgttttcgaaggataaaatcatgtacatgtattagttagtttgaagcaaatctcataaaaaaaagtcaaataatttcaaacagatctctctcaaatatttctttttcaacaaaacctaattgattagacacacaaggccatcttaggactagggttaaagtacagcacgcccgcccaactagtactggtatatgggataaggattttctacacccatggttcacctaggtgccatggcacccaacattcgcatgcgacttaaatagttataaaaaaaattagtaacatcgattgtgattatataagtctatacacaaacatgcagtactaaatttgatctacaacaagagaaacaaaaataataaaattagacagtaaatagtaccagtacagatatcttcatatgtcgatcgaatttagacttacatgtttacatagtatcttatatattatcatagtctatgttatcaggttttataaaatttttatataattgtttaaattacatgcatataactaagtataggaaaaactttcccctagtatatgcggtagaaacagtggccgccgatgtccttctcccaaggaacctgagacgcgtcaccgaagctcacctcgcgcggcaatatgcactgcctatgcatcatcaggcagcgtgtagtcagcggcaatatcccccgcctgcgccacgccgcgcgcccaacattgtacacgacctcctcgtcaccaagctggagcaggatctcctcgccctcgtcatcgtcatcgacaccattgggcagaacctccaccacatcggctgtcgagaagcgggcacgaaaagtttgagcagcggcggcgtgtggatcgtcgtcgagagcagcaccggcggcgctgccgcacgagtagtagtagtcgatcttccgctgaagccgccagcttgttgggtcggagtagtcctcgagcacccacaaccccaatgcattggcgcccggctcgtcggcaagggcgcacagcttgccgtggcaatgggtgatgtgtattcccatcatcgtgtgcgagtgcgacaggttgccgtcccgcactccttgccccccgggggcctccatcagccggaattcctcccgttccatgttgaactgttgaagacggccacgagaaactgcgccgatgatgacgaggccagccagtgaagacagccgtgcagtctgacaggcggagcacagaggaacttaatacagaccctcgtcgttgcgagggcagggcggcggacctcgcgccacacgctgttctccccgagccgcaggatccaaaaggtctccatcgttgtgaagaagttggtgtgcatgatgtggaagcgcgacgtggtcgggtgggcgtaaccgccgacgaggaagccgtcggtagccggagccggcacgatggtgcaggcctcggtgagcgggttgcagagcacgtaccgctcaacgcctcttccggggccaaacagaatgtgcgctgcgcacaggatgccgtcccacaagccgatgacggctgtcatggatcgcaccggctccgacgccgagacgaacgacacggcgagggaagccgccaccgcccccgagcatttgcggccaagccgtctgatgcggacggtggtgcacgaccttccgcagggagtcgtcgttctagtttccacggtggccgcggcggtgacgacggtggccgtgcaggaacgggcggcgtgggcgcggaggaaatcgggctgagaggtgcgggagagccaggccttacacacggcgtggcaccgcccgatcgacggcgccggcaggcggaggaggatctcctcgaccaggtcgtccggcagcgcctccccgggggcccttctcccgcgtcgccgttcccgatcgtcgtattccatgggcgccgggaggaaaaaacgctggttagcttaattaggttacaaatctcgtactcctatattgtagtacgaacttgtgtggggggacttggggcttgggctgtcatcagttgatgggccgaagcagcactgcagcagcaaggtatagtacgtcgattcgattagagttagactgataaacgacgggactgcctgcacatttgtcgacaaatttttccccaaaaatttgacagatgtaataacagtacaattgtagtgtaattacactgtaacttatatgtaattacactataacttacatgtaactacagtgtaacttatatgtaagtttcacataattttaaatcgttagatctattacaatatttgttttggtgaagaagaaaacaaatcatagcacacacatatatgaaagaatttgttcccacaatctccattttaccgaaataacatgttaccgagagatttttgaaagttacatacaagttacactatagttacagtgtaattatatgcaacttacagtataattacactacgattgtactgtaattatatctgtcaaatttttggggaaaaatttgtcgacaaatatatagcgaaatcgataaacgacaacaccgagctatttaaactgcaaaacaccaaacctatcagcaaacgagctaattaaaaccggacctcccgctattgctgcactatcctccactgtaactgtttgagaagagttctagctacttgctccgatataactttaacccctgctatagctgtttgagaagctaaccgttaaatgtattagcccgctatttaaaatattgctaaacacatatcgagatcaaagcccttcaggaagcgaattcccgggcttcagacttcagcaggactttctccgaccaatcttcaatcagcttttgatcctttggtgcagacaggtctccgatccgcatgcggaaatctagttttggctgtttgaaaaaaatatttctgtacaagtggtatatttgattatgtatcttatgtcaatatatctcttggtatattcggtttttctgttattgtcttcccacttctcaccagccgttcagaatatgcaaatattagctagtgattaagggcaaaagaaatactccctccgtccctaaatatttgacactgttgacttttttaaatatgtttggtcgttcgtcttacttaaacatttttgtgaaatatgtaaaactatatgtatacatgcataaaaatgtatttaacaaagaatcaaatgatatgaaaagaattaataattacttaattttttgaataagatgaaagatcaaacatatttaaaaaagtcaatggcgacaaatatctaagaatggagggagtacaatacctgtgtagttttgtctactcatactcctctttactcaggtgttctcttaacagtactgcgcctctcttctggtctgtcagcatggaaaagcaaaggcagaaagcgcagcatgtgagcgcgtgtatactactccctccgtattttaatgta

SEQ ID NO: 58857 - DNA, 8190 bp, Oryza sativa
aaacgtttgacctttcgtcttatttaaaaaatttatgtaattataatttattttattgtgacttgatttatcatcaaatattctttaagcatgacataagtatttttatatttatataaaaattttgaataagatgagtggtcaaacgttggttaaaaagtcaacggcgtcatacattaaaatacggagggagtatttgaattgtatagttttaatttgtattgtatttatctagaaattagatgtcgagggatatgcagaagtcacccgcaaattaatttcagaagtaaaaattaacatttccaaattatttcacacggacacaactaattaaggaagaacgtactccacttcattatatgcttcattttcttcaatattagctgagcgtttttgatatggacggtggcgcgatcttcgctgcgaaaacctgcctttgtgatgatggacttactacagataaagcattttggaaaaagaaaaaaaaaagaaagaaagcacaacaaaaaaaaaaatcaatattttgatgattaataaaaaacgaaaaaaatattccctccatattttaatatatgacgccgttgactttttatctaatgtttgaccattcgtcttattaaaaaaattatgtaattatcatttattttattgtgacttgattcatcatcaaatgttctttaagtataacgtaaatatttttatatttgcataaaaaatttgaataaaacgaatggtcaaatgttagttaaaaagtcaacggcgtcatacattaaaatatggagggagtagtacggaagaaaattgcacaggactccagtcctttactcatccgaaggaccgtgcttctttccgtgacacctgtccgtgaacgtctccgacatgtccagcttctccttgccgtcggggaaccgccaccagtcgaacaacgagtgcaccagctgcagaacaagttgtggacgaacacctttgccagcgcagtccagcactaattaatgtgttctaaagcaagaatgtgcaggtaaggtagcaaaagcgagctcagagcgttaatcagaattcacaagataatagttactccgcagtatctgttgctgccaaaagcaaatctcatctcaggtaacaaatcgatcgagcaggtcaaattaatcagaaggaattaattattgagaccggggagcaatgcatgaacgattggacgacgaggtcgacagccaccgatcggaacgaacctgcgcctgcgcggcgacggcccaagcccattatcagtttctgctgcttcggcccattagcacagcccaagcccctctcaatccaaccaacgacacgacatcatcgatcatgactagcgcgtttccttgcggatacggcggaggcgctgccggacgacgtggtcgtcgacgagatccaccgtgcaccaccgtccgcatcaaacggctcggcgacgaaagctcggaggagcagccggcttcctcatgcgccgcgggccgcggccgtgtcgttcgtctcgttgcggtcgcgatccatgatctccgtcgttggcttttgggacggcgtcggcctcgtcacggcctctcgtggccgccttcgacatggcacgggaggagttccggctgatggagacccctgagcaatgggcggcggcgtgcaggcccacgagctcggctgcgcgcgtagtgagaaggatacactgcacatcacccgacatcgcggcaagctgtgcgccctcgccgacgagcagctggcggccggcgccaccgacgcgttcgggggtgtgggtgctcgaggactactccgacccaagaagcagctggcggctccggtggaagatcgattactcttgcggcgccgccggtgtcctcggtggaccagatggtgcttgattctttcgcgcccgcttctcgacagctgctgtggtggaggtgctacccggccgatggcatcgatggcggcgaggagatcctgctccagctcgtttgctgagagcaaatagttataacggctaaattgtacatgagagcaaatagttagaactcttcccaaacagctatagcgggagatagcgcagtaatagcgggagttttaaaaccctggtgtttaggcgtccggttttaattagctcgtttgctgataggtttggtgtttcggatccctcttttcccaacactcccaacttgttttccgcttgtacgtttttcaaactgctaaacggtgcgttttttgtaaaaagtttttatatgaaagttgcttataaaaatcatatcgatctattttttaaaaataatttactaatacttaattaatcacacgctaatgaactgctctatttttcgtacgcactattcctgttcggaacacctcctagcgaacacacagctcggtgttgtcgtttatcagtctaactctaatcgaatcgacgtactataccttgctgctgcagtgctgcttcggcccatcaaactgatgacagcccatgcaagccccaagtccccccacactggttcgtacaatatactacgagatttgcaacctaattaagctaactatagcggtttttcctcccggtgccaatggactacgacgatcgggaacggcggcgcgggagaagggcccccggggaggcgctgccggacgacctggtcgaggagatcctcctccgcctgccggcgccgtcgatcgggcggtgccgcgccgtgtgcaaggcctggctctcccgcacctctcagccggatttcctccgcgcccacgccgcccgttcctgcacggccaccgtcaccgccgcggccaccgtggaaactagaacgacggctccccgcggaaggtcgtgcaccaccgtctgcgtcagacagcttggccgcaaatgctcgggggcggtggcttccctcgccgtgtcgttcgtctcggcgtcggagccggggcgatccatgacagtcgtcatcggcttttgggacggcatcctgtgcgcagcgcacatactgtttggccccggaagaggcgttgagcggtacgtgctctgcaacccactcaccgaggcctgcaccatcgtgccggctccgtcgaccgacggcttcctcgtcggcggttacgcccacccgaccacgtcgcgcttccacatcatgcacgccaacttcttcacaacgatggagaccttttggatcctgcggctcggggagaacagcgtgtggcgcgaggtccgccgccctgccctcgcgacgatgagggtctgtattaagttcctacatgctccgcctgtcagactgcacggctgtcttcactggctggcctcgtcggcctcatcggcacagtttctcgtggccgtcttcaacatggaacgggaggaattccggctgatggaggcccccggggggcaaggagtgcgcttcggctcgcactcgcacacgatgatgggaatgcacatcacccattgccacggcaagctgtgcgccctcgccgacgagccgggcgccaacgcgttggggatgtgggtgctcgacgactactccgacccaacaagctggcggcttcagcggaagatcgactactactactcgtgcggcgccggcggcgccggtgctgctctcgacgacgacccacacgccgccgccgctcaaacttttcgtgcccgcttctcgacagccgatgtggtggaggttctgcccaatggtgtcgatgacgatgacgagggcgaggagatcctgctccagcttggtgacgaggaggtcgtgtacaatgttgggcgcgcggcgtggcgcaggtgggggatattgccgctgactacacgccgcctgatgatgcataggcagtgcatattgccgcgcgaggtgagcttcggtgacgcgtctcaggttccttgggaggacatcggcggccactgtttctaccgcatatactagggggaagtttttactagtatcatgcatgtaatttaaatagttatataaaaaatttataaaacttgataacatagactatgataatataagataagtactatgtaaacatgtaagtctaataaattcaatcgacatatgaacatatctgtacaggtactattcactgtctgattttattatttttgtttctcttgttgtagatcaaaattagtactgcatgtttgtgtatagacttatataatcataatcgatgttactaatttttttttaattttttctataactatttaagtcgcatgcgaatgttgggtgccatggcacctaggtgaaccatgggtgtagaaaatccttatcacatatactagtactagttgggcgggcgtgctgtattttaaccctagtcctaagatggccttgtgtgtctaatcaattagttttgttgaaaaaatttttttgagagagatttgtttgaaattatttgactttttttacgagatttgcttcaaactacctaatacatgtacatgattttatccttcaaaaacaatattttagactcaaaggtggattaatccttcgaaaacaacctaaaaagctcatgcatgcactggtggagaaaccatctttcgtcggtcggccgatttccacagtagtcccggatgcaataaaaaccggggctaaagatgttctttagtcccggttcaaaagggtaacgggcatatttgatctttagtcccgggttgtgttaccaaccgggactaaagatgatctttagtcccggttcgaatgctgtcagggtctgtcaggccctcccggtatctttagtcccggttgataacaccaaccgggactaaagatgttaactttagtcccggttggtaataccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatgtagttgtaagttgatgagagagaaaatgtgtgtggggaagaaagaatatatagaaatttagttcatttgctaaataaggttttataaaatagttgagaaggaaaactctagtgaaagttaatcttaaataatagaaaacaaactaaaatgaaaattaaaagaagtaaaacacattaaaattagtttattacttaacaaatagtttttaagaattatttggtgtaatattttatgatttttgtatgaataaagatatcttataattattgtatgactgtcattattgtaagaataattatttgtgtacggtttttttgactcatatagatggatcggcaatggatgtacgctgaccggcggtccaaagagtttattgacggcgtgcactattttttgagagtggccgaagctaacaggaaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcaatttgttggatttgaaggaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtcgggggaaaacggattgtatcctatatcgcggtgaggagtacgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgatagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaggatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaagggccctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataatgacacatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtaccggaatcacgccatgaagggagactacggggaaagggaactctcggaaggaaagcaattatgacggtagacaacaatttattccgtaaagcccatttcactgttctgcaacactcttcattggtagctccttacatcgaggagcacttggctctagttcgcgccaggaacatcggtaagtccgatgtatggattacacggcatcacattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagag

SEQ ID NO: 58858 - DNA, 744 bp, Oryza sativa
ggcggctggcaaagttggctgatggagaagtgccaacctgcagatgaaatggagcattgtaaaaactctactaactagaattattactgtttattagttcatcagctagtggtgatttgttgagtaattaacagtaaggattttgcatttgcttgtaaacaaaatatgactttgtaactacagatgtgtcagtgcatatgaaattttttttttagaatagtgcatatgaaaatatgaatgagtgatacaccactgtatagtattctgtactactaatctaaaaatgaaaaaagaacggttggcacgtacctgtacgtagctcggtggacagagagtaattaattaaacaacaagtagatataaactaaagtatagattagtgtaacgacaagatattatcacatgcatgaactaatgttagcatcctaatatcacatgaatataaatgtaaacgaatgacatgaaattaaatatatacatctaatgcatgaacaaaatgacaaactgaaggaaggaattgcgtgcacatatacgagtagtgtgagtcagcttaattacattgaaggtgtgctccacaacagcagcctgagcaactgaagaaaccaaagcaatggcaatgaacagcagaagagaccagtgaagagtcatgctaatgtatatcatcaattggctaattataacaggaggttattagggcacaagagagatttgatttgtggcctaattactgggggaatggagatc

SEQ ID NO: 58859 - DNA, 64646 bp, Oryza sativa
tctagctccaggaggggtggagctagagctgaagctgtgccaaacaggcccttaattgcatccgagcaagtacgtcgtatatatagttgtgttgacttcacccgatgtctagagaaaaggcaaacataggaaaatacatctcaactcttgattgaatttattatgctagctagtagatgagaagagttaagagtagtgcaatacggtagtgtcgaggataaagcatacctcctatatacaggttcgcggtaaatagaaataccatatacagtagtatacaagaaaatatcctttaattaaggaaataaagcggatagaaaagaaaattatcttcccggaatagaagttgtgaaagtgttagagtccttatcgggaaagaaaaggtttccttaacctgtatcatgttctatttctacgaattctacttggatagaaagatgattttcactattaatacaagacccactaggatgagagggaacacaccgacagaagacaagccaatacagatctagacaaacccaatgtagaagccacagagaccgacatgagggatctagaactacatccaatctcgccaagtttatgtcagagaaagaagactacaccagccgttgagtatgtgcaaaagctcgatgccaccaggccgatagaaactagattaggtcatcccaaatattgtattcgtgtgatactgatatataaaagtaacaccggctttagccaacaggagtatggctattactccctctatattttattgtatgacgttgtcgactttttgatatacgtttgatcattcgtcttgttaaaaaaaattatgtaattatcatttattttattataacttgatttattatcaaatgttctttaagaatgatgtaaacatttttatatttaaaaaaaattaaataagacgaatggtaaaatattggtaaaaagtcaacgacgtcatacatatttaatggagggagtacctgtcagttaaggggcatgaacttgtcctatctcttttattttgatctcgcgtataccttggtttcaattattctcatactatacaaataccgtttacggatataacctgtcgacaatgattttcatgagattctaagattagaagggcgggttagcacttagcaataaacagcaaggaggtggagcagtgaggcatggtgtcaccgccacaaccatagaggggaagtgactacgctgccttacataaatggttagttggcagtatcaataaccaatctaccataaatctttctatttgtatgtgattcatttctaactttacatataggaattaaggaatatatatattttatattagagcatcaccaaccgtgtcccaaaattccatccataaaattttagaacctaaacagaatttgagggattaaattttttatctctcaggagattggctaaaattagctttttaataactaaaaggtgagactcctaggaaattactccgattggagctgaagtttgtccctagactataattgtaggacagggaataaaaaatattgggaatgagattagggaatcatgtaaaaccgatttttgattaaaaaaaatcaaaaattacaggatagggaatgatattaaaatactgttggtgaatatactgtgaggcttgtaactctaccataaaattttcctcgtcgcttctgcagatgaacaaattacaaattactggtagggccgctatagtaattggaggtagaggcaggatgacctggacgcacgtatattggcagcattacacgtcattcacaagggcaacacccgagcaaatcaattcaggagcactgtgaagtggggccctttccaccgaccctagctatgccgccacgtcagtatctgcttccgggtcatgggctccaattatgcctcactgttctttgtggcaagcaatttcatggccaccaatgtggcgcggcagcaaaaggatgaaaacaaggcattgtcatatagtagtatatgttcttcaaaaaatcaaacggtttgaatgtaatctttcatctacacttcatggtttgtaaaccttttcatttaactcttagcatcaccaacagattagcaataatctattcccgaaatttaattttggatttcctaaactaaaaatagaaagtgaaaaaactcattcctctaaaaatttaaaaaagtggaccttcttttctgttattttccttccacgcgcacagaaagagatcacagtaacccacatgctcccaacagaaatttcagccctcatgcggaaaggagagagaaaaggcgaacgagggattgggagtcactctctcacccttaaatccacgtaacgaaatatatagagatgggaactccaaaactagtgcaaggcttttggaaatatgttggatatgacttttatactaaaaaccctcaaaatcagttttggaaatgaaatagaataacggttggtgatgcttttactctaggtaatcaataactaatgtctctaaagtagcacacaacaaaaccattttttttgttaaaaaaaacggaagtaatccatgcgtagcatcaaggttgctcaagagaattaaattggaggtggcagagctatcaccaattatcctcgaattgatcgagctcagggtttacaaaatcgtacggttatcacacagttataatgtgtgctaacctttttagtttttcaaaccacagtatatcctacagtaaccgtgctattatcgtggtaaccgttaaactatgagttacagagttagtcctatttcaaacggtttgataaatcatgattgaccttgaactgatgaaaattatatcctatatcgtcctaggttggtcattggtgcaaagtgaaagtaccatttaaacctggtgcaaactaaaacatgaatcgcaacacaacacgcaaagtgcagtttagtctcctcatgatcaaacacaaatattatttttagcggaaattcgctctcaatctagcctagcaatcaatgagggtctcacaaattagctcatcctagcagaaaaggcggccgaaagagaggcgatgccacgggggatccggctggatgtggcacgtgggggcccacaccgacagccggccaagtcgatattttcattttcctcgagtgatttggcaccaaacaggccatcctactgggcaatgttggacgatcggtgtggactctacccccgaaagctgctcatcattgtacacttcattcatcaactcgatcaacatctcaaatggacggtttaaagcaacgaaaacgacacagagacagcagggtttttcttcttcttttttttttcagggagaagaaagctgcccccagcttcagtattctctgcaaccactagctaggacttctgaacgaatcaatttgaaaaattttactagtacagtggaagaggagttcctgttgaacatttgaaatcaccgtgtacaaagatttatctctttcttcttttttttcttttttcagagattacgcaagagaaccgcgcatcatcttagataagttaagcgaaatcgtgatctggattttggtatgtatgaaatcaaagggtatttagcctccccttttttttttgtgaaacatcatttttccttcttgaacacttatggcaggagctgtgccgatcgattgagagaaagaaaaaaggcatagtagatgaaacaccttgagcagctaacattatgcatcaccattatgcattactagatatgcttgtttgccggtgacaatgctgtggcattgtgcccccacggcaatgtagtgctactgcagacggctctgatctcgctgtcttgctgatgatatccctcttgcctttctctttatttttgcaagacaaagttgatctacggacaactactcctgaggtgttgtacaatcgtctttgcatatttctatgctagcttttcaataaaggcgtctaaagcaaagaggacgaactccaaagtttatagaggtctccatttgctgtaattattgtggctgatgaactctcaagcatcacacatgcaaccacttaaccaggcacaggatgctagttgtaatagtgttgatcaaatggggaatttcaaaatgtacttagaagactgtagagtttactccttctctattcaatgaaattggtggctcgctgattcgtttaaaaaaatgtactcaaaagaaataatgaaccctctgagtaaataagtatagttgatcggttttaatacttctcgcgtcattcttggtctcgttttaataacatttacttcagcaaaacatcacgcacaagttatttccattatcttgaaaatgaaaagaaaaggaagactttgatgccacatgaaacaatatatgattcttgtaaaattatcaggcatgtcccaaacaaggcattgagtagaataacaaccatatctcagaacaaacagaattaaagatcttatctaacccactaaaaagtatatccatcaacctataggtggccaccttgtgagctaagctgaattccccaaatcacatcagccactgttcaggggcacattcactggttccaattgcattgtcctcacgctaacccgacaataccgtctctgttcatgccaccactaattaatctcgtacaaaacaaaccctaatcaattcaatcgtctccccgatcaaaatttttacacgatcaaaatttttaaagatctcgatcgaatctcagactgatttggggcgcaggcagaacgtgcaggaacactgagatgtacacctaaaagccctgcatgcactgagcacaaacagcttagttagtaccctctccgtccataaacaaaagcatttctacctatgcacaactatatagcaagaaatacttatatttaggagcaggggagtacaactaggattcatagtttcgacataaacaagctgaaaaccgtggaattttaaggtttcaacgcaggataaaagcatattttgatgcaatttccaaatgtttttttaataaattcaaaactgaactgctactttcgagcaaaatttagtcaaaatttgtcaaattcatagagtcgggatccgaccgtccgtcggaaagataaacctgggtacaactcaaaagctatatctccaacttgctgccactgtggccaggctagctggttggccagctctcacttggcccttttcttgggcacactgatcgatccatctgtgacaactctgtaccgagtgactgtgtgtgtatgcatgccatttatatggatctgtgatgatatgatccctctgatccatcacacaaatgttagtgaaaatatagtgaaataaataaacaaacagcactccctgcactgttgcacccttttggacactttccatgtgccatgactcatggccaacttttggttgcattcttgcatgacatgtagtacatgtaccaaagattcctgatcacgaatttgcatgagatggatgggagttacaagttgagcttaatcctgaattattttaatcctttgggcatggtgtgtttttcccattctgacccttgtgagggcactatatatagccctccacctcagtgcaaagctccacacacacaaactgagctggacacttgatcagtttagctctcttgctcctctagctgaccactctactatacacacacatatatacttttttcttggtgtattagtaagcacacctcatcgacatcaatggccaccgtagaggtaattaattagctcgttgatctgcttgttaatcatcattgaaaatggttaattattgattaggctaggaaaatatgtgaaaattatgtgatcttgttgattgatcatcgtgttgtgctgatctcgtcgcgcggatcgatgtgtaggttgagaccccgaccaccgtgctggccgaggaggcgccagtggaggcgacgccggcggccgccgccgccgaggtggaggcgccgaaggaggagacgccggcggcgccggccgaggctgtggccgaggaggcggcgcccgccgaggccgaggtggcggagaccaaggaggcggagccagctgcggccgagccggcggcggaggaggtgaaggaggccgagcccgagccggccgagccggaggccgagcctgccaaggaggaggtggcgccagagcccgccgccgccgccgaggcggaggccaaggaggccgagccggcggcgcaggtggccgaggaggtgaaggaggaggaggcggcgccggcgccggccgccgaggaggtgaaggtggaggaggcggcgccggtcgcggagccggaggccgagaaggccagcgagtgagtgcatgccggggaaggctggctcgccgtcgtcgtacaccgtggagtacatgcatggcccgcgcgcgccgccgccgccggcgactcgccggagttgtacgtacgtgtgcgtgtagcgagtgatgagttgagtgagctggagtggtagtactcgactccgtaggtgtgtgtgggtacgcgtgacgtggggctaaataaaagagtttgtcatcgagggcggtggggcccagcgtcagtgacgcggtgcccctctctggcccccacatgcctccgtcgtcgcaggcgttgtttgtcggtcttttgtgctttttttttttcgtgtttgattggttttcatcgtgtaatgggtgcgtttctgagagtacattgtctgtctctatgtgtgtgcgatctcagccgttcatggccgtgtgccaaccatttctcgccgtcggtgaacctaccgtcttgtgtgttgttgttttgatcggttcgtcgtgtatatatgggtgtgtcacgttctgagagtacattatcactgtgctttgtgtgcccgatctcatccgttgatgtgcatgtgtcaatcatttctcgccgtcggtgaacctaccgaaatgtcgaaagcgaagcgaccagcaatggtggcagtgtatgcgtatgatatcttaagataaatcgagctccataaatacttcatgtttaggtctctttttaaacacgggattgaaaaaaatagagaaataggaaggataagctcaaaacatacaagaatgattgtttgagtagacaacatgaaaaatgcattaatcggataagagacatgttgaagcttctttaaacttttctccaaagtcttaggatatcctacgaatttcaatgaaaatgattgggaaataaacgacttcctactttttttatataggattgaaatccaaaaaatcctatgattttctccacatataaaaatgggccttatttgaaatatgggaattttattgggttttcacaagaatagctcatttccgggttcatgaatcaaaggggcccttgatcgtgaaccctactccttccgtccaaaaggaattaaattctagctttgggcatacctatagttaggagttgatttactttagtacggtggagtacctatttaaggatggcatcatgatgtttgtacattaatcccatgcaatcagctcttgctctgtgataagctaaggtgatcaatgcaagtgttttttttttagggggaaatgcaggagctctgccaatttcattgaggatagaaatgattcagattcacctctcaaaggttccacagaagaaatcacagggggatcaatgcaagtgtcatgtcagaattatgaggcaattgcgtcatatcaaaactattcggcatttgtgtttcagcgctgccaagtaactgcatttcattggttgtacaaaatgttgaagaggggaggaagatgagtgaaatcaaaatgaatcagaggatagatgattagagtgcagcaatgatctctccatcggcggctcgcaaaggtggagaaactgtaggtgcaaccgtgcacaagcatcccgtggaaatttgccagagtttcagcgggatttggtatggaatttctctcacagatgcaaaacatttgaaaggtgtgaatacacatcaactaggcatccgattccaccgggtgtagttgtcaacatataattgtgattcatataccaaagacatcgttggaatccatatgttcaggcagagtatggtccatatcacttgtcagctgctgagacaccggtttctggctgattcccagaaaatttctgctgcctgctggtactaaacagcaaagcatatccgagttttaacttcacattagcagagtcgcataccttcaaagtttcagtgaccgattttgtccagattcacaaacagatgatcactttaactctactcgactctatgcagaatttcagctccaccaggaacaccaagccacatggctactacacgttgcaattacctttatgacatggtttaagccttaactggcttccagagcttgtgagcatagcacgatgcaaatgctcccaccacacttctccagaaagtatatgaaaaatggaagcctggttcaaaagagggagaatgaaaggaacctgctctcttctgattatgcctaactagattaaatggcccagaacactttaaatatgtacaaaacaaacaaaagatagcctattgcttttaatttctagcttcaattgaggcaggtaaatcgacactaacttgggtatgtacagaatttaccatattggattaccataagggcggcatctaccatgtgccaaagctacagctcacatgctcttgtgtgatcttctgcagctggtttctcgtcactttcaaggatggataagcaggcaggcagagccggtaaaagcaggtatgtgacgatgggagacggtcagctgactcagataccttatatatgtacagttttgaggccagcccaccaaaaccatctgagggtaaatatttaactgaagtccaaaagaacagcagctgcctctgttgctcaattgacaagctctcaacagcctgcagtgtgaataaacaagttttcttaattcttatcaagcatacaccaaatcaatcggaaacacacaatggttatgctagataagtgtatggttatgctagataagtctacaaagtaagtttctattgaaattctagaaaagtgcatgcaagatttaaggagcgtatttgattttatgtcagggtgtgtttagttcacaccaaaattggaagtttgattgaaattggaatgatgtgacggaaaagttggaagtttatgtttgtaggaaagttttgatgtgatggaagttggaagtttgaagaaaaagttgggaactaaaccaggcctcagtgtaaaaacgatgacaaagtgcaatagttgccactatactttattacctactcattccactgtatttaatatgctactccatagctaatattggcagcagcacaagctctgggttatggaaccccagattgatgcggaactaagttaagaaaattgtttcattgttctcagcatttcacacaaaggagcaacaacaattgtatcaagtaacagaagttccatgaaattggaaagagtggttgttgtacagctcctagaagataaaataatattggtgctgtaaggtagagaaaaacccacgtctatggttaactgagacttgacagaaaacccagcataggatatcatcgattgacctcaacttataggtatacaacagcgccggaccagtaaagtgaaagaaaaaaaaaacacaaacagttgtcatcaaaacagtgacaaatacaaggatcacgttgaaacagcttcaatgttaaaacaccaaagagacaaacaagatttaaccttagtttcatttacttttcagaaagtaataacattttttattccatttgatgcctacaggttcaaatttcaagatatggcatttgtgaacaaaaaagaccataataagactccacatgatcccacaatataacctgaacaagactacaggacaaagtggcttaatatttttggcgccgtttgaaatcttacaggttaaggtttcagaatctgttgagattgtgaacagaaaaacatgaaaatgatatggcccacattcaaactccttattggtcttcaatgataatagcagcattttcccccataagtctaacatgcattcaaagccctcatttcttacaatgagcaaagtaatcaaataatatcatgatataaaactgatgaagaaaaaatcatggttgaatgcatttgtacaatgttacatggcataccttccagaaccagataatctggcgatctttttctttgtagccgttatattgagtatgtaatttccaatcttccagatttatagttttgttgcttccccctagcattccgtcgaagtcttctagatccaaaaactcaaaaaatactttctggagttccggatcaactagaatgtcactaaatccgcgcacgaaatgggttaactgaactgatatggaatccacgaaggtactcttaataagaaggtcaatataaagctctctgttcctgatatttacatggagatccttccctcctgagcaaagctcaatagtccttcgagaccctaattcatgaacatctcgggaaaatgttagttcaagaccatcaacaacagcagcatccatctctaaaattcttttacagcttgcatacatgacagggtctgcagcagaaatatcttccaatttaatacttctcccagcaagatgcaagaataatgtgcggtccaatgtgatccctacttgaactctatgcatcaatgctaatccaattattcgtcctgaaaatatgaagtatttcaggtgcagtggatccacagcagatgctgcaacatacaataagcataaaaaaattagaagagattcagacattcagtgaacatacttgtagacatcagctgtatcatgaataatgaatatataagaatcaattaaatataattaagaaaagtgaaaatggctcaaacagctacagctagaataaactgccaagctaaaaattatggtattctcatagaacttttcaagataacatactaattgcatattgtgccagcaaggacttatcctcctttttgcatgaagcatgcctcactttcaacctaacagtgtcacgttacctctctggccaagcttaggcttatcaaataagccagcttttatttatcagcttgtagaccaaaagttggaaattagcattttcgttagcagcataaaatagaaactcatcttaatatctatgtacctattccatttgtcccttgtgcacataagagacacattggggaagtctatggttgtgcagctgtgtcacaggctcactgcatttcccagagctcctttaacagtgtgacacaatttccaacaactgcggtgatacttttcatcttgaaggttgttcatcggaactttctgatccagttggcaaggatgatatccacaaaactgttagcatagccttgatatgttggactgtttggaaagtctcaatgaggaatgagcatatattgcagctgaccaactaatgattcactatttctcattccatgcacgttaaacttcactacagacttgcaatggaaggaaatctacaaagcaaagttttccacaggtatggtgagtaccaacttccacataggtctgggcaccaacagtctacagagaaacagccatgacaattcacaccaccagaatgggtggttctcgatgccctggcaggaactgctctggtgtgtggttggctacttatataactggagattagcaatggttgctcaaacaaaatttctccagtccaccaaaatttgtgtgtataatgtgcggtgccaatgacacattgcattccagattactaagtgccagaacatacaagtggaaaacagcttgtcatagcatcgtagtataaattcgcaaataaaaagtggcagcatctcattagtgcagtattgaaccaagttttatcaaaagaaaaaacaaaaagaggtgctgaaccaagtagacaagcaaaggtaagcctttactaatactaggccaacttaagttcaaaaagaaatactagccaagatattttgttttctattataccatgcatgccaattactggatccaccctcaagtcatcattagcttattcgattcaggatttttctttcaagatgtatgatcatagtgccataacataagaacagggtcttaagtgataatttaatactggggatgaggaaacttacttccgttcaagaagaacctctgtcgatcactaggacaaggcgagaagagaacttgctgcgggctgaaaagagcttgacacaccatgcagaaccattccctcagaactccagggcctgtcgcttcctcattcttaaactccataaatagcccactgcgaagctcactgggtctggcctgtataatgtattcaaaggactcgtccaataagtgttgccgatcaatcaacatctcatgaagctccccgtattcatcctttccctcaggtagcatcatcaagactaaattccttcttgattcaaagcaaaggaggtctttatgcttcacaagccagtggagatgctcattcctcttggaacagcgcacgagggcattgagaggatctctgtgtgccagcaacacaagccgtaggttatgtgccaaatcctcataaatcatcgatataaaatctagttgtgtcagcatgaccagcatatgtgaccgggcaacccatcgagattgacttatattgacccctctgttctccgatgacaaggacagatccatttccaacctcttcaagcactcatccaccctgttcaataagttcattgacatttcgtgcaacttccacacccacgtgtcattatgcccacgctcactgttatacagattcttgggcaatggccccccattgggaacccaacggagtgcctgctggcgcagcactttaaagaaatttgagaggtcttcaaggtttttggatgacacagtcatatccagtgatgcaagttcgtccataaccactcccactatttcttcagcaaacggaaggacctgctcgatcagcttggaaggtgacttgatgcaagggggaagcccagaaggcaagctgagcactgttgcaagcatagaacgggatgatatatagagttcatccctcttgcccacagaaaaagagagcaacccgcaaaattcaagcagcaccggcgccatgaccggcagcacgtcgggtggcaaggccgaaggatccatggtgaggaagcatttgatggcgttctccgcgtgatggtgggaggcggaggagggattagcggcgtagaggcgaaccagcgcgaagggggcgcccgcctggcggaaaatctcgaggtactgcgccgcgtggtcccccgtgggttgggcatcgaagaggggggagtcgcgatcatggcgctgccgcatgttggctcggtgcgcgcagaggatgaactccttgacgagctcgttgatgttggcggcggagctggtgtgggcggggtcggacttggcggcggcggcggtggaggcgatgtaggaagcgagctgccacgcgtccgggtagggggtggagcggaggcgggagaggaggtgcagcgtggagtccggcgggaggcggaggtcggcgagggcggtctccggcgcgagctgcctcccggcgtagacgaggcggaggtcgcggccgtacccccggtcggcgaggtgcgcgagcacggcgcccacggtgtccccccacgccgcgtgcatcgacacggtcctcgagtcggtggcccgcacgaagaagtgggccccgcaggagaaaccccccgccgcggaggcggaggcggacgcggcggccgccacaaccccgaggtatgacgaggccgaggaggattccgcccccacggcggcggcggcggcggcggggtcatcggggtggcccatcagcacctctcgggacaccgggaggagggcatgatcgggcccgtcgcggcggcgcttggagggtcggcggtgctcgcaaccgaagccgtcggcgtcggacatgcttagatcgggaccatcgccggggcggcgggagaatcgcggccggagtgagaggagagggagggtttaggagcggaatttgggggaaaacgaggggaagggggacgaggaggttgggagtgtgaaacaaccaaggagctcaccttgccattctctccttcgattgcttttgccgttttgtttttttctaccttttttttttctctggggcgttttctgcacgctttaccgccgcgtgggttggtttgccccgcatcgcgtcgcgtccagcggcgccgtgtgtcgtcaccggctcaccgccgcgcgcgcgcgaaccagtcatcggctcgttgcccgctggattcgtcgtgctttttaatccgttggcccctcacagcatagagattattattattatccttctgtaatctaatctgtgctggcatataccatatactccctgttcctaaatataactatttataggttttaagtatggaaaaagtacgaattaccctcccgaactatcacggtcgtccgaattaccccctaaaccacaaaatcggacattcttcacccccaactatacaaaccagatgaattacccccctccctcgacccaatccgcggtagttttggtctacgtggcatacacgtggcatcccagtcagcatttttctaataaaaaaatggtgggacctgcctgtcatactctcccacctctctcttccccactttcctcttaatctctcaatctttccctcttcctctcaatctctctctgtatcagatgtggccagcgagttggtggccggcgcggcgcacggggcggcgacggacggcggacggcggctgcgggcgcggagcacgagggcaggcggcggacggtggacggcggcggcgggcgcggagcactggggcgggcggcggtatctcggcgatagccgagcagaggcgactacgggcgcgacgcacaggggcaggcggcggaacggaggtgactgcggaggcagctgcgggcgcgggcggcggacgtgcccgtggcgcgcgtggagctggagctgctcccggtggtgcgcgagggcgacggcgctcttcgcccccccctccttccccgccgccgcatctagcgccggccaccaactcgtcgtacatatgagacagagagagattgagaggaataggggaagagagagagattgagaggaaagtggggaagagagacaggtgggagagtatgataggcgggtttcactaattttttattagaaaaacgctgactaggatgccacgtgtatgccacgtagaccaaaaccaccgcggattgagtcgaggggggtaattcgtccggtttgcatagttgggggtgaagaatatccggtttatggttcagggggtaattcggacgaccgcgatagttcgggaggtaattcatacttttttgtttaagtattatatttcattgatcccataacatagcaacatataatcggataggttgttatattatgatatgggggagtagttattaaaaaaattataataccatatattaaatgatagatggttaaaaaataaaaatattgttgagattatggtactgagcaaaattaaatgagagattgttagtgacaaaagtaataatttagtataattttatcggaaatgtttataatttgaaatggaatgagtggcatctctcaattttggatattattgttttctttctctaatatggtgtggtatctcataccatgttactccctctattttatattataagtcatttgatttttttcttaatcttagtcaaagttttacaagtttgaccaagtttataaaaaaaattagcaacatccacgataccaaagtagtttcattaaatttaatattggatatattttaatattatgtttgttttgtattagaaatattggtatatttttctacaaacttaatcaaattttaaaatgtttgactaagaaaaaggtaaaacggtttataatatgaaacagagagagtagtttaatgagatgcaatccaaagaaaatgaaatgatggaaatgatatctcaaagtttatcaacataacggcattaaattgatcctaaatcgatcttaggagattacttttttttcgaggaaggatcttagagcatctccagcaatagctcctattttacagcccctaaaaatttaatgggggcttcccctattttctaaatacctaaaaaatacctttaactccagcagcaatcccttttctcgccctttatttcatttcatcttctattttaacatatactttaaagtacaaatctatagttctatactctacgctactcctagtataaaaccataataatccaaccatatttaaattcacaattcaaattcgattcttttaaaaaaataaaatggaaatacaaatcctagtagcacgtattcatagctcgggtgaaacgagcttctgctgttgtggcgcttccatgcattttctcacatgtgttgatttttcccgtcttctcatccaccaatagaccagctacttctctcacgaagcaacaaccaagcaaagcaacaaaaaaaactgcatagcacatcgcatgtatcactttacccattcttctaagtcccacaatcgcagctgctagtgctaccctgctactactttctcaatttcgcagcctgcaacaacacttgaatcatccagtgcctcgacgccatcgcatgactcggccactgggccatgtttttcatcgagttcaggcagagggtgcaggctagaggagactccaggtacagcagacgcgtcggccgggaaggagcgtcgggtagaggaatgcacctgagggatgacacggtaggcagggaggagccgcaccggccggggatgagcactgggtaggagaggtgccggcggaccaagaccacgtcgggcggctcccgcgcttttccaaccgtggataggggctgtgcagtagagcccctgagactgggggctaggaaaggttatttgggtgcctacctaatttaggatccttgataggggctctgctggattgagtttttttagtctcaacacccaaaatctgtttaggggttatatttagtgtttctgctggagatgctgttaggagatttctctacgatatattccagtgagcatttttcgcttgcttgcctcacatcaatcgctaatcaagtacattttgtctcaaggcatcaacctaaacggaccacatttgtacgattgagcaagtgacgaattcctgaaaggacgggtccattaactgaaaccccgttgccatcttctcgccgtttaagagagaaagggggtggtgtgctacgcgtttatatgttttacccggaatgagagagatcatttcatatgtgaaaagaacgcaggttagtgcgatttgggtagtgtctcccttcatcgttcacggcggtaggtaaggagatacctcgatgtgatgccttatcgatggctaagaatatgtttttagttttcgtctcgtgtaggacagtcaaactcgttcattaaaaaaaacagttggttccccatagtgaaggttctacctaataagtcgtctaacttatccgcttacgtcatacgccatagagctgtatttatgttatatacagtgtgaaaggggtcccctatattatgatgttgtttagtcgtctgattttactaaataagtttttcttttaaaaagttttagagcttctaatctacttaaaaaatgtgtttagaccaagattgtaggtaatttcacaagaataaaatgtgatctcgtaacaacatttttgttgaatggacgaaacgaaaacatatatttgtacgagtccctaattaacttctaacttgctactagataaaatagggctacatcatatatttatagtattgcgaaaggctttacatccttaagcaacaaataaattaatgcgtaaatgcttcatatcgaaagctacaaatttaacatttcaacttaatatttttagctagccttttaccatcgtggtttacaggccagtagcttttcagccgaaaaaaaggtcaaagataaagtttttgttctaatacataaaagcaaaaatagagagaaaagtccacatttagtactcgttcaactatagccttgattttttttcacttaaatacgaagtcatctcttaacactcaaaaccattcatattttaccgtagatcctaagcaaacgtggtttttcccgtaacgtggtgccacggggcatcctagcaatttaaaataagatatggggaaaagaaggaattgggacagggttgaaatgtagattgtagtatttccttcaatttttttcttactatttctttttttaattatttatcactatgttgatgtcctcgttactaatccatgtggattcaaaaagcaggagtcatcaaaaaaccatccaggtatagacacaaggatgatatgtagaagattttgagcgttaatgaatcaaaaagtgaacgatttcatagttgagagacaacgatcagaccaacactataattgagtaactaaatataaaattttctaaaagggaaaactctggaaccaaataaaaaccaaaccaagggcctgttcattttgatgccaaataaaaaacttttggcaacttgccaaaattttggtaggatttcttatatagttaccaaaatttgacagcaaactaaatgtagccactttttttttaactttaccaaaatttgataaggttgaaaatggtttcaaagtgaacaggccctgagcccaagattttaacgacactttcgcctgaaactttagcattccgcaacaaggagcccacccacaaattgaggacaatcgacccagcccattaacggcccgcgatctccacatttctagcggtttcacctccccaccatccccacgtagtacgtgcagtctgcgactttgccttctccggtccatccggcgtacccctagcattcccgcacaaaaaatctccttcgagctgcagcccgcgagctcgtctcccctcgtcaaaggccccaaaaccacaaaccgcagcccaaccttctcctcacgcggcccgagacggcacccaggggcaacccaccgttttaccgcggcagtagccgctcgcgcgcacctcgcgtccgtccacgaagccgcgtctgcgtgggcgccgcacagacgctgcccgcgcgacggcgacgcaacgtgacgctgcgggtgcgtgcgggcggcgggcgggcgggcggaaaccaaagtaccaaaccaaccaaccaaccgtaactcgagctcgagtacgtcttacctttcgttcaccctcgcgctttgcccattcccagcgtcgattccatcgatcgatctgcgcggatatacggtgccgaatcgtcgccgtcgccgaaaccgatcgggtgtggtccggccgatcccgacggctttccagcgcggtagtatgccaggctagcttgcagcagcaaaggacacgagaaggtattaaggcatcgcagaatcgatcgcaggcgtgaggtaaggccgacacgtacgtacatgccggcggtgatcaaggagaggatttgatttgatgaaagtgtaaccaggaatggaatgtgcgcattgatgcatgacgctcgccgtcactccgatccggctccacacaaagatatcggccgtcggcgtcaaggcggcaaagacggctaaacatgaggtgtttgggcgtcatgcgtgtttatcctaaaagccacaatgttcgtggctttccattccatgtttcgtcacaggcaggaaattagtttctctcctgggtgattgatggatgggctcacaagtcacaaaaaacaattatgagcaacctcttatatcctaactactaattcacgattcagtttctgaattacgatttatcaaggttttcttcctctgttatcatgtttaatcttcttgtcggttctttagttaaacagacagtctaatctaccaacaggagtacacgaccaacaaccataatattgttatctgtgttatactcatttgatcttgctccgctattacctagtcaaagactaattaagcaaggggctaaaagagattaccatgcccttattagagcatctccaatagaatgtctatttggctctccaagttaaaatttaaccaatatagagaaaaaacaagctccaacagactctccatccagattcggatgccaaattgctcctccagctgaccaaatgtagccagcttcctccactggccaaaggtgggtcccaccaccactcctagtctaatccttcctctctctgtcgtccacccaccagcaaggcagcaacttgagcgcatcggccgggggcgaattggagagcacgtcggccacgagcgcgccaccaatgtctgggccaccacccgccgcggctgtcgtcgtctagccatcgtccgccgcggcagtcatcgttgtcatcgctgtgtcacggttcacgcacaagccgttgccaccgcaaaaggcgaaatcgtgacgcacacaatgaggaagacgaatcgcaagtcccaatcgattcctcccatgctgacggcggtggtgatggcgaggaggatgaccctttgttcgcggacctccagaagctcccgccggacgttgcccgtgacatggaggccgtagtcggcgcggctgaggggttccacgcggacactgcgtgggccgggggcctcctagagcggtgcggcgccatctacatcaccgctgccgctgccgccaatcatcgctgtgagcccccttgcctcgagcagcagcagcagccgccacgccatcacctgcgcatccaccagcgggtgggtggggaaaggaaaagagtggggaaatggaatgacgtgaagagagatgaagaatgacagagattggcatgtggaacccagtattaaaattggagaaggtaaccgagagactgttggagtgaaatacaaatttgactctccaactctttagcaaactggctaaataggcatttgtagagttgaatttagagatgctgttggagatgctattaaagagataaaagggggacatgaaaaaaaaatgaggaggagtagatactattggttcaatgtctaaaacgagaaggaaattaaggttgtactatagaggtctactgaacccgttctaaaaacatagtttttttgagataaatctttaacctaaaataatatttcctccttttctttttgtttgacgcttgttagttcatactttattagttaaaaattagttagttcaaattaaactaaccaatgttctaattgaacggaggtagtggttctttttatgagtggagtaataaatttgtccagagtgctttcaggaaatggcataaaaaaaggaattgctaaatggtattcgatgggaaattggggctaaaaccttgaaaacttctaatcgtaggatttgctgtgcgtttcgtgcttcaaaatccacaatccacaagattatagggggtctctgacaaatgacaaaaaaaaaactttgttggctgcctaatatcctcacatatgcatgacgtgctgatgcagtgatgctcatgccctcaccaacgctttcaatcccgcatcactcaaaaccaacaactcgaaatagctatgtccggaaccgccatgtgtatactccctccatcctaaaatgtttgacgccattgacttttttaaaaatgtttgactgttcgtcttatttaaaaaaattaagtaattattaattctttttctatcatttgatttattgttaaatatactttttatgtatacatatagttttacacatttcacaaatgtttttgaataagacgaacagtcaaacatgtttaaaaatgtcaacggcgtgggaaggagggagtattacggatcaagcttaactccaatcataaagtggcaaaagtggcatacataatgtctttgtctctaaaaaaataacactgctagctgttacccttttaagtaagctaattagtcactatatcgccatgttttggcagaagaaagacatatgattagtagatattgatgtttcacctcatcattttcatgataggagaaaatctaaaaacctctagagattatattgttcattcgacgtccctctagtgtatatttggttcaactatatcctataggtggttttcttggagagtaattttacattccttaaggaggtatttaggaggtataataaggtaccattttttctattgtaatttagtagctaggaaatatgatgtactaaattttacattaaatttttggtaccttatggtaccttctcaagaaccataaaattactctttcttgggaccttgggtcttgccactacctccattttcctacatttccacacttgcaagcctgcattcatccatggtggttttcatactcatcctacgtacaccagcatcagatattagcaagcatcggtgcacctaacaattaatgttggcacgcctagcaacaataaggtgtagggttatagttacacatggataccaaacaaattagaaacatgttgtcaaagagcagacatgtaaggtttatccacaaaatgaagtagagagccaatctaaatagaatgtgacaaaaaaaactcgacaccaattaaactagtggaaatcaaatttgtttggcattgctaaaaattccggttttgacaattttttgatcgcatgctcccaagcagatagtgtggaggtgatcgatcaatagtgaagtttgtgaatatgcagccttgatacagatggtgctcgaggataaggccgttgatagtataagcatatataggttgttctataaataaaagatgacatcgtatagattaactagaatacttcctttgtctcataagttcacttatatacatgaatatgaacatagcctccattcattccaaaattaaacttatttgatacggagggagtatgagtatattgtacatatgtataaaatagtacatacgaacaaatcaaatatactcgatatagtcaaagcggcatgccgaggattcagttcgggaagttcgtagcaaccggcatatcaggtaccgtgataatgacttgtagtactagacgtagacgtcgatgagcgacgctcttgtgatgatgtagacaaatcgcggtggatgagcagccatcagtgaccaattgcgtcccatgctctcaaaaaaccttatttgcgctctcccgttgcagtatcacgaatacgatgattccaaagacctgctctcccgatcgctagtacacacttgttagcataatggagcagacgacgtgtgatggtgtagtacatatgaaggcaaaccctagtttttttaccgtaaatttatgtggagaccatgactcggtatttaaagagaaatcaggaaatgtaatcaagtcacatgtaactgatccagatttttcactactccaatgtagtaaataaaattgcaaaaggaacttacgtccatacaagcaactaaaaccaattttgatgaaccattcatgcaggttctatatacttgcacctgcatcccagaaggcgaggcaaacaaatgagctcgtgtgtttctctagttctctctcacacacatagctcaagtagtaagaagagataatcttttttaaagtggtgttactctcttctaaaactagtaaggtggtactaaaatttacatataaccctttcgtattatagatatcttgatgttttcgtataaattattccctattacatgggcttttggttaactgttccaacagaggtaggggctggaatccagccatgccaggctaccagcacttacacaaagtacaaacagagtcatgtgtcaggttggaaaataaaatggccacaaatgataggataaaaaaaggtgaaatgataaaattgccagaggagacaagataacacaaggaaactacttgcagggtgcttattgatccaaaacaagatatgaggagtatgtgggactccctgaatgaaagtgacttgttgggtggttacgattctcctctctcctttcgcattatttttctctgcaagtaccaatttaatttcttctatttggtcttgcatccaagcataagaagctgagaacgtaggcatgactcatggatacgtcaagactctttgcctatcgggtaagctgataagaacacgtactatatactttgatcaactttgcccaccgaattacatttcattttcgtctccaggaaagctagtttctttgccaatttgccaattgtccactccatttcgtcatggtccggcagatggcgtcacatcgaggcatgtttgcgatcaccttccaagctgtttttttattttgagttcaaaaaatggggcaatctgcagtcaaaatattgattttgtgtacagcacaagattgtgggctcttgcctcttgacggtgtggcgatatttttacacgttccaatcaaaatcctccgagatatctcctaatcggtgtcttttcatggctgcttttttctctgcccgtagattaagttcaccaggatgttgtaaaggaagtagacatgactaattaatctgtgggcggggccgtttggtggccagaaaagaagggttctaccggctactaattatagtttctgttccccactttaaggctcaattaggtcataagctttataaaaaaaaagatgtaatggaccctgcacaattcagttagatatttcaccggccggcctgcgcattagtactacagaacttggcgtttagaacctgctcattaatgggatttttaatgatttgatcaggacggtatccacgaggtcaacgcttggctttgtggatgatacgtatcataggcacatggtgattaggcgaaagcaccacgaaggcgaagagaggtgagaggtcagagggagagggagtgagctcacattgacgtcatgttatcaccagcctgcagccaagtgaaaaatcttacctttcgacgtcagagccatgaactgaattgaggatcatggagccgtcgcttggaaggtaaaaatacctcagggccatgatcttgtcttctctgccccgtttcctcccaaatactaaaaattaattaacctcacgcccgcaaaatgaaaactcctttttggcccatttgaatcgtaagaatgaaaaaacggaggaatagaaaaaacatagaattatgatagaaatgcaagtataaaatagaggattgcaaaacataggaaaaacacaacaatgtttgtttgattggatcacatgaaaaacacatgaatcggataagagagatatactcaaaggatttttaccaagaggttggacctcttgctaagtttcttctaaaacctatatgcaataagccattccataggaattttgtaggatttgggaaacttcaattctttaaatcaaagagctacataggaaaatttcttataggatttcaatcctatgaaaattcttcataattcctttgattcaaaggggcccttaatttttaccatgtggtaatttatagtccctattcctttattaagatagtagattttatgatctaggggcgaatcagtccgaaacgaggatatggtatgcacttttagaaatccagcgaatgtggattatccgacatttctatcggattatccgataggccgtttgtcagataatccaaaattatcaacaaatgtaaccactctatatattgcatataatataagttggttcatccaatgacctaatttatcaattaacctagatttattagcctaaggctttcattgtctcgtgtcacacttgcgtagctatatttttatattatagacataatgtatttatgttgttcagcacttaagtacataattattacaatgggtcatttattaactattgtattattgttccttgtattgctaactcgatgttgtattgattgcatatacatgtaacacccgataaatttaatccgtttccgaaccgattccacaccagctccgcaccatttccgacatccgaaacaatccgctccgcattcgcatccgcatccgtacactatccgcacccgctccgaatccgcttaaaaaatatggtttaggatatggtatgaaggccatccgtccgaatccgctccattttcacccattttttctcaatttttagcacgttttttaaactgctaaatgatatttcttacaaaactttctactttaaaatatcaaaatgactttctcgtcttatgctgacttcatcttcattttaatatatctcaaacaccacgatagagttactactaaataaaagactcctttgacttaaattactgggcggattaggattattacggcggatgattgacttggttgtagatacaaattgaatattataaaattaatttagtataaataacttaaatcaaacagtctaaataatgcaacagaaaaacaatttgtttcaataatgagttatatctgttttaataattcggtaaataagatgaaaagcagctgaaccatcacggcagtaagccagtaaacgtggcgttttgatagcgaggcgttagttcgctgatcacccaatcaccattcggtcttccattcactcacctgtcaccacccgtccacccccgcgtgctgatgcgacgctgtcacaaggcacacgtatgcagagcccgagcgcgacgggggcgctagggctagcggcttgcgtgcgcatggcgtcagcgtgaccgccgccggccgcaacagctgcagcagctggcacagcgtttcgaaaggaaacactttttctgttgagagcgcgagctatgcggcgagcttttatatatatttccccgtagcggagagaggaaaaaacgccaagaaaccatctgtcgcttttgaccccgggaagcagcagcagcagcagcggcggcggcgtatcggggcgtaacggaatcgaggtgtgttgccgctatataaagaggaagaaaataggccccaaaccaaaccaccataccctactacaaaccataggcatcgccggcaagggaggtcggaggaagaagaaagggtcgtcgaggtgttcttgaattctgaatttctgatcaagtcgatcgttcgccggcgacggcaaaggtggtaactggtagtactatatatgacgacgtcgatggagaagccccggcaggtggtgcggaagttcctggcgcggccgcagcacgagggcgtcggcgccgtcgttcgccggagcatcgggaggtttgagctgaggtacttcgatccgttcctcgtcctggacgagttctcaggtgagtgaattgcttctggctcggttttgatcatctggtttagagtgatagagatttgcattttttgatcgtcttcttgatcgaatcctgtgcagtgtctgctccggctgggttccctgaccatccacacagaggtttcgagaccgtcacttacatgctcgaggtaggcagagtcttttaccacagttcacattctgttcgtcggtagtagaacatccaactgcatatagagcggccatgaaaattccttgcttaatccccagtgatacgtacagacagcagcgtcttttgacaaccacatcacacggatcagcagaaacgaattaaacgcgtttcatttgtcaacaacgcaaacctgataggctgatacggagtagtagtttttagcaaattcagaacgtttctttccgtcaaattgaagaatctaacccatccaaacgggccctgttgccttgctctgcctttggttggtagccttcctacgtcaaccacctcgcgtcgcatatacttttccgcgctcaaaactctgcttcacaccttgaactcatcattggcagatcgattagtaatatatatcttcgcctaaacccaacatcagtcaagccaagccgtgtaaaatgaaatagaaagaaacaatttctacaggaagacgtacgatggccttgatagtttggttttgcattgaccgtgttcttttttttttaaaaaaaaagagaggagtatttttaatccggtctttacatccaacagaaaatatgaaaccatttaaattgggaacttagcctaaacaacttaatctgaaattcactcctataaaaatttaaactcagaatctacgtgctacttaggccagtgcattgaccgtgttcttattggaactgacgtgaatggtgggtgtttttcagggagccgtgacgcacgaggacttcgagggccaccgtggcacgatcaaggccggcgacgtgcagtggatgacggccggacgcggcatcgtgcactcggagatgccggcggggcccggcacctccaggggcctccagctctgggtcaacctctcctcccacaacaagatgtgcgtcacgacccgtccttgtcatctccttcgttttttttccccactctcggatgtcgtgtcgctgcattggcatggtggtttgacacgcgtgtggtgcgtgcaggatcgagccggggtaccaggagatacagagcaaggacatcgcgagcacgacgtcggacggcgtgacggtgcgggtgatcgccgggcagtcgatgggcgcccggtcgccggtgcgcacgcggacgccgaccatgtacctggacttcacggtccgcccccacgcggcggcgcggcagccggtgtgcgcgacgtggaacgcgttcgcgtacgtgctggagggggagggcgtgttcggcggcggcggcggcgacaaggccggggcgcaccacctgctgctgctcggccagggcgacggcgtcgaggtgtggaacaggtcggacaagccgctccggttcctgctcatcgccggcgagcccatcggcgagcccgtggcgcagctggggcccttcgtcatgaacaccgaggaggagatcgacatgaccatcaacgacttcgagttcagcatcaatggcttcgagaaggccaagcactggaagtctcaggcgctggtggcgctgggcttagagtagtagggtgcaaccatgggacgacacgacatgtcgacatatgctctgaacgaagggaaaaaaaatggaatagttctttctctcatgatacgaggttgttttatttatttgttttttttctcttccaaacaaatagcgatcactttgtgtacatatccggcataaggttgctgcttgcttttcaattaggcaggtgcttcaaatcttcggcccaatgactaaaaatcatgtacttactccacaagttcataaacaagtccttttggactttcactgtgtctaatgcaagatttgtttttatagaactctaatgcacgacttcgattaaaatttttatcatgttatgttgacgaaatttttaaatgtgtccattttagaagtagtactggtaataattttttagtattaacggtcaaagtgtcaagaagttggcatatcgtggtatttttaaaagcagacaaagatatgatttgatttggaaccattcacttgacacctgtgaaatttatcttcaaagttggccgtcggagtggcgattctccggtagcggggaagtgcagaccccttccaaaaaataagatttgatcagggggttagttgcgcacaacgatcaagaagatggccaaccagaggtgcagtaccctaccctgttctttttgttggtatccggatatggagaaacacaaactttatcttttctaaaccagaaacaagcaaccctttctacgtagcatgtcccaccgagccccatgaaatttttcaatgtgtctgatttataagtactgcaataatttcttagtattaaccttagttttagatagtttgtatatgtagcatttttaaaagcaggcaaatatatgatttgatttggaaccattcacttcacaccagtgaaatttatcttgaaagttggcatatcatggtattttgcttgtttgccgtatgggactatatttatgatgtcacatttttttatgtttacaacgtcatattttataaaaagaaaaattgtacattttttacattatagattacgtacagtaatattgtaattacatagtaaattttgcaacataactttcaaaatttatactgtatgtttttctactataacctagattatacaagataattagaaaaaaaaacatcgccaggcgcgcaagatggggaaaaataacccatgttttccggcggtgcaacctccctagaggtgtttttttgaaggtccattagccaccttagatggattctcctcttgtcgcaacgcccttgccatcacaagatgaccacatttttgcacgcctcgcgagagatagcagattcattcttctgtctcgtcctcttcccgataaacccaaaggcatagatgaagttgagtgtattgggatgtcatgctcctgattattgtttaacaatgtgtgcttgagttgagtgtgttgggatgtcatgctcctgattattgtttgtgtgcttgtgtcggataagtggaaacaaggcttcccactccatcagctgcttggggcactacggggcacacgatggtcaaggcaaggactaatgtagggacccaagtgccaaagaaggtgactcgatgtcaacattagctcggggccaagctagcttccgttcacgaaaccactgcaagtaggatagggacccgaggttggcatcgaggcctgatgtctctctagatgaatctacatcatcaaggagatttgattcggtcatgtgtgtagccttgccctatcataattgcatcccctcgcttgcccacgttgccctggagaaaaggtgggcgacgcgacgcatgctccttgctcacccgatgtggcccaccctttatcagccttagtggctaacgagagggcccattggcagttgggacgaagacttcatctaccctgctccacttgttaggttgtaacaacactctctctagaaccgcgtaaccagcccatctgacgtgtgggcccacttacactttcatactcgattcgtgtaaaagggttaacccgagagttgtatggttggagggaagaagccttataagttggttccacccttgctaaaccagtaaggtggtactaaacatgcgcacacagctctcatgggtcacacaagataaattctaattggaccaggatgttacatagatgataggtgaacatgttacatccggttagcttgcttggagggacagcgacaagactaagcttaccatctcctgcggagttggggtccgttttttattgtatgcatggacgatgtaaaatccccttgatgtatgaaaggaggatccatgccattgagaatttttttttctaattccggttcaatcagtttgattcattctgattaagttagattctagccacattatagtgaagaagggttgatactctcccacttaaaacaacaccaataactcattgtaaactccatcatatagtcctagaaccataggagtagagtattatgcttcccagcgatccgaacctgtataaatcatgtgtccatgtactctcgcacgacctaagcatgagcacggatgcttgcactctggccgaactctcaaggaagggtgtctagccttcccactagaggagttccttgctccgacagtttgcgatgtaggcgcgtagagtgtagttcgtttgggctatggttttataattttttcttactctatcaatatatataaaatatcgtactctcttatgcggctcgtttggaaaattattataacgcccgaaacttccctatgcggttcgtttggaaaaaaaaaattacgacgtccaagactgtcctttgttgggcctgagaaacagaatacatcatcgacgtgtaatatgggccttatatgggttgtttattttggtccatgtaaaggatgtttgacgggactcacctcatttgccgctgctgccttgcatgccggccgccgtcgccgcacactcacttggaatttggaagcaaagggaggaggaggggatggagaggagagaggggcaaggtggaggaagtgggacccaccgacatctgggtcccattataaattttgttttatttgactggcttttgggcccatatattttattttaattttttaatctcaattgtagtgccacgtcaacgtcaagtgggacaatgaacaagttaaaccattcacataggcgccacgtcagccaaaatcactgtccaaatttcaaacttgtgtgacaaattgagagacttaaagtaaactttttcctttgaactgagtctaattggtccttttcggcttcaggtatggaaaacctcacaaatccaacctggtgacggattgggcctttactgattcggcctaacacaatccaatgaaatgaagacgctccgataagatgttctgaacttctgatcttcctctctctctctctctcggttctagctcacaaagttttttttttctttttctctagaacaaacaagagtacaagacacagaatttccacacggaaggggtttgatcatgacagacattgaaaatacagaaataaaaaacgtgtggttgtgatcattggtcagtcaggccgtcaccaaacataagcaacatagtatgtgatttctaacacggaatctgaagaccacacacacgtacgagaaaagactagtcaccggttaataaacccgttaccgtgaaacggtcgatcggctgatctcgtgctcatcctatcgcaaacctcgccttagctagtcacgtcacgtggcagccgcgatttcgcccgaaatttggttggaatctcgagctatcgctcccgtagcaaacctgctcatctcctgctcgattgctcgcaggcagcgatcatcaaacggtttacgcgcgcgtgtgcacggcgcgcggcgcgaccccgggcaggccgcatccggggcgcgcgcacagaaatgcgattcggactcgtcgtccaccgatcgcggctgccctggatgatgattgtcgccgccgaccgatcaatcgagacctacgtacgtcgtactcctatatacgtatactcggtactcgtgtcctgtcctcgcgtaatcggactaacgatgattgtgtctacgtgtggcgtcccgtctacttacgtgtaatgcgaggcaggcgcgcctttcgtgtaaatcttcgcgtgttccactctgtgtcgtcatcgatcccaagctaagctagcggctacgcggccacgagacgttattttcgaagtgttggtttcgacacgattgcaagccagaggcagatcgacattcaatcattgaggccgaatattcatttagcagacaggtcgtgttgttaaaaggaagatttggtaccttctgtccctgtttcgactcggttggaaccaacttttggatcgaatcgcctgcgaaattgcgaacagagagaagcaatagacggcgccggacccggctgctataggtttgacgtcatgcgctacggaagcagctaggaatgcgacagaagaatgtgagctagccgtgtgcatgcatgtgcctgaatttatgtgtgcgaatagagtagtactgaacaagtcaagcttataacgtgtacggctagctacatgactcgagctcgatatgacgatatgaatcagcaggagtcaatattcccggttctccctctcagccagtaattagaccttttttttcgcttaaactgctttagccagtaagcagtgaccatttgcctctcgcttgtaggagcgtaactcgagatccctcacgcaacaacaggatccgtatctcatccccagccagagtaagttgttcgatggcagacacgtacgtacctgatgacattatccatctactacgaccaggggaagtaacggaacgaagcaatggacccaaaacaaattatagcgagacagcctgcaccgatcgggaaagagatacgtcccctgctgcttcggtgggcttccgggccacgacacgccgcgatcccccctccctcctcatgtgcaggtgcatcttgccgcgaatgcatccaccagccgcccaacaaataatgctcgatcgatcgtagtagcggaggagatcgatcgatcgctttcgagccccccgaaccgtggaaattatttgtaaccgccgcgcgagcacgcgagaaacacaaaacgattaaacgccgccgcaagcgcgcgcgggtgcatctcagggaggcgccaccccctcgcgaccgcgaccgcgacgcgtgcacatgccgctgccaaccaaaccaacgctgttccgttgctcgcgctcgtacactcggtgccgccgatgcagatcgcccgcgcgccaccgcgcggcgtgggcggccgtgtgcccacgtcaagacgtgcgtggatagcagcagctagagatgattccgcgagagcgagtgcaaggaagcgtccgtgtcgtctgagccgatggatcgtgtcgacatgtccggataagacccgggcgccgtagtagtacgtgatcaattgcagctgctcgacgccgtgagacggccgtgcgtgcgtcggcgggtcgccccgtctccgtccgaccaaccaaccgcggtcggccagctcttcgtccactcaagggctggttcaagatgggggcacgagcatggcggaggacacatcagcagtcgatggctggagtcttatccgcgggtttgtactgctgaccgtgcttatctggatgctgacttgttaattaaaaaaggtcattaatgctccctactggtcgttggatagccatgaaaaatttccatgttactaatttggcttttcctggttaaataatatctgacgtggcgccttgattcgacgcgccacgaatgatcgatgatcatttgatcacaacctgataaccgcaagttcgcaacaagtacttttcagttttacaaacagtttctctgtttctgttcccgcgccggctataaaagcgccaagctttttgggacgctgcagctggagaagacgagaacgcaaaaccaatcagtcgtcgtcgaacgcggcgggcggaagaggcgaatcgcgtaacgatttttgttaaatttgtaaccggccatggatccgaggcgcagccactgggagagctcgtcggaggacgtgacgaggccgctgctcccgctgcacgacgacgacggcgcggcgggccggcgctcctgcgccgcgctgaggtcgctgctcgccaacaagtacctggcggtcgcgtcgggccccgtggcgtgcgcgctgatctgcggcctcgtcgacctcggcggccaccgcgccgcgcgcaacatgctcggggtgctcgcctgggtgttcctgtggtggattaccgacgccgtgccgctcgccgtcgcgtccatggcgccgctgttcctcttccccgtgttcggcatctcctcctccgacgccgtcgccaaggcctacatggacgacgtcatctccctcgtcctcggcagcttcatcctcgcgctcgccatcgagcactacaacatccaccgccgcctcgctctcaacgtacgtgatccgcgccgcgagcccgtctttaccaagcccgttcgtccgaaccgtgcaactaacaatccaaggaaaacccgcgaactttgttgcagatcacgtcgctgttctgcggcgacccggtgaagccgccgctgctgctgctgggaatctgcggcaccaccatgttcatcagcatgtggatccacaacacaccgtgcaccgtgatgatgatgccggtggcgacggggatcctgcagcggttcccgcgcgtcgacggggcgtcgtcctcggcgagcagcgccgcggacgcgcgggaggtgcagcggttctccaaggcggtggtgctcggcgtcgtgtacgcgtcggcgatcggcgggatggcgacgctgacgggcaccggcgtgaacatcatcctggtggggatgtggtccacctacttcccggagcagccgcccatcaccttcagctcgtggatgtcgttcgggctcccattggcgctcgtcctcttcgtcgcgctctgggccacgctctgcgtcctgtactgctccaagaacaccgggagggcgctctcagcttacctggacaggagccatctcaggagggagctcagcttgcttggtaggttctcgttcttgctctgtttgtttgttacttcacggcaatggccagtgctcatcaatggcgtggtcaatgttattctggggttatctctgaaactctgacagcttctcggccaatatttcctgaaacctgggtaactctgaaatggacctcgttttggtctttttctccataacagtggcactcattgaaatatcagtgccatgataattattgccataatggattctgattcggttgtccatcttgatttgtgacaggtcctatggcttttgcagagaagatggttctagccgtttttggggtaagttccgtttccatttctggggttatagcaattatctcaacctggaaacagtgttcggttagagcatctccaacaaagggctaaaattaaagccccaaaaatcctatattggggacagccaaaaactaatttggcctataaaacacccccttctccaagagatgcctgaaattttagttcccaaaattttaaaatttgccacatcatcactggtgggcccttctcaactaattttgtgcaggttcgttattatgacgcgatcatggaggggttcgttatagtgtgacaaaattttaatgtatccataattgattcttgcagggtttgattgtcctatggatgacgaggagcctgacagatgatattcctgggtggggatcactcttccacggcgaagttggggatggaactgtcactgtaagcgcaccaaggatcgaacaaattctgatttgttttctcagagacgatttgtcacatgatctcacgggacaacaacttggctcgcaatgcagatcatgatggcgacgctgctgttcataatcccgagcggcaagaacgacggcgagaagctcatggactggggcaagtgccggaggctgcagtggaacatcatcctcctcctcggcgccggcttcgccatcgccgacggcttcagggcgagcggcctgaccgacatcctctccgaggggctcggcttcctccgcggcgcgccggcgctggccatcgcgcccgtggcgtgcgtcttcagcggcgccatcaccgagttcacctccgacgacgcgaccgccacgctggtgctcccgctgctcgccgagctgggcaagtccatcggcgtgcacccgctcctcctcatggtccccggcgccgtcggcgcgcagctgtcctacctgctgcccaccggctcgccgggcaacgtcgtcggcttcagcacgggctacatcagcatcaaggacatggtgatcgccggaacgcccctgaaaattgtcggggttgcagctctcaccatcctactgccaacgttaggtaaattaactgacaagtgacaactctctagtctctacacaaccgagaattcagacagtgaaaatacttgccgtatcatacttttaacttactgattgacgtacaatccttttgcgttttcgcgaaggaaaaaacttactgatttgttttcttgatgtcatgcaggatccgtcgtttttggcatggatcagaagctatagaaactttagtcaaagttcaattggatgttttttgaatatttcaatttgtaggctgtaggttattacgtggataatatagtagtaagttgcataggttgtattgttgtacagcgtgtagtcaatcccattgtcttgcctcatgaaaaacatggggtcatattctttgagtcaatataggttgtatttgtattgagttgttccatgttaatatatctttcgacatcgtagccccatgttgacattttgatctacacgtgagtcgtctgaagaataacttaaataacaagggaaaattggtttcggttacaaaagtaggagagcagaacagggaaattgggatagagcttagcagacagtataattgctcattctataaacaactgcataatgaggggcaagttgcagaaagtcctaaactatccctttataattgaccagttgcctagtcatttcaacattgccacaattggaatgatgcaatggaccttatcatccagctagctactcctataaaaaatttgtgatattttctctgtatcatattccaagtaggacagtatattagagcctctacttacaaattctcaattgttagaatatttgtactttacccacctacatgtgcttttgcctttctaggatcaagtacttctctgcccattataaagaaaaaaaaaggtacttctttgtcatcacgctattgaggatgtcattttgaacgcatgaataagtgatttatcatctcccacaagaatcatgctccagacttcagagtcataagttatgtgtcattgtgtcgtagtggagacgaaccttcatctcttagctgcagaatctccaagaggatctagacaatgctaagtgcctggataaaatatgacctgcacatatggccgggcaaaaattcgtgtttggttagtttgctcgactcaagtcgactcatttccatcttgtaatgagccaagatagcattttagctcgttattaagataagctaactcaggctagtccacaagctagcgagccagctgaaccgcgcaggtaccacgagttattccgtggttttaaaaactgaaaaggttatcgcaaatgataaccgcacgtacggttttgtaaactctacccgtgagcccttgccccaatcagcccatcacccacaacaacgctatcctacacgcctagatggccatgactacccccacactccttataaaaaaaacgaaaactaatttcattatgaccaggtcgaaaatctttatgttgaaaggaaaaaattatagatctaatgtcacattccgtaaaaatttatgatacatgtataggatgcactcaatgtgcacgagcttgtccaataaatgtattacaaatgataccttgggatggatgtaaagccaagcaaattgcttccgcaccaagaaccgaagattgtgtgggttgtaagagatgcgaatccgcctacccaacagattttttaagtgtccgcgtttatttaggacctgagacaacccgcagcatagctctatcttattgatacgttacaaaaaaattccacttgaatcgtctgattcctctttactgaagaagcatgtgctcaaaataatcaagcacgggcttttctggtcgttgctcctgttactcgcgctgctgtctaagtccatcccctatgcctcttgtccccctcttgtcccggttctgatcggggaacttgtggttgtgagtcggaggttggagtcacaggtcattgacaagcatcgatgggcccagtgacggagtcagcggcgtcgtcaagttcaggtgactattagtgtttccgtgattgattaatttttatatgtagcgtcgtcaagttcaggcgactgttagtgtttcccgtgatcgattaatttttatatgttttggcagctattgacaatgaagacgatgacgatagagtccgagcggtcacccaacctgcccgtaaagtggctccgccactgcctctctattctcagtctacatggaatgccacaagcaaacgagctgatccacgaatccacttaatgatttatccacttaggtcctgtctgtttcagcttaagattattgtaatctagattattaaatcagattactctaagctgtattataataagctgacataaaaataagctacgagttgtttgtttatttggattattagaggcatctaagggtaatgggtctttagccactcaataatctggaaaaagctcctctaaaggagattattggattatagtaatctgacttatatattataataatctagcataataatctacttgtttgttccagcttactcctaataatttagattataataatcttaagctgaatcaaaccgagccttatttaatggtttcgtggatcgatccacttacactcttcgctgcaaggtggaagcgcctccgtaggtggcgtcgcagctggcggaggtcaattgcgagaggcagcccacgtgcatcccgcgtccactcagcccaagccaaacaaaagtccaagactccaaaaacgtggggttggtgccacgggcaagcccgtttagttacacctccctttcagcccagaggtcctacctaagcacaaccagcttaaaaggcccaaaccatgtcaagcaatctggccactcaagtacaacgtgattcctcctcttcccatggataccaccgtgctctaccgaaaacacagatcaacggcacggactcaaccgcgaatctcgacttgatcgaccggcgcccgctgcacgccgtaacgatcaggaagcagacacgacgggtacacggacaattggacatgttgcgccgaagcatacgcgtgaggtcgagcgggcgagcggccaacttgacatggtgggcggcgttgccgtgttgccgcttgcgcgcgccgcgcgcgcggcccatgccgaccgatgcgcgcgcggatcgtggcaaaaatgaaccgagtaattgcccgcgcggcgcggatggttcggggcgaggagatatgccggcccgcgcggccccatgccccatgatgccccggctgcatatgcctgccgcgcaccgccgcgatgcccgcggcggaatgtcacgaacgtttttggtggtctggctatgtgttttccggtgtttcttggggcggcaatgctgcatgcggcaggccggcagctaagctagcaggcgttgtacagtatcatgcatggcttctgccctctggtgatcgagcagatcataagagcaacggcatgcagagcagcgatccgctcttctcgccgagacgacggacgaccggctgattcctgcatgcctgcgatgcgagcccaaacgcgcagacatggaattagtacttttttcccctcccaataagagggcgtgaggactgcctctttctattgactacaaaaatattgagccttcaaaaatacctagcccaaggcatatatatatatatatatatgtaaaaaaaaaccccttgtgaatatcacatcaatctctgtgctagacaaccaaaccatagtgtggagattatgggtaccccatacccacacggcatggttatccgactagttatagtggataacttatatatatggaatatgtaacagattatgacttgggtattacgtttccttgtatattacggaacggcctaaagccctggtttgataagattgtaaagtagatttaggaaaccaataccgtattgaataaggtttctatcttgtaatcctgccacccatcctatataaggtgggcaggaggccctctagggggcatgagacaactagatcgtcagatctataattcacctggcggattcaaatccccaaacaggagtagggtattacctctcattgagagggcctgaacctgtctaaatcctttgtctctgcatccatccacttttaggtctcgtgcgctacccccttttattattgccgaattcatgtttcgacagttggcgcgccaggtaggggttcgtcgagtttcctatcacaagtgtgatggaaccaatctccgacatcgccggattcatcaagcatgtctttttcgtctcggattcaatccagtcgaagggatcaatctcggcaatttcatcgattcgatctccaattaatatcattggctttgtcgttttcactagttagatcattctctaactgcagactaatcttctattacttttctttttcttgttttcacgcaccggctgagatcgagacgaagtcccggtgtgtctgctcgtcgcctggtacgatctgtacaggtgccggcgtaaccttcatacgacacggggacaattcatgtccatgggatcaacagcgactgagtgcttcacgtgcatgtgttgatcaactgatatgcacgggttaatatcaaaccctagcttgatatatgcattacacaattaagcgtgtaatattttaaggctaatcaaactatatctgtttgttttgcatgtatactggagcgatggttggtcgcatgcacaggatggcaatcgagatcaaaaaatcgttccttaatgagtgatgggatttggctgtgctgccggttcctaacctccttgtaatttatatatttagattaattactaacgtatactaatcttctcatgattttttattgcatgtacggccgtcggtgcaatgcttcccactgctaccatgttgccgagaggggtacaccaggacatagtgcgtggctcgactaccgatgtagcgtttgctcatgccacacgcaacctctaaggccggttagctgcaccaagcccataatgtcaacaaaatcagagagacgaatctacatgcaaatcagcctcgcctatacggttggttggtcacgccgtcgttgttgggcgtctacgtcttcaccgaccggcttgccttcgttgccgccgactggtgtcaccgcctgcacggctggcctattatgccgccgctgttgggcatctacgacttcaccgccggcctgccttcgccgccgctgactggtgtctccgcctacacggctggcctattatgccgccgttgttgggcatccacgtcttcaccgaccggcttgccttcgtcgccgccgactagtgtctccgcctgcacggctggcctattatgccgccgctgttgggcatctacgacttcaccgccggcctgccttcgccgccgccgactggtgtctccgcctacacggttggcctactatgccgccgttgttgggcatccacatcttcaccaaccggcttgccttcgtcgccgctgactggtgtttccgcctgcacggctggcctattatatgctgccgttgttgggtgtccgtcgactggtgtcctcgcctatacggttggttggtcacaccaccgtacatgggcgtctacgtcttcaccgaccggctggccttcaccgctgccgactagtgtttccgcctgcacagctagcctattataccgccggcctgcctctgccgccacttactggtgttttcgcctatacggttggcggacttcgccgccattaatgggctccatcatctacaccactggcttggttccactggcgccgactggtgtttttgtcaccattgatggactgcttcgttcccacatcggctacttttgctgtcaccgaggaaatacgacaaagctaagtcatcatttatttttattctttatatgatattttgccttttcctttgcctcactacatcaactggttcgccgttgactagtgagtcgggggctacagatgttatatcatattttttaaacaattttcataatatttatcttgattgcttgcgacatattctgagtacaaaagtgcctatcgagttatggagttccatcttcctatgctttccgtttggtttgccaatggatagttgcctttgggccgattcctagcacccgggggcttgttggatggaccgaataatgcaaggtgctaagtattattcggaataaatcaaaagtatagagataagataatttattttctgctcttaataattgcaaaagtacccgagtagtaaactccgacccgtgaaactttgttccattaatgacgaactcatgtcactcatatgcatgtttgggaagtgcttaggccgactcccggtgcttggtggctatgactagtcgggcagagtgtttaaacgtaatgagtcatttgctcggggaaatcaaaattgacaagagaagaaatacatatttataaatattttaaaatacttgaatttttctcgagtattatatttatatcagatactactcatcctatatgtttgttctgcaggatccagatccagatatgtataaaagggattcatggctttaagcttatctcttacgctccaggaatggatcagtcagaacatcaccaccggcttgtgccaactggtgtttccgcctgcacggctggcctattatgtcaccgttgttgggcgtctacgtcttcaccgatcggccgcctcatccgccgccagctggtgtttccgcctgcacggcaggcctattatgtcaccgttgttgcgcgtctacgtcttcaccgaccggccgcctcgtccaccgccgactggtgtttccgcctgcatggctggcttattatgccgctgttgttgggcgtctacgtctttaccgaccggccgcctccttcgccgccgactggtgttttcgcctgcacggctggccttttatgccaccgttgttgggcgtctacgtcttcaccgaccggccgcctcgtccaccgccgactggtgtttccgcttgcacggctagcctattatgtcatcgttgttgggcgtctacgtcttcaccgaccggccgcctcgtccgccgccgactggtgtttccgccgtgcaccaccaactggtgtttccgcctgcacggctggcctattatgccgccgctattgggcgtctacgtcttcaccgatcggccgcgtcgtccgccgccgactggtgttttcgcctacacggctggcttattaccgccgttgttgggcgtctacgtcttcaccgaccggtcgcctcgtccgccgccgactggtgtttccgcctgcacggctggcctattatgccgcctttgttgggcatctacgtcttcaccgaccggccgcttcaccgaccggctgcctcatccgtcgccgactggtgtcaccgcctgcacggctggcctgttatgacgctaactgatgctatcttcttcacggctggctacatcgccgtcaccgctaataggcatcagcatcttcaacacaagctgcctacgtctgctgccgactggtttcttcacttccatggctgcatgattctgctagtgttgattggccttatcgtcttcatcgccggtcgtctcgtctgctgctgactagtgccctcgcttctacgtctggtttatacagctaccactactgatggacatcatcgtcttccgtcgtcgactggttatgtcgccgccgactggtgcttttatcttcacaattgcgcgtcttcactaccggtttgcttctgttgccgccaactcatgttcacttcatcacggctatgcaactttgtcactatggtggagcaacttcatttttattatcttcggcatcggcaaactctattgcctctacttcgcaagctttgctacttcaccaaccatgacgactacaagagtttcaacaccttggcatacgtcaccaaatatgatgccgtgttattttattacaacaagtggtgttccaatcttcaatatttatcttcactcaagcaatgactactcgacgacaagaagttacagttctcgactctatgttcagttgtttcccaactaaccaaagagtcgggggctacacaaatacaagactctcaaaattcgacaagctgaagcaatcaattaatcagccaacaagtcaattccaggagtcattatcttcgtctttgctttagagcagagttatcaaccaatcagctcagtttcgacgagttggacaacatcatctactttccttcaagtgaagcatctgcaacagctataacatcaatttgatggattattgtcactgacatcatcaccaacacctctgcttcatcggccctgacatcaactctgttgctaatggataactatgtcttcgccgacttattatttcactttcacggttgctatcgactggatcaccgacatcgttatcttcatcaacatcctgtcaagcctcttcaacatagcccactctactgctattgatgggcaacttcgtcattatatttgatcatctatgattgctacttatcatcattactatcggttgcatttgtcgtcgccgactattttcttcatcttcatgattggtggatttcgtcatcgcctttgatgcgtgtctacatcttcaccatcggcttgctttcgtcaccaccgaccggtatcctcgccttcatggatggcttattatgtcgccactaatgggcatcttcatcttcttcaccagctgcatcgtctgtcaccgactgattatttcgctgccatggctacacaactttatcgctgggcgccttcatattcattgctggctgacctgactgttgccgactggtttcttcgcctccacggctatgcaacttcatcacttttgattggtatcactatcttcactactaccaatatttttgccacctctggtgggcaatattatctctatattggtcgtcttgtctctatgccaaccgcgtcagctaccatcaatggacaattgtgactacgacagaaggacaagctatatactcaggggcttactacctcaaacacaagtatcataccttcaatttggacttgttccggatacatgcaacatgaatttgatgatcatgggtctattttctatgctcaaagactggactatttattattccccgtaagggttatcaaccgaatacttgcgctagtcggaattcaattgttatatctattttggagtatcccataaaggataatcactcagatcagaagctattcatatgagttacacttggtctatatcacccgaaagatttattactcaggagcatgttacatgcgtcatcctttaaagggtgtcgaaggcatattttttggcctagacctaatatgtctgcagcccatattttcaggtgtggcctgtcacgttcttttagggacttaggcatctttttgcttaggcaaaagtgcgcgtgattatgtgcccaataccttaaaatccttttataccgcagttactcaattttttaggagttggtacaatgcattttaaaaggtgccaaacagtaatgctttatatagctccccactgacttttttatataagtcaaggtgttgtttgggttcataaagcaattgattggatacaatatcattgctttttgccacgtaagtgtgcacttttattgaccaatattatggcttaggctgattatatattttggtcattttccaggcggttggtaaatcctttatgagtttatttactcggattttataccacatatgccatatatttccaggtgtggtggaaccatgtgtcttctagggacttaagcacatctgttaaagcagtgtgcacatggcgtatgcccaatactttggaaatttctttattcacaacatataagcttctttatagctgttttgctatgtgaattttcaatgatgtagccaactttaggttacactcatcatattttacaaaacagtcggtatatcactcggatcatgttattcagggattcacaccgcatatgctacatattaatatcaagtcgcttggttgactataattatcgaagccactcggttggttggattatttattacttgactatatgcttggtttgttcaattaaccacatagtcgagggctacacctattaggtgcatctagtcgatgcacctgactttatttttcagcccttaacagtcttcagatttggtaaaagtactcgggagaccatggcaaagatgattgaagcactcggctttggagtaatctagttcgagagaagattatcttttcgattgtgaaggtctcaggggctactgtggagattatgggtaccccatacccacacggcatggttatccgactagttataggggataacttatatatatggaatatgtaacagattatgacttgggtattacgtttccttgtatattacggaacggcctaaagtcctggtttgataagattgtaaagtagatttaggaaaccgataccgtattggataaggtttctatcttgtaatcctgccccccatcctatataaggtgagcaggaggccctctagggggcatgagacaactagatcgtcagatctataattcacccagcggattcaaatccccaaatagaagtagggtattacctctcattgagagggcctgaacctgtctaaatcctttgtctctgcatccatccacttttaagtctcgtacgctacccccttttattattgccgaattcatgtttcgacacatagttgagtatagatcgtagttacaatgtagttagagcgtagtttcaatgcatttatactatagttataatacaattgtaaactctgcatttctttcaatggatacggggaactcatgttcttctagtataaaaaaaagtagttacaatacagttagaatataactacactttaattatactatagttatatttaaaaatattttatataatcaaaaaacttgcggcaactttttaatacttgctcagataattgtgtcttctccttcttcgtctcgcttgtcaaaacaagatttcgacaatataaaggggtagtgcatgagacctaaaagtggatggatgcggagataaggatttagacaggttcaggccctctcaatgagaggtaataccctactcctgtttagggatttgaatccgccaggtgtagtattgatctgatgatcagttgtgaatcatcttgccctagagggcctcctgcccgtcttatatagaatggggggtaggattacaagataaaaaatgtaaccaatatggtatcggtttcctaaatctattaccaaaccaaaactttaggccgttccgtaatatacaagaaaacgtaatactcaagtcatgatccgttacatatttcatagatataagttatcccctaaaattagtaggataaccatgtcgtgtggatatggggtacccataatctccacatcgctgaacacctatgcaaactactcaactaaggccctgtttagttcgcgaaaagaaaatttttgggtgtcacatcggatgtttgatcggatatcggaaggggttttcggatacgaatggaaaaactaatttcataactcgctttgaaaccgcttgacgaatcttttgagcctaattaagccgtcattagcacatgtgggttattgtaacacttatagctaataatgaactaattaggcttaaaagatttgtctcgcgatttccatacaaactgtgtaattagttttttaatctatatttaatgttatatatatgtgtttaaagattcgatgtgatttttttggaaaaaaaatttaggaacaaaaccagggctaattatatcttccagatcgacatggagatctggactgatcaactatagatacgtacatgtaaacgttaattggttgccgagcttgtctgtgggccttccaccacgtacagagtccacagcaaacagcagagtacgcacgtacacgcctcagctcataattgaggaggcgagacggcatgtgtgtacgtatactacatgcgaaggggaggagcgaaggcgaagcccctctctagccacctactctctcccccgcgtacttaatttgttccttttgtctgctgatcgatcgattgatacactgtagatcctatataattgatgtgtctgtcgtctgtggggactccggataaaattaacacgccatgcaccaacgcattcatagcgtgtgtgtgcacgcaacgacgcgcgtgcagctagctagcatgcagatgcagggtgttgtagggcacaggacatgcagagccatcggccatggccattgcagtcagcagatgctgctgctgctgcatgcttcatttcctcaccgatccatccatcggtggatctgtgtaccggccggtgtgtacgcttgatttcctcgacgtgctaaggtgtttcagctatcgtggtcgaagtactgctccttcacctatgttaaaatttatataaaaaaagttgttttattttgtaacagaggaagaacgagctaattattacccgttttctttgggggttggggggggggggggtgtcacgagtagaagcatgcagctgcagactcgatcggtgatgcagactatggcgagtaactgacagatgtgatagaggaggcatatagagcagatcgagaggagcatgtgcaggcatgcatcacatgccgtgctagctcgctgctggatggaagccgaagccgttatgggcaatggcatgggcaataatggaataggattgttgtttatcgagggggtatgtttgttcatttcgatcggattgtgctcctcctactgttcgctgcgtccggacggagtgactgtgcatcgtgccatccatgaatacacttgtttacttaaaagtaaaagaaaaggggaagaggcatgattattgctgactacatatatgtattgggcaagtttggtgttagtatcagaattatacagaacttgcggcttgaagattattgcctagattatttattttttttcatcattctgttagatgtagagcagctattctaactctagatatcgaatttattagatatttttgaatcttaattatgtatcttaagttagctagcaattgatatttaattgtaaaaacaagtgctgaaagaactagagaaccatcataagaaaaaagaagaaaaatagcggagatacatttttacatatactagtaatatgttcatacattgcaactgacctataccattaggaatgatctaggtgcggatcgaacctaaatcacattttttgttgttaaccaaccttttttatctgggaattttcttttattatgcgagagagtgtgttgcgcacgaggggaaataggggaggaaggaaccaacgactccacttttaaatagtaaacaaccgttttttatctaggaattttcttttgttatgcgagtgcacgctgcatgtgaggggaggacaaaacaagtgtgctattaagtaatagaggacataattcacaatcctttataaaacaaaatccacctttaaataaatttaacatgttaagggaacaattatttttattattcggaagttactactgatgaatgaatataattatttttaagtccatgtaaaaatagagatccagagtaaaaataaataaatttaacatggcatgggaacaaagaggagcatttacaatcaaattggattacatcaaagcgaggaccatgctttgattatcattggttagcaagttcaggttgatatcttttaatactgaaagaatacatagttctgcatctgtatcatccacacttcacgatgaatatgatactctaactactaaaaacttcgaaggaaatactcctggaataagggggaaaaccgtgaatagatggtggcggctaactattaaagcactgaagtatacttttgccacagtacagtaataggagtaatcctttctctttccggaatgctcctggagagcatgttcctctgatgtgcccttctgccggcagactcatctactcatcagtcaaagtatcaaatgcacaggggtgtctagatatatggacttaactttagtccctatatttagacactaattttaactttagtccctatatttagacactaatttagagtattaaatataaactacttacaaaactaattacataaataaaagctaattcgcgagataaattttttaagcctaactaatccataattaaaaaatgtttactgtagcatcacataggctaatcatagattaattaggctcaatagattcgtctcgcgtattagtccaagattatggatgtgttttattaatagtctacgtttaatatttataattagtgtccaaacatccgatgtgatagtttcttaaagttttagtcacatctaaataggtattgcgaactgtaaattaattgcccctcaccttaaaaattcagatatcaacgatctccagcaaacgtagaaaagggaattgaatggtcctggaagaaagtaaaaaccgtgaatagatcatggcggctactagcttaaaaggggtcaatttcccatcctccaattctggcacatgcagtaaattaaacgagtttttttatcctcttggaatgttgcaacttgcaaggaagcatgttttacgtgcttgatgtggcgttttgcccctgaactcgttcgtgatatgttcattctagctagctaaggccggattctaaacttcctggctggattactttctcattttttttcttgtttattgtgagtgcgctagctaattcctaaactattaaataacatattttgggtaaaaaaaacttttatgtaaaaactgttttttaaaaaataaatctattttcaagtttataacagtgaacacttaattaatcatacaacaatgtcctttctcattttgcgtgtcaccaaaaatttcaaccaaaccacacacgcgaatgaagccttagactacatgtcacgtcaaatacgtcgatttctatctagtcggccatcaccaaattaaccctaaaaatatcatctccctgcatgcatgccagcgaattctacagttagaccatatatgaagctgtctcaacaccgacaagatttgtatatatcggcatgcctggctagtgcaaagcacaaacctccagataaccctcaaggctagggcaaccgatgataatccaattgattcaattcacatgagaaaccgatttgcaggcaggtattggtagctaccatgcagaaaaaaagggagaaaaggccggagagaaacggagaagaaatttgcctggatcgcgacggccggggaaggggattgtgatcgatggtctcccctctccttttccatgtcctttgattaaatgcacacacccatttgccctaccgtgcaaccacattactattgtacgcatcacaccaccacaccccttgttctctggccactatttccaattcaatgccaccactgttgggtcctttattgcttataccttgaacccactctgtctgctgggatcttctacctctcaaacctaatgcattgcatggagcatgcccattggatgccatgcttaaatcaaaataaatatatatacttaaggcagactgtctcatttcaactttttgaagaagagggtagctaataattatgtttgtggaataggacgtactccataatagtactacataagaaaagtgataataaccctattgctaatacaaattatgtaagaccgtacaaatacagagttcaaacactacaccatgaccaagaattaccatatgtcattggtcagagaaaatctattatactgacaaactatatatcactataactgtttggcgacctatcaacccacaacaattccttctttacaaacatgttgtctgtcagaaatttagtggctccatatcgtttttaagtcactgcgatacagaccatcgcccatcggtgggctctaattactactaaaacttatcttgttggccatacagcagttctagctacttctgggctaatttatttaacgttgggagaatagaatttagttctctccatatcaaaaatatttggctacagggagcgctacaattttttttgaacgactcaaaccagacattgtaaagtttatattgatagagcaggaaaaaaaattacacgattacaaccttagaaggtcgcaaccagaaaaacgaagaaaaaataacccacccaccccccccccccccccaaaaaaaaacacaaacaacaccaacgcaaatacctaggagaaggttagcactgaactagccgtcgctaggctaacaaagaaaatacagctgatgttgtccagaacctatagagggagcactacaattttaggttgataaaagctcaagaaaattactcagagcaatataaccaccttctcctggactttttccttctcaaaaattgaagaaaaaacatatataccggcaaaattcgaagaggtcgcagtcgcaggtggtgcaatgtgtgcatagcgtatgaatgaatgcccaaacccaattgataacacacggcggcatctcgttttggtccagtggacccggcacacaaatgtattaagacgcatgtgtttcctcaggctagctgcatggatcagatcaattacctcttaaatccccaccggctatgtacagagatcgcaccagctgcctaattaattggaacagtagacggctagccgtcgagctaggccacctatgcacacactgtgtgtgggcaccgggtttcaatgctccttccccgacaattcgatctgtctatagcttcttaattatatagcccaatgcaataataatctcttaaccaattatttgcttgtgatctcgatgatcaaatgttcaagcagggtggctataaagtacatgcatgcaataagttacttcattatggcagaatatgagaaaccactatactatatgacagatagctaatcgcgtggacaatgtatttaagtctttgtgagctgtttatatacagctattcgaattaactggacgagtcatacaaggcgcaattatgtccatcctaatacagtagatctgtaattaactatcaaattaattctgtctaaaaatatatatttataataagttgaaacacgtccaattggttagatggaggtatcccgccttctaccttctcatctttccattcgcatctgcctcgacctttttttttattatatgcatgtagggttactgtggttatttatatgtactaatatatctatttttttataatacaattatttcgggagggaggtaatactatgtacgcttacacaatactactccatcctaaaataaaaagtgtaaccattttcattacaaggggcgcattgcatgcatgcaattagctagaacatctccctccttttattttattttttaaattcggcacccttaaaatctctaagcccattgggtacctggattgtatttactagagtgatctagataaataattaataattgttgtgccttatatttaggatggaacatatttgtatatttgaaatgtaacaataataataacattgtatggcaagtgtaatatattaatggagctatttctagaggaagactaacacggaatgggttgactagtcaatataatcagtggtggtcctcagcaacaactaggttttgactcttgagctaatgatttttcccgattaatttgaaattatttcattaattaactatattagttctatcaagtttctgtttgttctatatactggcaagtttccaagtgagcatcttttgttattagtattattgtactgctcaatagttagctatgctaattaattgagttcaggttagcctgaacaataattaagattaattcctctaatttccaatcaatgcatgtataattattgaacatgaatggtactggatctgtccatgctccccgatttattgactggcttgggattagcactcactcgcaatctcacatcgatcatctacaggaattgcacgggccactagctaattgaacagtaacttgctggtaaggccgcctatatctatagtaatactgttcgctccttgaatgctggtttgaatatatcctattccacgtgtaattaataatggcctttaaatttattcttcttttcaggtgttaaatgtatgcatagttgtggccagaaaaggccaatcatatatgattctggatcttacagacaattgggcagaggtaattaggctatatataaatgaaatctgtagtgcaacggtgcaaccatcttattgtttaagagggtaaaaaaaatataaactggttgaactaattataagacaagtctacaattgacaatgacgagactttaattattgttccgagaggtataaagaggtatagataaaccagtgttagagcaagtttaatagtatagccaactactagctccaaattatctatagtcaatttaatagccgattaatataatagttacctataaacatatattacatgatttatagtttgtcccaccaatacacacatgtatcttagagtccgtgctgcagctggctacaaatctgtagcccttatctctcctcccttatttcctcgaaatgtgtttatagcaggcttatagtctgctattgcacctgctcttaggctgagttcattcccttgagttcccaactcatctcccttgttttccacgcgaacgctttttaaattactaaacggtgcgtgttttgcaaaaagtttttataggaaagttgtttaaaaaaatcatattaatccattttcaagtttttattagttaatacttaattaatcatgtgttgatctatcgttccgttttgcgtgtggaggggaagggttcccaatccctccaaaagaacacagcctagtcagtgttatataactttaccccgaaggtatatttctcatgaataacacaaatactcgtagtatacctctcaaaaacagaagaaaacattaaaaacatactgcctttgtctaaaacaattaagcaattctagatacgattattaagaaagtaggtggaaataatttggggaatgttaagattagatgataagagaaagtagaaaaaattgaatagagaatgattgtgatcggttgagagaaggagataggtgaagaaatagcttaatcaaagatcgagtggtagaaatagcttcattttgaaacggagtgagtatataaatatgaggtttcaatcttatcctaactccaatctataagattaattatgatacctcctttcacaaagaggtaaatatcaaatataaggaaatatatacctctctccaagctaaggatgagagaaagaaaacctattaataaagaccaccaccgaataactttaataggtgaattgttagtctataatttgtttaagcgatgtatatgtagtaatctgtcatagcattatagtccattttcattatcttaataaaatggagtaatgacctgccctcaatgcatgttggaattaagagtgttggttgtgtaatcgtaaggaatatagtttttttttgtaaatatatcttactcctacttaggtaccaaagaatgtctacgatcaggttggaattgtacaacttgatggccaaaaagattaatttccattattttttctcaatttgtaagcaaaaaacactatccctgcatgtgccttataatccaatgatttctgtggtgcggccagcgaaagtgcgaaacattcgcgtcgaccatatatttactacgatcacaattcacaaatggtcccggtataagaaccacgtacgccgtttgctttcagatggcgaaaagacggaaacccacattaattcagtgttggtcccttgctgattcattctccgtagctaaaatcttgctacatgttctctctacatctctacgtaccgtagccaaattaattaaggtaaataaatttccatcgagaataatgttttaaattctgccggttaatcatgctaacaattgttaatttgtttttagtctagctagctctttttataagcgggatcaggttactctcagctccctcaattagcaggtatctcccaccgcgatgttaaaaacaaaaggagaatttacattatttgtatatatatatttccctgtttattacttatatatgtcctgttcttagaaacgtcctaaaatatgtgcagtcaaacctcaaaatcttaagttattaatagattaattcaaaggtatcatgattcaaaatatgaaaaatgttgacatacttgtgtcatgaaaaactctttcataatttatcttttataattatatagtttgatatagtaatgataaaatgtattggagactgtgtcaatgtccaaccaaatcatcctcttaagaacataagtactagtaactgcatcaagagccatgttaaaaataaaaggagaatttacattatgtttatatagtaaatgaaatcaattacttggaaaatgccatcaagaagaggtctaaggcatcaatatatacttcggtttttttctcaccgagtgttatgacgtctagactctaattaacaatagcaaaatggattctccaaaaaatacaaatactatattgatgtcacattttacacccttttcatattcttacaatatactatgtgtttatatagggcagtttcgcattgtaatatccaaagttttgaagttcggaaagaatatttaaatcagcctctcaacatttggtacttgaaacggtaattataattatatgctatataacatttcataatttcaagcaagcaaaattgaatatgttgccattaagaagatactagctgaatcgatggacaggaacccaacaccttccctcgaaagggcaaagttgtgatcatttcggaacgacaagcgcaaattccacactaaaacatagctaatgtacagaaaatgtgatgtggtgacatttttactatgggatattttaaatgtttagattagtcattcaagaacagtatatgcgaatcttcctctacaaaaatattttatagattataattttgctatatattcaatttatatgacaagtgtacatatgtaataaaagttttgctccaaagatgcatatcgaaaaaaaatttgtaagaattaatatccgtgttattttgtagccacattcatatagggggttgtttagttcccaaaacaaaatttttcacccattacatcgaatgtttggacacatgcatggagtattatacgtggacaaaaaaaaacaattacacagtttgcgtgtaaattgcgagacgaatcttttaagcctaattgcgccatgatttgataatgtggtgctacagtaaacatttgctaatgacgaattaattaggcttaataaatttgtctcgtagtttcctggcggaatatgtaatttgttttgttattagactgcgtttaatacttcaaatgtgtgtccgtatgttcgatgtgacaaccaaacccaaaaatttttccctactaacaaggccttgcgcccttagaatcttcctccggattttcttattcatcccttgagccttccctttaaagtcccatatttgtcctcttagttttcttctaaagtgccatatatatttatcctcttgggtcctatatatatatttgttctctaggctcccatatcatcctcggatctctcgtctcgattcctatatttgtcctttaggatccctcattccatatatattcatattctaggtgcttcatacatcctgaatttagttaattttattcattttttaaccgattcagaaaacatcttttttccattattacaatatttcggaaattaatgtaagaactcgtaaagttgcacgtttgtagtttggtcaagaccggtgatgatgttcttagttgtcttttgacacaagctattgctcatctttaaatagcagcatcaataatccgtgaattgtggccccggacaaaacaaattgacctataacaaaatgctaataatgtgtatatataaggaacaacagtaccgggccgaaagaaagaaaacccatctggacaagatttctccatcaaaattttataaaccaaacacataataatagtacatgtaccatcactagcttgtaactatgggcacacacaataaatgggttttcgttaatttcaaataaggacatatggaaaaatgaatcgatcaatggaaatttgactacaaatctttttttcccataaaaagaacatttcttataatatatctggcgagctggtgagaatatagagaagtatatataatcccctagcttatagcactaattaattcctggatttttagctttactaagtgtcacaatcttgagtaaacatttggattgtttggggagctagccgagattctcggagtatctatggctgctagaagccccctaaagagggcatatatttcttatctatattttgattctattcatgaaccttttaatgaatatataaaatacaaaatttaagtgataaagtcacaaggtattgattggccagtgaaattcgagcccagtgagacatcgatttttcgccaatctagaaaaatcgacacatttcgaatgaatttccataaactccaaacatgataactcgagatgatccaaattcccgaaatccgatcaaaattcatcgagcttgtgaagccttactctgcagaaagaacatgtccctccttacgagaaagaaaaaaaaaccaagaggggaagcaccactggtgcggtgctgaagtagaaaatctggtgttgaagtcgtatgcacatgatttcacccaccagggtttaaatcgtgatgtccaagaaaactatgcacatgcagttgggcttccaacaagtttttactgagatcagagatgcgctgttggtttccgactcttggagagtgtataatggtgtgcgcgcgcgtgcgtccatcttagtaatccgaaaaaacaagagttatctcccggtacatcgtacgtacgtaccacgtcctccatgcacacattagctaattaacctccacagtaaatagtaaatatactcattcccaatccccttcgggggccttccctctcacactcacacgccctataataacccctcgccaactaccacgcccacgccaccacacacgcacacgagctgtgtcgatctctccatagcaagaggcgcaagctaccttgccagccatggagaacccctactacgcgagcttcctcaagaatcaccaccgccgctactgcttctccaccccgccgtcgccgtcgccgtcgccggctggcgcttactcctcctcctccttcccgttctttccgacggcgggggtgacgtcgacgacggccgcgacgccgccgacgacgactgccccgccgtcgcctccgctccgggaggccttgccgctactgtccctcacccccgcctcgcgcggcggcacgacggcggcgcaagagcgtgcgcggcagcggggggaggaggactgcaccgacgacgacgacggcgcggaggaggagggggcggacgaggaggacgtgccgggctcgacgcccggcggcggcggcggtggaggcggcgatagacaccaccagctccgtcgtcgccgcgcggggcggctcttcgccgacctgaacaccaaggctgcggcgggagacccgatggacgtggagggctccggctccggctgctgcgccgccgaagccgccgcggcgggggacgacgacgcggacgtcacggtcgcgctgcacatcggcctgccgagcccgaccgccgccgccgacctcatctcggggctctcgtcagcagccgggagaagatcctccaccgcgcgtcgtgacgaggaagaggacgaggcggaggaagccggcggcgcgagcagggacgacggcgacggcggcgacgccgccgacgccgcggcgccgctagggttcgcgtcgacgccgatcgggcgtctgaacaagggccagtactggatcccgacgccgtcgcagatcctcatcggccccacgcagttctcctgccccgtctgcttcaaaaccttcaaccgatacaacaacatgcaggtcagccagcaatttcttcatttctcttcacagcttaattctgctagctgctactgttcttgcttgctctagattatcgctgctccatttaattttattcttttttgcgattctttgtgggttattgctgttcagttttgtcgcaattcaagactaataagtgattaatttacttagaattagacatagcatcatgcgtgatccccaaactgtaccactagtggtcctcttgttcgtcttcccccgtttttgtcgtcatggtatgacaaagcatatgtcttcttcagtagattgataaatcccttttcttaggctagaataaatccgatctagctagaactaatttttttttctttcaagcatatcctaattgcaatcacctaacaaataaatgataccgacagtaggcgacgcaatttttaccttttctttctaagatctggctatgaaaaatttctacagtagtagttcaggaaagctttatggctcttgaacgaacgctgcatatctagctgggtgtaattacttgctagttcttttgtcggaataatgtttgacaatgcgtctcactcgttctatatatacctcttgatcccattaacgtatgcttcttatacttagctagttactcagcctcgatcagcatgcgaacgaaaacctgcactacctttatataaaaacaaaaaactgaattttatttttgccgggttgactgaaagaattaggccgaccgaattttattaggattggtaagaagaaagcctgaacctaattaattacttaagagttatctgtttacagtgattaattaagtgatatacatatgtatctatgtaaaaatatccatatattcaccaacctctctttgcattatagatactctgctagctgctaaacctacatattatctgagaaattcttgacaaaaaacgtcccacacaacatgcagctgatcttggaattatcgtacactagtaaatctcgattatcaagtgtgtcttgccactccatagccgggctagctagcttaagaacatgaatcccgtcttttctttctctgaacattaatttgttcttttgctcgatctgtcagaccaatgaacgatgaagcatgaagctcctattccaaagtcaattttttttagaaacacagtataaacgtaatcgctcataacacgtgtacattcatccatatgaacacatacacgcacaccatatttttaatgaacgacaaagtatgaaggtcctatttccaaagccatataatttgaactacagagatagctattttttttccattcgaaaaaaaaaatccattcaatgagatagctatattttgaaactggcgacctattttcaaagccatctagtttgaaacggagggaacatgaaagctagagagcagttcagttcagttctccttcgattccatggctgctagtgctagctcgtacctttttgtttagcttatcgttgaaatacgacgagtactagcaactgctagcaagcaagctataagagaaggagatttgctccggtccaaaaaaaaaaaaaagttacctcaaggtactggtaccctgtggtaccaaatcgtttcggatcgttagatctaacaatacccatactacccagctatatccgacgatcggaaatgatttaataccgtgagttaccgctaccttgagttagagcaaatctcataagagaagtagtggatacaagctacacgtgctggtgtctggtctggtctctgagatcaccggagattgagctgagctgagatgaggaggagagggttggagttgtgcacgcacagtggccgccttttcgtgtgattgaacaagacagatatggccaggccggggcagccatgccatgcaaatgcaaatgcagtcatacatgcatgcgacttttatgcttttctgggggcgctcttgctttttacagggggctctctttagaaatgcgcgcattattagagtggtggttcgtcagagctagcagagatcccagtgaagatctcttctccagagacttcacctttgcatgatctgcatgaataagatttgtactaagtagattagatgagtcctggtgtatctattgatggatggaaagagatctcattagcatgcatgcagcagctagctatagtgtgtgtgtctgatgatatctctgatgaaaaagcttagctttgctcagctcagctgcatgcacagacaggcagggcaggggccaggtgttcctggtgctagctactttcttctactccaatggtgtgaagtgtgtgtggtagtatctcacagcagccagcatgcagtccactaccatatgacactgatctctctagctttcagatgatgaagcttttttgccaagctagcttaggttggatgtttgatcaagccacattaaccttttcttccttcgtttctcacttgtcaagagctagtggttttgctacagctgccgtttacctctcccaagaactgcaagagatgtgcagtgttcttgctgtagcttagctccactgtccctgacgcacacactgtgctcctcaggcacaagcacgccacacactctctcatctcacaagcaacagtcacaaacacacaagcaatggtctactcctactactagctaagccatagccttgtctgatctgaagagctacatatatagcgccctcactttcaaaaggccggcgtttcttctgcgctcatgcggcttctccggtttatcacagctgcatgcatggggaaagccggaaagtttgtgtgagaaagagcaaggagagattgatgcatgagccggccaggtccagccagatcgactcccttctgattatccgtactagatgtctgcaaatatctcaagataagcaaacgcattaaaaagaaagccagtatacggtgtcctagtaccacactgaaatgaacagcagcagtaacagtacaagtctgcatgttcacatggaaaccaccattgcctgaacccagcctgcaaatccagcatacgatcatacagacaacaacctgacatctgcgttctgagttactagcggtgtacgtacatatacacggagtagttttcaggagttgtgtgttgtgtttttctaacttagggcgtatatagtagtattgtacaatgtttatttgatagagtatatacgtaatacagtaatatgatgagttcaatatgataatatgcagatgcatatgtgggggcatgggtcgcagtacaggaaggggccggagtcgctgcgggggatacagccgacggcgatgctgcggctgccgtgctactgctgcgcggcgggctgccggaacaa

SEQ ID NO: 58860 - DNA, 21230 bp, Oryza sativa
tattggaccagagtgaatctcttcattgtaacaacactactactatgaactactagtctactacgttctaccgtggatgtatacgagtttgctcatcggtttcgctcgctgttggtgattgtcttcttcttcttcttcttcgtggtacgtagtacggcgtacacactgttgatgatggtggtggtgtcgccatctggtgggacgtacacgccttgttctcttgttgattattagtgcaactccgtgatctggtatagtaggaggctagctttaattttgctagggcgatatctcaaattgatcgcgcccgtagctttgtcgcgatcaaggaatcgatcgatcgatcgtgtctagattttctgttttgttttgttattatcatctttcttgtttaattggttgggtgctgtagcgtggagtggtctgtaagctgcatatattgcctgtgaatgcaatgtgtgtacgtatttgccagcgggtctgatattctcgatcgatttgtttcgatcacctcgtacagtggtatgtactttcgttcatctagaatatgagatgctgcgttacaaggacgcgatgtgtgcgtcagtcaatttgcttactatacacatggaaaattgactgacgcaaattgactaacgcaaattgaaaataatggcgtttttattcttgtttgtccatcatatatactatacacattcagacgaaatgtttgtacagagtttggctcaagcttgtacatactgtttttcatttgcatgttgtttccatatactaccataagcaaaacacgtatttggtatatacgggcaggtcctgggtgctcacgtttataaatatgtgatatagtacaattgagaaattttatgagattagtggatttgttcatggacattgtctgttgagaccttgagggtgttagttaaggccttaaggggacatggctcatgtcactagctaatgtgtatacatgtggcatgtgtgtttatgtgggttccatgtgtttgccaaaacagtgttctcattggcattttatgtctggacaaaagcaaccaccaagaatgtaccatcacctggacatgcatggaaagtggcccttgatgatgtgcttgagatggaaactaatgagcggtaacacaggtcgaaagcgcacaaaccgtcatagatatcaaactagagtagatgaaaaggtaccaaagcaaacgtcataagagcagtcgaggagtggcggatgacatcggtcaaataggagataggcaaaattttctacaggacatgtaaaaaacgtgtaattggctaagaggcaccgtaaaaacgtgacacggctgattgacactctaaaaattgtgtaattggctataggacaccggagacaatattttatattttccagatcaaaagaggtgataatatttttcaaatggcgagattgtccctgccatggagcaccgccgccgccaattcatcggatcggattgcctccgcacctacctcgctctctagcctcctcctcctcggcagccgtcgaaaggtccacggccagaggggagtcgcgctggaaagcctgcatatgtagtacttggttgtagtgtaggataaaaagaagaagaaaagaagccaacaaggaaaagaactcacgaatccccatccgctctttgtgaactcctgccccactgtcctgaactggcagttgatggagaggaagagctccacgtatggcagctcgtcgacgatggccgccacgacgccgctctgcaggctggaggagtagtcggtgatggcgagctcccggaggcgggactcaggcacgcccagctcctgcatgaggtagctcttggcgaaggagccgacctggaagccgatggggtcagagctggcgatgaggccgtccagaccctggatgtccgtggacagctactgcaccatgaggatggaggtgaggctggccgttggtcgtcaccgtcgatgttggtcctcactgaacgaggagatcccggcgctgctcgtcgccatggcgttggtcctcgctgaatgaggagatcccggcgttggtcctcgccgtcgccggcagtgataccccggcggagcgccgccgctttttccgccgcgtaccgagccgtcccagctcaggctgctgttcctctgctccgccgcgtgcgtgaggaagaaggaggataggagagagatgtgggccccacttatggttagtaaatagtaatcaccctactaattaggaacaaattagtccatgacgcgtggggcctgatggttaaaaacctattaaaaattagattaaacatacactgtccatgacacatgggacccaccggtgtttaaagaaggaaagagaaggggcaagtcaggcatttagaaaaatatctcacctcttttgacctggaaataataaaaaaaatgtgaccggtgtcctacagccaattacatgtttttttactgtccatcagccgtgtcatgttttcacggtgtctcttagccaattacacgttttttttgcatgtcctgtggcaaattttgcctaggagatatggtgcgtcatgagggaggatgttaattacttgcaggcaacaattgtgaagtatcacaaggggagacagggcaaacgaagggagagaagggaaaatgaggattcgggtgagtggagggaaaaaagttgcgcatggtaatgagtggggttagtttttcttgctaggtcctctctatggaattgttttttttttcaattttagcattgtgttgtaagatttggaattttgttatcttcgcccattaattaaaaactcatggccttcttttgaaaatgaaggaatactaatggatttgtactagctagaggaaattgagctagcatcctatcaaaaccctagaaaatgtttacattgcaaatgagtcctaaaggggtttctaggaaaaaaaagaattaataaatggatcctcccccaagatttttgagattttagataccagctagtactagtattaattaactcgtggcagcaaattcaagctaggagtggataattttgccatatagctctcttttttaatttcaactgaacctgtcggttcaaacaacgccaggttttgctagagctaacgctatgcgtttgggatggggccaattttatcaccatctcttcgtctacatctggaaaacaataacctcccaaccctgtatcggtcaagcttctactgttgctatgtgttctttcctgtgcaagcatccgaacctcccctgcagaaaggctgtgagagacatgtccagttgtttgtttgccctagaaaagggaaaaaagggagcaatggggtattgtagctggagatacttccaaaaacaaagatgtttccttgcccaaacatttatatactcctatcctacaattggatggagctgtgacctacctgtgcattgcatgtactgtaaaagaaacaagagagagagagagagggaaacaaagcacagagatgagtagtatgtgtgtgtcactgtgtgtaagtgagagagaacaaatagcttggggatcttcttttcacgaggagaggatatgtgtgtagatggagatcaactttttgggcgcacttgaaggctcaccacggaatggccgacaaaagtatgtctaggcaaggttgatggatggatggaacatcagatgtacatgcttgctacctgctgctgctgctgcacacacaaataccatgagatgttcatgtcaaatgatgagcttttctcatgcatctcttggattgaaagggaaagatacatgagagggaatcaatggggggacctggaatattattattgccgctagtcaggcatggaggaagttgctcttctgccagagcaggccgggacgacacactgtatgcgattgcctatcttacgagttgtgctgcctggggttccgttcgtttctgcaactcgggcaagcaactccctcgttaattctttgtggatatacttatcaaactattttaaggtacatttcgtaaaataaaactttatatgtaaaagtttcttaaaaagatcaatcaatttctaagtttatataattaatagtcaattaattactcgttaatgattttctttttcatgccatgaaaaatctcacctgagttgttgaaacgaccatgcccttaattctagcttccaatggttacagcttcttatagaatcaccacctcttctaaatgctccatccaatttaaaatataaaccctctgccctataaaatataaaattttatacattaatctggatatagtctatgtatattctcgtataaaagttgatttattttgggatggagagagtaagtatttctatgattcaaattttacatcataatattataaggattcatgcacttattcccaagattcatatcattctattgatgattcctaagacaatgaaatgcttgaaataaaaactaagcaattcaaaattgacaactgaagttatttacatggaatcttttgacctaaccttagtatttgtgtaagaacaattttacggtacttgagaagataccatgaggtactgccttttcaattgtaaatttgatacctcgtgatacctaagtactatgatataccaaattttacactaaatctttggtaccccatggtatctctcaagtacaataaaattgctcatttgtttaaacctaaaaatttttacattttggaaccgagggaagtggtccatatactcatctagactatgtgaatcaatagctataggattcagaatgaacccagctagcagcaagaagttgggaaatctagttttgacatactcccactagctgatgactcaccaagcgatggcggagacaaggggggaatggatggagtcaaagctccctcaaataatttctttttttataataggaccatctaactaattaggtaattataaactgaatagtagggtgttagaccctctccgatattcttgggctccacccatatctaaataatggctagtatatggcgatttctcttttgctaggcccggtgctaaaaaaccaactttcttaattctcataatcgtcggccccttgccaattgattttgacttactccctccgtcttaaaataagtgtagttttacattattcacgttcaacgtttgaccattcgtcttatttgaaaaatttttatgattcgtatttttattgctattagatgataaaacataaataatactttatgtgtaactaaatatttttaattttttcatatttttttcaaataagacagacggtcaaacgttgggtacggatatccacggctacacttattttgaaacggaggtagtacttctcaaaactttcaacccaaaacagggccttagcttcatctagacgacggatcgatagatggagggttggtgtaacgtgcacttcacgggcactgcatgcatatcctcccctttttttttttttttgtcaatcttacccggccctcgttaccacaaactcatgcgtttcatatatgcagtttgcaggtgtaaatagattgcttttcgggcaaaacaacaccgaataccatgggaagctagcttgcgtttgatccggcgtgcgaaagcaggacgagacgagagggggagcagtcgatcggcgcggcgcgcggtagctgctggaggacgggtcacctcaacgggcacgcgtgtgtgagaattttgcaggtgggggagaccggccggaccgggcaggccagcaacgtgacccggactccacgtaccccttgtagtaccatctgccacgcagaaacacacaatcaatgcgacgctctcttgcgttgcgcatgcacacacacgcgcgctggccactggccacagacggagtactgcgttggctgcaagtactgaagtacattggtgtctttttcgcgccctgccaaaatgtgtatcggtagctgcctgaataattcgtggggaggaactttgggagatatggaaattattgccctgctatgcaaagtctaatcaacaccagcagcagcttcagtctttgtcctgaaaagttggatatgccggtgccccaaagtacaacctaccgctaccgctggcctggctggctgaccaggccggccctcccgcgcccagtaattttccttcaacacaaaaaacatctttctttttttttaaagaaaaaacgtagagctggctattttatactcgatctattgcaaaataagcgcaaccataaatttcggtgtccaaccttaatcgtccatcttgtttgaaattttttcatgtttagtatttttatagttattagattataaaacacgaatattactttatgcgtgacttatattttttagttttttttaaaaaaaataaataagacgaacaattaaagttgggacacagaaactcatagttgtgcttgttttgggaataagggaatatatatttttgaaacacattacatacacaaatgcttataaacacgcgcacacagttgaccttgtgaatacatacacatcttttctctatgagcaaccaatatatcttgggattgatgaagtcaccaccaacgtttcgctgtcgacatataccttaaggcttacgaagacactacaagcactccacaatcgatatgtaccttgcgattgatgaaatcatcacgagcaccttgctgttgacatatacatcacctacacctggaaaaattagccataaatgcgggtacccatgctaaatctaagatttcaaccatagtttatatgtttcacgaaatgaaatctaaccagctacgctatgcaaaattcacaggtagaaaatatttttgtaggaacaaaataagcaaaatcaactgcatgtgtaaaacggcaccctaaaattccatggaacactaacatcaatcttaaatatgcaaatcatatattgtgcctctttaacttttcaaactgtttaagttatatcccttgctcgaaccggcctaatttggcctatatgactccaatcattaaaaaagaggatcttttgagaaaataaaaggtgagggcgagtccgacatgtcacttcattagttttctcctctctttcaccttcttcctgatctaaatttttttaagaaggcaaaagctacatcttgtatatatagggggtgtttggaagagaggggctaaaccctaaactcagtacatacgaacccttgaataaataagaattgagaagtatgaaatgtgggcatcataacaaaaaaagaaaaagatcgaaccagtaagactaatgtatacttatttatacctttgagaggtccacttagactattatgattttctctttagctacgtaggttatataagattcaattcaatctaacaagcggactggactaccttcggcggtgcctagcctgtaatgcttgcaaagtcgctaggcggggtgataagatgaaagaaggtagtatgtgcatctcaataggcctaatcgccttaaaactagacccccagggggtctcccggctgaaacaaatatgccctattttccgatacctgattagttggtgtggacaagtaaccctgaatctggactgtcgctctatttgatcctcttatgttggcccttctgcatcatccagcaaggctcggaagtctgagctattaaggtctagttgacgtataagaggccttcgatatgttaagggagagaggggagagtcattttagagttgggtgggaatcgttgatagaaaatttttttccctgaggtatgatagcgtctgaactaaagaaagggaatatggaaagtgaatgtggtaaaggataccaagagccctgaatgatttttaggcgtcttttctttgaacaaataaatctaactctctcaaaaatataagtccatctcctagagacttatatttttgagagaggggctaaagtttagcccctctcttccaaacaccccatagtgagggagtaaacaaaattaaagtatgtacatcgacgtgtgaaagtcctcgcccgacttaaaaaggtcaaagtacgtaatctccccccaaatagaaactcttagaacttggacgctcctactttgacccaagccccagcctcctatttgattttgcaatcacggaggttggggatggcgatgtgtcgaaagattctagtgttctgctcgcataatagcacccaaacgatgagggtctatattctgaattttcgtccaaagattgatgaattgtcacagatggtcctccgtggttatctttaggctgctttcgaacctcaaggttcccaacctctctcactttctttcgcgcgcacggttttcaaactgttaaacggtgtgtttttacaaaaaaaaattacgaaagttgctttaaaaaaatcaaattaatccatttttttaaaaaaaattagctaatacttaattaatcacgcactaatggactgctccgtttttcgtgcggaggggatggattcccaacccatcctatcaaacgcagcctagtgtgttcagatccctgacccaaatgttttggtatagtgcattcgccacagttctgttcttctattttgaggccacaaagatgtcaggtgctacgagttcagagtttggttctttaatcactatggcacgccaaaacttttcacccctggaagtaaatagggccttagttcgcgagacgaaatgttttggtgtgtcacatcggatatacggacacacatttgaagtattaaacgtagactaataccaaacaaattacagattctgcctataaactgcgagacgaatttattaaacctacttaaaccgtcattagcaaatgtttactgtagcaccacattgttaaatcatggagcaattaggcttaaaagattcgtctcgcatttacacgtaatctgtgtaattactcactccagtttcattttaattgacgctttggacaattacacgctctacaaaatatacctttgaccttatttttctattataatatatacaataaataaatacatgtttacttttattatagtgttttgaaagacaaatctatatatgtttttctaaactaaatatttttaaagttattgatggttaaagttataaaagtttaacctcaaccttgtccaaaacgtcaattaatataggaccagagggagtagttttttatctatatttaatactccatgtatgtgtataaacatttaatgtgatagggtgaaaagttctttgagagagtgaaatgtgcgtgttctagccgccgatgtaaatgtggagaccaagagtcaaaactgtaaacaaacagttggagcaactccagtcagcaaagccgcaggagctgaaggatgatgaccgagagagaggctcagaggccgcgaggaaaaagctgacaggaacccacttgggaaggctggcaagaaccgaacgcgacgcagcgcggcgaagtcagcagcttccctccctgctctgctctgcgaccgcggccggtcggaccgacggaagctcgcccgtcgtcgtcggcgagctgtaactaatcgcagtttcttcagagttttctgaatgatgcttatgatacatgtttggaccacctccactgcgtgatgaggaccatgatgacactgcgtgacagccaccgttattagcacgtcaacgactgactgtaagtactacctatgtactgtactactagaaaaaacgtggagattattagggttggttcaaaaatcacaaggaagttgcttgtactctcctggtcctggcgtcctgccgtccttggcgtggagagagacatggcagtacgggtacggcactactcacatcgctagtttcaatttgggccagatctcttcccctgcatcactactacgtcgtccagtgtagtttgggccgtttgtatttggcccattacccccaagccacaacctgaaaagaggcagcaattctcagcgggaatgtctgtgtgtgcgtgtggagtgcgagctccattagcacaagatgccaatcccgtcgcctcatcacgccatggcggcgagcccagctctcgcaccaacccgcacggtgccggtactgccgccgcgcgggccgtctcgccaccggaacgccgcggcaccgccgtgtcggcctgcgacggcgcggatcggcgcgtctccaggcgacggcgcggccgcggcagcagcggctgcggtggagcagggcagtcggagcgaggagaaggataggaagcgatgcctgcggtgcgggagcctgtatctcgacgaggacaactcccccaccgactgcgccttccacggccacgtcacaggtagccaacctcgcgataaatatcttcttctttctccggttcgtggctatcttgggctagtgtagtgtgaagtgtgtcgacattttggatagacgcccacaacattttaacacttataagcatcttcaaatgattagatcgacgtattttgaaattaacgaaatgaccttatataaatatacattatatagcactgaaataataattagctgtaaatataagtatctattatattattaaaacagttttgaaaggaggcaccacgtttgccgtgggggttagaaatttccacattaatcggagaaaaaagaagaaaacgaaaagtagagtccaagtagaaatacaatttaaaaatatctgaaattcggaattaaaaataagcaatattgaaagaagtttccaaataagaacccaatatgagattaataaaaaatcacaaatataataatataatatatacaatactcataaattatgagaaagagaaaaaaaaaaagagctcacagagagaagaaatatcacatagtaggagaaaagtaggcatgaaacggcggaaaataaagaaaatacgacatatagtagagaaggaagtccaccatataaagaacccaatacgagattagtcaaaattcaaaataaaaacaaaaattagaaaagaaaaggataatccaagtaggaatgcaatttaaaaatagctaaaatacggaattaaaaataaggaatattaaaagaagagttcatataagaactcaaaacgagattaattaaaattcggaattaaaataaaaataaaatctgaaattagaaaaaaaaagagttcaagtagaaatacaatttaaaattagctgaaattcggaattaaaaataagcaatattgaaagaaggatgatataagaacccaatacgacattaattaaaattcagaataaaaaataaaataatatccaaaattagaaaaactaacagagagttcggaatacaattttgaaacaactaaaattgaaaataaaaaataagaatattaaaataacacaatatggtattaattaaaatttggaaaaaataaattctcaaattagaaaaagaaaaataagatttcaattatgaatacagtttataaataactaaaatttgggataaaataaagactattgaaagaaaaaaccatctaaaacacatgacaagataaattaagtaacagacctataaaagagtagagtggtgacgattgatacgacatataaaaactgttaataaaacaccaaatataatcctaatgatgattaaaaggagggacgacatgtaggccgtgaagcaaacgagcaaggcgattgccgggacttctagaaagtaaaaaaaataaaccccattgataataatattcgatttttaaaatctcaatgacaataaaaaggagaagcagcgggcggggtgtataggagtatagttgtagagccaccgacggttgacaagacttctagaaaataaaaaatgaattccaacgatagttatgttcgaattttagaatcacaatgacaataaatagtaggcggcggacgggccgtagaggagcatagtgacatcgtttgatgggacttctaaaaattataaaaaatgaaacccaaccagataataaactctaaaaactataaggtccaatttttaaaggttcggaacttcttaaaaagtaaaaaaaaaccaatgataatcatgtttgattttaaaatctcaatgacaaaaaaaaagggaggcagcggccgagtggtagaggagtaaaatagcaaagccgctgatggtttggcgggacttctagaaagtaaaaatgaacccaaacgataattatgttcgatttttaaaatctcaatggcaataaagagaagacagtggacgggccgtagaggagtataatggcaacgtttgacgggacatctagaaattataaaaacgaaacccaaaatgacaataaactctaaaaaaatataagatccaatttttaaaggttccaaggagaatgaatagaaattgtggtagatcggacaagcaaataaagaaggagatgacataagaagtagcaactagtgtgacttttaaaaattatataattagaaacacggagatgataaagtttgatctttcaaaatcttaagacaatgagatagctatttaataaattttaagtaaaatcatacttaaaaaaatatatgattttgtttgggtgctagccgcgcaattgcacggaccacccagctagttactgttaaataagacttgaatctatcttttgacgggtttgcaggggagaaggggttgttctcgctgtcgccgccgcaccaggggatcgacggcgaatggagcgacaagagcggggtgatcgtgtacaggtggaacgacagggggagtcgcccaaacaccgggagagacaactggaaggggaggtggagctgctgccaggagcgcgacgagggcgcgccgccctgccgccgcggacgccacgtctcctacgacgacggtttcaccctctactagacgcactctctcttaagtacagcgacggtttcaccctctactagacgcactctctacagcgagaatgtgagaggaagtccccaaaaagcattcgcaatgttgattctgtacgtcagtgtcagatcagtagtgcggagtgtggtaatcaaatgaattgcagctctaaatcacacatgcatccatgatgctaacaatggaatcctctatgtccagataagccaatgtctcgaaactaaccgctgcttccagtaacagtggaagggcaggggaaaaacactcctccagtttgcaatccatcatacgcaggggaaaacataccagctcacacttttaagtagcattatgctgtttatctaaccacgaatgcttccagtaaactgtctttaggggatgataaatagacttcataatcgcaaacagaaacaatatgtaggataagataccatgctccattacatcctaaataacccaccattacaaaattcagtctctcagaaaattgcaactcagaggatgatcagacacgggagacaagaaacagcacttcatgatactaggtgaagataggagtttacgcatcctctgtgatggtacccttgtcgctcacgtagataccatccaagaacttcctgatatccttgttcttcacgtggcatttctgtttacaagcaaagggaattttgatcaacaacacaacaagggcacaaacaaatcaacaagagcaaaacacacgataattgataaaatatcttgtttcactgaaagcatggaaaaaagagtgctcgacgaaccgaaaaatagaagataaatcacattggcaaaaaggtttgatgtataatcatggtgttgtgcagacgccaaattcaaatagggatcagacagtggataacaaactgtaccctgagcaccgacaccactcatggtttccaaaccaagaacttagcaatgccaattagcccaactacaaaagggatcttggttgttcaagaaatggatttgttcgtcacaaatgtgttaacgtaacttcagtactgacataacagacagatggtgaaatggttattaaaacctaagtagagcactgtaaataatgacattcacaactgccaatgatcaaactaaggacatagaacatcatgccgccttagcagtttcaacatataaccttaagcagcaaacaacagaaacaagcaggcaggcatgacttgttaaacaattacaaacctagatatatcattggagcaaagagaactaattcctacaaccatggcaacatgagtacataacacatgcaaagatcaggactaattaggttatattgcatcatatcagtattagaagaccaggaaatctccaatctatagggagaagaaacgggatcgtatcattcacctggttgatgagggctgctgagcgagagacgagctcgatgtcgttgccgtcgaggacgagctcgtccttcaccttctccgaccgcaagatggtcaccccctcgagcatgtcaaccttcctcacctgaaacacaaagcatacagaaagacgcatcagatttgagagatctgtgggggagatctaggatgatccacgaacagcgggcaaatggaagtgatccaaaggtgggtttcttaccttcttctcgcccaagaagttcctgatctcgatggcggtgttggagttggtgatggaggcgttgatggggaagtgagcgtagacgaagcgcatcttgtagcggtagcccttggtgacgccggtgatgaggttctggacgtgggagatggcggtgcggatggcggccatggtgcggcgggtgccgaaccacgcgtccacctgcagcttgcggccgccctccagcagctggaagtcgaggttgaggtgcttgaagttgcgggtcagcttcccgcgggggccctccaccgtcaccaccttcgcggcgacctgcaccgtcaccccctccgggatctccatcgtctcggacgccaggatggtcttcatcttcgccggcttcctcttgccccttcctcggcggcggcggcggggtagaggggagggtttgggtgcttgctcgagagaagggcggcggcgcggggaggagtgggcttttaatatagtcgacgatggcgcaggttagggttttgatcttcgccgttggatcgagacattaggtcgcgaggtgatgactcactgggctgctggccttaggccggccccaattcatgaattcttaggcccactaagaagtatgtcaaaatttggcccatctgtagatgcgctgggctgcaggtctggtagctttgcagtccaagcaaattgagcccaaaataatgggtttaattccccgtggaactcgaatattcctctcttcctccggagtccggagtccacacacactcatattcccattatttcgctgcagttgctgtcgaaatcgctctcgctagcctcgctcgatctcggcgcgacgcgacgcgcgcgcgcacaggcaagcggcggccggccggccggcatggtggtctcgtacacgcaggagcacgtgtaccgccacccgtggcaccgggtgaccgcggcggcgtggcgcaagttcacggacgcggacgcgcgggcggcgccgctgtcgcacatcctcgaggtgcacacgctgtcccgccgcgtcgacgctggatcggggcgcatcgacgccgtgcgcgccatcgcggggcgggcgccgccgctcccgctcctcctccgcggcctcgtcgccgccgccgacgtggtgctctgcgtcgagcacaccaccgtggacgggcccgcacgggccatgcgggtgatctcccgcaacgccaacctccgggcgctggtgcacgtcgaggagacctgcagctaccgcccgcacccggagcggcccgacgagtggacgctgttccggcaggagacgagcattcggtgcgcgccgctcgctgccgtggcggcctgggcggccgagatggtggagcggcggtgcgcggagaggttcaggcagaacgcgtcccaggggagggaggtcgtcgagacgatctgtgaacgcctcgcgcttgcagatcactgactgctcggtctagacgaagaacattctcaaacttcaattctgcttcggcatcgaaagggaaaggatttgtctagagattgccagttgcagatttgcagcattttcgaatgaaaaaatgtcgtttcttgatgttgcgaacactgtaaattgtaacgaagttttacatctgcgggattccacgcgtgggagcgccgctctgtcccgagatgtttctctaaattttctgcgtttggaacggcatcgaatgcgccgacctgtcaacctgtgaagtgagacacgatcgcctgagagctccggacgttgacacgatcacctgagtcctgaggctgaggtgagaagagcgcggcctgtgccagaaaactccaggcgtggacacgatcacacgacgaatatgcggacggaaatcgaacaacagagcagacgtcgtcgtctgaacaggtattgctgaaatctttccaggggctctgcctgtttcgttatgccgtggggtcgcggtgggccaaataaagatccatatttgtgcacgagaaaagctgccataatagcccacgaaattcggcttgccctaagcctgtaagcctaattcagcccataaatatcgacagattgaacagcccatcatgataccacccatttcacgttcggaaaagtacaccgaaggtccctcaacttgctaccgagataaaaaacgtcctcgaaccgcaaaaccagatatcaaggttccttaacttaccaaaaccggttacaataactcattcggtggttttgagcccgtttttatcctacgtggcagctgagtcagcatgtaccccacgtgtcagactgccacgtcacatctcttccttggtgtactttttccttcacggggaggagtcaaggggggttccacttcctttttctgttctttcttgttttattttgtctctttctctctgtttcttcacttcgccgttctctctctctgcctttttttttcctcctcacgcgtcacacgcgcgcagcagaggaagggcgccagcgacgcaggtgatgggcggcggcggtggggaagaggggccggcagcgtggaagggggagagcttggcggcaaggagagggagcctggtggcggcgcggttgcacgcaggaggagagaggctgcgaggcgcggcggcttggcagcgcggccgggagacggcgcagaggggaggaatcgaggtggcgccaggcggaggagggagggaagggagtggcgccgggaggagaaggacggggcgccaattggagggggcgccagcggcggcatcggctccgattgggtgatggccggctattaacgacccaggcctcgtgtttttcatcaacaccggcgcatcgccgcggcgcggcggtcggcgcctgagggaaaaggggtggctactcggcggtgcccgtctaggtgcgacgacattttggggtggatgaagacaagtagacgacgacgatggcggctttagtggcgaaggcggaggtggttgcgggcgcgcgcgggggcggggaagcagctgcacgggggacggccggcgagcgcaagcggcgggggaggagcagcgtgtaggcggcgtgcagcggagcggcgcgcgggcgggcggcggcggcaggggaagcagcagcccgggcggtgccgctccactgccttctccatccttctccgccggcagggagaacagctcgccgccgccggcgagttcgaggacgaagtcgaccgctactggccgccctccccagacaagagggagagaggaggaggaagggagcagcgatcctgctcctcgtcaccgtcaggctccctgctggcgtcatgcagtgagtcatgaagcggcggcgcaagagtcgaggccgccgcagggggcggtgtggctacatgagggggcaagaggagggccgccccggaagagtcgctgtcggggagcgccaaggcgattatcgcggccgcatcaatgttcgatatgatggacgacgaggtggcgtcgacgacagcgtgggggcgcggcaaaactgacgcggctgaggcggcgtcggagctggagctcaagatcatgtgctcctggttctacagtagcggcttctagcggagcccctcctccggctccagctcccacgcctcctccctatgtcggaagatgacgacaacgaggctggcgtcctccgcttggctccgccaccccgtcggcttcgggtgccgtcactccgcccgcgcgtctgctcaccgccgccccactccgtcccgccaggcgccagcttcgcgtggcgctggtgactcagcgacgaagaccaaggttaaagcaccacggtggacaaaaccagtgccacgtaggataaaaccgtgtgaaatactgccctgggactacttgtgaccggttttggtaagttaagggaccttcgatatctggttttatggttcgaggacgtttttttatctcggtgacaagttgagggaccttcgatgtactttttcctttcacgttggaccaaaaaaggcagcccagttttcagcgtgtcccctacgcggcccaatctgcaaaacgcgcacgcgggcatcacgacgactctcctggaagccggaaggtgcggtcaaaccggcgtcgtccggaagcggacatcggccccgggagcgagtaaacgaaggttgacggctcgacgcgtgtgcgaccctgaactgtcccgtgctgggctggcgctcgtgctcagtggccgggagacacgcggtggcgagcgtcacacacgtgtgaagcgcagcgtcgccgccgggttcgatcacagccgccgccgttcgacggaggatatcacaccagctgccggccatccacccacaatcgccacgtctaaactccacaaacaattatgtagtaaactcctgaagtgcaaagccactagtagcatcatcctgaactggaactttatgagcgaaaaaggagcacttggcaaaggtgattctagggtcaagggatagcaatccaaagccaatcgaaatatcaagtcggtccgcaaactggaacggacacaccgacgctgacgctctctgttgcccgcaagacggacggtgacgtgttgcggcagtaatatacagtcctgttgatatcttcggttggatgtggttttcctggttgtcgtgcttccggtaaaggattggtacagccagccaaggcggctttcaaaagttatacctgcagctagttttctggtactagctcattgtcctgtcagtcacttgagcggtactcgacctcatccttttgagcaatggtccagcctttcgatgcctttatatcatggatattattccacgccgacttcaattttccagggaacagctaattcaatggaaaccatgaaggattaagcattaagcatcttaggttatttttgagggaccgaattaagctcaattaacatcgaattatgatgtaggtatatataacatgtgttcgtcaacagcccggttcgttcgtagctcatgattagccgaacaattacgtgtatatatatcggcaggacaaatcattggtcgagttggttgccggtcgatcgattgggcggccggccggccggctgccggtcgacccgttgtcggcagcgtgcgcaattaagcttcccctgaatgatcaattgatcatatgatcacgaccatgcatcttccaacctctgcaagttagctccaatgctctatccaaagtacccgacggatcatccatccatccattcctgcttttgctgctacctatccaagggcagagagatatttcgcgcattccggcatattttcctcgctctcctttaccccaattcgattcgatcgggtgaggtgatcgatcaatcgatcggttgccgaattgtcaatgtactcatgtggggaaagtttcggttcgctccgtctctcgcgtggcgtcgcgcgtgctgttccggcgtcttttccgtcctctctggggcaaagggaatccgcttatccggggattctcttcgtgcgctccggttcgcgtgtctcctcgtggttggccgccttgtactttgttaattcaggacgagttaagctcagcgaggccgtgaagtttccctgtaaaatcgggcaacaaactacgccgtgatttcacatgaaaacgccatcagcgcgtggctgcgcggcgcgtatgtacggggcaatgtattgcgtacgtagctggaccaaaaccggtccacgaatcgtccttctccatgtcgacatgcgtacagccgatgcatatatcatatacagagagagaggccgtgatttagtattctcaattctcggattgcaatttggcttttgagtgtgtacgtacgtatgtgtgacagtgacatgggcacggtctacgtagggagggagggggagaaaagaagaagggggggggggggggggaaggccggccggaaggaaaggaatggccatgctaatccagacagctcagcgggcggaaagcgacgcgaggagagctccacggcagcaacagcagaaaggggggatcttttccttaatttttctcatcgcggcgtcaggcagatcggcagaacgagaacgtgcggtgaacgggggcacgccgcgccacgccacgcgacgggtcgagaggccgaggacgacgacgggttccaacttccaattcccagctagaacgagagcttgcttagccgacccgagacggcgatgcggcttgccgatggtttggtttaccgctttgccccggttcttcgctttcccgttttccaccccctcccctcctctttcggtcgagcatatctcctccccgcggggtgggctacttggctacttgcccgggtcccgtgtcctaaaaacacaacatatcttacggggaaaaagaccgttccacccacacgtctccacacgcttagggcctcaccttttcgtttatacttatacttaaaatttaaatttttaatattaaatttaaaactgattttaagtctttttattaaaatttatctttcatcttttatttttagatcgttaagaatacatatataaaaattttatttataaattatttttcgtttgtaaatatgtcatttcgtttattcatgaaataagcggaacgatagctccactgtactactcatccagtacacggtcacaggagccagtgagccacggctacccatctggatccagctcctccactcccagcgccgaactgtggccggcagcgagccatgagtggcggcatgtcacgttccgccgtgacgattctaccgtagtactacgcccgtgggagaggcgaggcgaccgacccaacggccgtgcacgccgtttaccgcttttttggctgcggaatccacccgtgaaaccgagggccgcgttgccgccgcgccaacccccc

SEQ ID NO: 58861 - DNA, 51715 bp, Oryza sativa
  unsure (1)..(51715): unsure at all n locations
cccccccccccccccttcccgcgcgacgccaacgaggccaataccggaaataacacgcgcccgcgcggcaggcggggcaggtcgctgcccccacccccacacacgctgcgcctccgcgtccataaaaagcccccccgcctcgccgccattcccgatcaaatcctctcctcgatctctcctgcaatcctcatcacacagcaaacccaaaccgcgagcggaatcctcagcctgctgagagagcctgagaccaagagggggattcttttttggttattgacgatggcgcagcgcgacaagaaggatcaggagccgacggagctcagggcgccggagatcacgctgtgcgccaacagctgcggattcccgggcaacccggccacgcagaacctctgccagaactgcttcttggcggccacggcgtccacctcgtcgccgtcttctttgtcgtcaccggtgctcgacaagcagccgccgaggccggcggcgccgctggttgagcctcaggctcctctcccaccgcctgtggaggagatggcctccgcgctcgcgacggcgccggcgccggtcgccaagacgtcggcggtgaaccggtgctccaggtgccggaagcgtgtcggcctcaccgggttccggtgccggtgcggccacctgttctgcggcgagcaccggtactccgaccgccacggctgcagctacgactacaagtcggcggcgagggacgccatcgccagggacaacccggtggtgcgcgcggccaagatcgttaggttctgagaggcaaacaaaattaaaaaaaaaatctactgttttagcaagaaatggagaaaaaaattgggaattgaaggtgtggatgttattattatgctgttctcttctcgcaattgtttttccctttttattctttttaattgcaaacgggaggataagtggtggaaaaggaatagtgtaacaataatggtgatgtgaggtggttgagggaaaaagaatcgaagaacaaatggattgggtgtgtatttgtctcgcactttctgctccatttttacaaaattattcggcatatggttattgctcaatcattgaaatgaaaggaatggaattgagtagcttgattagcaatcacttggtagctggttgctgccctataaacaatccatccaattccagttccgacacattccgtgttcatctcaaactggaacctttctccacactttgtaaactgcaaattattcatccaaccaagcaactaatcatcaattcgtgcgcgtctctcatgaaccgctaaaaagggagaaaaaaaaagatcagccaacatagtactactacccaagtagaataaacttttcatttttctcaacaaaaagataagtcattttgtgcggagaaattatgtgcgagtagtaaaagatacggcgcgatttgtgcatgaacacgggttatactgtcgtggaggccacacggcctgactcttcacatggccacgtccacatcctctgctcgtgatggccagtcgtcttctttctcgcaagtgttgtggtctcactctgacctgttcttcactcgtctttgattacttctgattatatttttttatttggtctaacacgaactgttagcaatagagtatacgtgatggtaggcgaattgtgttcttgtagatgatgatgattaggattccttagctgctcgatgtgatgcgcaatcaatagtcaagagttctcgtgatatagttctctcttctcgttaatttggctttgccagttgggcttttctattgtttgtgccgaaactgatcccttgaggtttacattacttaattcttttttgttgttgaaatggagtttagcgtgcttcatgtggcagtacggagaacgggcaaaatggatgagcacatggtattctcatcgaggtctttggtgaggaaagttcaatgttatcttttcttactccctcccaatcaggcaatcatgttcattgttccttgcaaaaaaaaatgttaattgttccaccgttagatcagtatttccttgagattatccacatagttcaaaatgaacattttaattttaaatatcatctagatgccaaattcaatttcagttttttttgagcaagtgtttttagctgttgttggtagtaactgaagggaaaaaagaaacatagcagcaacttttagtgtgtgtttctttttctgaatcattttctgtatacccagatcacctttaccaacaatcaccatcaacaaacagggagcagatggactacaaaagtactgtcagaacaccataatctcttatctccaattctccatgtttgacctgtatagcgtcacgacatgaacgatagagtacacatgctttgcaccttgcgcttccaaagagaaaaaagtagtagaactggacacggagtgacacgtcctcctgattatagaatccaaacccaacaaccgttgtaaacttgtaacccatcaaggcatcaacccagccagccagtagctttccacggtgggctggctggctggcctcgtaaacccacacgcacgcgggccaaattccccgtgaaatcccgtgaattccacgaactccaccgagcgctggcccgtcccgcgcggcctcggccgtttcgcccatttttttgccgtttcgcacggcccatcggtggcggtcggctgatcacatcccccgcggattcgtcgcgcctcacggcttccccggctcggctaccgcgaattcacgcggcgccggtggtgtcgtcgctcgtctctctgcacggatcgttgttcgtttctgcttcgtcgccgaacagtgctcacacaacttgtggacattaaccgcggttgtcggttgttgcagagcagttcatcgcggtagttctgatcttgatctttgatctgatctgatctgaagcctcgccctcgccaagagttgaacagctaagcgtcggccttgaccccctttttgtgtgagagtgagacgcttttgcataaagcaatctgcgccacaatccaacgtgacgtgacttcacttctctgatgtgatcgcacacaggggtgatctttagtaacttcccatatgaacaaaagtggtattgttcagtttagtggctcttatggctgaaacgatgcctgaatctgcgttcgttggcggcaaaggtcaaggagctactaattgagcttcactaatcatcggttcatcacgcacccaggagctgcaaaaaagggcctcctatcctatgtccctatgtgttcttgtgttgatgcatctgttcttgtgttgatgaaattacttagtgctgattacctcactttgatctagaatactcccgtgtaatggccgaccaagttagacacctattgttaaatgggtgacaagctccgatttgaatactcttaaccccctgcatcagtgtgggctaacatgttagcaactattcagctttacgacttgttaaagactagggggagtgagtagccagtaggtgacgacgaagttaaccagataaacaggaagatgccaaacgccaagctcagctccaataatggagcagagcatgattcgcgcacacagtcacacaagaatgcacgggtggaatttccaaaaggatcgttaacctgacggattggcaggtggcaacaacactgaacactgagcatatccctatacgtatatatgtgtatctgtcggtctctgcatctgcagagacaccaaaatccacaattcttctccatgttcagatactacgtctgaattcacgtctccattttggttctcttctgtcagagacattcccagctgggtatcccttggcaggaaggaatggcctttgcgtgcacagtggcatgaagcaacaacggcacaagacgccatatgctttgattagccagggagccacgttacgtttgttatagctaatcttgctttcaggtaatcattgtttaaggagaaaacaaagaagttttcggtctcgtcccagagctttggtaatgagtggtagacaaccaccaaacgaaacgagcgatcgaggccttgaccggaccggcgcctgatcaagaaaagtgatcatccagaactggtccctctccacggctcaagttcagagcatcatccaaaccatcacactgattcactgttgataatttcatcatacatgtgccgcacagatggtgttggataggatggtttgcctatgccacgtgatgtttctcacatcccgactcaggggatgatctacaacagaaactgccgggtgtcctccgtccacacactcatggttcctttgaaacgtagaaattttggaggaatttcataggagatagtttaattcctgtgaaattgcttcatccgtccctgtctcgatcgacggcggatgaagattttctagagttaggcaacactaggaactaggagtgactattccattttatagcaggtaatcaggtagtgtttcaggaactctgttctccatttacccattatctcgttttgaacttagcactgttggagtttatggttgttggttgaagtgtcgatatacaaattgttgaccatgggacaggtttcttggttattctaatgtgcttatgtaaggcaaccctcaaattcaggctctgggctccacgaagaattatatatcttcagaaacgacagaattggagcaattagtattgctgccacttagcaatcaaacctcctctcaaaagagaacaaaagtagctaacacactcaacttaaacatgactccatgaagattttcttcatagaagtacaccgtctttgtagtacgaaccacccaccctttaacatatataaacttatgttccctgatggttatgttggtttttgtcagcaaacttagttgaatatatatactttttgtttgcaacttgacgctggattttaggccattttggatggctcctgtgccatactgaaataaatacggctctgagtatcttctttatcacacacatgtttacggacgaacagtgttcctggtagactggtggaccaggtggtaccctggcactactgcagctaaaattaattagtaattcaatttatataggacccatttctgccatacaagctcaccagttgatgactgtcatactgatggtatactgctcctcgtattgcacatttgaaagaactaactgaagaaatctataaatatctgtatgaaagtaaaaaaaaaaaaactacagtccaagtactcaagctcaattctctgttggacatgtttgaagcaagccaatatgatccctgattattctaaattataaccgaatttaagcactgtaatttggtggcacgtaagcagtaagcacaatgtcaacttcaattctgaatttaagcactgtaatttggtggcacgtaagcagtaagcacaatgtcaacttcaattctgatttttctgtcacatgcatgcagctcaccatgggagcgaacttcaccaaaaaaagatagtagcactttcaaaaggtaaagctaaccatatgaactaaacaaggcctggtttagttcaccaaaaaattttcctaaaacatcacattcgatctttgaacatgtacatggagcattaaatatagactaaaaaaactaattacacagttatgggagaaatcacgagacgaatcttttaatcctaattagtacatatgattagccataagtgctacagtaacctatatgttctaatgacagattaattaggctcaaaagattcgtctcgcggttttcaggcgagttatgaaattagtttttttattcgtatccgaaattccggttaaacatccgatatgacgcttaaaaattttcttttcgcgaactaaacaagcaccaacagacaaggctgattcacgaaaagatatgttttgaccttcactttcttgatttcagcattaaacaaaatattatcatgttaggagggaagcatcaatcgcactctattttgtctcattaatcaaaccgaattcgtactatcaaattttgactcgaagtcaatattggcgacgtgcagaagtcgctgaaggacgggttctgctctggccagttaatttagctcgtaaatttgcattcaaaattcgttaggtacatcgtacaaatatgcaaaattaacacaagctacgactcatgagcagcatcccaagcacaatataatggtacggttcgtcctatcggtatcataatcttttgtcatgtacaatcgcaacacaaagtctctcgataatcccgtacgatgtccgatttggaatatgcccgttccgttgcatcatatgattgatgaccagcagtttaaattttgttttgaatactactatgtgaagtgcctgtttgtagagtcactgtaaaaaaaaaaaaaatcttcggttgctgatactgtgcacacgtgtaaagctcacctttctcaccttgagctccacgccaaatgatctctcttgtaacgcctcctttaatggatatgcttgttcaccttatacaagagaaaaaaattaactctccaataaattattttatagcatattatttaaaatgctttgggtttcacaattcctctcatattttctttagaagcttagctcttgaagaagagatagtgcattctctctccttatcttctctctcttccacatcatacaaaagctgatatggagatttattagctagctgactcacctttattggaggaggcataagcagcacaaaattgacataatttagcttatcatgcacacgtattagtgagtggaccaacggcatccaccacccacttactccatgctgaagtgataaagctagttttcaaatcttccacaaataaacagctctacatgatagtactatattaaactgctttttatttaaatccaccatatgattttcatgtaaatcatgacagatttattttaagatatcttcaaacaatgtattttcttgactagagttagagagaaacaattacacattttttcctcggatacaatatcttagaaatgctaaaacccaagccagaggtatggttgaaaatgcgacggtaaattttcagtacttcagttattgtagttatcatcagtcttattgagcgcgtaggaattaagtattgagtcagtaaactggtatagttcaagagaattcaaaagttcagtatagtttgttgaagggaccattaaataactatatggctgttaaaagataaacacttatcttaaaaatatagacaaaaacagtaaagtgtacggtattaatttttcacaacatgcccttgcatcatatccttaggatttatttgtaggtttttagccttgctaactaaccttaggatttgcttacacaaactcttacatgcataaccccttgatagaaacatttacgagggttttttccccttcttcaacatattcaggttatttggtcttcatagggtagacttatatcgttatagggtcactggtctccctggaaggtctttcagggtgcccttcagctccagccaacctttatctcgttggtgacttattggttgaccctactcgtgtcaccacatcgatccctgccctcagcatgccaacaagacccgccaatcgaccttccccttccctccccgcctctcctcctacccaatatgggagacggcaaggtgcccccattagctcccctaccactctgatctaattcctctatcgccgacttatccactaccctcctccgacctcgcggctctagcggcaacactgtcattgccggggagtcggtcttctccatatctccctgctctctttttggctgaatcttggagacaattttctagccattagatcgaaggagacgaccgaggttaagataaggcccatcctaatatagtagtttcattctatttaaatagggtgttatgttagtatttttttaatgatgtggtaagaaatataataaagtgagagatgagatcgatgagtttcatctaaataaaaccatgtccaaattgttccgacgtgccaagaggtcagaggataaaaccatgtccaaattgtttataatatatagtttcttgcatgtattacctatgaaacaacaaaaataaaaccatgtgtttttcaatcatcaattacatgactcgttgcttatatggcacctttggaaatataaaagatggaaatataaaaatagtatatttcactgggaataactttcaaatactcctacctttgttcaaattttgtcggacactatacagtaatcgcgtttatcgaaaaaaaggggattgctatatggcattcgaatgaaatttgaggatgaaatcttacagattttggaccattggatccatgccaagattcgtgcatcggcttctctcctccaactccggcgggttagggtttggggttggggtgagggtaggaggggggttgggggagggggaagaggggggtttccttggggcttagagggatggccgtgggtggcggagaactggcggtgggcggtggactccggcgagcggcgaggtggcggcggcatcgccaaagccgcggggatggaggagggcggtgagccggcgtcggcggcgggtcaaagcaagcgtgggattaggaggtggcggccagaggtaacggatccggcggggcgggggcacctcgtcatcgtcgccatgaggacaaagtgaggggggaaggggagggggagggggcttgcagggccgttgactttttccggccagccggcgaggcgggcggcagcgcggtgggggtggcggtggcggtggtggcggcggatcgcgtgtgggacgggaggaggagggtggcagcatgatctggaaccggggaaggaggaataggagttagggtttaaggggctgcgcgaatcttaaagcacatccaatggttcaaaattcaaatgataggaggtgagattttatgtcatatgatatatagacagaaaaaaaaggccgtgcggtattcgatgactgagccggttttgaaaccctaggccagtatatgctccgaagatcgtctctttgacagaaccgatgagaattgagaaaacgccaaagctgtgccggagataacaatagtataaatcttgaagtggcgttgccactttgtttcattaatctctgcaggttaaacaagacaaaaacaacaaattaattaggcaaccgtctcgcgggtttagcccggccccctactaccagcttattatatctcgcctccacgtcctcgtcgctcacaacgcgacacactcccaagcacacacacagagcgcgcgcgcgcgcgcccatgcagcagcagcagcagccgcgcatggcggacattgacctcgacgccgtgcgcgccgtccgcgtgctcggccgcggcgccatgggcaccgtgttcctcgtcgccgcggcggcggacgacgccgccggcggcggggcgtgctactacgcgctcaaggtcttcgacaagaggtccgtcgtcgcgtcggcggcgaggcagggggacgcggcgcggcgggcgaggtgggaggtgtcggtgctgtccgggctcgcgcacccgcacctcccgtcgctgctcgggcgcgccgagacgggcgacctcgtggcgtgggccgtgccgtactgccatggcggggacctcaacgagctccgccacgcgcagcccgaccgcgtcttctcccccgcggccatcaggttctacgtcgccgagctcgtctccgcgctcgccgagctccacgccgccgggattgcgtaccgcgacctcaagcccgagaacgtcctcctccgcgccgacggccacgtcacgctgaccgacttcgacctctcccggctgctcccgcccgtctccccctccgcgtccacctccacctcgtcgtcgtcgtgctcggccacgtcgtcgccgccgccgcagctgcagggacatggccggagccagctgaggcgaatcttcgcgagaagtgagtcgtcggtggccgcgacgacatcgacgtcgtcgcccgggcagtacacccacaacctggcctggttcctcaagagaagcgacggcggcggcggcgccgccgaccacctcaagaaggcgaagtcggcgagggtgtcgccggtaagccgcggcaagaagcaggcgagcttctgctcggccgcgagcgcgagcggcggcgccgccgccgcgtgcgagaggtcattctcgttcgtgggcacggaggagtacgtggcgccggaggtggtgcggggcgaggggcacgagttcgccgtcgactggtgggcgctcggcgtgctcgtctacgagatggcgtacgggaggacgccgttccgggggcggagccggaaggagacgttccgcaacgtgctcctccgggagccggagttctccgccgactcgcggcggcggtggccggagctcaccgacctcatcgcgaggctgctcgacaaggagcccacgaagaggctcggcttcgccggcggcgccgacgaggtccgtgcccacccgttcttcgccggagtcgcgtgggacttgctcggcgagctctcccggccgccgtacatcccgccgccggccgacgacattgccgcgtgcgaggggttcagcgtggtagagtatttcaacaagcttcacgagccttcgccggagccggaggaggaggagttgacggagttcttgccggagttctgacgtccggtctccggtgttccactcgaactacagtatttctctctttttttcactttcacctcaaaaaaaatcattaattatgtgatcctgtggtgaaaggggtaaactaaaattgagtagaagagattgtactgtaaaattgtgacatggtaagggtaggtttgtgaaataagggtaactatttcggtaggggactgtaaaatccgaatccttttctgctcactagaggctagggtgactgaaaatactgtacttcacaagggttaatccctgcagtctaattgactacggtacagtgttcgatttgttggtctcagacgcccgagcggaagcattttcgatcagatagttgtatgtgtttcgataaaaaaaattcagataattgtagttattgattctctctgcatgatgacacaaggacgattccaaaattttcgtgggatgtaattcctatttttgaattacatctttcagtaataacattgtgccaacaaaatacagaatctaattactgaataattgagtcgacaataaatggcacaaaatggcacaatgttgctgctgatctatgacatattgacatctgacagaggagttactataccagcagaggaaatatgccattttcccgatctgtcaggattcgatattcggaaaagatgtcccatgaattaagcagtgttgatttattagattaatcattaaaccccgtctcaatgtttgaccatgtacgtgcactaattcatatataatccatggttcgtacagcttgactgttcagtttatctgtacttgctttgagctgtggctgaaggctggctgttgatctgaagaactacgtcaatattttccaatgcatgcaaagttctatttacgacggggctgagattaaatttcaaatctgtgcagtactctctgcttttctataaaccttcagactatgaaagagctgaaacattcaggctttagctaggttacacatagctatgcactatacagtatacacacagcttcagtcatttgcaggctcgtagtgcttactattctgaaaaaaaaaaacgaaatactactgtgtatgctacctccattgctgtccacatgtattttaaaatctggactatgacatttgaataaaccagtgaaagccgagaacagcctataactaactatggcatttttcaagatttgaaggaagagacgtccctccaacatattttaagaaaaaaaatacgagtgtgttacggattaaatatgagatcttatggttaaaatcatacatctcttgttgctgccctatcaagtgcatcacacctagctttgccactgtacctactgcattttcacaactattatgtaagccaatagtttgccatttacgaaaaccacataaagaaaccattcttagcatgataatatagctgtatatagctttatacaaaaccactacccgtaattaaatggctatgggcatgttccacaacgcaaccaacaacctcaacagtgatttgtgtggctgtaataaccgatacgctgtgctgcgctacacagcggttgtaccatgcagggccctgtttggttccatgggctaatgtttagccctcaccttttagccttaaattagccctcaataatccaaacaggtgggctaattttgagctaatatgaattagccctcctcaaaacattagcccctccaaggggtgctaatgaggctaattttgtgtgggaaccataaaaaaatagctctctctctccttctctctcctctctttctactctctctctctctccatcttttagccttgaattagcccatggatccaaacatgccaccctatgctaatgtttagcctaccaattcatgactaaacattagctcttaaaattagccctgggctaatcttccaaacagggcctagctaaacacgccatatatatgtgtgtgcatatatattatcttcaagatcagtcatcaatcctttataatcattactccctcaaaggtttgctatattttgggatggagggagtaataatcaacgtgcatatgcgcaggcacaacacaactattccattcgtcccattttaagcgcaaccatgagttttcgtgcctaactttgatcgtccgttttatttgattttttttataattagtatctttattgttataagatgataaagtatgaatagtactttatacgtgacttatgtttcaaatttttttcaattttttttaaataagacggacggtaaaagttggacacggaaaatcatggttacatttaaaatgagacatagagagtactagcttacaaactcgtactactactgcttgaagtgtttagagcctgacatatatgttcagactcatcttaaaaattagaattattattttttaacagtgagatcagagagcagatgcttaaaggagactgacaacaatggtaaatccggtgatgcttctcccacacgccgtttgggtttctaggtacaccattggccgacaattggcacaaggatgggccgcattcatgcatggccggagagatctcatatgcgttgctgttgcttccgttcgtccaggcaaggcaaggcaacggtacgtactagatgccgcgatgcacgtcaaggacaatatatagatggagctagctagctcacgacatgcgtatgcatggaatgcacgcacgtcgcgagaggtgtggcgacctactttgtccggcaagaaaagacaccggagagcgaggccccttgctgctgttaattcgatcgtacgcgcgcgcacgttctccagcacggctagctacgtacccttgcatatgcaagattaacttggcctcaactagcagctacagcactagcgtaaattttcagtgtaacgacttacgctttgtacgtacgccgccttgacgcatccctggccaatgaaaattgagaaaactctcctccggtaacctctgtgtttttcaaaataacgtgtggtattttctaaatatgtcaaaataaattaatttttatcctctatcagtccgcaaatcgatgagttattcctctaataaccctcatcaacccttacacatatccacctaccaatattacttttctattaacgaggaaaactttgatttttttagctactatctaattttgagcacccaaaactatgagtaaaattactctgggtgtttggtgtgactagatggcaatcaacagctacagtagcaacatacaatttctaccataaccgcagcagcagccgccctacacagcagttatagttggcctgccgaacataccctctgtactagtgactctaataacagattgccagtcatgccatgtatcataatcctctgacgtaatatcgccatgacattgtgactcattaacatactatggacttacgggtggatggctctatcattgatcacatcgatcacatcatgtagttatgtcggagaggaaccttttgttagtcagacgtggttttttctctcaaaaaaaatatattttctctcaaaaaaaggttagacgtggttttcacttgtctatgcgggattaagatttgattactttaacaagtgaaacggagatgtaagacaatttttcttgttcagtttcattgatcaatatttgaactcgataccttttagttaactcggatagttgcacgttcgcgaagaaagttaactcggatagcatattaagttgtacctatgagtacactcagtaatttaaaagattaaaatgacactatagaaagaccgtaaaatttactttaatttgtactatttcattgacgcatcaatctcttgaggtcatagcttagcactatccatggttgatctagtatctggacgtaaaagagtgatttgattcaggttccccccgcccaatagcgccccttaattaaccaacatattagctcaatactcaaatactatctctgtttcgaaatgtttgacgctgttgaatttttagtacatgtttgaccgttcgtattattcaaaaaatttaagtagttattaattcttttcctatcatttgattcattgttaaatatatttttatgtaggcatataattttacatatttcataaaagtttttaataagacgaacggtcaaacatgtgctaaaaagttaacggtgtcaaacattttgaaacggatggaatatttggttgtcgtctatgctgtttaatgtaaaatgttcgctttgctacgtacgttggttagtccacgcatgtttcattcaacgggtcatggatttaatcccaatcccgtgcacctagctagctatagtattttttttttccaaaaataaaaaaacctgtacatatctcttgaataatattgtgtctcacatcggttattttccacctatgaaaaacattttacaattgatcaatgtaagagcaagtttaataatatagctaacaactagctccaaaaattaaaatatcaccaatagccaacctgttagctcgctcatacaatagttagatgtagatatatattgtatcattaatacataatccttccatctctctcacatagtttattaaagttcgtgctatatctgactataaatatgtatcccgtttttcttatctctcatcttctctcctctagcacaaatctgatgtagcaaattgtacaaattgtacaacccacgtacattactttattgtacatgttctaagttaatgtaagcaccctaacttcttgttgatgttacatcaaattaattacaggtataaaattaattattacaccttttgaaactgttataatcagaatttcggtcctctcaacatccaacctctctctctctctctctcattctagaatgttagaccctatcgtacagtccccaatgggaggggaggggtttataagctctcgatcttctagccaaatgtgtgccactaatgactactggggtagctctcacatatctacccaaatgaatacgacgtgtttatatgcatcattatcttatcatggcatgcctgagttgtttcatcgatctcctgtcgatcatcaggtagctagctaactccaatatgtagccacttggatatattactagtactggtgcatggtttgacattggcacatgtggcaataatttgagtagactggacgaacaagccgtgtcaactcgtttgattcgtgaaagtgcattgcactagctacttactctacatgatgtcacacgtgtgatgtgtttgagagcttagcttctaattaagcaactcaagtttttgtcttcaatctgcacacgtagttgccacatgggtgcatgcatgctgcaggtagctttcttttacgctagcgagtagtttatgctactccctccgggctgctaatacttatcgttttaagacaagggtgagatcaaactttagaatctttgattatgaattatttttaaaatatttgtctttcaaatatggtgaccacatgtatagattcgtcttaaaaagtactttaataaaataatatatttattaacacttttttacatattataatagaaaataatggtcaaagttgtttttttgagaccgtgcctttgcctaaaacgacaagtattatcaacccggagggagtatatagagagagttcatcaaaactaaatagtacagcttccactcttcggtagtagttaatttaaattttaaatcttagttttaaggttgattttgctgtttttaattgtttgttttacttgcgttgacttttaagcaaaaaatacatatataaaatttaaaccgcgataaattagtttttaagtcgctaataagtattacggcttataatcagtttcatacataggggaactgaaagcttcaaatatgtaaattaaatcaactggaaatgagtttaattacctcagtgcaagatagatcatacgagatgtcgtaactcgtaagtgcagtgcgcaacaaattaaagcatgtgtggaaattaaagaagcttggacaatgacaactgtaagaacgtttgcatcgctgtggtgggattgcgtatctattgtgtggtggcgcgcaagtagcggaagttgaggaaaaaaagggaccaaagacacgagtgaaataaacatgcacggatatagtgtgggcccctttaaaaatgtagtagaattgataaaaacagacatgaaaaggttaggattataatataaatgtaattgttaaataaagaattgcaaaatacagaaataaataaataaatatcgttgcaatagatggtgagcagtggtggatccataattttgttcattggtgttatagcatactaattatatttagaatatagtgttataatatatagacaagcaatttaagcatagcttgtcgaaagacgtcggtgccgtctgagacaggtcataacactgtagatccgctcctggtcgtgaggaaacaaaagaaagaaactagaggagagaaaaaggttcaaagaaaatttcccataaagttagccatatcatgtgttaactttcctcacatttatttctctcgagccattttataaggaccagataagaaaataaagtaggactcaaacttttttttaaaaaaaaaatcactatgtttttttttgtttttctttttacaaaatcaaagagggccttacaacacagtacacggagataccgcggcgtccgtcctttacgtaacagctggaggagtacgtaaagtggcttgcttttatttgtgccagccaattcacaaacacgtcctgcttgcttgccatgttgtttgcctacgcgaggatggacaaagttacgaccgcccccgatggtgacgcgcatgcctacctgcgggcggcgatctcttatcgtcaactcccgcggagtcgtcgtcgactcgtcaccgatcgcgcgcgtcgcatgcataatgtgtgtgcgcttgcgcagggcggccgcaagctgccggccgcaaaccacgtacaacaacgggtttggatcaacgcgcgcgtgccacgcgagagaaccagtgcaggtttggcggtgattcggggggatatcgcgcgcgccacgcgagaggatcgtatcgcgggatggacgacgcgcgggctgcacggagagtactcgcgcgtgacgttgtggcccgtggaccggtttggcgggcagcgcgcccgcgtgcttcagctgcgtcggatcacaggtcgggccggccggatcggaggaagggactccgccacaaggaataagttcattgtacgtccctcaatttgtcgccaaatccgaaattcgtccctgaaccgcaatatgacgagtcccttaattcttaaaaccggtgcaaagaaagtccaagacagtttggttgacgtggcggcgtctacgtgacattgataaagtcagaaaaaacatgggacccacatatcagcgtgtgttcggataaaaataaaaatatgcagtgagacccatatcatcctctctctctatttcccctcttctctaaccttcctcctctctctctcccacttctgttcggaggagagcggcatggccgcggaagcatgaggcggcagagctcgttgcggcagcgctccagcaggattcacaccgttgtttgcgctcctcgcgccgctacctgagccctgagctgccgctggagccctgacgatttttgtcatggcatggagtggcggagtgatgccaccatcaacaacctgggctacctcacccggcggacaagctctggtggatgcttgtcccagcggccgatgtctatatatatatagggatgtgctaaacggcacctagggtgcgttataactaaactactcccctcacaacccccaacccccaccctccctcctacccccccagctgcacccaccccacatccctcaccctgcaccttttagaaataacgtatagtaaattaattactaaatgattgtttgtggcgcaatatacgataagtaacatatttactatacgtaaaaattgaatgatgtatcaatcccgcaccttttgctagcccagccaccaacaataatatgtgtgactttagtaattcatttactattagtatgtttttgataagtaatcgagttactattctcgagtaaatgagttactatcagagacaaagcccattagtaaatgagttactaacagataagagtaacatttgtttggcacttcccttattggcccatgagtaaatgcattactaacagagacttggcccacaatgagttactaacagataagaatatcgtttgctagccacatctcatattggcaatgagtacatgcgttactaatagagactcgcccatgagtaaatgatttactaatagataagaagcaacatattcatggaataaaaaaaattattgatatgtattgggattatccaatcatggagggagtaaaaaagttacttagtagttgattgggcctgatatataaggtagtaaatattttactgcacgaatacgggtataatggactttgtttttacaattgatcgtgccatcatcgttacaaacacatatacacccggtacccaaaaaaaaagcacaatccagagggcatcgcatcgcctgccaccgaagcctgtcatcaattgtggtgtggtcgtcctgggctgaccctttgtgttggctgccggcgacgaacgttgacgaaggacatgtcgaggatgccattccagtggcaccatcaccactggcataatcttctcatgttcttttctagtttcctgaacacaaatgaattcacaattaaaaagaaaattcagatatagatgagcaaccaaaaaaattagaacatgtacatcttcagcagagcaaataccaaccaccataccatcaagatgtgcatccacctgcaagagtgcacactgtagatgctgatgcctgcaaaaattagaagttaatcatttcagtaaaatttagaccttagtcttagtctgaagatgtctgttctgtcaaaaatatacagagaaaaaagggtatgttcaacagcgaacatatctagtcagaagttcagaaaaaaagaattcaattgatgtgctcctttgaacaacaaaaatttagaaaactgctattcgatcgagctttttgagttttcatctatccgaaaattcagaatcaggacatgcagtactaatttcagaaaaatacgacgaatactgtacacatgctgtaaaaatatcacatatctcagagtttacacatctcacaggacatgcagtactaatttcagaaaactacgacgaatactgtacacatgctgtaaaaatatgacatatctcagagtttacacatctcactgcatattttgcagtcctgaaaatcgtgaccaaaattcaaaactcatgagccccataataaccatataacactagcctatcagagatatgcctgaaaactcaagaacactgttagtctataattagtgctgaattccatgatccaacaaaaaataaaaataagaacttccctacactagaatcattcatgctattctgttcagcaagagttccagagctgtgcaattggaagaaagatttaggccaacaaacacacaaactaagaacgaatcaggtactttaagcaaaaaatgatctgaacattcccgcaattgaaagaaaagaagtgcaagaactgctcaagtgaaatgagaccagaccttcatcctaaagtgtgcaggaattaatcatattccccatacaattcatgccagaatcaaaactctaaaactaggaaaagctgaaattgtttgtactgctagaactagattagtgaaccaaatttgtcacttgaattgctagtaaagtacctgaactgctcgtaaagtaattaaacaatggctccaatatctctaattagtacctgaagaatcaaagcacaaacagcatcgcataacattgttattcagccaaattaaccgaaaaaaaacctccaagatttcagcaattggaaagacaacaagtcattacagcttattgaatagatcccacaacagtctgagcactcaaaaaaactatgtccaattactcaaaaaaactatgtccaattaaaatagtatggagaacaaaccgaatggagaccacggcaagacgacatcgcagcaccctagaccacggcaagagggatgtcggggacgcgcggggccgctggatacggcggatctggcggcaaggctcccaaaggctacacccttcttcacccctggcgtcctcaagtattcctcgtcgatgcaggctaacctatggagtgcagggagcaggagctcgtgtcgccctgtagcttgtacatctggaacagaagaacaaggggcatccaccagcaaggagcttctcacatgatacccatgccattgaagcttccagatctggagcagaaccaccatgcaaaatcccatcgcatgaagtaaagaaaaaaataaagaaaaaccaaattctgattcgttcctatacgcagggagggcagaggaaccctataaatcccctaatccccaaaccctagagaagtccccacctcaccgaggagaacgatacagcaatggggatccagcggaggggttggcgtcgggaggtagcgcgggtgcggttggtggaggcctcgtcggcagccttggcggaggcagcgcgcttcttgcttttctcgcttgagggagggagccgacgacaaccgcggaaacgagagcgaaaccgtcctcgcctcctcgccagacatggacatgcccgttcttgccgcctaacccattagatccagcacgccgcctcctccctgtagcacgccatcgccgtcgccgccgcctccgcttcctgatgccacagctgccgagccggcttcctgcctctgtagatccaaaaaaaaaagggggggaaattgattagtggttagttacggtgtgggaccaacacatgtatgtatacgacgattcaaacactactaccagtaaaacaattactcagtagaaattgatagtaccgttagtaacaccattacgggaattgagggggacagggatgtgctagtgtggtgtggtgtggtgtgggggtaggggtaggggtgtgggttgcccccggggggtggggtggagggtgggttgcggtttaatacaacgcaaccgtatagtgtgtgctccaaatcaagagcagtagcattagcttaccaactcttcgctctcactcattgctatacgcttgatcgtcatttgccacaagttaatattatcaataaaaagctatctgcagtgtccagttcttcgatacccacctaagctctagcagcagcataattcagaggtaggggccatagcacgtagtactagctcgatccatgggtcgcccgccgcgctcacccgccgccacgaagtcgcgaggggatctccatgcaagacgagcacaacatcggcaacagagcccgcccgctgcgccagctctgcccgccgtcgcgctcgctttgccggccgccgctgacggcctctccccccatctgacgccacgcccgctcgagagaagagaagagaaaaaggaaagaaagagatgcggtatgtgggctctatattttattttattttatttttgctgactatgatgccacatcagtgaaacaaggcagaggataagggatgtcaaaaaaaaatcgatgtaaactgtaaagttgagggacgccagttgaacttattcctatttgtgatcagttaggcggcccatcgaacgatggctgacgcagaagtcacgctcactctgaccactcactaaaatttctcctcactaccaccaacaaataaatttatccccttttgccaagagtgaaccaatcacttcaacagaatcaaaatgcaaatatacatgagaagaatggggggatgggttctaaacactctagcattttgccatgaggatatccaagtgctgttcgttcattcagcgtctgttgcaaagcagttccttcccgaccaatttccaaccccttgttcacctcacagcaaatctgcaacccaagaccaagaggctctcttttcgtcttccgttccacactttcactggttactcaaaccaggcctctccgaccatatacttctctcaggagctcgtatctcgcgttcgacatagagccaccttgccgtgtagtcgaacgagaggccccgttgcagggtgagggtggagagctcctgtcgtacagggacgccagggggttgcccaggtcgtccaggtcgtcgtcgctggtgtaccctctcctctgcaccatggaggccctcaggtccggctccgcgttcccgcctgcgtctgctactttctccgcgacatcctccggtgaaggggggcagtagacaacaggagccgcgacgcaggggaatgtggtgatcacatctttctccgtgaagcgctccagcaagctctgtgtgaaaatttagcaaccaacactgattgagaaggtgtagagtgaaactatagaagtatcttggttagtcattacatatggtgagcaagattgtatttggactttgtaatgctacaatgcaataatatcatttagcaaatagacgtcgtacctcggcattcagctcctctaaaaccattccaggaacaggttcaggacagaactcgtcaggagtgaagttgcagagtatccttgttaccagtggaatgccaatagaagggcagacctaaacagaatgacaaaattttaactgcagcactgaacctgaatatatgttccaacttaagagttggagtgactaagcatgaatactgacctccttcctgatggacttttcaagaagcatgtcctttgggagcatcagaagatcacttaactcgttgagcagcttgaaagaataaaaatcagcagcaccacttctgtcatcactctcatctcctgcttgaccatgcttctcaggggcagcagcaaccatgccaaacttatcttgcaaccatcgggaccaatttccgatctgaagaagcatttggtccattaacatttggttttgtttgcaaggaagagatgatttaaaacacatgttctggtttgttcttcatgcagttacaggaaacgttccaacgtaagtggttttaaactaagaacgtagttgttttgcaatttgggcacataccgagttcttcagctgtgcacctgatccaaagctgaagtcaccagctggaatcggtagaactcttgagtcgacaatcgggtcagatataggatcagatggtacttcatttgcagattcacgcaggactgcattaaacatagcaacgtctaaacgagctacacagtgctccatcacctgacaataataaaacaactcatgcataaacttcacaaaaatgattattcttctcaaattaaatatcaatgattaaacataccagttttgccaacactggtaagcatccacactcatgtccaccagcacgaagaggacatattctgctgaaggcatcttggaaagcagttttccaaagatgaatggagaagttcccttgttgctgatcacccaaagcaggtcccaacaaactcccagcctttggacttgatatatctttcaccagtgtttgcatgtggggtgtcaatgcctgaaaaggaaacatccttcagaaaattgacaacaaaatgaatcgaaaaagctgtctgctatcctagttttacagagaataaaatgtactcaatttcctaaaaagtgccgagaaagcataagaaaggttttacctgccaccacactgactcaacaatccgagaaaagatccatgattcaatcttctccagtgcagccacgagtgtaccagtttcccgccaatcatcaggtaatggccagatagcaggtctagcatgcttgccactgtagttgtttttccgccgcgttggtgaagagttcttaccgagcatctttgcattaacatttgtgctgaaagccttcatagcaagacttggttggcgtgtaatgccaaatgtttgtgcaatgatctctcttaggacaacggtgtttgatagccagaatgtcaacctacataaagatttattttaaaaatgatggtatgcggaaatataagctacacagagttacatactatatccaattacagatactttaccttgaaacatcatttccacaagactttgcaacaaggacaagcccagaaacgaagttctttgtgacagaagctttcttatcagaggaccaaaactttgatgcatgaacatatagcctggacagacgccgagctggtgtgtgcaatttatgcgatgaacaaccgtgctctggcactactgaataaagagaaatctcaagggcagcaacttctcgaagttcctgctccaacctttcacatttagattctaattcctcactcttttcatatgcagctgatttaccatcataagctatgctttcttcagtatcagctatttcctcgtcagtagcagtactctgatcacaatttggggcttcatccaatatatcaatctcctttgcctcttcactagatttaacatcagctgctatacccgcaatggtcctatcatcagtgccactctcaatgctcctttcatcagtggtgttgtcctcaacggtcgtatcatcagcagcttttccttcagtggccttatcataagaggccgtgccctcagtggccttatcatcagctacatcctcaatggatttatcatccgtcactatattctcaatgggtttatcatccatctcctcagacacctcagatgaaggacaagaaggaactgtcactgtatctggctttgttatctcaatggttttagcaccatcagatgttttgtttggctttggagatttgctctgcaaattgtttgacgatatatattgcagcttagtctgcacttggcgattggaattaattctgcctgagcgtgggctgttttcctttgaatctttcttcactagcttctttggaacccttgagactcttttggctctggtatcttcattgctgttagcctcaccctgagatgaaacagagtctctagctggttcatagtccgattcaacttcttttccttgtttaccatcccgttccacatcagtcgaacgctcttctctcccttccatattctctacagtacccatctcaaaggttgtttagtgcactagaaacttgatacctgtatataacaccaagaaagttagtaacaagagcaaaggtctagcaacttgatcaggtcaatgagcaagatagcaaaagagctttcaagggtggtccgaccctgcaacataatgattatgacaggaaaaagtcacgcacaaaacagcttgtacataaattgctttaactgaagagatcaagaaaatgtactacaagtgcagtacaagttcagagaagataaataacttacactgcacccagagtaaaacgctaagaagcccatgttcataacttcataacattgaacaagtgataggacatcaaatgaataactgatctccagcttgtctcaacagctgtacagctaagcagaatctccaccttaaagaagcatctcaagcaagatttttcaccttaaaccgacgtaataacacgagaattcagtacaattatgcttccttgtccagtcgatctcaggaagaaggtggttgttaagcacatggcagtggggcacgctggtcttggaccatcatgcgacttggattgcattggagaatttgaggtcccaacggcgcgaaagagccccagacataaagctgtacaataactataatacaggcagatctgacaagccgcagatttggaaaaagctaaccacaatccatgatgaatatgcatactggccaccagtgacagtgagctatccagtactggattccataccaaataaccccaagtcctcctagtcattgcccacattcaccaatcaccacacgaagcagctaaatactaggcaagtgcagtgatactactttggatggatggagcaaatggctagagcaattcaccatgtaaaagttcaagattaacacatactagtgtatatatattgacaaatttcggatgccaccgatggtccccaaattcacattccgatgctccgtacgcgcagaatttttttttatcaggtaaccgctagtgcaggagaattcaagccaatcatatgcgcgaaagaagtaaaggaaaaaaaaacagaaaggtgacatgagaaaactatcatctccgatcaatgcgcaaatgcggatcaaaacatactaacaatcggctatacggctagcttcccctccccaattacgaacaaaaaaaaatgcggacatctcatccatgtcgcaggtacagaaacgatcagcgcgtgcagttattagaggagaagaaaatcaacaatcaaaacagcaaacgaggccaaccaaccaacccaatatcgaatccaatacgacaccgcgaaatcccacaccgcacaacagcgcacacgaactagattgggggatgatgattcgggccggggaagcggaacggcggaggtggtgggggcaaaaaaaaataataatatatcagaatgctcctcacctcacctgcctgtgcctgttgcaatttcgccgcttcagttgccgcgacgcgagcccgagcggttgccgactccaaatccgagcgggaggatggatggacgacgaacgtgctcgcgttggatcagcgacgcggcgccgcccgccccccgcgggcgtgtgcggaatgtccgtgcggcggcggcggcggcggtcgtcagcggcgaggggcggtggcagtggcaccgcgtgggggtggtgggtttttggttttttggggtggtttcgctgcgggctgtttatatcaacgtgcatttcgaggcaccctctctcgactcgagtcggttcaccgcacgcggtcagcctacctgccgctttccacggcatctcaaccattttttttctccaaataacgagtcttttttaaatttttattatgtactccctcttttatattataagggctgtgcaccacggaaaatggaacggttaattagcacataattaattatatattagttattttttaaaaaaatatcaatatatttttaaagcaactttcttataaggatttattttgcaaaaaaaaagtatcgtttagcaatttaaaaagcatgcgcgcacaatagaaataagtgagttgggaagtgctaggtcatttattttttatcaagattgtaaaatatataacaatacgtatagcactaaatttatttcattacgtctagcttctgatagttttttttttggttgaaaacattgctataattttctataaatttaatcaaatctaaagaggattgacttaaaaaagttaaaataacttgtaatttaaaacagaggtaaattttctataaatttaattgacttaaaaaagttaaaataacttgcaatttgaaacagaggtagtatatttaaagatattttcagaatatatagggttacgtttattggattcgcctaatagcggcaacgaaacataattttggatacgacttttgtatttctacaattagtgatttcaaattaagttcagaaattaaaattaaaaagcacctataataatttaaaattaagtttaaaattttaaattttagctttgacttaggctgcaaattgctttagcctttcggatggaagtaattaggatatgattaattgagtaataaatgttatacacttgaaaaatatatttatttattttccaaaaaaccttcatatatatatatatatatatatatatatatatatatatatatatattctaaaatatgtacttccttcgtttcatattgtcagggttacgggtaaggtataccctctacccttcgatatacgtcacatatcgatatggtatacatacgcgtatacagatgttttcggcaacctccgacgatatcgcctcatgctcaatccagagaagtgcacgttcggagtaccattgggcaagctgctcggtttcctcgtctctggcagaggaatagaagcaaatcccgaaaagatcaaggcaatcgaaaacatgaagtcgcctacaagactaaaggaagtacagaagctaaccggatgcatggcggcactaagcaagttcatcgctaggtgagagagtgaggacaacctttcttcgctctgctgaagaagcaagacaaatttgtatggacacaggaagccgaagaggcattcattgcactcaagcgctacctatcaaatccacctgtacttgttgccccccaacctaatgaagaattatttctctatatcgccgccacgccatattccgttagcactgtcattgttgtcgagagagagaaggtgcaacgaccagtctactacgtcagcgaagctctccacgacgcaaagacaagatatacacagatccgaaaactgctctacgcggtaatcatgacatcaagaaagctacgccactacttccaagcccacaaggtcacagttgtatcctccttccctctcggtgaagtcgtgagaaacaaagacgttgtcggccgcattgcaaaatgggtagtcgagctaagccagtttgatgtccactttgtgccacgaacaaccatcaagtcccaggtactcgccgacttcgtagccgattggactatgcctgataataggtcagacaaccaaatcaacaacgaaacgtggacaatggtgttcgacggcgcactcaacagccaaggagcagggacatgattcatcttgacgtcaccttcgggagatcaattcaagcatgcaattcacctcaacttcagggcgaccaataacacagccgaatacgaaggactactcaccgggataagagctgcagctgcactcggagtcaagcgactagtcgtgaaaggggattccgaactagtcacgaaccaggtgcataaagattacaagtgctctagccccgagttatctacgtatctcgcagaagtcaggaaactggaaaaaaggttcgatgggatcgaggttcgacacgtgtaccgcaaggacaacatcgaaccggatgatctagcacggcgtgcgtccagacgagagccactcgaacctgacacctttctggacgtcctgacaaggccatcagtgacgttgccaccactcgttgtggcagcagcggcagcaacatcggacgcctccttggcgacgtcctccttcagcgacgccgccgcctgatgatccacgagcggcccgatgatatcagtcagagggagagcctacgcttcatgaagtcacaatgtgatcccggaagtaaaatgcaaaagggccgctgagtacacttacattgatggcagcttcgcgttcgactgcccccttctcgcaaagggggacggggacgttgctcgtcgttgtcgggccgctgatcatcaattggccgacgcgacgcttcacggttgcgctgttcaagcctatagatcgagaccagaattcgataagtcaggaggaacacgcacataagggagtcaattcaactacaaaaaaaataccccgaggagaaacccgggtcgcgtcctccggcctagaatagtcaaaggctgggtgggctcaagcctagagcagctggatccgcctaccaatgaagtcggtagtgacttcataccccgacaacccccgttctcggaggtcatcaatgatatcgacgaaagatttgagggatggggtcaaggcgggtttggcagtccaagatgaaatcttggctggttgctccttagaaacaatgaagaccggatccgaatcttctatctgaagatagaaccacctcccccgccatttgctgcgagatgaagggcactggaaggggatgtatcgcgacttcaggccatcccgaagtcggaaaccgacacatccggacaccttttttggttccatccagcgcaactcatagtaaaaacggaagaggtcaagaaacggctctaccccaatgtaggcctcacaaagatgcgaaaagatactgaggaaggcgatggaattggggttcaaatggagcaagaaaaggctgtagaaattcaagaccaagagaagaaattcagaaggcggaggaagaaaaccataaagaatatagtcctcgatcgcaaccatgcgacccaggacaggctggggttcagtacctcctgcttctctctccatggtcccgcgaccgggaagagcgccatcctcctatagcttcttcagcgacgcactggtggaggtagacttgtcgaggtccattgccgccggggttcgccggagaaaggaccgagacgagctagctagggtttttgcggaagcggagaagacgagggacgcttggaggctggagagttttttcacaaccggcggacttcaaattggatccgcaaaactcccttaaatagtcgcacttccgatggtgcgaattccaaggaaaggagagagattaccgccggaaatttctgggtccattacgcgcagtagttttttggacttcaatttaaattcactcatgaccattgagcttcacagggcgttgtcgatcactccttatccctcggtcctcacaccgagaacaacaacaacctcgacatcagaagtcacgatcggttacacgagttcatttaagcagaagtcgggggctactgtcagggttacgggtaaggtataccctctacctttcgatatacgtcacatatcgatatggtatacatatgcgtatacggacatttttggcatacgttaaggaaattcatcatggagttcacaaatggaaggagtcctactcggacagaactgggtcgtcattgtatcgtgctgggtccgatgtctccgagtcctacttggagaccagttgacctgcgatataaaagggaccccccgggaggacctaaggcatcgaatctcataatcaaggcaaccaccacagcctacgaagccggagcctacaggagccaagtcgccgggtgatctagtcgaatcaactcgactacgatctcgtcggtatcgtcgagttccactatcccccttgtaatctgtggtttccatcatataatctcatatcaattggattagggctattacctatcaaggggcctgaaccggtataatatttgttttctgcctacttgatgtcgtattacgtagatccttgtaccagcgtacccatagtagattcattaacatttatataaatgtagtcaatgctaacaagtcttataatatgaaacggagggagtattgtttatgagattagaaaacgtgctaacgataaataagaaagcaaaacattcccttgcaaggcaacaattaaagcagtgataatgaccgttaataaaaagcagtgataatggaaaagatattccctccatcccattttaaatatagatatagttttcgtgtccaactttaatcgttcaacttatttaaaaattattttaaaaaatttaaaagtataagtcatatgtaaagtaaagtattgtttatgttttatcatctaataaaaaaatactaattataatttttttaaaataagatgaataattaaagttgaataaaaaacttataattgcattaaaatggacggagggagtaggaaacgaagaattcgaaattattcacttggatcatgaggtgaacgtactggtcagtggtctctgggaatccccgaccctggtcattccaggcagaggctgtcggtggtggtagcctagtaggtcaccaccagcgtcacagaatcggattaggcggctctctttagccggtgattaaacaaaactacacgcggttctcacttgtcatgcgccgccggtgtgatagccgtgcaacggcgagaaccaaacaggacacacggtggccggccggctggccgccggcggcaacgtgaccactccagctcaccgtcgcagcaatcgctgctcactgggctccacattgtacgcccctgaacactccaaattaacacgtctatactccctccgtcctctaatataagagattttaacattttatttacgctgtttgaaaattcgtcttattcaaaaaaaaatttggaattattttttttacttactttattatccaaaacactttaggcacaacttttccttttttatatatttgcacaagttttttgaataagacgagtggtcaaacagtacaaacaaaatgtgaaaatcaggactacttgaaaaaaaaatcggcagaaagcccaggttaaccactaaccacctggcagtgttattgctactaaaatggtcataatacaccgtagaatgtagatctagtggtcggaatatttatttctttatcttactaaacaaaaaatatcaactgaattccttgcttaaaaacactatcatgcgctagaataaattcagtaggtctcctctttgttttatgcggtccctctgatctatatttgtggtctctgtttaattatggtataatcgtgaaccttttttttatttgtctttgtctcattgtgcctttcattttgagggcagctagcccacgggataccgtggaaaagtgatgtcacgggataattaaaacacacgacaaaataaaaatatagcgtcctgcgtccctgttgtcaacgtgaagaggcatgatacctagccggctcctcatggtatcgcacgcttcccttgccggtgttgtgttgcctttgcagctggagaagcacacacctcctcgtcggcgtcggcgccccagagcagcgggagcagcagacaactcccccgctaaatcctcctctttgcccccaccgacagcaacaacaacagaaggagaagagaaacgttgaggagaggaactaaggaagggagaatagaagaggaggcaacgaacgtgtggccaccggtcagccaggcggcgacggcgacacgacgtgctccccattcccacacctttgacctggtacctgtggtactaggtacaataggtatcaggtaccaggttgtacttgataactataggtatctggtatctgataccatgcacatggtacccatggatggtacctaggtactaggcatctggtacctgataccatgcatatggtataccatgcctaggtatcagctcgatacccagggtaccaggtatcagtcgatacccaggtagcaaggcctgatacccaggtaccaaggcttgatacctagtatcagctcgatacccagggtaacaggtatcagttgataccagggtaccaggtatcaggatggagaggaggtagaggttccagagcaggttgtcgtcggcgttgcggcagtcgaggcaccgggaccgccagcttcttctgcttctacggtggcagcggaggatccatctacgctcaccggcaaggaggcggcaggagcagcgggcaaggacagcggcacccgtggctcacgagaagtaggcgatggagaccttggcgaggagcacgagggaggaggggagcggccccggcgccggcagcgacggggagcgtgcgcacggaggcgacgccgcagtgggcggaggacggcgtcgaagaggcgcggcgagatcacccccgacgcccccttgacctcaccgacaaccccgcaaaaatagatctattgttatttgttgtcgatgtcaccatggagtggtagagtttgtgtgaaattcacacaaacaacaaaataatgcccatgaaacttttcagagtaaattacatccgattcaatcccactaaggtgatgttcttttataaggaatgaaaccattctatttaacggcacgcttcccgaacttctaaatagtaatattttcacagaaaactttgttagtatatatgaatttcttacgaaattagtttcaattatgtttaatcaattattttttaccctcgaataattatcacgaattattcggctattaaaaaaacaccctaaaacaaatccatgcacgtagttatcccgccgtcaaatattcagagtcaagacaacaatgaagctcatgttcaagagatgtactactgatacccgtatgccttaccagtatatgaatagtttttttttggaaattagcacgaaatgattgacagcattagtacatcccagtgtgaccaaagagcagatggatctacgtacggagcgccgccgtatggcttctagtacagggacgcttcgcttgcatggttagctgctcacacaagaggccaaggcataattaagcggaaaggacttcactatagtccagctgccattgtgcgggaccttttggagccggccccacatgtcagtaaaaataatgtgattatataagtttttctgtatgacagtatgagggtgatgtgatgacgttacatgacacttggacggtggaaatggaatgttcttggagacaaagaactatgatgctaaaggaagatttgtctcgcattacagctttatcggattaaaagcattgcttcgcccattacagctgccaaacaaagaaattttaggccaaaagaatggccggaggcagagaaagataagatgacatgcagcgatgcagacgttgcgactactcaccggctcaccgcgagggcatttcatgctctaccgacactgtttgtggcacggttttacctaggccagttgagttctcttgtaacaaattaccatggcatatgcttcccaagctcctaaccgatatatatagtcatgttcttttcttcaacaagagttggatgaaaattaagattttcgtggcacgcttttcaaactgttaaacagtatgttttgtgagaaaactttctatatgaaagttgctctaaaatatcatattaatctatttttaaaatttgtaataattaaaactcaatcaatcatacgttaataccacctagttttgcgtaaaaaacttaatcttcatcttcattttcaggagaaaagaacaccatatatatatatatatatatatatatatatatatatatatatatatatatataaagaattctatatataattttcttaaaatattattttgaaacaactccaactttgtaataatggtaatccattcgcttgtatcccctccgtcccataaaaaatcaatttagaataagatgtgatgttttctactcccttcgtttcacaatgtaagtcattctagcattttccatattcatattgatgttaatgaatatctatctagattcattaacatatatatgaatatagaaaatgctagaaatgacttacattgtgaaacggaggaagtagtatattgaatttggacatgttcctatccatattcattgtactaggaaacgtcacatctcatctagattgattttttatcgaacatcatcacaaaattagaaaatctatcacccattcatctatattcaaaccaaacaaactaggccttaaatgcccccagcatacaggaacccaccacaagtcttttatggatggagtgaatttcaatggaatatgaaaccaattcctaataggagtgagtgagtgaccatatcatacataccatttggagtgcaaaagccagccctaaatttttatataatgcattttgtctccagtgaagacttaaaagtagtagggagttccaaacatttatctctctatagtagtatactccagctgcttaaggtgaaatcttgctagaagaaaaggagagacaagtacgagtagtatacagaaaagaattgtcatcatagataatggacggtggacagtggttggttagcattaagtcattaacagctttgccagctattccctattccgcatctgcacattaaacataatggaccacaccaaaaagttctaggacatgacaataatcaagctatggtaattgaaccacacagaagactactccatctgaatcaacagaaattctgtaggaatttcatggcaagggagattactacaaatggggctttataagaaaattcagcggaaattgaagttctgagttaaaaataccgtgcttgcaaattatggaccatctgcatggaggtcacacagacacagcagatctaaactacagggaaatttgagaaacagaagaaatgtgctagtgtcgcgcaaaaaggcaaggagaaaaataataaaatgcagggcagagataacaaaagacgaaaggaatccagtaaaaggattggcagaactgttcaaaagttcatgaaagacatatatagctttggatctacgcaaaagttagcatctgtactcatatgaaggctatgagtatgtacaaataattcatgaaagaggtctcataaagatgcgtcctgaacaaagcaagcgaataaatctacattgacataaaggatgaataagttgtcgatccaggtctaaagtgcaagacaaatggtaaagcatgaaaagacaacatcatcgttttgtagatcccaaattccaaatacctacattccactttgagcagtaactaacagtcttacagtactgagactggctaggagcctaggatggctgctcaaagcataagaaatcaccaggaaacaagaaatagtccttacggtgtgattctctatgttactagctttgatgtaagaagaaaatagatactatatgtggatatgcatcttcctcatgcgcattatatcagactagcaatccagtttcatatttcagtggcatatttataactcactcgtctgcttaattagacctcagaactttcagttcacctcaaattcatctagcattccatggtctgctaaaagttagaatgccaacacagtttgacaatatttttgcttacagtagtaacaatagatggcatatgtgaaaaacacaggttgcattttgtaaagaagaaatatgtaacagagttgcagtggtgggatggtgtttagtgtctacagtctacacaggccaagacactaaaacattaagtgaagtacgtacccttaaaaagatacaaggttgttcaaatataaagcataaattgcaggatgctccattgtaggaaggaacaaattaatgccagattctgggcctaaacagatttctatgaaactttcaccaaggcagtgttttcccctccacttatttgctcgtaaagtaaaattactagccaaacatattacacatggcaggaggcaggcaactaattccttatagagtacagagcacaactgattattttcccaatttgctgcataaaagattgaagcttctacaaagtcaatcaaacctcgtaacccagagatcagttaaaacagttaaatggaattgctcctatgggcaataggagagaaatcagggtttaaaattatttccccaaaaaaaagtgaatgtgataatttttagaagaactctacaactcgtacaacatgcaagaacaaggttggaacttgacattgaagaatcgtcagctccatattggttatgtatacatgaaaaacattcaaacagcagaagccttgctgggatagcggaccttattttcatgggcattattcatcatgataacaaatctgatcagctaaaatattcaaaattgaaaaaaaaaatattttcttgtcttccctaacctcattgttagttttaggcaaatgaagtattgacaatgtaaatcttcctactcaaaggaacccttatatttctctgtatgcgtgtttacaattgttgtgtttagcaagatgccaagaaaatggaaaacaaaaacaaagcactatggtcatggtctatggtagtagctaaggaccctcgatatcatgctatctgaccttaatatgtgatatgctttcatggttcaccaggcgatggtgaaagtgtgtcctttaaaaactaatgatattatagtgcatgtcgttgatatacacatgtttcatgtgaagtgatagtatgcaaacggatatgttcaataaattgatagattagttggcaacttggcatcaaatgaacttgagagaaatttaagcaccataaacaggagataaacaaataacagccaccggtgctacagtacgaaatcattcattgtggcatatttctaagttattttcagatagcttaaccgcgccatgatcagtttagcaacaaggtaacagtcatcatatttggcaagaggagtagctattcgtgtttagggtttggcttcagcattcatcacgatgatgctcaacatatttggtaagagggatagttattcgtgtttagagtttggattcagcattcatcaagaataagataatgcttaagcaacgttcaactatttgctcaacctaaccccaacatgcgatctgcaactgagttagttgggaacgggtgaaattcacgaaaactctcagagcagcacaactaaaggaagagaaaataatagaattacaaagcatttcaaaatgttcagggcattcgccatcattggacaaattccacgaggaaacagaacaaaaacagaaacaagagcacagtgttcatcccgcacatctcaaacatcttattgggagtaaaacagatgcagtattctagggttcgaggtgacctgaggcgcgcagatcactcggcctgggcctccccggaggccagctcctgctgctggaggcgctcgagcgccttctggtgcgcccaggtctcgagggtgaggtcgggcttggcgttgagcccgacgccgaggatgacgacggtgaggaacgaggtgacgtagcagggcaactcccagtcctcccacttccgcgactcccccgccggcggcggcggccggttgaataggtagcccttgggctgctcctcgtgccccggggtcgtccaccgcccgcccccctccccgtgcccgccgccgccgcggacgcgcgccccgccgcgcagccgcgcccgcagcatcccccccgctgccgacgagatcgcccgcatcgaagcccccccggttggtgcgcgcgcccgcgtggtggtggtggtggtggagatcggggggtggtgtggagatcggagagaggtcgccgccgatttgggggagaaaggggaagagttgctcagctacgcggagacaatgcagaggtgaggagttgcaaaatgggctgggctttggtcaagtacattgggccgggctgaaaaggtcgggttaataatcattatgggccggatttggaggtttggactcttcttctcgattttgaagctcccaatgtttcgcttgggtttacgcttataagctactccctccgttccatattataagacttttttggtcttatctagattgattcattgattaatgtactccctccatcctaaaatatttgacgccgttgacttctttaaaaatgtttaaccattcgtcttattcaaaaaaaattaagtaattattaattcttttcctatcatttgatttatcgttaaatatacttttatgtatacatatagttttacacatttcataaacatttttgaataagatgaatggtcaaacatgtttaaaaaaaagtcaacggtgtcaaacatttagggaatgagagagtatatattttgtatatatgcctagatttattaacatccatattaatttggataatgctagaaagtcttacattgtgaaacggaggaagtaaattttaatttttagaactttattttagagttgattttgtggttttttttcatcgtagtttattttacaacattttcttatgaagaacacgtacataaaatttactaacaaattatttttaaattgctataataagcagttcgcataagcataagtataagcgaaaaaatgagatcttttttgtatgcaaggttggaattagtagttatctcctaattccagaaaatttgaactgtttggaacgaaggatttttgaaaattttgacatcctgacagcagctatggagaaattttttattttcttgggaaaatttgcagttcagcgggaccaagatctggaactaaaatgacgaaactccatggaacttgatgtgtttttttttcaaaaaaaacttgatgtgtttgcgcttaccatggagaatgcacagcgcagctgactcactgaactcaacatcgctttatggagtaagcaaggtaacaggcaaacaagaagttggaacagaaatatgaacagacaagaacattaaaattcgaaatccagatcagaatgacagcataggtttattatagacaattgagattgaatttgattgtatctgattcagtcagttcagtactcagaaatcaattcagcagccattctcgcccattcgctgaagcttacagggagttgggacttgaggatttttattgactggtaagaaccttatgccattcaagcgatgattatcaacatggtaagaccattgcctttcatgtgatctttatttacacgtttcagaaaagaatcaccactcagattgtgatacagatacttgtacaaatgtgatgttcagtaggcttgctcttccattacctactgacagccagcgattgccagtcatggaatgacagcttgtcgactgtcgatggctggaagaggagaggatcaacatcccagcctttgaggcttcctcttgaccatctcatcctcacattgtcgatctcaaggccagagatgtgctccagcatcataccaccggttcggtgcttcaccatcttttggcatccaggcctgtaatcatacagccctcccgagtagtttgtccatctcttgtaggttaggtcgacattcttgaacttcaggttgcgaagcagcccgtgcttcgatccagccaagaatactccgttttctgataccgatgagatgttgatgaactgaatgtctgaaatggtgccttctttggaatctgggtgccttggacatgtggtgatgtagatcggttcagctctcccccaccataaaggatggtagtacctggtgctcattttgatgtttgagaacaccacatcgctcacatttcctgcaggaatgaaaactccagtttagaagaggcttaaagcaaatctcatttctagaccaaagaccttaatggtgcagtttttacttgatgaaaattcacaatagaaatatttcagcatacaggataggttcgctgctgtataaaaatttcatggtgctaaagcaatttataaattctatataaacacggggtacaaatgcagcataaggttcagttttcctaaaaaaatgtccgtgaaaacaatctaatatattttaattgctgcggaaatcttatagcttgctagagaaaatagtaagtactacctaatatcacagaatggcaatacacacaacagcaagtacaggtcagtacctccatctctaatctgcatcccaagtcctctatgtgaatcaactattgtaatgttgtcaaataccagcttcttgaagtcaaagaagctagcgctgccaaacttgatagcgcaagatttagtccgtatccagcagtttgttgccgtcaagttgtaaacaggacctgtggttgatttggggcatatcgcatcgtctccggtgtctatgtggcaatgagtgatggccgtgttgtttgaatcctcaatgtcgatgccgtcgttgttgggagtgtcaaaatccccatatatcgacacattgtggatcattgtattgtcacacctgacaatatgcagactgcagggaatgcaagtgcatatagcctgttaactttccctgaatacctcatcactacacaaatgctgtgtaatttttgctaatcagatgatatctagggcagtggagtacaaattagccggatttatcatctttaggatgaaatgacaagggaaatgttgtcatgttttggctgttctactacgaattgagcaatggatttgaggtatcaagaaatgctcaccaccagtaggcaggctggttgagggtgatgtcgtggatcgtgacgtccttggagtcgatgaatccgacgagccgcgggcggcactcgtcgccctcgcagtcgccggtggcgttccagctcaccatgatgttcttctgcgggttgggggtgaccacgaatgccccgccctggccgttgatctcgccgccgccggtgaccccggcgccggtggtgttctcggcgaggacgacgtaccagcggcgggactcgggagggtagtccgcctgcctggtcccgcccagcagccgcgccccgggggcgacgtcgagcaccacccgcgagcggaggtggacggtcgccgtcaggtagtcccccggcgccgggaggaggacgcgcccgccccccgccgccgcgcacgcgtcgacggccgcctggatggcccccgtgtcgtaccgcgcgccgtcgcccgccgcgccgtagtccgcgacggagaagacgcgcgcggccgccgcgaacggcagcagaagggacgagacggcgagcggaagcagcagcagcagcggggacgccattgtgacgttgactcgctcgccaagaagcactctctcttctcttctactcgagctgcacaggattcgcttgggaattttgtcagttggatcggggtttcatcgtgtcgccgccgtggcgcggacgatcggagcgagaggcagggagttcgttgcgaggggaatggatgatgagatggataagctggagtggtagctgcagctttcgtgctggactctcactcgagatgatggataatgggattcatggatcaatcatactacctgatctcaaaatgtagatcacaggtgttcttggttgcctgtacaagtttgagagttgtggcacgaggttgcacggaaccagatcctctgaagttgggaaaactactcccttcattctaaaaaaagacaacatattacaacgaatctggatacagaggttgtcttttttaaaaaaaacagagagagtacgtcagtagcccatcgatcgaccgtttctcaaatatggaacgctcccaagaaaaatccaatgttgtccttgctcgcacgctagcgaacatgatagtgactgcgagcgatggcatcattggcttttttttttggagcattccatactcggaggacaatgaattgatacaccactgccctctaacatagtttttctaacatcagagaatgcggtgccaaggttgcacaggttggatgggtcgtggatagggctggaaaaaaggatgatggcactttagctcgcacagctcggcttgtttgggtttgttaacaagtcaaaactaaagtttaacctactcgtaaatctcaacttaactcatcccccatccactcattgtcacaccactccacttggtcataggcctaaatatttagactgactttagatgattatatgaaagtatgaaattaatggtgcatttgctaaatttgtgatgatttaatacttatattgtatgcaaacatttgtaactttgaaatgatgttggttcgaactgagcgaggcttttggctcgtaggataacgagccgagctgaactggcttgatatggagccctagttgtgggtgaaatgaccagtcatccgtgctttgaatggtatgagtttctgtagtagcaactcaccgagacagaaaacacaattggtgatattataaacttgaaaaattgatttatttttaaaaaatgtcgatatagatggttttgaaaaaaaaataccatttagcaatatgggaaaacatgcttataataaaagagtgaatagcttccctgtagcacaatcctcataaattggagattctgccctcctcatcaacaatcctctctttctttctcccctttttctttccccaacttgcgggatcggtggttggtaatcttgagatgcttgcagatgtcgaggtgctttcggagcagacgctcgatgccggtaaggaggtagatgacgttaaggtacattcaagaggccatctcgatggagcaggcgagcatgttgcagtataaaaatttatcgtcggcgcccttatcgatcccttattgtcgccatcgcatcctcgtaagagccctacccggagagacgacggagccctggaagcggcaaggttggaggacctcatcccctccccatcgataccctaagcatcaccatcggtgttgagggagatggggtgtggagctctgggtggacaacaagcggtggccggtgaggccaaaacagcaagggtggcagagcttggggaatcctacatcgactctgacttcccaccttgccgccccgccactgccgttatggagaagagggatgataaacggaggaggtagaggtagctacacgaagaggaggtaggcaagcggtggccctccatgaggcagagaggaagggtgtggaagtgagggagatggcatcagtgctgggctcatcagcctcgtctccaccgcttgtcgggttcctgctgctatctgcaaaagaaagaagaaagagaagaataagagtgggctatgacaagtgggcaccacagttgtttactttcttttgtaccacttacacttgaatcctctatctatttttggttcatcttatgactagactgccattagatgccaaatcactgaaaactatcctcaaaacagtcaagggggttattttaaaatattttaataattaaagtggtagataactagatataccaagttttgcacttgaaatgtactcctatatgagaactcacattagacttttcccccgccgaacaaaatcgagcctcttctcttctcgggccaccaaagaccaaacaaagctgggcctccgtgtgggcctcctcggaataggatcgctaccatatccgaagggtccacctgaaccgtccgatctaccatgcgcggtggatatcgattaggcgtcgtctcatcgtcttcctcctcgcgtgcggcggcggcgcgccagtggccgtgactgactctgcgccggcggcggcggcggcgtgcaccggcgaatcccctcgcgggaacggaggtctaaagcctctcccgccaccactatcccttcctcttcggctcacgctcccgtccccaataacctccgctttcgtcagctccattcttgcaggcgtctctcctcggctccgctcgcttcggacagtccgaaggctaaggtgcggattttacttcattatcctctgcaatttgtgactaatttgagttactactatcttccaatttatctgctctcccgggtgaggggaatggtttgggtgcattggcacttgctgaattcaattgtgcatataatgcattattttccaccagcttagggttgtagtcttgtgaattcgggcatgggaatggcctggtagcacgaaatctcggcttcgcggccaagacaggaacttaaataatcttaatgagaatagttttctagtgattcgctgctgcccatgccctcgaatgctcgggatttgggagggcaatttctccctgtagcacatcctgagaagttcacgaggataatatggattctctacgcaagtgtgacaaagaaaaggaggacaaattgcttttgttctagcaagtgtgcgcttatgatttagcatgcccatccttcccattgttttgtcgaatctcagcagaaagtggtcgattgctagaggttggagacattcagtcttttatgctcactaataactatctgccacacatttatttcctggatatgtcaacgatgaaactattttttgtgctgaaaaataatttaatcctcttcaattgatactaatgttgacatcaatcatatctatcataggtccgttgtgtcatggtggatcttctacttcattgtggtggtggcttgctttatttgattttcgtaagaattatctcatgttccactaattcttaattttggtcatcgaaacatgtttttcagcttatacttggtggcgcggtgctgcctgaagcagatggctatctacacacctactgtctgtttacaacgctgtacttatagcttgtattctcagtcttgtcagttacaaggagggctgacacagggcatggcattatggaagtattctcgttcacaagcagtcggttatcatgtaaagatcagattagttggtttgcctcctaagatgaacataaaatcactgcgaacatgttttgccagttcggggaaacagttgtgtggcagacaacctgcgagggataatattctaaagctaaagcttgatgagccctcacgtcagaagttgtatagtattctctgggattcaagaagcataggacacaaagttggagctacaggcactggacttttcctaagttttgcagttcctgcgaaggcaaatgctgagggtcctgtggacaataatactgatagcccccaaactactgaatcgtccactagttatgctcatgggaaaaaagtttgcacggattattctgttactggtgagacagtgtgcgtgtttttctaattactatacaatatgcatttggttaaagcatgcatcgtctgctcacttgtgtttgattcacatggtaaccctcaggcattcctggagatggaaggtgcttgttccgatctgtggctcatggtgcatgtattaggtcaggtaagcgacctgatgatgatctccagagaaagatggctgatgacttaagagcaatggtatgcttgtaatgttctgctgatgtactactgttgatccattctgttcttagatactaaatgttgctctggaagcaacgcaaccatttctggtgaatttatcatgtaaaagatctatttaaatggtgtcactgttaggtcgccgatgaatttatcaagagacgggcagagactgaatggttagttctacctgtcctcattattctgttagttactctgcatctaaatattgttgagttacgcattcttatgcttcgctatgacattaattcacaggtttgttgagggggacttcgatgcatatgtctctcggattaggaagccacatgtgtggggaggtgaaccagaactgttaatggcttcgcatgttcttcggtgagaattagccatgatgtttggagttattttactctcaccatttcaaatgcagtatacatttgtgcagtaacctgttagaatacttatgccctcttggtcatatttatatagggttgatggttagttggtttgcttttaatccattttaggattcctgggataagtttgtccacttatactgtcttgtttgtttgtttttttttgtcatgttatgactgttaagcatcttccttttttttttgcggggatcttcctttttttttttcaaaacacaactcccaaaagtcattaatattccattttgttaggctttgaccaaagtttattaatgtagctcaacagcaatagtggatagtttcatatatgtgtagtcttgttgtattgtccttctgaaaacgggaagtaacaaaagctctaatatgccgttaccaatgtggccaggatgccaattactgtgtacatgcatgataaggaagctggtggtttaatagcaattgcagaatatggtcaggagtacgggaaagaagatccaattcaagttctttttcatggttttggccattatgacgctctacagataccaggaaagggtggtccaaggtcaaggctgtaacatttggagctcagattccaaacagtaagttttgaaccaacctttgtttccctttcttttcccagtacgcttgctgtccaaatgtaaccagaatctaccctcaacaaatttaaaatgctgcgatgttccaagttccaaccgctgaatccatctcttcttctattttggttgcactagcctcccttgtagtacatgtcaaaaagaaacttgcatgtatgcaccctggctggctgcaagcagcttgagtttgcttaccctgcaaacctctctgccgcgtgagccggccggtggccacaaggcgacgccgtctttggtcaaggctgtgaggtatccggccaccggcctacccacctgagccgcggtcgtcgtcgtcgtggtggtggtggtggttggcttgcactggtgctagaatgctagatcctatagcctcatgctgttgtgtcaaccgggagggaagcttagcgctggctggcgatctcaatcttgcgccatgcttgcctgcccgggccggtgtttccccgtacggctccggcttcacttccctcacatctatgcagtacgggggccctgcagttacgtgggcagctaccacctcttgtgcattgaaaggccaataaaaactggacttggcatctgctactcaggtctgggctggttgtctaactctcatgtgtttatgtgggcattcagttcagatcagagatcagattggagtcctccctgtcccccaaagaagtagagggctttcacctaactaaatttgtgcaagagccatgcactagcgtccaagtaattaagagagaaaaaatggttatttgagtgtaaaaaaaaagattatactcccactgttccataatgtaaaatgttttggtttgtccaaagtcaaacttcaagtatgacaaagtttatagaaaaaaaatagcaacatttccaacacgaaacatatgtcttttaaaaatatatattaaaatgttgatttaataaaactaatttagtactgaaaatgttgttatgttttattataaagttaattaaaattagataagtttgacttagaacaaaactagaacatccattatggagcgaagggagtattatctaaggtgggtgttagaatctgataccgggttgtgaaaatattattatttggacagcaaaatattgagaccaccacactaactaattgaattccttttgcaaaataaatatccatgcaacctttacacataattccgttatctttgtcttttcatcctttcatgctcctgtagtgatacgccctgaccaaaggtgccaataatgtgaagcttatcccaatgaaagaataatgtgacgtgattttagctaccgagaggaatagtgttcctgcaccacgatcactttggtaattggctgctgagagtaccttcctttggacctttctaagacataaaaatttgcaattgctgtcaggattcaggagattattctcaggggaatatatcacagaacattagtacataaatggtatagactgcttcagataataatgcatagatccttctgtatattcgaacaaaatgtgagcattattgaggaatttccaccggtaggaataatgggaacattaggttccagaaacggccaagttctcgtgaagatcatgaagcgctcatggcgacacatacatttcacaaatcctttggcactaatctgcagatggtatattggtattatccactgttcttgcagataacttcagaagatttttcttgcttgcaacaccttcatccattcatccatggtgaggtcgttctcgtttgatcaaagataccttatgccatcaagagatccttatcacgataattatgccattttatgtacaaacgcacatacactccatgactccatgcattgggggaccttttactgccgttggattctcgaggaatagcatcctcggatatggttcatcactttatcaatattagagcacacgattcttgatacgcctattctcgagaatagattcataaagagaattattgtttagtacatgcccataataatacattttctaaatatattacaagtgcgggcattcatatatacgcgagcgctcttacccttgaatacatctttccatatccttatgagcacctttgaagattgggtttatcgaacaaacaaacatgtcaacgttagttcatggatgatacaagggtcttcgatcttagcttggcaacatccgaatacaatttctacctatgtaaaatttacatgaagctttctaactgctacaagaaagtgcatctaaaaaaaaatccttcaagaaagtggaaacagagtaaaaaagtatacgatctacagcgaactaaaaataaacatggcaactttttccaaaacaggctgtataatataggatgaacatataccgacttcaaacatgcatattaccttatcttgcatgccaaattgaacctattccattcatatttgacatatctcaaaaacacatgctgctgacacttgctacatgggagtgtgttaacacgccaggttttatatgccaagacggatgggaataatcaccgacttaaaaaaaaagagaacaggaatcaagtcacaatatatgatgtactatggagagagagagagagagagagagcacgctaaaaagagcccccattttcactatagaagcataaaaacatcatatgttacttgacaaaaatcagagagacatacacacgttggccgtggtaaatctagtaatgatgtaggttgatcaataatgttgtatagaaaataaattgtgtatataaagagagtaagggttacgcatcaaatctatttctacttttaaaatctaactctgtataaaactgcataagaaatactagtgtagcattatgtcctattattatctatccctaatgtttgtttttacttatccgtcccaatcaaaatttatattttaagttgtctttttatattttgttatcataatttttttcagcgtttgcttttagatcgtgaagaacccacatatataaaagttttacctataattaatttatatgtctaataagcattttagtttataatcaactatgaacgaaatgttggaactgattgtgtcatcatccaagtggcagggtcaacctcttgatgaagaccctcctggccaggtctgggaggactagtggctgcttcttggctgcccagccggtgtcaaacccaaccgtatcacctcctattccctccttttttaggactttatgccgtgagagaccaccctcccaaactctccaaagtgtggccatgtttttgtctcttgttggctcaccaacaaaagcagagggagccacactgcctgcctttcttttttccttgctcacctttttcctgcctctcatttctgcatggataatggaacagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58862 - DNA, 833 bp, Oryza sativa
aaaagaccgaatgtaatgaaaagcctgttggttgtaggttgcacacttgcactgttttaaattcagtatgacggttactgtaaaaaaaaaatcagtatgacagtagagagacaaccattatcctgttgattttccttgcaggcatggattgcaatgatagcagataaactggatgctacattgtcaaagtcgtaagaacgcgtagtttgttggatattgtttgtatcttgcaattggccaaactgtcacgagagatgatcatctgtcactgtacatgttcaagttacaggtagagtttgcaaaaccaacggataaaacagtacagggctggggttgaccaattgttttaagccaggctgtatgattaggcttgattaagtttgaccagcatgaattgattacaatgttagttacttcttgtaaccagtcactgttggctgaatgaatcacattactgatgctttcatttgtaagatctcatcacatttcaaagagtttgcagtgaatttacgttaagaatatcctcctggaccctctctaatactcgtgatcaacagtcgataaaatggaggaataaaatgagccctaacaactttctacagttaatgcctagcaatctaaagcgcacaaaccgctgaacaagaagagcgtctagagatcaaaattgttcctctcatgactcatggtgagatcaaaactgctcctagccgaatggtctcaacatccttctcagcttcattcatccaatctctctgcatctcaaaatcatccctccaaagatcttcattcagccactgatatctttgctttcttcttctcatgggctgcaggaa

SEQ ID NO: 58863 - DNA, 740 bp, Oryza sativa
gaaattcgtggaacgaaacccatcgaactgaatcaaaataccaccttctggaaatctttggagaaggttagcaggaaagcaagcagcacatccttggaccgcttcttggggtcactcacggaagctccgaacttcttgtcgttccgagccaagaaatccttccatcccccctcggcgcccttgagcccgttcttctgggtgaacctgacgatctcaacgagcacctgacaacgaacacagcaacgcagaatcaggggagaataactcacgccaggtttccgcttgctgctgccttgcttttacctctttctcggcgccggcgagccgcttgcccattagacgaccacgtggaaacaagcaaggaagagcaggggaagggagtaggaagcaaggggaccgcgggttgcggcggccgctcgttctcgtgggcggcggcggcggcggtcgggaagtggcggcacggagaaaaccgccggaaaaaaataaaacaaaacccttctctttgctgccgcaagcgaagatcggtgggtaagtagaaaatacggcccagcacgttaactgggccgctttggctaaatttgtgaaatcgatcagtgggttcagcccacataaggtccatgtagtaaatgagattttcttctttaaaagcctatctttttatgtaaaacaggtccatatagttaggtctgcaaattaattaagttattattagtatatgaaaaaaggccaaagggctgcag

SEQ ID NO: 58864 - DNA, 715 bp, Oryza sativa
ttcacatggagaacataacaattgtctaccacaatgattgttaggatacaagttgccgggccgcgcgcgtgcaaatatggcccatgtaaagcccataagaaatggcactcaaaacggggcccgtacacgagatgcagcaggggatactggcctggcctggcctgcgcagcctctgctgctcccttctgttgtgggcctgtgctgctagaatcttactacgacacttgctcgctagcaccagtagtgtactgctggttcagatgctcccgtgatgtttacgcccacctagaatcttactagtagtaggccctgtttagttgtcacaataaaaattttcacgcacatcaaatatttgaacacatgtatgaaatattaaatataggaaaaataaatcaattaaatatattgcatgtaaattgtgagacgaatcttttaagcctaattgtgacatgatttgacaatgtggtgctacaataaacatttgctaatgatggattaattaggctaaataaattcgtatcgcagtttcctggcgaaatttgtaatttattttgttattagactacttttaatacttcaaatatatgttcgtatatccgatgtgacaatcaaatttaaaaatttaccaactaaacgaggcttactatgctagcattccaaaaactgtgtaaaattcgccgaatctagccagctgctaagtgctaacggttaattt

SEQ ID NO: 58865 - DNA, 1586 bp, Oryza sativa
gcagtctggccatccatgcccgcctttttctcttttccgggctttttgcctttcacccagtgtgcctttaccgggattgccaaaatcttttcagtaatcccatcgtgcatatccatacgtacacgcctggctactacaacgtacggcgactatgtatatatatatgcattgcaacaatttgcaattgcgattgcatgcgtgtcagagatcgccggaggccgtacgtacatggatatgtctggttcaacacattctctcttctcgctggccactgtaattccaccgaaaagtagctcatgcattccctgttctgatcgatgggcctctaacgcgtcgcagccttgttgtatcattgctgctgagtagcaaaagaccgaccgatttgacggtccccgacattgcatggtgtgtcacttgcattgcaccatgcatggtgtgtagagacgacagacactcccctgcaggcaatggacatggcatgggaggctctagctgaatgacactacaaattaaagctatctaagcctgagtacgtgatgaccagtgtgaccaaggacacaggaccagtgtagtccatgccacaagctaagcttatcgatcgatctatggatcctgatgatttgctgtaactaaacagtaaaatatgttattttgcaaggaagcatgcacctcgttttcctgactgtacccagcaacttttgcacgagaatgatgtgtgtcactctctgtatcattagctaagctctgggatgatgggctttacttacctgcaggtagtactgctgcttttgctgatatattgccgggggttatcagggtttcaggaaagccatgttgtgtactcctacatgtaatgtgttcatagagattacagggtactgctgctacatatgcagtgtggaggaatattttttcagtgcgtactggaggtctggagccatggctctgttgatgtgcagtatcctgttgcgagttcaacgatagatggaggcgctaactccaaggtcaacctcagcatcaatcattctgggtctcgctttcgtttgcatgctttgccaatcatatatactagcatgttgccgcttcatcgatggcagatatggaggtttttgatggtctcctcatcgatagccccctctctgcctgcggctaacctagctaaatatatagagcaaatatatatggcaaatcgatcttagagattgcggacaggaatatacttttctgtgttttgctttgctttgcttctagctaggtctatatgatcatgcgcaatcatatatgcaggtatatatagatggagttgtgactagctagctagttatagagagaatagcacacaatatgcaatgcattcagactagcagacagcaaagtaagcagggtaattacttgtcagacgaagactgtaattttaacacactacaaagttcataaatatttcatttgagatatgactatatgagtcgatcagatcgagcttcatatatactagaccatatatagtacatataacaaagatattttttttttatattctggagcaaatatgtaactacatttatgatggccaaatacctggtcag

SEQ ID NO: 58866 - DNA, 1699 bp, Oryza sativa
tttctccttcaaatgcctccgcccgctcgcgcccaagatctcgctgccggagccgaggaagatgatcgcgccgccggacttcgtcgtccctcgcgccagaaacgcttccaagctgctcaactacactgttagacacatcaaaccctacttgttcttgatcgatcgatcgatcaggttcatgatcgtgtatatatttggtttgcaggtgcaggtgccggcggcggggacgacgaggtggaacccgtcggcggagcagataaaggtgctggagatgctgtaccgcggcgggatgcggacgccgaactccgtccagatcgagcggatcacggaggagctcggcaagtacggccggatcgagggcaagaacgtcttctactggttccagaatcacaaggcccgcgagcgccagaagcagaagcgcgccgccctcctcaccctcagcacgctcgacccttccttgctgcccgctaccgctaacgaaaccaaagtaattaatcagcaaattaaccgaattttaataatccatgaatctgtagacatttctgcccggctaatagacattttttgcgtgtatataggaggcaccggagaagaaggagaaggacgtggaagatggattggcgagctgcaagcggcggtgcaaggcgtggggtgacggcgccggcgatggagacgcggtggtggcgacggaggcggccggcggctgcaccgacgaagtgaccctggagctcttcccgttgcatccccagggaaaagcttaattagctgcatgtgcatatatgtatactccgtcgatcgtctgtcacgcatggtatcatcatggattggccgggttgatgttgattgtggaaattaaattccctcgtctttgcgtgtgcattgtgttgtagttggtcgatcgtgtgtttggattgctttgaacatataatgcattgtgttgtggccgggtgcttgatcggaagaatataatcagtagttccaaactggaattagcagttgctcatatacatgcatgaatggtgtagagatcacgcaactatatatgcaaggtttggatatgctaattagggcttacacacgcgcatgcatttcaccaccggttattgatatacgtacttatcatatattcacatgtgtatgacatcatccaggcatgtaagggtgattgctatttttaaaaggtcaaagacacaaacaattaagtacatgttcatatatcaacaagtcacgtcaatctcataacattatttcatactccctccatttttttaaatatggcgtcgttgatttttggacatacatgtttgaccatttatctttatgtgtagatacgaaaaacacaagttatgcgtgtaccttcaatggaaaaaataaaataaataatagttgtgttttttaataatatgaatgatcaaacatatatctcaaaataaacaatatcatacattaaaaactaattgaaatactagttagcgtacttggagattattgatgcccccgcctccccttttttacttaatgggaaataaaaggtgcatgtattatccatcgggtttagtagtcctttttttatggaatatccatgctagcacaaatcttaatgcaaatcagacgatggaaaaatcaagtttttttctaacggaaaacttgtcgacgttttattaagcaaaattgttatccaaaaattaaggaaaacggc

SEQ ID NO: 58867 - DNA, 710 bp, Oryza sativa
aaagccgacgacacatgtcattgctcttgtgcaaagccgacggcacatgacattggcttacacaagactttcgtcaatggcttacacaagagggtatctagaagccggcacatgtcacattcagtactcccttccccacttgcttcattacaaatcctaccggctttcgtcaatggctagatgccggggtgttgagaatccaaactggcgtagcgatccttatgtatacctactaccaccttggtgccagcgtcctctctgcctatacggtgatcgatgccaactaatggcttcgaggaatcctgatattcaaggaaggcgcttttttaggtgccctaactatgaccgtgaggtattttattatctgcatatgcttattcattccgtatgggcaatcgctttattcttcgtaacactactctattcagcaaacccgcactacggcttgcgcatacatcgagtgggtcgatacagaaaatcccgttctcgacctaaccacttgtttacaagaaggtcgatggtatttcgcatccgaaagtactgagcaatacttacagagaaaagcggcttatgaacgacaatatcgtgaacaacagagcgactggcgggtgctacctacggcactccctccatgggaagcccgtccaagatatctacaatgatccggcgtctagccattgacgaaagtcttgtgtaagccaatgcaacgg

SEQ ID NO: 58868 - DNA, 3649 bp, Oryza sativa
tcttgctaaactgctggtgctcttagggatcctgtcttcttgtttcaccgtggagcccttttggggttttcgccatcagttctagctgatgtaccattttcacttcctgctgcgcagaaggaagcttattttgagttaatatttctagtgggtttagagttagacttctgagctctgactgcttgtttctgcatctttcttttctctcatcttcttctcttgccctccttgtgaattgtatatttgtctagatttagatgcaatcaatttgcataaatactgtctaaatagatattgtgaggttgggcctcactccagttagcaataaaacttcgttcagaggttttaaggtttactactatattcgagttgtccaaaatagtaaatgccatcaaaatagtaggccctaaagattgtcgagacaaagaagaagcatttcgtttttagaggtgtttaagtacttcagttcttttgacttctgagaggacgtacctgagtcacataaatgcctttgtaccggctggttttaattgcatcggttggtgacgcttctggatcaaagtgataggttcaatgtcaatgggcttccactattggagctgacacagaagctaaaagttgacgggcaattctgttaaaatttgttttaagaaactctatagctgtattttgccaaaaactttaccttttgaagtggtaggtacaaagagagtggaacagaacaagcttcactatatcctttactttcttttctgagctgagcatcgctttctgcattgaaaggaaaatgatattatggttagctgatgaagaaacttattaatcatgaatagtagattagatagtggtcaatttctattaacatggcagataattaacagtactttacttctgaacaatcattggttaacaaaatacttgctgagctggcatacgccagccaaagtttttattaagcttagaaagtgttcaaagggatttctttgttttagtccacgagtccaaattcttgtatttttcaaccttgtctcatggaataaaaaactaacgtgtatacgatataattatatgaatttaactgggataaaatacaacttgctttcagattatgttagcttgggatagttttgcaaagatgacttgatacacacaatttcagtttcttaatagaatagcacccaaggaaatgttctgtctgtatccaccttttgtacaatttggtgggaatatatcttactaacatttatatttcttattaatttctagggagtttagaacggcgttgaatattgatagatatttagcatctcactaatggataataaaacatggctttggagaaaaaaatcctcagaaaggacaatttcaacgaagaacaaagccaatatatcagagagggaacaggaggtacatcacttatctctttaacattattaagaagccttatgaattatgatatgttcctatctggattttcaacttttccttccctgcagaaagagaagattgcacggttagagagatccttgcaatgcttaaatgaacagatttcatttgctcaagctgaatgcgtggagaaggatgctattttagctaagcaagcaaaagtggcagaagaagcaatattaggtaaaactccattcacttttcgctaactgatacatgttcttgtttcaaaactagttaagcacatgatttttccatcctagaagagaaatggacagctgcaagtatgcagatacaatggcaattaaagttctgcaattctttttttctgcaattcatgttattggtttacaactattctaggttgggagaaagctgaaggtgaagcaatagctattaagacacaacttgatgatactctagatcagaaagccgcaattgagcaaaggatttgccatcttgatgaggctctaaatgttgccatggtagagagggagttattgataaaggacactgctaaactgatttctcatgagcaagttaaagttgagaggctggaaggagatgtagtagagaaaataaacataattgctagcttggatgccgagaataggaaactttctgaaatgctctcaatgaaagagaaaatgatctcagagttaactgaagcaaagggtgtgatagagtcaaatttcaagaaccttgaggtaaaactagagtcagcggacaaattgaattcttctcttagatatgaggtttgcatgctgcagaagcaacttgatattcgaagtgaggaaaggaaatttaacctgaaatctgctgatgctgcacataaacaacatcttgagaatgtaaaaaagattacaaaacttgaagcagaatgccagagattgcgttcaatggtacgtaaaaggctaccaggccctgctgccattgctaaaatgagaaatgaagttgaaacactgggtaacaatgcagtaataacaaggacgagaaggttcaattctacaacatcattcaactcaggcaatctagtgcagaactcctatgatgcatcacatgaaagttcttcattgcttgcaaggctgcatgcgatggaagacgaaaataagactatgaaggaatctctttctagtaaggatggtgagctccagtattcgcggaccatgcttgctcgcacaacctctaaactttcccaagttgaagctcagcttgaggagttatcaagaggtcgggttgcaacagatttagtaaaatgcagtctaacagtggtcgagaaccctctatcatcaatctccgaggacggttgcaatgaagataatgtcagctgttcaagctcatgggcgtctgccttgatttctgaactggaacacttcaagaaggggaagctgactacaccctcttgtaagagtaccggagtatcagacttgagtttcatggacgactttgaagagatagaaaagttagcattggcatgtgatgcgaaacctacagaatcgtatgattcaaggagggagtctagagaatcatcagggaaagagctagtaacagttgatggtcctattgaaacatctgaccaactccgtcagcacaagattgagaaggcagtcctgaagttgatagaacttattgagggtgttgtccagagatcatcaaaagattatagtagcactgttgtgctctctggtggcagtgagggcgaccgctctaacacattgactggctacgttgcacgtgcattcctgtggaaaacgtctgaacttacttctgtactacaaaatttcgtccttgggtgtaacgagcttttgtatgggagtacagatgttgaaagatttgtgcttgaaatcaatatcacactagactggataatcagccactgcttttcactccaagatgtatcagacatgagggagactatcataaagaacttggagataaatagcagttccggactagaagttgttccagtaattaagcacaccggaatccaaacaacagatggcatgtgtgaacccaggacgcctaacaagatgcagatggcgatagtatctgtatcaagcttaatggatattggatataaagctgatgatgactcagaaattttcaggaataaaataccagtctctaaatgtgaggaatcagaaggaaaagcttcaagcctgcgagcagagcttaatgcattgaaagaaacaggaaaaatgat

SEQ ID NO: 58869 - DNA, 886 bp, Oryza sativa
tggatgatttctttggcgggccagcatttcttgcatggtctcggatggccaatatgcatgggtaagtcatgcttatgtagttatgtttcacgttggactattccaatgattcacactaccgtattgtgagtcgataaactgttcttttacataatttaacaagaatgcggtctgtttttaatttctttaaatattccttagctgtgagaccaggacaatagaaatttggaactaccaccagcaaaactattttactaaaagatagagctgcgactcaatttatgtagttttgtcttgtggacagtatccccccccccccccccccccgaactaagggggtagttgctggaaacagttagcttatcggttgtaagatgaacttataagtcccttttttatgagagatttatacaagccaccatgttgataatatgacttatattgatgtttcatattagtgttttgctatgagttcaatttttgttgcaaggaactgtagctcaaagaacatgtagtgacaaattgatttatcagatggggcggacctcttcctcaaagctggcttgatgatcagctagctcttcagaagaaaatcctttctaggatgtatgcttttggcatgttcccaggtgatgcaaaacagttgcatttttttagtgcatggtctttatgtggtattgtgattacataagcatgcatatgttttacagtagattatttagcatagttaatattatgtgatctcatgaaaatatagtggttcggatttctctcctgccatttctttcagaacttctctgctaaaatcagataatttatataaacaagtatgcagtctgccccttctagttgttaaacgctgacccctgttcattttacattttaa

SEQ ID NO: 58870 - DNA, 2072 bp, Oryza sativa
  unsure (1)..(2072): unsure at all n locations
tatctttaagtcaaatccttaagtgcataatttctgcaacttttctggtgaaaaggagaacaacttgtgaacacgaacatggggtgtttctggctactacatcaataaattattgttcttccctatttcaagcatgcagcttttacttttctagtcatatgtttaacatcaaattccttggtggttaggcactgctgcattctgttccagttggccgaatgattgttcttgatctatatgcagaagtgaaaccaatatggatcaactctgatcagttttatggtgtcccttacatctggaaagttctccttctctctactgtttttttttctttcctttttttgtattagaggaattcatatgctacttttttttaatccaggtgcatgcttcataattttgctgcggactttgaaatgtacggtgttttggatatggttgcttctgggccgattgatgctcgactaagtgcgaactctacaatggtacaccattaacttaatcagctgtttcttctagtaagttagcatatagaattatgacatatgctagtctttttactaagttgtttttttttataaaaaaaattgaactacttgtgtttgaaggttggagttggcatgtctatggaaggtattgagcaaaatcctattgtttatgacctgatgtcggaaatggcctttcatcacagacaagtgnatctacaggtgaaattatacnaaccattttctggaagcatttaatctgcactatatgtgttctctctcttttttttaataatttgcatgtgctttatagcatcatctgatgtccttaagaaacagtatagattgctgtttggtatacattttggagttaactggtgtgtcaggttgtctggttatgctttgcagcaaatgagccatgctacttgttatgtggttttcttgtttttattgctttgaacttttctctctgagcttgataatgagtgtggctagttttggcttgatcagattttcattatttccaggtgtgggttgagacatatccaacaagaagatatgggaagtcaatggtggggctgcaagatgcttggaaaattttataccaaactctttataattgcacagatggtaaaaatgtaagctttgatattctccatgtgtcatatttaccgattgtaacgtgtatctattttcatccaacgatagacagacatatataggaatggcagtcatgtgaagtggaaaaactataaattactccctccatttcatattataaggctttctatgtctagattcattaacatctatataaatgtgggcaatgctagaaagtcttataatgtgaaacggaggaagtatcttttagtacaattaataatctaaaatttatctttattttgtagaagttacagcttattctgtgtaatccaatatattttgaatggaagcacatataaatttactcatagtcctatgattttcagaactttgattgttttcgtttctgatattttagcttttttcttttggctacaggacaaaaatagggatgtgatagtggcattcccagatgttgaaccttttgttattcaaacaccaggattgtatacaagtagtagcaaaacgtattcgacaaagttatctaagaattacattgcagtggatgcatccaatgatgaatatgaacatccacatctatggtatgacaccgatgctgttatacgtgccctagagctttttcttcgatatggagatgaagtatctgacagcaataccttcaggtgagagtgcaggttttctagttagtactaatgccagtgctttctgaatgactggattaaaaatattatatgaattttaagagaaagtcatatttttcagataatggaatgacaagccatatactcctccgaccctaaatatttgacgctgttgactttttaaaacatgtttgaccatttgtcttattcaaaaacatttgtaaaatatgtaaaactatatgtatacataaaagtatatttaacaatgaatcaaatgataggaaaagaattaataattacttaaattttttgaataatacga

SEQ ID NO: 58871 - DNA, 786 bp, Oryza sativa
cttcaatggcggggcgttgccaccagaggtagaagtaaaaagacgaagacgtcggcgtgggtccagtgggcggcgggcttgttgatggaggcggcgcagacgatccggtcggcgatgcggtggcgcagcgggtggtcggagttggattccacctgcaacggcgaccaatagaaatccaccgacgcgttgtattgacatggcgtacagtcccagcattctctcgccgccgcaacgcgccttcctgaataggaagtaattatattaaataggaagtaattaatactttgatcaatgcaaaaagcagcaaatgacggagcatgagagatgatgtaactaagtagtagcgttggtgactggatatccgatgccatggcgagtggtggggaagacgacgaagagaaggctgaacatgacgccgacgcccagtggcacgatgcccagcaccgattggatggcgatggtggccggcgatggtggtggcgacacgtggccgaagggggtggcgcggcgtcgagcggcggtggcgaaacggtgggcgacggcagcaagaatggtgggcggcggtagctatacaacggccggcggcggcagcggaaatgcagcagctgctgcccgcgcccagctccgccccgccggccgagcccgttccgcccccgacggccgcgccaagctcctcccccggtggcggcggcgtgggagggcgggcgcgggaggccgtgccgcgccgccgccgcctcgtcgcccgtcgccggtctcccgcctcccccaccggtctgccgccctgcg

SEQ ID NO: 58872 - DNA, 835 bp, Oryza sativa
gcctcgtcatggacaagtccccccactcctacatcgccttcgacggcgccgagcagttcgcgcgcgaccaggtaaattatctttcgctaattaacccacacccaactaataaatcccttccaattaattatgctaatttcctggttaatctaacctgcctctgcacgctaattaacaaaacatttttaatgtggaattattctgtggacatggcacgagggaacgacggatattaataccggacagccaaaatctaatggtggtaggaaataattaaaaactgggacatgttcgacacgtgtaaatgacgtccgggaagccatgtacaagtgtgcaacatgaacctccaaacagtaaacagagcagcaacagctctgcattaccaaaaatggctccttgtttccttgcacagttcaatccagcaagattccattccaacacgacaacacatgcatgtgaatcctactacggctttacatgaaaaaaaaaagtaaccttttttctgttagcttatttgtaggatataagtgcaagaaatctttagtttcgtttttttctatatcccttaatcctattgagtcatttgggtgaacatgtcatctaactatgtgagttgcatgcttatctagctttacgtgatttagtgggaaatacaattgatgtgatagaggtttaattcaataggccaacaagttaagcaatcttgcttaacaatttctatgtttttgctgcatgtgcatacaaatacatccacgcatctgaaaatttttctgtgtttttgctcacgagttttaccattttcctttttgtttatgcttgtgcacaccttcacgtg

SEQ ID NO: 58873 - DNA, 3681 bp, Oryza sativa
  unsure (1)..(3681): unsure at all n locations
gtttggcgtcgttcccctccttataggggttgtttagcatacccctttcttttccctaccatattctccgggtgaaaaccttgcttcggttccgaacgagcggtggcggtgatccacgtcgcatcctccttgggggcaccgctttggagaaacctcttcgtgcaaggatattgtcattgatctatgcattggcttcgaacttcagtcctaggctttgacgaggccttctagctccacattttgttttgcttttctcagtttgggtcatttcttctcttgtttggtgtgttcaacttgtcttgaactacactctcttctggagtggatctttataataattggctgtagttctttttgagcaaaggccgggatattatatttcattatctaaaaaataataatccgtcattacgccattcccaactcaatgactaggatagtgtccatagcattaaataagctatcacctaggatgcaaaataatgtggcaagtgaataactgagaaaagagaaggaaaccagatcttatatgaaacatggtttctacacaacattcaagacaacatgtgagataggtagaattaaatttaagtatatagcaaagtggtgtttgcattggaagagtagcgtctagtactggtttcttgataatgtggagtttataaaaactatgtttaatgtcttgggtggggaatggccttagcacatgtggggtatttgtagcacttatgactattcatagactatttagactcaaaagattcctctcgtgattttcatgcaaactgtgcaattagttttttattttatctatatttaacgctccagacatgtgtctaaagattcaatgtgacgtttttgggaaaaaaaatttggaaactaaacaaggcctaaatcgatgcgactgatgatgtaccattgacaaaagtatatactccctccgttctaaaatataagagattttagacggatgagatattttctagtgccacatcataaactagaaaaatatctcatctttctaaaatcttttaaatttgagacggtgagaatagatggacacgaacgcgcagcgcacagacaggtacaattgacgtactccatccgttttcaaatacaagcattttatatataatataaaatatatttaacgctccaggcatgtgtctaaagattcaatgtgacgtttttgggaaaaaaaaattggaaactaaacaaggcctaaatcgatgcgactgatgatgtaccattgacaaaagtatatactccctccgttctaaaatataagagattttagacggatgagatattttctagtaccacatcataaactagaaaaatatctcatctttccaaaatcttttaaatttgagacggtgagaatagatggatatgaatgggcagtgcacagacaggtacaattgacgtactccatccgtttttaaaaacaagcatttttatatataatataaaattttttggtcactgatttccaacatataaaatttttttattttaaacaatttagaattgaaacaattgtaaaaaaaagcttagaaagggaattgaaacaatntagaatctactaaaatttagccaattaaccttttaattttaagctttgctaaacaaactaaagatgcttatatttaataatattgggaataaggccatgtttagttcctacacaaaaattttataccatatcacattaaacgtttaaacacctatatgaagtattaaatataggctaaaaaaataaataattgcacagattgcgactaatttgcgagacgaatcttttgagcctaattgctccatgattcgataatgtggtactacagtaaatatttgttaatggcggattaattatgcttaataaatttgtctcgcggtttaccgacggaatctgtaattaggccctgtttagttccaaagttttttttccaaactttcaactttccatcacatcaaacatttcatacacacacacaacttttcagtcacatcgtttcaatttcaaccaaacttccaaacttcagtatgaactaaatacagccttagttttttattagtgtccaaacactctatacaacactatataatattcgatatgacacgacaaaactttataacctagatataaatgcacgccacgaccagtcaatatcttggaatctgtggtcaatcatgcattcatgccgctcgtcgtacggtactctcgtcgtccactcgtctccgctcatcagctcagctcacagcctcacaggctcgctcccgtgattgcctggaaagaacaacaaagaggcggtgttcggacctctaggttcctaaccatctctctcattttctacacctacgcttttcaaacagttaaacagtgtattttttaaaaaaaatttatatacaaaagttgcttaaaaattatattaatttatttttttaaaaaaatagctaatacttaattaatcaagcgctaatgtattgtttcgtttttcgtacgcactgttcctgctggaacgagcaccagcgcatttttttcttctaatatattgacgtgcaatccttttacgcgttcgcgaaaaaaaaagcaccagcgaacacagccttaacttttcttcactttaatctaataaccatttaaaagtgattggcttttggaaaacaaaacgaaggaagcatatgcggggataagtccattttacaccctttaactcttcattttgtttcaaattcatcctcaagctcccgaaccaagcatttaacaccgtccaactatcgatacttggtaaattacatttctgagcggtttataggctagttttggtaccgtaggatgccacatatcagggactcagggctaactttcttctcttctcttcttactctctcgcacgggcgcacctggtaggcgcattgcctcggtgaactcgcatggcgtgtgccaatgagcggccgctcaccaccggcatggaggaatggcccccctactcctccccgagatcgaggcgctcatggaggtggagctcgatggagacggtgcactagggtgctcggcataggtgctggaagcagatcttgagtaacggaacttcatcagagccgcacccacgtggcaaggaggagaggatcgaagccactgtccacataagtgattttttttatttttttaattcaattaataaacctttaaaaatatttctcaaaactgaatctcactgtttagtctttcatccaaacataatggaacataatggagggggaaataaatgcacgacacgtcgatcatgcgtgaactgtggtcaaatcaggcattcatgccgtaagggctgttggtcaaatcaggcattcgcgcacggtactctcgccgtcgactcgtctccgctcaccagctcagctgaaaggctcactgtcgcgattgccgggaaagaataatacaaagactaatagccccattgattgacttaaagcaaaagctaaaatttatatttttaaatctaattttaaagttaaatttaagatattttcaatgtaattttcttttagtattagcttgatatataaagttgtacttataaattaatttatattccataataaaccattttgacttattaggaaatatgagcgatcgataatactctaacttttcttcactctagtctaataaccatttttgaa

SEQ ID NO: 58874 - DNA, 3617 bp, Oryza sativa
ttcctgcagccccgagcgtgacaggcggcggatcgggcgagagcggcggcgggcgagagcagctatggcaggcgagcgcggtggcggtgggcgagcgcggcggcggctgctggtggcgccccgtcgccgcccaaatccggcggcgcccgccccctgctccgcttcggccgccgcccctgcttcgcccgcgcgcccgtctcggcccgtcgcggcgtcgcctacccgctgaagaagagagaaaaagggaataaagaagagatgacgtggcatcctgacatgtggggccatgtaggataaaaccgggataaaaaccaccaaagaatctaaagtgaacggttttcataacttgagggatgtcatatattttttcggttgggggacgattttgtaactcgatgacaagttgagggaccctaggtgtactttttcctttttggaaaacaaaacgaaggaagtatgcttgaggtttttgggccctggcgaggaatatgtaattaaagtttttctttcataagggaccaaaatccagtagctcgtatttcccagtttaaaccagctggttaagcaaaggcccagcccacgtaagcttatctggacgggccaaagtcccagcttattcacaatctggcccatccacacatggaccacaatctggtccatcaaaagagtaactatagtacacaacagttttttggttgaaaaactttcagattgtatatttaactaactaatcgtcgggtaattaatcgctgaactgtagtctgtacataccttggcatccattggctaggtaagggtttccctcgtatcctttggagcaattgcaccgtgctcggccgtaaaggttcccgtcaacagcgtcgtcgatggcgctgtgcacgctgacacatcgcgtccattgagagaccctggtgtcgtaccagaacatgtcctgatcgcggtccatgtccagcgaccactccagcaccgtcgggaccgccgtcgagtcggccagcttccgcgggtcagcgacgaagccgagctgcagggagcgttgctcgccggcgaaccactcgccgtcggcgatgaacgccgccccgtacgaccccacggtgaccgacctctgggtcaggtcgttgaggtggacgccgtaggacgggaggcccctcgccaccggcgtctggcagcagccgaagccggagcagcttgaggcggcggcggcgtccctcggcagcgcggatcggaccacgcacagcgcggcgcagacgctgatgtagtcgtcgtcgtcgttggcgacgaggttggcgaggaggttgcagcccatggcgacgaaccggttgtgcctggtcgacaccgccagggagccatttgccggcaggccggccggccacgagccgttgagctgccgcggcagcgacgacgaggagtccgtgcccagcatcctggtggcgactctcaccgtgccggacggcagggagatgtcgatcacttccacgccgtttcttgcgaaacgcagcttcggtggtgcagcagggtgcgtctcgtcgcaggcgagctcgaagccatcgcggaagcagccgtggccaatgccgaaagggtaagggacggtgacgttgccgcaggtctcggggcagccaggcaaggctaccggcgcggccaatgctgtcactacgagatgaaacagcagagccccaacaacaacaacaaccatggtgccaatctttgcagggcatgaggaggaaagctgcttcatcttgctcttgcagagatcgagctagctattcgattcggtatttggtgtctttgcgtggagaaatacctcttcatatataaccatgatatcattaaacagccagatgaacgagaaacctcgtactgaacttgtctgaaattgttctgttttgtttaatctttcgaagagttttgggcgcaggtgcgtgtcccatgtgagataaagataagagggtaacatcataagatggttgacctatattcatttttcaaatgagatgttataaaaaataaacttgaaagggtatctcggggaattcattaatattaattagttggcttcacggtttagattagcaaatgatctggatgccttccatttcccctggaatggacagacgacacgaccattacacgacgtgctggtagtggtgctgctgtgctgatcaggatatgctagcttttttttgttttcgggatatggtagcttatttgagcagcgtatgatattccaaaatagtcccacttagcgctgacttgctgtagtaaataagtaaggtttcggttcgaagtcaagtcgccggcgatgatgtgccgaaatttgatcggccgctaatttcagaaattcgattccctggttgaagatagacaaagacggcacgtataacttgcaagcaagacataaatcactttggactaaaaggtcaagaaaatcaaaagaaatcgctttgggcttggtgttggcgtcattttttaaaaaatttattttttaacacaaggcaagaagattgccttagagcaagtattataagggctcatgtgttgtccctaaaaataccacataagattggttgaagaaagaaaaagataacatgtataactggaaaaatatacagtgcaaaccacaaatatagtgaaaacatgaaaattttcatttggatcgaaaaataaacgtcaaatattcgtccacgtcaccctgagtaaaaaattttctctcacaagtaaatttgtgagtaaaagttttactcataatgacgtggacaaatctgatacgtctttttttaatccaacggtagttttcaggttttaactatgtaatttccaccacatattccatgtataacttgcaagcaagacacaaaatcgctttggctaaaaggtcaataaagtaaataagaaatcgctttgggcttggtgttggcgtcattcttttaaaattttatttttttttaacagaaggcaagaagattgcctttatatggtgctggcgtcttgggcttggtacaaagtaggctcgccttttgtgtttggggccggaaattaaagtactctctagcttggtacatgaagggttaggccgagcctcgtacttctcaggcctttgtggctttgtgggcttggtacatttgttgcttctgcggcgtctggcagcagccgaagccggagcggtccacggcagtgcggagcggacgacgcagcgcgcgccggcgcagacgctgatgtagtcgccgttcgatcggtgcgtacgcgccgacgagaggttggcgatgtcatttgcccttgtagatgttccaaaatagaatatcacgtcaagttttaccaaatatcacaagaaattaggagaactatattttttagccgcttaaaatatattatattattaaaacataaaaaagggaattatgttacttttattatttttaaactatcagtgttagtatggcataccccgtttgcctgcacttgctatcacctagaatatcgcatttatatccttatatagaaagatattcatgaggatgatatagacaaggggaggggcatcggatcaataagacttacacccggctacatcgggaggaaacctttctgctagccgctgactacaatttgccgctgggctgcag

SEQ ID NO: 58875 - DNA, 4095 bp, Oryza sativa
acaaatccatttcacggtgaaagttacgtgcatttctatttaatgcttttaaaatactgaaaacaatgccatatttatgtgtggctaagaaacagttccttgaaatattttatttttaagctgcacatatattttatttttaagctgcacatataaacctttgaaactgctgcaatatactactgtagagtagagcgagctcaccaacccatttagctcatctttcagtgctctatccacgttttccacaatcatccaagcgacggtaaaaggtatctgtaattctgcagtggtaataaaagtcatcttgttttcttcatcagtaactcatttacctcaacggcgactctcgttctgattcagtgaatttcagctccaacttggctgttaaaacagtggcagttttaccgccctttggtactccgtttgacatgtaagctctcaatcagatgcaactagttcagtgcttcacaaaactagtagtagtagtaggtacaaactcttatccggatcaagtttaccatcgctactcgctagccgaacagagtccccaaactaatcaaacagtttcactgtttcagtgcaaaagcagtcagaattgtgcatgagaattaaaggggtccagcactccagcctccaagtgatttggccactgcctgctctttttacaacttgcacgtagtagaagaacattaaagttctctcatcagaatcaatcagtcgccactgcctatagactagcataaacaccggacgctgtcgtgatcatgcgccatggaagcatgcacgtcgattgcagcagtggagctgaccggcctcgtgctgtttactagtcttggaactccaggccaaagttcggcaagtgcatgtgccattacagactgaagcgccgtgatcagtgccagaatagttttccatcaagactttgcaaccgccaaatccaatatttaactgaatttcagtttaaccatatttgattccatggacgatagtgctcctctgcctagtacttaaatgtggattaaaaaaggatacagtgacgcagaaatggtttcaatttcagatgaaagtgtctggtttagtggttatctgcatctccttcatgggttctcctctagttaggctgctactactatcacctatcagtaccattgtatcagagttcagtaaacatttaagtgaaacaggtttcagtttccaaaagaatgttcaaaaaaaatttcagatggaataagtgaaggcaaaaaaatggcattggaattacagacagacacaaagtttgggagatccgaagccatgcatagagtattgtgaaacaactatgagctttgctttgcttatagctcatgtttaattggagtatttactccacactccaagcaaacatgcagcatgcctaatttgttgacatcggtcagactcgctacgacgaacggcactgctgttcacacctgagttaaggactagcagatggagatttaggtctcataattttgtaaattatcgccttattggtttctgaagtcgcaaagtcgcacgttaaaccccattttgcaaacctggacccgcatatgtgggttgcaccttttgaaaccacgaccaaagttggactagagaaatgcaactatgcaagtggctggatcttgcttgattctgatctactagataccaggcaacaagggagtagcagcagcatgattgtctcaattatcaccatgaataatcatgtacgtacgtatgaccaatacagccttttcaaacctgttgttccgcatagtaggtcagtagtacaattgtgaacttctcaaattcaaggcatatcttcgtctgctctgccatggctataaaacttatttagttatgtttagttgttttttcttgttatacagaattatacaaagtgaatttggcatgtactgaacttccttagtgctagtctgctagacatgtggaactaagctacataacagtgtaaagttttatatttttgtgtatgatagtcacgccaggtaaaaagtgcaagtatgttgcagatcgtagcagcattctgcatgtaaactaagttttcatcacacttctcattccgtgctttctggttgtagtccactgagttaaaaacaatggaagacaaggaaagccgacgcactcgacaatatccaatcggtagcttgacagaaactgacagattggagaagcatccagtaacctcatcagcactagcctataaatcccgccgctcatgtagctctccttgcattgcagagttcagtgtaacaaagacactgaagctacagcctacagagagagagtatctggatacttaattgtgtgcttagcttgcggttaagcaatggcttattccaggcaaatcttcgtctgctctgccatggctgcgttgctcttctctgctgttgtttcggcgcagctctccactgatttctacgacgagacatgccccgacgcgctcgacatcatcgaatctgccgtcagagacgccgtttccaaggagtctcgcatgggagcttcgctgctgcgcctccatttccacgactgctttgtcaatgcaagtctcacacaactcacccttttaagttcagttttccttctcgttttctagtccgacctttgaagtagatgtttcaatttcgaaattcgctagtcgctacagtttacttacttagttactagtcgccaaacattttatattcagatgatttttcccgtgttcataaatcataatagatataattcagaagttcagagtggatgctgacgggtcagttaagcaagtggtgtgcatgcagaaagcgcgcgaaaagtctacttaaaagttaaccttttcaaattcgaaggactaaccattgacctcaaaaacggcgcgcgcgtgcaggggtgtgacgggtcagtgctgctcgacgacacggcggccatcaccggcgagaagaacgcgaagccgaacaagaactccctccgcggcttcgaggtcgtcgacgacatcaagtcgcagctcgaggacgcctgcgagcaggtcgtctcctgcgccgacatcctcgccgtcgccgcccgcgactccgtcgtcgccgtaagcaccagaccggccgatcaccactccgatccctgtatttttgatgaattgatcgggaacgaacgaactgtgtgcagctgggcgggccgacgtgggacgtcgagctgggccggcgagacgggacgacggcgagcctggacgcggcgaacaacgacctcccgccgccgacgtccgacctcgccgacctgatcaagtccttctccgacaagggcctgacggcgagcgacatgatcgcgctgtcgggcgcgcacaccatcgggcaagccaggtgcaccaactttcgcggccgcctctacaacgagaccaacctcgacgccaccctcgccacctcgctgaagccgagttgccccaaccccaccggcggggacgacaacacggcgccgctggacccggccacctcctacgtgttcgacaacttctactacaggaaccttcttgaggaacaagggccttctgcactcggaccagcagctgttcagcggcggctccgccgacgcgcagaccaccgcctacgccaccgacatggccggcttcttcgacgacttccgtggcgccatggtgaagatgggcggcatcggcgtcgtcaccggctccggtggccaggtcagggttaactgcaggaaggtcaattaaagtggttgataccgtgatcagtgttaatgtggttggttagtgtcaggtttcttaataccgtgatcagtgttaatgtggtttgtacaagtgttcttctttccttcagcgatgtagtctgcttcgaacggttgtagcactactatacgcaaaaataatctgatgaaggaacaaagactggttcctactgaaaaatcgtgttgcacaagaccttgttttactggaattattatgtttgtaatcaaatagagataactagaaatgagatgacacagttgcatgggaatgggaatcactaattagtactgtcaaaattgcagattacaaattgaatatcctacatgtacgtgttaaaacggctcggtgtcgatttgggccct

SEQ ID NO: 58876 - DNA, 1244 bp, Oryza sativa
gccgcccgcgacgctccaccttccaatccctcgctgtctctctcggcgctctcgctttcgcttgcatttttcaaatccccaacccaaccaccaccaccgccaccgccttcctccttctcccctctagttaatccctccccacaccatgccggccgcctcaccacagtgtcgtcccactcccaccctcttctcccggccgcgcccgccgccgccgccgccggccgccgcgatgccggctccccgcttactccgggtgctcctgctgctcgtcgcgctagcctgcgccacgtcgggggtcgggtgctccgacccgcggttcccgcacctcggccgcgtccgggagctccaccgcggggagggtcgccccgcggccgagcaggaggccgcggcgcgcgggctcctagcgctcctccttccgtcgcactccgggagcttcgatttcagggtcatctccgcggtgagtagttttaggggtgggtaactgggcgtggcgttgcgtagtaggctacccggaggatcgtgtgtagtgatcgatcggcgagaatctgaagccagttgatggagcctgtcgcgtgatcgtggagtggttgttggaatgggtcatttgcttatttcgactgtaaatcgtgtttattggacaaattaatgcctaaattattttgcgttggtaaaatttgcatctggtatcctgtaatggttaggatttcccactccccggtacagtagtagtacttatctgcaaggactcacaatctgttccatggaatccacaggaccaatgtggtggaaaggcatgcttcattgtggacaaccatccattgtttgatggagaagggactccacaagtactgtatgtttctgaatttctccattttagcattcattttgaatcgtttttccaactattgtgtttgtatgggttctaggtgaaatctattttgcagaagcagaatgtagaggagtcttcatgtaaattatggacatgacaaccatactttgttttagctcactacaagcctattaagtttactattagtaaaatatccatttgtagagatgttagatgcactgaaaactgacttgcctgaaatcaaatttcccaatattttcgaatgtctagtttttcaccactcttctgatttgcgttcttttgtgcatccaaagtgatgctgactattctggccacagcatgttctgctagaatcatgcaccagcttctcatttaactagttaggcccactggg

SEQ ID NO: 58877 - DNA, 753 bp, Oryza sativa
ctttatcatctctgtaatgttgtccacacgtggccaaaataagccttataaagtgaagtagagtgagttctattttcttaatttatgccagccattttctccaacactgttggttaacacagtcttatgatttatacatgtattcacttatgttgattttgcagctatattgaagttaaatgagcttatttgattctcttgtttgatattaaggttcacagttgacagcaaccccaggtggtgttgcacatatcttctggatgcatctgatcccttatttgtagaaattgggaagctttttattgaagaacaaatcagaggtataatgcatgatttccactacttaattaatggtgcttcagtatcagacctaaagtcatgttttagttctgaaactaaattcctaactagaaaagttcacagcagatattcctaagtttcactatttttcactggttgtatttctaacttgtgtatttttgtgctgagaataactgaattgtttgtgataattattcgagggtacaaacgaattaattaaatattacaaagttgaaaaatggattttaaacagctttctaagaaattcatatatagaaagtatctgcaaaaatcacacagtttaggagcttgggaagcgtgcgcatttatcccccattctattccttagaggaacacaccgtaaccaatcagttttgtttaatccacaagtgttggtttttcatttaagtagagagtagtagtcatcagcac

SEQ ID NO: 58878 - DNA, 1791 bp, Oryza sativa
cgatgggggcctcaatctttttctcatctccatttttctggccccactttgcctctggcatctacgcaccatttaaactgtaagttgttcgtggcagtggcaatttctgtgaatgtcccaaccggttcttgcgttagttcaacttttctttttgttatccaaggaataccatatgatcatatgatcgtacctattccgacagttcgactgagcacggcatgcatgttgttagttggatgaaataccaaagggcaagttggtgctcaagtgatgtcatcacttaggtggcgaaaggatttgatgaattgcagacagcacaccttgccagcctcatcctccctctggattagtcacgtacttgttggccgcccgtgtactactccactaaatcccctaatcagtagagcatccgatcagggcagatcagccatcaggccatcaggtgtattggatcacggattctacgactaagccatattactgtagtgtttagtgtagcaatcagaaccgacaaactggtagctatagctttagctaatgcggcgctaaacaaaaaattagtcggaccgaagattccaacacgactctttgcttgtttattgtatatggccacttgaggcagacacaacaatcgcgtccatgtgcaatgtaactgtgccactccgcagtgagcccgaaacctctccttttcggcgtgcagatgtaatgcgaaatcgcgaatcgatcagccattcagccaagccggccgtcagattcccgtcttccaacggctccgcggccaccagcttgcgctgcgcggctgcggcgatcgcgatcgcccggcgcttctgtgttttgaccccgtgctgcgattcgcgaagcgatgcgtttgttgttgtgttatgtcgtcgcgcccccgcgcgcgcatcggcatcgggccgtggccgccgtcggtccagccagccaccaaccgcccactaagaatatctcgtctactttcttcgtcacataaaaaacgaatataaaacagatataacatattatatatatttagatttataatattaagatacgtcatattcgatacttgattgtttttttaaaggaatggaggcagtactcggctagggtgcgtgtgcgcgcgcgtggcccaccgttttttttttcctcttgagcacactgacgtggtggaccagaagtggtgctatttctcagagggaccggaccacctgcgtccgggcctcctgccattacgtgatgatgtgtaaaggacgaggctttttgagcacacaggggaggaaaaaacctcggcaaagtaggcggcgctgggtgcagatcttttccgttttgttggtaggagaagaatttgccttgcacggtttgcgcctcgctcgttcagcatagtagcataccacctaccgcagcaatggacgtaccaacaagcgtacgagtgttgctcaccagagctactactaccggtctgtcacgctcaccctagtataaggatcaatgagacttttcatcctcccaggagacttttccccttgccaatgtagcagcagctcagcaaatttgatcgtgtttgtgtgtatgtccaatctatcactgctaagccaaaatattacaatactacactactatgcagtaccctttttttgttacgaaatataataatttataattagatgaaacgtacttggtaccatgaaactagatagatcatctgttttgttatagtactacgatgatttgcaataccaactaggcagtattaaatttgccattttgctagtacttgaccagccaagcgag

SEQ ID NO: 58879 - DNA, 721 bp, Oryza sativa
ggcggtggtatcaagtccgtgaaagtgacctatgcttctgcaagggctcctgatgatcttgacacgagacttcttcgtgcaatgatcaccaaggggttgatcgaaccaatctccagtgttttcgtcaatctggtcaatgctgacttcactgcgaaacagaggggagttcgtatcactgaggagagaatcttgttggatggctcacccgagacacctattgactacatccaagttcatattgcccatgttgagtccaaatttcccagtgcaatatcggagagtggagagatcactgttgaggggaaggtgaaggatggcatcccccatctgacaaaggttggatcattccaggttgatgtgagcttggaaggaagcctgatcctttgcaggcaggtcgatcaacctggtatgatcggcgcagtaggaagtgtccttggtgaggagaatgttaatgtcagtttcatgagtgttggaagaatcgctcctcgcaagcatgccgtcatggcgattggtgttgatgaggaacctaaaaagagcacactgacaaagattggggagattccggcgattgaagaattcgttttcctcaagctctagattcatgcgttgtatgtttgaagctgcaaacatggtgtgcaattttgatgtagctagctatttaatcaggatctagaggactgatggttctcgttggaataagccttttttgggttatggtgct

SEQ ID NO: 58880 - DNA, 2212 bp, Oryza sativa
ccctagatcgcgccacgcgatgctgtgaaatcggggagatttggcatgcaccggcctctccttgctcgcggtaatcatcacagattcaccatgccgctgtcaactgggggcaatatcttaatccacgcgcgtaacaacgagatgagatctactgatcgatttgtttgctggagctagattactagtactaactagatttgtatcaggttatggatatcacatacctaatagctaatagtagttgactaaatctcggcaggactcaccacataccatgtcttatacgggaactgacttcggatatggaaggagttccggataaggaaagacaaccagagttctacatggaaacgacaatgactactcggattgtatctatattggtttccctagttctacttggataaggggacacctatgggtataaatagaagaccccctaagaggagaggggacacggagcaatagatcaagacacaatatcaacatacaagccaacatacgccaagacaagacgtcggatatcgacttcagaaataagcatggctagtcctttacggtgtctacggatactgttaggagatatatagcattgtctctgatctcgtcgggcacgaactcaagaaggaagactaccctgttgtcgactacgggatggttttatggccgccatattgacaacagttaaatatgctaccccaaatattgtactggtgtaattatggtgaataagagcaacgaccggcttcggccaacatgatgtagggttattacctgacaattcagcggcccgaacctatataaaaatcctcgtctccatctcttttacctcaatctcgcatataccctggtaccaacgatccctatactatgcaaataccggaatcgcgacatcaaacgtcgacaatttgataagggcttgttcactttgatgctatttctaaccataccattttctgataaagttgccaaaattatgcatatgtttggtttcttaccaaactttggtaaaaagaccagaaatttggcaactgcacagtactgaccaaaatttggtagaatatacgttggcaacaaagtgaccacattcaaaaatagctatcttgctaaaatttggcaacattatcaaccttactaaaaattttgacaataccaaaatttagtaaggtttattttggcaacagtctctaagtgtactgatcggctggccgacgaccatgcattgatcgacatgttccaacgatcgaggtggacaaattaaagtagcaacagtaatccagcagtgcttgttcgtcaaatccactcgggtcccatgccatgtctagcaagtacacaccacggtttgaccgtgagttccgaacaagctttgcgactagttgtttcttggtcactctgaaccgttcattttagatctaacgggtgacgttgatattggttaatgccgtatactacttctctaggctgtgggccaactcggcccgcaagataatccgttcgcaacgctagtaggccgaaagcctgcattccatcagttgtctttgtcctgtatatgggcctaacttagatgcctgacattgatggcgatccaaactttctgatgggtctattctgggccgaagctttcctccgcaaacttagctatactgggctgaacttcaggctccatcgattgttcctttatttggatagtctcagttttggttggctatgggaataagtccaaattgactcccttaattagtggttgaatctaatctatatccctaaaccacaataccggatatcactgacatggattagattcggtcactagttaagggagacaaagtgggacttattcctggctacggcgatggaagaaattactaatgggctgctggtagctacagtagaacagggagatgggcctgcgggctgtcaacacgggacagagtgcacgcgtcgttgcattttcttcggtttagtcccataccgtaggcctaaggccgtcgctacatggcaacatcaacctaggaggacgggacaaccaaggccaacctgagctttcccgtctccgtcaccactcgagctcggtgataccgtctagctcctctctcgttagctattggtttccgcgtgccaccatcctacaggcctagagagatgtggaagagaggggagacgctgaaatacgtttcagtgatgatatatgtgagtgggtaaactacgacaa

SEQ ID NO: 58881 - DNA, 4022 bp, Oryza sativa
caatagtgattccgagaaaccaatcggagaggacgcattcgatcacccgacaatgccgagagcgccatgatcagtaggagatcccgacgagggcaaccatggtgtaggcgacgagctcctcccgcgacctccgctcgcctggcgacaacgacgacgagcgcccgtagccagacagctgcggcagctgcaccctgcgccgcccgctcaggaacatccgcatctcgccggcgaggaactccgccgcgccgcggagcgcgacgcagacgcgcggcaggtggcgcgccagcggcagcacgaggttgaacggccacaccaggaacgagtactgcaagaacgcctgcaggaaccctccgcccgccgccgccgccgccggcacggcgagaagcacaacgtgaacagccatctcgatctccaaactccgagcctctccagtttagtttccaccactgccgcgcgcttacatatgtgcgggccgtcgtggcgtgcgcgtggcctagctaccggccgtctgcctcggccatgatgccgatcagcgtggtggtggtgctctgcgcgctacagaaagggccatggcttggagtgggtgatgcctgatcgataccttgcttgctgatggagagatgcttttataattgaatccgatcggatgacggatcggctcgatcgcttgacaggtttggtaactgttaacccaaaccctctgccggttataaaaccagtcccaataacatgttagagatcgtaatgtgaaagaacgttatagaaaatccaaacgtgatgactacaccaagatatatttggtgagggagttcaattgtagtgattatcaatgttcttcctcgatccagtataattacagtgtgcctagggtatctatgagatcatgaccatcgaccaaagctaggctgaggactagttgtttctcgcctatactaccatcatcacgttattatatgtgtgtctctgtttaagagaggtctaagataaaagtccaacttcattattatcctactacttattacatgttttagtagttaactgtaatcgattttatacacataacatattcaacagattaaccctttacacaaatttttgcacggccggccgcccggccggagacctctcgttgttgcttgcgtttgtccaagtttggcgtaacggcgaaatggaattagtgagagacactgtgtcgggagatagcgagattcttggcatgggccaaccagccattggcatcgatctggaatttacctttctgggggagaaagtaatgacactgcctgattgcttgcgggcccgtacgcacgcttttgttctagtctgaactgaactgtaccgaccagctttacatccacatgcactcagccactcgctactttagcagtggtaccatgtccaaggtcactgaagcctggcctcttttttcatttggattattaagcgtattgttacggtaaattattgatttaattatagaagtgaattaaatatttttataaacaaatataacaactagttttaaaaaatggctaaggaatacagtaggaaaaaaatattttaagagattatattttttttgaaaagcaaataatccgttaataatctgataaataagctgaaaaaacaaagcattacgatagctgatcagtgatcacggatgtaaaagttcagatatgggcattgaccattctaagtatgaagttatacgaatctattaggccatcagcaatgggtactcttaacccgtgtctccgctcacggccgtctgcctcccgtcgctttttgaggccgaaccattccccagcaggggagcacggcgcctcgcaggggggcgcggctctctccgcgcctcgcctactttttcgtggggggtccgagccaggcaccacgttgaagcgtggggagctcgtggacacgacgccctaccccgatgtttccccttgtaccctcgcccttaaccacagccactggccgccggctcctcgtcctcatctgccgcgccgccgccggtggctcgccgttgaccaccgtgacgggaaagagagggaaagggacagggagaggtaaacggcagcggcgagagggaaagaagaagaccacatctggccacagcttgccgttgaccactgcgtcgacatgccagatccgcgcgtggctcccctgtcgtcagcggcgatggccctgcgacggcgacaaccccgcgacgagcggagggatctggctcgccgttgaccaccgcgtcggcatgccatatccgcgcatggctcccccgtcggcagcggcgacgaccccgcgatgagcggagggatctggcacccccgagcggcgacgggcggcaacgagagagagggagaaagaagagcggcggtggacgccggtgacgggagaggcgagcggtggcggcggagagagggagaggcaactgcggcttgagggagaggcgagtgcggcagcgaaaaaaagagaagagggggtgggagagagagagattaggggtagggtagaaaaaataaatatgggactttgtgggctgggatacccattgtgggttggagtgtctctattaagttgcttcagattttgaggagactatccagaggtatcctctattacgagctgagttcccctatgagtatcctcagttagtgaggacactctaggagtagcttacattatagatgcccttatgagccctcacttggccgacagaataaaaaaggattgaggctgtgttcacgattcttggttcccgagggaacattatgcacgaaaaacagagtggtctattagcgcgtgattaattaagtattagctattttttaaaaaaataaatagattaatttgattttttaagcaactttcgtataaactttttgtaaaaaatacaccgtttagcagtttgaaaaacgtgcacgcggaaaacgagggagaggggttgggaaaatgggtgccgaacatagctgaggtgtaatcggaagcagaatgattactgtatatcgcaatgtgatgtcgacatcggcaatgttggctttagttcacgctaaaattgaaagtttggtttaaattggaacgatgtgatagaaaagttgaaagtttgtgtgtgtagaaaagttttgatgcgatggaaaagttggaagtttgaaaaaaaagtttaaaattaaactcggacatcatagtggcatcttccagggcccaactacggatagcctgacacctgatgcacaacagcttcggtcgatgccaagcaaatgcattagcagctgtctactacgcggcaggctctgaaactaaaagaaatgaaatactctcgtttcattttgtagacagatcaacatcgtttttaagactggataaggtcttagctcgggtgtgtgtttaaatattggtctccctatatttaaagtgagtagcatgacattgcagttgaatttttgtgtagttttgcgtaccgagctagaacaggtcaagctggaagcaagaacaagattggatagttcagatatatctttcaaacaatgtagccccacaaggatcagtagacagtaattggtcgaaaaatcaacaaaccacttactcgatatgcacaagtttcgctatccattttgttatcatatatgccacatggtcgtttccccgcaatttttttggtcgattcaaggtacatgtgctggcctttctcggttcgagaggccacttcgattgcatttttggcctttcggcaaatccctggctgcatttgggatccatttgatctgtagatcatccactgtgtcacgatgaatcaatccaaatccaatcgatgaactgaaaccggcaagtttttccatcgtgacgtgcaagcatacttgttccctcaatcatgcctgcacagatagctacgttcgttgtacggtataaagatgttaattcagacaacagggacattcagctgtagaaaaatacgataatgtactggaatacactgaaatattactaagattcgttgaaactgtaacggaaaatgaagcaaatctgccacc

SEQ ID NO: 58882 - DNA, 2234 bp, Oryza sativa
  unsure (1)..(2234): unsure at all n locations
taagcaaattggatacatgtaaaaataatcaagttacccttattctggccctgttcagaggcactagctgccgcagcggctgcggcagcagcagcccagccgaacgcaccctctatttaatatgtgtggtcgttatttcagtgctatttaatttgaggcaaattaagtgaacatgcatacatgttatacttatgctgaaacgagagcttttgtgggacattttttgagatgtaaacgacatgttttgcgggacaaagaggctagtataaagacgaagtacaccaaatcagaactgatctaatgcaacctagggtgaccggcattgtatgcccgatctgacaacctatagtaacccaatctacttatgagcaactctttgcatgataattaactttaatgtatccaaatgtatctataaagtgcctcttctatgttaatttattaactcaattcaaaaaccaaagctaaaccctagttttcctgtccaaaagatactacatcttgagcctcaacttctcctctattcatacttaaaagatgactgcacaaaagccaggaatacactatctctttacaaatttggactcaaaacctacttaaatttagactccttttaaatatgaccatttttttcaattccaaacactttccatgtaagccatatagaagctctacctccacatatattgttctttatccaaaatatccggtatgatctccttactgatcccctcggtttaatcatgattatatcgccagcaacatccctgaagcctcaaacaagtcccgatatttgagaataagttctttcctaacttgattagtattagtataaacacagtatatcatacctatataaaataattagaagctataaacaattaaaaattaacgtgaaaaaaattactctaattacgagttaatcagtttgactgttgtgatggctggtctgacttgtcaagcatctctggttagatcgcctatgcaatgacactccaccaaattaatacctcttcataattctctcaataaaaatcattgcaaccaattgttcatgataaattaataatcataataatgatttcacaatgtcctgcttaaatcaggacagcaggacatcctagataatacctgcgcttgtgttagttttactctttattttagaaaaccttgtgttagttttactacccatttacagtttgtttcataaaatggtcacaccatcactaaaattgcggttgttttgctgaacgtagatggacgagttcagagtcgtgcagcactactgtcgtactgtgcactgatcacagtcagcgtaattggcgttttgcagagcggcaaagatattgcaaccgtgtcgtaactgtcagtctaagccgtctcagcctagtgcagacgcattctcgcagcatcaaaattcgcaacgttgagacgagattttctggccgtatttcacttgtatttacacaaaatcacgcggttacaacttacaaccagccctgaacctgatacggtgaacctcgcaatggtgtcgccacgtggaacaccaagagcagagcatcaagaaacaaaaaaagaatgaacccaaaaaaaaaaaaaaccaagaagaagaagagagaagcaatagcagttcgtcagcttttcagtaggagatgctgagcagcgcctggcggaggagctcgtccgcctctccgccgccgccgtcgccgccgcggatgcttcggctccagacgttgccgccgccgccccggcgcgcgtaggcgcggcgcagcaaggcggcgtggaagacaaccccgccgtagagcgcggcgcaggcggcgggcaggtggcgcgggagcggcagccagaggttgagcggccacagcagcggcgccgagaggtggaacaggtggaggaaccccctcgccgccacgatcgccaccaggtggaaccccataccacagcccgctcggccgcttgctttgctcggttgctcccaacccaagtttcacgagagcaagtcgtcgcttcgctgcacgctgcttgcgagttgcgagctctctcaagtagcagtgggcaactgggcatcattggtagtgcgtgtttcgtactcgcgggagctgtgcgtgtgatgtggcgtcngccgcggtggtggtggagggtggcgcgggtgcggccttccccaattgagggcgccgggcgcgggtgggcaactgggcacattgatggctgattttattttgtgtgatggtcgg

SEQ ID NO: 58883 - DNA, 5080 bp, Oryza sativa
attcctgcagccctttaagtatctgaaaatgaagtccttcaacatgtactaggaggagtacaaggtagtagtagtgcgagtacgatctttttcgatatgcaaggccatatcattacaagcactataaacaaaccctcactgcacagaggagccatgttcaaaatataagttctcagagttctaagcactgggtattccagtactactttagtaagactaccaacagacaaagagcatgctgaaactaagtttaaaatcacgaaaacattttacagcatgctaaaattcttagctggaagcgaactagtcagagagatcatgaccccgcagccattcacctacattaggaactgttctactggctttttttttctgagcagatcaatgcatgcaacatcgaatggatcacttcagaattcagataatcctgccgacataaacccatccatgactaggaattgctagtaagatcgctgtcattgtctccggcagtatctgcttccttcacttcctgaatcatcttgaggacttgccaggcagttggccgactttcaggcgaggatcgaacacaggcagatgctatgtcaacaatcatagagagacgttcgacgtccactccatcgtccctcgcagactggacataggtctgaagattagttgcaaccaatactgagtgctgaagcggaggcttcccactgataagttcaaggaggaggatgccgaaagcatatatgtctgactttggagttagccttctgttggacttcatgttttctggtgctctataagcagcatcgtctttgacttctgatgattccaaaaggaatgccaagcaattgtccgtaagacaagcctcaaagtcagaaccaagcaggacattggaagacttgatgtttccatgaacaagtcgggatgcttggtgaatgtaagcaaggccctgcccgatgtcttcagctatctttaggcaggaagtccagtgaagtggttttgctcgagatgaccttgaacctgcagtgcacacaatatcaatacaacctacatctacaaagtatggctctaaggtacagtaatgtacagaggaatgtatttcaacatcatcgaatccgtaaattacttccatttatcatgccttaaaggaaacatgctattacttggaaaataatatgtccttgctccaacaccaacatatcaaataaatcttagtaacaactatatttgagctccaaactttcactaatgtttgtgcgacagcttaacttataagaatacccacattgacaaaagactcgaatttgagcaggccctaaattctacaacaaattggcaacaatcacatttcaagtagctagcattgctatttggtcatatcatagcctttgatgaactaagttcacagaggaaaatacagttttccttttgtaaactccatttgaccacccatttcgtgaattcaattgatatttagtactatagaacagtgaccacatataataccattggtccactctagaggctaggcacttggtgagaggctccaccgacgttcaatcccacccaacccggtagctagcatgatagatcaatgagcacttaagtatggctattcactatgtttactcagtccataaagaaaagagtccaatagatcatccccaaaagggtaaaataaagcatcacatgcatatgttcaatacaggcaaatagtcattctcctgccagatttatattcacgtggcccaagttctctaaattttaattccatcccatgttagttgggatgaagagaatgtctggttcaaaaaggtaatgctatcctagcacccaactagtataatccaatggaatttgcattagagtagatgtaacggcaataaccagaattgctcctagcacaaatgataatcacacaacctatcaaatttccagatagagaacaacaaaggctgcagggtacgcaccatggatgagagagtagaggctgccattgggctggtagtcatagacgagcagccgctcctccttcgcctggaagaacgcccggagcgagacgaggttgggatgccgcagccggccaacggcgtccatgttctgctcgaacgcctctgcctccagcgccgcggcgccgatcttggccgcgtccagcctcttcacgatgaccacgaggcggccgtcgagcaccgccttgtacgtcgtccccacgctcccgcggccgagcacctccgccgacgcgcgcatcagctgctcgaggctgtagctcgcgccctcgcccgcgcagaacgttaggcagccgctccgctccagccgccgcgccttctcctccggcatcatcatcgccgccgtctcctcgtccggcacgcactccacatagccgagatcggtgttgtccctgctcacctccgacatggccgcgctcttcttggggctcgggtatgccgcggagctcggccgccgacgcttcttgccccttttcattgcaatcatggcacaaagtagaagcacggccacgaacgctgcggcggtagccgcaacggcgatggcggcccgcctcctcagtttccgcgaacgcggcgtggatgaatcgggcaagctgatgtcgtcgcgttgcggtccgtcgccggtggccgcggcgctctgcaccgggggagcagcggagccgttgttgccaggaccgtgaaagaagaggaggtgggagccccggcactcacggcggagaacctcgccgcagagctctggattgcccgcgaacgcggcggcgcccatctgcgccatgacgggggtgaccggcacgggcccggagaagttgttgtacgacacgttcagcagcttgagcgaagactggttccacgccgggagggagccattaaagtggttggcgtcgagccgtaggaacgtcagatgcgggaacgcgacctcaatgccgggagggagcgcgccggagagcctgttcccggcgaggtcgatggagcggagccggcggagcgacgcgaccgaggcggggaacggcccggagaagcggttgccggcgaggaagagcgccttgaggttctcgagcggggagaggtccgggatggggccgtggagcgcgttgctcttgaggctgagcacccggagctcgacgaggcgggagagcgtggcgggcgcgaacgtcccgttcagcccggacgactcgagcaccaggcgggtgatctggccgtcggcgctgcaggagacggccgggtgcgaacacggcgacaccgccagagggaaccgcagatgcgcggagggatccgccttggcgaggaatgccgcaagcagcgcccccggggtcgccgtcgagaccagcgtggcgggcggtggcacggcccgcaccggcgcgcgaggagggaacgtgggctgcgagtgcgacccgccgcctaccgccgcgggcggcggccgtacggcctgcaccgggggaacagcgggcagcgtaggctgcgagtacgacgaggcgacgtcgccggcggcataggcggcggcgacgagcacgacgaggaggaggcggaggcggtgccgcatcgtggtgggcgcttgggttggggggttttcgggggggttgggtgagcggtgggtttcagtggagtgcggccgcgtgatgtggagtggagtgaagtggcggaagcggccggggtggtgtggtgggtgtgtgtgtgtgtgaggctcgggaagggagaggaggggtcagagagcggtcgccacggcacgtgggtggtcactgcagcttagtttcccgtgcttcttttggcacttgatcggttgatcgtttggagagcctgcaacgctgcaacgggtggataaagaggcacactttcgagtttaaactcagatcacggcaaccaattgcacgcactcatgctcaaagttcaaacattcaaattctaggaaagaaaaaaaaaacaaatccattgcaggtaacatatcaggctctacagaaagttagtactccatactccagtagtgctaatattcaggagcattttggttatccatctctggatctaaacaaagtttgagtacctacctcctcacctgaaaaacattctaatgtgctaatggtaggaatgtaggattcgccggaaaataaaaatactcgggagaatgtttgaaaaagagccgttgatagcgagcagccatccagtactataccgaagtcgacgtagcggtccattgttaatttgactgtgctgctgctgcctcctgctgctgctgcatgggtgtgagggcccgatcgcagttgatacctggggccacgaaattcaatcagcccgtgggacccacgtgcctgtcctgctcctcctccccctcccacggtggagtaaaagttacagtgttcttttgtcggttgatgggagcttcgctgtgtttcttcggggggctactgtgcccaccacacgttatcacatcaccactcgccaaggttccgggcctacagctcgatcggaaaggcccacagcttcaggcccaaataattagggagaaaaaaaactgtacaaattggggaataagttcaccggagatccctcaacttaacagcgagattttttgaggtcccttaaccacaaaatcagaaatgtgtacccctaaactcactcaaaccgttcaccggaggtccctcggcagtattttcgtccggttttgctgatgtggcatcctagtcagcaaaaattttttaaaaaaacaccgtagagcccacatgtcagttgcacatcttttttttcctcttttcttctccttctctcctcttctcttttcttttctctctcctcttctccttcaggctggggcggagcagccacgcgccgtggccgtcatcgtcgtcgccgtgggcgaggctacgcggcgtagcggagggcgagcgtggcaacgaagcaacggaaggtgcgagcgcggcggcgggccgagcagtggagcgcgagcaggccgcggacagtgtagcggagcgcgagcgcggtggcggagcggcggccatcaagtttgggagggagggggaggcggccggcgaccaataaacaatctcttcctctgcctcttccacttctcccgccggtgatgcctctactagcat

SEQ ID NO: 58884 - DNA, 2619 bp, Oryza sativa
ggtagacgatcctgtttagaataagttcattttaggtacccacgtcttaacacgagtttggaaaacgtcagtgaaccgcaatatcagatctaacttgttcttaatcttgcaaagccaaggtagatagggttcgaagttaatatcgagggtagttttggctgacgtaaaactaacagcaaaagtttaaaattaaaagccatgttagacctagatgtcagtgctggactccaacgagactgccgccgagcatacccgcggagtcacaactccaatggaaggtggagcgtaagagaggttccatgttgactcaacctggttgactaaagtaagctcatcacgttagctaaaaccgagagcaatactatcttgggtcttgggatctaatgtgacccaattttataagattagggatgtgttgtatgtggtattttggttcagagacgattttaaaactcaacggcaagcgaggaacttcaagtgaacttttgatgggcagatgggccgcgagagatagttctgggccattttctgaccagaccttttgaagcccaccgatgtttgggcctcactgatgtttagtgggcaaaccgtcagatttcatgcccctctccatctggattctggaccagttggactcttctccttgtacttgcgacatcacaccgacgccgctggcgattcgtgttgccaccgtgcaatgcccaaatgtccgtgcatcgccgtcaactgtaaagcacaacgctgccgtggccaccatggaaagaagcgacgcttcacgtgctccggcatttgacaaaaaagagaacgttactttccgatcgattgctgttgatcgttgaagctatcaaattatcactagcatttcacgatctgcagcaatctacaaagtccaaacgtcgacctatatatatatggggcctattcagattggagaaattaaactgtttcatgttaaaatttcgtaaaattcctatgttctgaaggaggcaatagggcaattttgtttggatctttggggcactgcagcttgcttgctttggccgttgccgccaattcatcctatgtgaagtggccagcttcatgtttcagctaacacaatacagaccacgcaatttaactagtagtactccagaaaacacatcatttgccacgtgcgcttaattaataagtccatcatagtgggtaatacccgcatttccgcaactaaactgtttataccatgtgaaggaacagtgctgcttgggatgtgattgggcactaatctgactctaatgcggtctctgttgcgtgcgaaagcagcagagctgcaggtcaagaagaaacgactcgatcaaaaccagcgccccgtgcaaagtcgtagtagcacatggggggcccagtttggtggattgacgacgtgggccttcaatatgggcttaccgaccgggcctcctccatggcacagtcgtgggccagaatgcctatggtcggttacttcaccagactaatcagtgtgtgtgaagatgctgactgacgtctcagtgttaggcgcaccaagttgtaattttgcattggttagatatagggtgtttgttgttaagtttggtgcccctaacagccatgtaatcctttaaaaaaatacgcaagcacacaagtatattgggatgatcctactgtatactaagagctaattgtacaactaataaaatccaagtgcgctcatggtcttactaccaaatttcaggcaacctataaattagaacgttgttaaacaaatgcaaagtggagtgacaaatcaaaagcaccactgtttagcttatgcttatgcatataagtcaaaattaaacattaatacttattcttgaagttgattttaaggttttttcattataatttattttatagtgtttgctttttaaatcactaaagatgcatatttaaaagtttcatctaaaaattatgttttggttgctaataaacggtatcaataagtataagtataaacgaaaagataagaaataaaatcatgcttttctctctacttttctttttcttttttcctttaggagtatgatgggttttccttttccgttttgatattgggttatgttggttggtctgtactagaaaacaaaactggccctagccattttattcattcactcattcactcgctcactcggatcccattcaatcattcattcatgtcggattgatgccgtatactgacttgatgagctctgactgctcatgccataatccataccatgccataagagtagggtaacgagcagttgaccactgagccagactgcctcttacccgccaaaatataattactgtacggcccacttgttacgcggtagattttgaactgacgaagtccagaaagcaagcaaggacagatagcaacaaccctcttctctccagtctacagcctacactaccagttgagaaagaaaaaaaaaatctcagctcccagctcggcacgagcacgagcacgagacgacctgacctttctcttctccatctccaccccgtcccctgctcgattcccacctcttcttccagcccacgcgcccccgcctcgccacgacccgaatcgccgtgagatcgagccgatcgagcgtcgagcacctt

SEQ ID NO: 58885 - DNA, 3865 bp, Oryza sativa
tttttatgtaatcaactaatttttataggtgttgatagttattatcggcagtgaagaaggtaacggtggacgtggtgagtggtgaccgtgcctggcctacccgggagctggctccgctgctgcacgtggtgaggaccgtgccatccgcccaccccacgctaggccgtttagcggcaaaacgtccgggcgtgcttgggccgttgttataccgggacacggcccagaaaatacggccggttcagattcaggggacattctgtagcgttgggccgagacgatccaggtatccagccctcagccttgcattgcacgcgcagcatatgaggggcaaatttggatctcaacacatttcatttcaaaatagaaatctgaatgacagataaacagcccaaacctgaacttaatcacagaactacagcccagatctggataacagctatcagggtaggcttgtacatgaactgggaacggagtgtgtatgtatgtgtttctgagggaagccaagtataattttgctcattggcaagaccccaaaagtcaagagcatgatcatcagcactgcaagcgaatgagatattggtatggaatacatgaatgatggattaatatggcaatgaccttatcttgttccaatatcaatttgcagttccgtcgaactggcatctaggagcttaggagcaaacctagctgaattttacatatacattcagaagcaaatttggcagttctgtaaccaactgaacccgtttttttagattttatgtacacgagaaatctattataaaagcagatatacttagtgcgcagggttcgccgccgagctgcgcaatcgtcttcgtcagttaccagctgatcatttgatgatgcaaccacgctggctctggacggtctgatacggttctgaaattgctcaagcgctgctcttcttgccgttgccaaacaagaaagacaagtttggctttgccagggtacgcttcagagccttcactgccagtggactgtccttagcctgttgtgttcatcaagcaacaaaacagtaagaatcacagggaattcttgcacttgcaacagtgctagtaaattaccaatctctgcaattgcttaccatgaggcaggttccctgctgaacattgcagatggggtactcgtgagggcagcagctgtagtgatcatcgcagcaggtggcgccctcgagtgggcagcagccccaggcgtagcagtatttgccatactcgtagatgcagcagcaggtggtgctatcggggcaagtgtagtagttgtcgcagacggtgggaggcggggttggggacggcggagtagggccggggttcggggggttctcgcccttcttcagagggtaggatggctcaacggcaatgccgcacttgccactgctcgccttgatgttgcgctccatacggacgtagccggactcaccccagctcttgccccacgagttcctcacgatccagtagtccttgccattctctgtgccgtacccaacagcagcgacgccgtggtctagtgctgttccacatttacccgtgaagataccctaagaatgatatcaggaaatggcaatcagtgcaagcccaagtcatggaaataacaacataattgaaaagaacaaggaatttaggattaacttatttaacaaaagcagagtacaatgcatgtttcaaattttgagtattgctttatgggaaaaacaatcataatctttttccctatctaattgggtttcgaagtggatgacactggatgatggctcataccactccactacggacctgggaacacatcaaaagctactcgttccattaaaagtgtttcacaaagcaggggcaggaaagcaacaaatgaacatggtttatggtctatgaataaatggtgtgcactgaggtactaatttagtggaaagctgaaatgggattagattatctggatgataacaaattaacaaagtatgccaggactggacaaaatgataataagatttgcttagtagttgcacttgcaactgacaacacaatcatttcttttagtgcaataaccgtgattaaagcaaagtaaagcaggcaagggcaaaagcaatcagtgagcctgcctatttgtttctctatcaaagatagcaaaacttactaccgactacacattgttagaacttagcaaaggatcacctaacgaatttgaacaataacgttaaatcgacttacagatgagtagagctggaatgctctgccaccggcttcattgcaacactgacgggctggtttgctaccgccttctgcagactcgtctcactgtttggtgttacatcttcgtagctgtcaattgtgacaacctttgcgtttttctgtgagtatagcagcacaagtgagcaatagcatatcaaaattatgctactacctgaaaaaccaagggagcaaaaagacgaaagataccctgtttacgtcacaccgttcgtccttgcctttgtaagggtagtcatcctcggtgtcgattccaccattgttgatgatgaaatcaatgcatagtccatcagacctccattgcatccctcgttatatgaagtgtcacagtcaactagctcctgctcagacaaagatatcaggtcgccagtaacaatctggttgatgccttctacagctgctattgctgagaaagcccagcaacttcctgcaatataggagaattgaaggttatatttccatattattgtgtcaaaggatgacatgaaacattgtttgactctcaaatatacaagtaaataatgaggcaatacaaaacaaatgcagccaattatgaattagatagaccatgtggagcaacaacatttttttttaaacgacctacatcagacagtgcgaagtttcttttttcttttttaagcaacaacatgatgaagaactttagcaatgcaaaggaggaccttctaccaataggattgtgaaacgtctgcaagagacgtgaatgaaaggtgtttccaagggctcttttggagccatatgccaaatgacagctgaccactagtgtggctccaccagctacaattcaaacagtgaccactaatgcacagtatgattttctgtttggctctaatacgtccatgcacccacaaccaaaatatccacctttccaactaaaacaatttatgaatgaccatttattatagcttgccttcctgcctcccctacaagccacagtagagtacactcagaaacagcaggatcagttgcaggctctggcttattcataattccagatcagaaataaaggtgtccgattattgagtgatactccatacagagtacacaactggaatcaagttagtcaaccaaatatttttttgaggaccatgtgtatagccaactacacaaaccataaaaacaattgaatttcaaagaatttcattttgtgaatcacactgtacttcaaattctggattcagatcgaaaattccccccccccctttccggtctgcttaattttggggcatattgaaacatgtcctgatttatcgtttgacctggatgtgcccctaatttatgttcacgtggagtactaactactgaactgttgcaagcagaccaataatttcttgaggatcatcccgaataaactaaccgcgaaaatgattcatatgtaaaaaggaaacatattttacccctgaaactgaaatgaagagaggagacatgaaaaggatcaacggatgcttaccgcaacctccctggtccttgatctcagccacggcccccttggtcctccagtcaacggactccggcagcgcctcgttgtcggcggcgaggtacctgtcgctgaccttcctctccctccgcggcttgttcctgaggccgaggtaggt

SEQ ID NO: 58886 - DNA, 5298 bp, Oryza sativa
agtttaccgtatcgtgtcgttttaaaggccgcgctgcagcgaaaagcgaggtgtttcacgaggcgattatattaaaagcactagcagtatgcatctgttcgtacaaacggagctttcagccgtgccaaagctaatcacgatttcccttcacgagagtggtagcaaactggcccaaagcagcagctggtgactactccttccgtctaaaaaaaataaatataagactgaatataatatattcatagtacaataaatctgtatagatgtatatctaaatttattatattatgatgtgtcacttttagtatcttttagtattttagtatctggttggttttttatggaacggaggaagtagctacaccatgtttagttacaaacttttttttttcaaacttccaactttcccattacatcaaaacatttttacacatataaacttttaattttttcgtcacacgtttcaatttcaaccaaactttttaattttagcttaaactaaacacagttctttgtttcttgcagacatgaagcatatcccacgatcggcagatcgggcgggggtcatgcagtggcgccgtcagtagtcatggtcccttgcctcccccagttgcctggaatttactgggaacgcgacgagatgggctggacgtacgcaggcaggaggggatggaaagggaaggcggccaataaagtggacggacgcaggatcgccaagcacccggcggccagttcgtcctcgcgaccccaaaccgatccagagagacgcgccggatccatctggtagttgggatttgggaagatgacgatgataaggcgatggatgggagagatcgaaggggttcgcggtttcatggaatcctccgctagtttcgcgtgccaaaacgccgccgatacgcacggtagtaggtatctctatatgccctatgtctcctcgggtatgtttggagtagctatagattctgagaagcagctgtttgatacccagtttctgagaatctggaaaatgtttgaaacctagcttctccagcttctgacttcttagttcatttttcagaatctataactatatattctcaaaagctatgaattgtttggggcagcttctagcagaagcatcttcagctaggacaagctccccaaacagggccttcgtgacttcaccgatggaacgaggtggaattatcggcgtaatttaggattaaactgttcgaggaacgtgtgtgattatcaaggtttataaaaccgtgcggtaattaataagttatcaagtatagtatccttcttaatttttgaaactatgatataccttatgataactacccggttactacgataaccgtttaaacgtgaggtggtgataaccttatccaaaacgatctgataaaccctaattattcgtcaacgagttgtgttttttttcctagttatatccaaaatcggagcttagcaagcggggaaccaaaaatcccacattccggtgacgcacgcagcgagtccaatgggaggaatcttttggcccgcaaaaggaaagagcgcggctgcggccgcatcggtggacggggatagcagcggaggagggcgttggaatctctcgcggcggccatggcccatgggttggttggttggttggttgggtggctggcgtggaggccccgcacaccggaatcgtacaacaaaatcgtcgcgcggaaggatggatgagtgacgagacggacgacgagatgcgcgcggaaggcgacgggcgcgacccggcgagacagtgagtcggcagcgcacgccaccccgccggattggctagccgcagcctgcgctacagtggcagactgcatatccaagcgatgcacggaacaaaaattggcagaaactgtaacaagaattacaccaagacagaagaaaaaacatttcctagggtgatgaaatcgtcgatctttggtttggtttagttaatatctaccataagggtcggagtatttgattccaatgtatttaaaaactataaatgtattcaaaacttccagtgtatttaaaaattataaatgtatttaaacacgtgactgaatcatatcatttccatcaaaattcatatggaatgaatgatcatatagagattttgaataaaagttaacccaagcttcaatcttttaaaaaaatttcttcgagtttatctttctcctatgattcatgtgatctattcaaacgatcgtacatgtttcatcattctctgttgctcttgattcttataaaaatcttgtgttttttctattgctctaatttttcaatccggtgtttcaaaggtgtcctaagcattttctttggatgaagattgtgaatgagtttggatcaactactaggataggtaactttttcattttcatccatgctttccaaactcataaaatagtgtgcttcgtacagaaactttataaatagattttttctaaacaaataaatttattttttaactttgtaatagttaatgcttaattaatcactcgttactgatttatctcaattacaacgtgcaatagattatagctaggttcaaatgcaaccaaatgtatcttagggtctgtttgagtggaacttaatattttgataagtagatgtttggtagtcaatttataataatatgtagattctacagctataacttatcagaatctagataaaaaaatactaaactgtttagaagagcttctaattctaagagaaattggagtagttagaagcttccctaaacagattattaagctattgctaaatttgattttgtggcacgattgctaatcaccttgcgataagcggtcggcggtagcggcattggcttatcatttctcatgggatttctggaggaagagtatatttaggcagataattgtctctttcaacttgagaaacaagctaccactggagtaatgtactagcactacatacccgtagtaatgcttgtcacggtaccgcggctatctccttggtccatagtgcggatgtcgtagcagcacttgtgaccgctcactccggctaataatagcctgagaaaactaagccccatgtggacccacccacttgatgctgctgcctatagtaatctatttggccatggtgacgagaaccaggcaaaaactttataaaactagcgccgattgccgactaaatcaatcaaatgtaaaaaaaaaggatgaattttgatctagttaaatcagttatcagttcatcctgcccatagttaggagtgacgacaagcatgtgccagggataatacagcaacataaagtattgagacaggaaagaaaggccatgttagtatgttactgctacctcgatcatgcagagtacgttcataaacatgtgatgcgagatcactaaaaaaacatcaagaaatccgtcctgtgtcaagcactgctctgctggttcccctcccttgcacaactcttttttgtcagtggagtatttttacttgtgaagcacatgcatccactctcgtttttcttcccctgaattctcattgccatgtcgttcgtatcaactgcccagcacgcaaccatgcatcgacgtgccatcgaatagttctttagtttatgagttctttgttacggcactccagtcgatcggtcaaatagttctttggataaccatattgaatagttttgcactctttggataaccgtattgaattatagaagtagacgggttcagattgatgcccaccatggaatggacatggtcagtttctgagtttgtttgcttcacaactctgataaaaaaaaactctgaagccgtgggtcaaactttaaactctctaatttgagctcggagtgccacatacttaattggaattctgcagctattatgtaaccctaaactgtaacttcagattgaaggattcctgaatctatattttccaatagcgctttttccaataattgaagtcatggtccaataatgtgaactcagctgattcctgtatcatggccaagatagagccaacaaagaataagagaaaaaagatatcttcctatcttgaaaggaaattccaattagttaaacagtcaacgatctccttgttgctttcatttattatgtgctgaggcttacaatttcactgatatttcttctgcccttttgttgacgttgatggaatcattacaaaaaaaaaaaacagagaggtgacgttgatgaactgctgtctctgttcctgtggccattaattcggcctataatctagcaattcatttcggaaagtacagcccaacagtgaacagatagaagtatcagatacgtgggccaaattcacatgttcggtcgatatagtcccagcccagctagtataataataaactaacaaaggactgacgaaacgagatgttcaataaaacacgagctaaacaaaatatccaccgatcaagccaatcgggatctttacctaatttactaacatatataactaactctcacaaactgatagtaaaaaattaaccctaaaccaaaacactctaaacctaattaacgcccatctcaatttctagttgattcgaaggaatttcttgattggaccttccagctgctgcatgacggccttccatccagcctccgtggggtgcacatcgtcccagtagaagtacttctccggatcgttgcacacgctgaacaggtccttgccatcgtgtcccttctgcccgcagaagccgttcgggtccaagctctcgcagcacggctgcatcttgtgctcgaactggctcgacaccttgtgcttcgaacctacatatcaaattcgtcaatggacacatgtacgttgtaaacagaaaaatgaaagttcatcaagaaattaagacgaatcaacaatgcgtagtaattatatattaccttggtcgggattgacgatgttggagaaggcagtgttgaggtcgacatggtggacgtagtcgaggtgcgagagcttctgttggaggttgctgccgtggaggtaggcgcccatgttgccggtggagctgcagccggagtagttgcccggcctggttacccacggcgtgcagccgacggggtgcaggttgttcaccaggatcttcctcgccccgttgttcttcagcctgtgcacctgcttcgcgatctcgctcgtcacctcatcaacaaacttgatcatctgcaaacacaaagaacatgcaatatcgatcgatcagaaagactgttaactaggacgtactccagtagctaatgtgtgtgaaggctgatttagatgactatttaggtagcatgcacgaaacgagaatcattttccccgatctgtgtactgacctt

SEQ ID NO: 58887 - DNA, 5069 bp, Oryza sativa
cgcttatccatgtgataaagcaggtcaatcttatcttcctgcttatatattataagaaaatctaattgtcaggagttttacactaaactaaactttatatactttttatctctatatatgccaataaaaatacgagactacccattgatatttcaatagatttgaagcttcaaattttacagaacttccaaccaatacatatagccatttttgaatgaaataaaagaaaagggacaaacatatagaaaatcataaatcttgagaaagaagctgttgtaaaatatgtttttttaatgtaagagtgtagttgctctgtaattaagtgtaaatactctataaccaaatataagtactttgtaactaaatgtaattgcaactttgcaagttgaattcataggaacacaaatcttgatacaagatcgtacgggtgaaaagtcagagtataagaactcaaaattctatcgcaagtgaaatagcaaaacctcaaagatcatactctgtactagttttgtaagttgggggatacgttttatccagttttacggttgaaaagcacgattttgtatctcgtgacatgatgagaggaacctcaggtataccttttccatctgactgattactgtagtcttctgtaattctgttcgcagttacaaaactttttttcaaacaagtttacgtactacgatgctcgttttgtttctctcttaaccgtgaacagcatgatattgaattttgagtaaagtgcattagcagtacttaaacttgtagggttgtgtcatataggtctataaactctcaaaatgtatatccggatcgcataacttgtcaaagtgcatcatctaggtcccaaattagcacatcccctctaagatcctatgtggcgctgatatggcaatgccacatggacgtgacgtgtccttttccttttttttcttctttttccttttctttttcgttttcttctcattcttatttttttccttttttctgcacgggtcacagagaaaggagaagaaaggggaaaaagataaaagaaaaggaaaaaggaaaaaaaattaaatgggtcccatttgtcagtcaaaataattctatatcatgtccgtgaggcatacacatcaacgtcacgtaagaacctgaagaggttttagtgatttgggacctagatggcacactatgacaagttatgggacttggatatgcattttgagagtttagggatctagaagacatacccctacaagtttaaagactgcccgtacactttactcttgaattttttatcgtcctatgatagatgcctagaatccaagaactgcattatttttttaagtttataacttattcttctcattttccacacgcacgttcttaaactgttaaatggtttgtttattttttaaaaaaacaaaagttgcttttaaaaaatcatattaatctattttttttaaaaaaaactaatacttagttatgttaatgagttgctccgttttgcgtgcgagaaaaattagtttccaacggcaaggaaggaacgaagtgttaaattgacgagtagaagatgtttctctgtgggcggaaagacgatagaggttgtgtttagttccctttaaatttctaaaaattccgtcacatcaaatgtttatacacatacatggagtattagatgtggacgaaaaaaatcaattacacagtttgcatgtaaattgcgagacgaatcttttaagtctaattacgtcatgatttgacaatgtggtgctacagtaaacatttgctaatgatggattaattagacttaataaattcgtctcgaagtttacgggcggaatttttgttttgttattagtatacgtttaatattttaaatgtgtgtctgtatacttaaaaaaaattagctgtgtaattaaacacggccagaattgtagtccaagcttcgaaagctactctctcccgccccctttcttctcaccattcataatggcacagtgctagttgtgctcgtcccttatagtgatgtactcccatgtttattattttcaatggaagattcagtgggaaagctctctcctccagtgatttctccaaaaaaagaaaaagaaaatcacgagtagctctctctaaaaaaatcacgagtagcgacaaatactaaaaacagttcatccaagaagctgccatagcctatgatccaagaggcgaagaccaatttacaaagttaggaatacgacagcttccacctaaccataatgttcctcacaatcttatagacacatcagacaagaacagacacattatggatataggctgtgttcggatgcctgagttctcaactctaacagtgcgcacggaaaacggagcgatccattagcacgtgattaattaagtattagctaatttatttttcaaaaatggatcaatatgtttttttaggcaacttacgtatagaaactttttataaaaaacgatccgtttaacagtttgaaaagcgtgcacgcgaaaaacgagaggtgagtattgggaacttggagttccgaacgcagccataggaggagaatgaaaaatggattgttattatttcagacgagtatacaaccaatggtttaactcccagttacccacaccacatcaattcgtttttaaagtccctgctctgatctatattacacaaaaacaatatgcctaatttgctatctaccagacaagggacagatggcacatataattaaacttttatctattttacacggtggtacaaaatatgcgcggggatttatccccaagattacatgtactgtctatggtttctgtagagtccagagaaataatctgagctgagttacattatgttacttgagagcgtttggcaccgacgaggcatagatgcatcagtgaagtacttggggcagatctagtgagccatatagaggtatggtttcgatctgatttctattttccaacaaaaaatggcctctagtgctgaccttcagtattcaatagcgtggtccgcttgagtggtgtttctggtttggcatcctgttggcgggaagcgatggttaccagaggagggtcaattttccatctgcacaaaaatgaaggataaatttagtactgtggtttaagagaaacatcagggttaatctgatagatcttcaaactcaagcaaacaagaagggggtattcttttgattcttatgccatgcaaatcacaaaagacatataatgaatttataaacaccaaaggttacagtgacaggacatacatttcatattcaaatcaccacacaacagggtaaggttgattcaggaaagaggtttcatcattgataggaatgatgtgttaatggaagtgataagtatggccaattagagttgtctgcctctaccttttattgacacaacgcatgggacagctagatcaggccagaaagtggaagaaaataaagagccttttggtgaaagtaaggcgaatgtggtatcatatccccttccggtcctccacagattaaacaagttaactcaccacaaacatcatgaaacgatggcaagaaaaataacagttttaaatactcgtactccatcttaaatgatactccactcactactagattgttgacatactaaagaaaacccaatatcctggcacaatttgaggagtaccagcatatactagtaccatatgtataataattaatatactagtacaagaagacagacgtatttggtatatcagatgagttgcccaagactcggagactgagataggctggtcacaatatatgaacactgttgctaagaaaaaattggccctgttctagtgttgtgtctggtcggcacatgtgcttgagacctacacggatcgctttcagcgatcgtccccaccccaccgaacatattaggaacacaatgaccatcgtcgcctcgccaaccataatctgctcgacctaacgtaccttaccttgccatggtgtcgggatcaaatcctagatctgacccatgcaatttcgagctaactgctaacgtgctaatcaaatcacccgtaatcacgcggtaacatagtactagcatttggagattattaaatttgggaggagtaatctggtgatgtagagagagggcaccgacgaaacttactcgtgtgggaatttgacctcgtggagggcatccgaccggtgggaccatgccagggcggcctggccgcagctggcgagcggctcgacgcgggcggcgtcggtgaccagcgagagcgggctggcggcggcgccgtcgtcgatggcgtcgatgtcgctcacccactcggggcgcgacgccgcgccgccgccctcccagagcgcctgcgcgttcaccacgaacccggcccactccagcctgctcgacagcagcatgtcgccacggttcgccggcagcatggtctcctccgacacgtggtagcccaccagcttcccctccgcgtcgcacgacggcgcctggaggaacgtctcgctggtgccctcgtcctcgcccagcacgccgacgggcacggcgcccaccgacttcaccttctgcgcctcgtcgaacagctccgtccggaggatgctgttctcgtcggcgaacaccacgacgccgtccatcttcctcttccgtatctccctgcatttggtggcaccagagagatctcaattgcaacatccgaggtcgcgaatcgagagcgagatctagctgcggtgattacctcagggcgtgcattcgcaggcgcgaggtggaggagtcgggtcccgtgatgtggaggaagttgaggttggagcgggacagcacggcggcgacggcgtcggtgtggtgctcaggctcgacgacgatccacgtgagagggccgtcgacgaggcggagggtgtgcgccatcgacgtgagggagggcacctggagcgcggaggtggtggtaggggtgacggcaatgacgggcctcggcggcccagccccgcggcgacggctgctgcgctgcgcgttctggacggcggcgaggatgtggtgcgccttgaggagctcgttggggtcagggtgcggccacgggcggaccggatcgggtggcggccgacgaacaccgg

SEQ ID NO: 58888 - DNA, 8140 bp, Oryza sativa
gaggtgaggtgttggggttccaccgcgaactcggcaattggagaagagaagaagaagcgagagagatacacgaacacgaggtgaggttggggttggggttgggctggcggtggcggtggcggttgaggcgtgggattgggggagaaaacacgcccgaacgctgggaatatttcggccgttggcggccacgcggtggcagccagacacggttccccgttttcacgctttttaaaaagctcggttgcttttacctctctgacggcggtgtgggtatcttgttcactttggttggtgaagctgtctactccgtatggttatctgaagtaaacgcgagctgacctaaacagttgacagtaaaagtcgcctagtaaaatacatactgctatgaagagggagcagtattcattcatcttcctgtttccacgcaataaatcaccgctcaattatcttcccctcgcatctttcatccattattaatactcccccctacggtacagtaccactgtcgctgtgaacagaactattgcactccaagcaattctcaaccatccagatccttttgcaggaactctatggacagtagacatgagctctctcgctgccgatcagatccttgaacagtctgcagcgaccgatgtttccctgtttttttttctcttgcaggaatttcactgtgttgtcacaagccggggtgctgcctggctagtttgttgtactgccgttaataacatggcaagggacagtagtactacagtaagcttcctgtcgttggctaaaccaagatgtgtttgattaacaacaaaaggggttggctgttgcctaatgcacgcactgcctgtacagatttatttaagctaccaatagtacagcatcttcttgcagcgttaaaactgctacaggatttttctagtcggcgccctgaactttcatcagggatggtgctcacgtgcaggcaaagggcaggcagcccatgctggctgccgtaattctgaactgatccaacgtatggccaatttggccatggatggattggatgcttggctgcttgctcgttctggagttctgacctgtaatgtcattttcttaatcctttctttttctccccaaattttgttttcctgccaatgtcagtgtcaatcccggattggagtagaaccggcactcgatcatagttccatactcttgtcttgcattctgcattgccatgtgtgtcagatttcttgttcattctgaagaaagtagctttatgagcagtaagacactgtcccattcagtccagaacacaatacggtgaatctgtgaatctcttgcacgaaacaactgcaagaacgggcagtacaggataagttgataatatgatctgaaaagtgattaggagagtgtacaaccaatcatgttttgaactaagcttgaagaaacaataatccgattggtacaggttgggttgaatctgctacagttttattcaggtatgcttgtcctcgtgttcgacctgatgggtactgaactatctacctagatgcctacacatataaacaaattacagagattacacgaggaggaagaagtgcatgcaatgcaatgaaaatggacatgaaagcttagagctagctaaaccaggatgttgtcacataattatgaattgaaaggaacatgacataggcagtgttagatacttaatatacttggatacatactagtatatcatttccatacctacgcagcttggtggtgtgagtgtgacgctcaccggccattgctgaagactgcacttgaactaccagctagtgtgcattttaattcctggggctgcattcttaataattcagtacgattgccttttcgtctctctatataactttagttaaaatgttctttaaagaaaaaggataactttaaaatggacttcacactctgaagtctgaatatttctttctggcaacgaagtctgaatgtttgttgtgcctggtctgccgtactggccgttcggtgaaacatgcacataaacagcgattgcataacagtatacagtagcattatgctcctccttttttcatcagctttaaaaattgttaatgatggccgattaagccacatgtaattataattaccgcgtaacaggtggctacttaattatcagctcatgaggttaatcatttcctgacgctaaatcggcaatagcgacgtataggttgcagttaggtggagtccttttctttcgcggcgtttaagtattgattagcacctgctttatgtagtttaatcgtcagtggatggagtagtagttgcaacgttgtcgtttacactagaagccatccgtgcccagccaaattaagcacgaatgcatgcatgctttcagctcaagcgaaacagagcgaatcacagcctctcctgtgagactgtgactgaatctctgggttgttacttgttcaaagttacaacggtgactgtactgtaagctactcctaaaagttggagggaagtgaacaagcaaagcaatggcaggtgatgaaaggctgaaagcatctgcaggcatgcgttgcccgggcgtgaattctgtcagaaaggtaatataaagttttggagacgatttcacaataattcatgtggtcaggggagtaatcatgatcataggagaggttccattcaactaacagaaaaggcagagcggaatctgcactactttcttcagcactttgtggttgttcctccttttgccggtctctgcaatttgcatccgggtatgatttgctactgttgtttgctttgctccgtactactgtctactggtagtagttcactgctccactcttcacatgcagacatgctctgattgatctggcacatgcatcaaattggaaaagaagaaatggcatgcacaaatgaccaagatgcgtgctggtagtacacaagaaaccaaagaatttgggtcttcatagttaataccgggcctagttaactagcagttttgcaaagtttctagctcaaccaactggtagtctttcggacctcggatcatgctctctatgatttgtttttgaaaagaatggaatgatgaaagcttaatcttcaatccaccattttggtccagtttcatttcatgcagtccgaccaaaaatggcaactgaagatttgatcaaacatgattgcacattgatctgtgtcataaaataagacactagcactagctaaaacgaatgcaggattgagtcctttgcttagaagcgacatcagagatgacactcactcagttcattacaagaaattgcccataatcggtgcttctgataaaaatatccatggcttcctttgctgaatcagttatgtttgtacagattttcaaggagcacaagcgctagctactggattttctctaatttgtctctactaacactaggtgcacttgcattaatttgttgctagtaacactgatacctatcgattcaaccaaaaaagtaccatgtgacagcatctatagcaccaagaccagttgtgctatgaacttataagctaacaatctgaattagtatcagtattaaatcagataattgcacctaactaactcgatttttggtcatagtacatatgagaacttatgcattgtgacgccgaacgaccaaaacaaccaattctccaaatgaatgtgctccatttgttccagcgacagtccacctgcacaacaatggaggacaccaatcatttggggtcctagtacgccccatgcaaatgccataacaaacttcttttgacttaatgggcacctcaggccaaacctccagctatgcacaaacagttcccctagtttggctgtcccatagaagaattgaaggttttcagttcacgtttcatgttcttcttttgttcgacatctcattgtaatcagttgacgttacacaatttggggccattccataattgtagtaccttgacttgcagagagatatatcagaagatcctataggagagatttttgtcagtaagcagacaatggtagaacgctacaggaagcaatgtcaagaatatagagcaacgattcacccttgtaactatcatacatttcaaactgaagacagaaaattttagcagcagaaatatgattagtttgctaacaccacatggttctaccagcaaaaactggtgcttctaagttttaacaagtaataacaattctcccacatggttcacaactcaaggccagcagaaaaacgttctgcagagaaacgaagctatcccagctgtgcttttcagaccaggaaaggctctttgctttggtttcaaacaatggcaagaaaaggtcacagctacatgcaactgtagtactagtgatcaatgctcatgaacagatgcttaaagcagaggaatggaagattcctccctccagaaatccggcacatgggttgttgtctttgtttttattttatgaaaatgaaacaagaacaggttaggttagtcgaacgtcggcgtatgggaatcggacatctcctctgctgagagggcacctcccactgttttttttcacaagtcacaaaggtcagtaggaatcagggagctagcagttggaggcttggagcagagcccagtcaattagatttggtttggtcagattatgacaccgactcttcaatttccaatttgatactagcatggaaatcaagctgaaaactatgtgtatgctgctactaacacgcaaaagctagcatcctagcacatggcatatgaagcatatgcaacgcaatgccgtggaatctgttcaaagggaaagagcacttacgatagagtagtttgttcaatcagaaggtgacagaaagtttcagtctttcaggtgcttcctgcaaacgctgcagtggaaaggggaggcacatcaacttctcatctactgttgagctgaaatagccgcctgatctaaatttcaagtacgaaatgatcataccttgcataagtagactggtagttgcatgccatgcgcggtttgttcagctatgcaacagacaccgaaagctgagcctccatttcgaacgagaaattctcacacgaattcaaccgtttactgcaaatttcaatacaaccaagttaaaagaacaccaaaacaatcgttatttatttctcatttctaattgctttgcttattgatgaagctgatcaggtgtatgatttagcatttgatacaatgttcagaacagacaagtgaagaccaatcaaccaaccacgtgcagtcaaagcttctgaatctcctgcacaaaccgctccagatcctcgtaggagctcccaccgctcctcaccgcgatcgcggcatcggcggcgagctccttggcgcgcgcccgggcgccgctccccttctccccgaccgcgtcggccagcacggccgcgagctcgccggcgtcgggcgcgacgccggccccgcccgcgcacgcgcgcagcgccacgcccgcgtcctccacgagcagccgcgcgttcacgaactggtcggccgccatgggccacgccagcatcggcaccccggcggccaccgcctccagcaccgagttccagccgcagtgcgtcatgaaccaccccaccgccgcgtgccgcagcgccgccacctgcggcgcccacccgcgcaccaccatcccgcgcgccgccgccgccgcccgcgcctcgaacccttcagggaccacgccgtcgccgctcacgacccacacgaacgggacggcgctccgctccagcgcctctgccagtgccgccgccatggccggcgtcagcaccgcctggctaccgaagcacacgtacacgaccgaaccttccgggaaggcgtccagccacgcgctgagatcgccggctgcgacggccgcttccccaccgcgctcgccggcggcgtccgtgtccggcgccaccgggcccaccgcccacacgcgcttgaaccccaggtcctccagcggcgcgtccaggtacctcccctcgagtgcccggaaggtgttcgacacgaatccccagccctccagattccagagacaattctgcttcagcgactcgccgacctgctcttctacgaggccttctatgtaggccttgtacaacatggagatctctctccactcaaacgccggctcgccggggatcgccgggaacgcgaccggaaacccatcgtcgcaccccacgggccgcttcaccaagcggcgaaagagcgagtgcggcacggcggtgccgagcacgccggagggcgtgaagacgaccctcgggacgccgatctcggcggcgagaggttgcatccacccgcagaagaagtcggatacgacggcgacgacggggtgcgcgggctgcgacctggcccacgcgaggatggggcggtggagcgcggcgagcgcgtggatgaacacggcgatgtagacgggagggcagttcatcgtgttctcgaggccggcggggagggaagggtgggaggggaaggggaggacgagcgggcggacggagtcggggtgcgcggcgaggagaggggcgagctgggcggcgttgcccggcgtggtgacgacggtgaggcggagcccccgcgccgcgaggagcgcggcgaggtcgtagagcggcagcgcgtggccctgcgccgggaaggggacaaggaggacgtgaggcgtggcggtcggcggcgccattgctgcggtggtgaggaacggaggcggcgtcggcggcgagctcctgatttataccgtacagttaagaattttttaaattttattaaaatatttaaaactatttttttaaaagttttacaaatctgacctctcatgccctgtgaaagggcggatggcgtcccgttctcctcactcatcggccatgttttacaaacggcttaacaatgtattttttaaaataaatttctacaggaaaattgttttaaaaattcacactaacccactttttaagtgtttttacctaatgcttaaccaattgtgcactgatctaatatttcatttttggtgcgaaaggtgagagtttccaacccgcggtcggtcaccttgcagatagcccttttaccggcctcccaaagggctaggccgtctgcaaaacaatcgggtctaaccagtttacaggcagtcacttgtcgccgatgggtagatttgtaaaacactgaaaaaaatattgttaaatattttaataagtaaacttaaaactgaaaaaagtttctagttagtgggatcggaatgggctgggcctgagaagactactacatgggccggtggttcggcccagaagaaatcaggtagccgacgagtcatccacagcgacggcgagtggccaccggccgttctacatctcgcgcgcggcctccggtcgtcgtcgcgactccgctgccgccgtcgcccggcgccgccggtgatcccgctcatgtgctagtagaaggcgttcggagctctttgggagtgtcgcacgcatggagatgaccagaagccttacgctcgtgccgctcccggcgacgctccggccggcatccgcggcctgtcgccggcggcggaggcggcgagggcttcccttcggtgcactcttctcaccatcgcctccttcgaacgtatgtttcttcctcccccagctaattctgttccctgcttgaatgattcagtagttcgcaattcttcttcagcagcagcagcaggaaatgcacatcagggcgctgcagccgcggcaggattgggtgggggagtgggtccggagcaacgacacgctagtccgcggcctgcccatcctcggcggcggcgcctccctgctcgccgtcctcctcaaccgtgcggtttccggcattgcagctgtcgccgacgcctccaggtcatcctgtgggtgcagagccaccccaagaaatgcccccattttgcgctcgtcttggattggatttatgattactgaccaattggttaatttgatcttcatctcaatagttcgcagtcaagggctgacatactgactcttgctctctccgtaactgatattcttgctggccttgtttggttgtccatccggccgaaatccatttctcctgtgagttttttatcctttgcggcatattactgtagtaaattttttacaataattcctcattttgaaatgatcttaggttgttcctcgaggttcgagtgcaaacgggtaggaacgggtgtattggacgggctgcaggaat

SEQ ID NO: 58889 - DNA, 1145 bp, Oryza sativa
agatcttattttaattcatagagatcatggaagctcaaataatgaaatattattacttaaaaacctcgctaggtgttccataccgtgattctatataattactagtgctatgatcttccatgaacataactaaacaaatctttcagttttatgcatacacaatcccatccatgtacttcatgtcaaggaaattatgttgtgaggctggctgtgacttcaacttctcacaaataggacatgggattcccttacaactgcaacttgttgcaaatccttggttgttgtgtatggaggtaattgtgttcttcaaattggggttgctgctggctctccagaggatggtaatgcagttatggtggatgcacagaagttcatgcaaggttccctttatagaagtgccatggaatccaagaagcgtgagtgtcttttgttacttataaagttctttttttctgtttgatttcattcagaaacttcactttggtcttcttgcagaatcttacctagcaaatcttgccttatatcctggaaggactgaactaccattcttgccagctaacacgcaggtactaaaaaattctttcatcttagagaaattacatgtaagcacgcattggtgtgtttgtcaacttgttatacttcacgaaagctgatcataccatctttaaactaggaaactccagaatgcatcctctcttttgtttcattgaaaaagaagggggaaatcttattaagtctaaagatgactgcattcaacattcagatgaattaattgtatgaatgtttaaaaccaaagcttttgatatcttccctgatatacaggccctaatattgcaaccaattggtgataaaggaattgcagttattggtggtgacactataagggggttcactaatcttgatcaggtgctatttctaatctacagcctcctaacatatatagtaccacgttttgttttgggtgattcgcacagataatacagagaaaaacaatctatatgtgtaagctaaagatcacagtttttaaaaacaaacacaagccaaaactaggtcaactaaatgcttaacattggttttatgctcacttttgctgaagcatacaatctctacggtgtgtgtttgcattggagcagggctgcaggaat

SEQ ID NO: 58890 - DNA, 733 bp, Oryza sativa
tcctgcagcccggtcagtaggagatcccgacgagggcaaccatggtgtaggcgacgagctcctcccgcgacctccgctcgcctggcgacaacgacgacgagcgcccgtagccagacagctgcggcagctgcaccctgcgccgcccgctcaggaacatccgcatctcgccggcgaggaactccgcggccgcggagcgcgacgcagacgcgcggcaggtggcgcgccagcggcagcacgaggttgaacggccacaccaggaacgagtactgcaagaacgcctgcaggaaccctccgcccgccgccgccgccgccggcacggcgagaagcacaacgtgaacagccatctcgatctccaaactccgagcctctccagtttagttagtaatgtacagaggaatgtatttcaacatcatcgaatccgtaaattacttccatttatcatgccttaaaggaaacatgctattacttggaaaataatatgtccttgctccaacaccaacatatcaaataaatcttagtaacaactatatttgagctccaaactttcactaatgtttgtgcgacagcttaacttataagaatacccacattgacaaaagactcgaatttgagcaggccctaaattctacaacaaattggcaacaatcacatttcaagtagctagcattgctatttggtcatatcatagcctttgatgaactaagttcacagaagaaaatacaggtttcctttt

SEQ ID NO: 58891 - DNA, 1525 bp, Oryza sativa
ctgcagcccaattagtatgcaaaaaccttctcatcaatactgggattggcagaaaataatttgagcagctcctgacaaggcaggtagactggaattttgtgagcaagcaacttcatcatatcagattcaggtacctaagaaatggaaataaacaagtcagttggcaactccctaacaatgctgaggtttaagataattgtttactcttacactatctcttgcaatttcaatgggatcattaaatccatgcttaagcttggcgagaactagattcatcgcagcttctgcatccttcaagcagttatgtggctccccttcttctcgaacagcatagcccaaaacagactagaagcacaaaaatcaacaaaaaaatttcagcatgcatagattcagagcatggggttcttcaggccttgtatgcattgtttttcttaagcagaacatcattcataaggaaacaaggctacgagtaaataagatgctatgcagtatccctttaactgtaccttgcacaggctgtttaaagaggctgatgcagtagtaggcaaatttgcatacttaaagatgtatgctgtatcaataacccgagagtagtcaaacttaagagctgcaaacgaatcaaaaaaatgataaaagctgagttacatactgagtaacaaaataaagcctgccaataaacatgatggatgcatagaatgactatatcaaatagattggaccgcattaatcacagattaccatgtaaatcttttgataggctatgaccaatcaagatctttcctttggacaagagcttcttcaacgatttctagggaaggaaaggaacaatataacttttgcaagattaaatcaaaccaaatacataaagaatttgtagaagcatacctgaacatcaactaatgagcatgtgactccttttaaatccttcttagacaaaccagtaatgcttgtcctatagtctgcaacagcttttaaggggtttacaagttcatctaacttcacctgaaaaagaatgaatttagtgtggtctaagaagaaagatggaaaattatggcatgattaatgattacaagtcaaaggacattgcatcaaatatacatgtgtctaatgtttaaaagatttggcataaactttatctaaccagcattaaaacatgtttttttgttgaaattatgtagtgttaggaaagttctgcttgttgaggcacgcagcagaagacaattcaatgcgtccaaatataatacctctagattgctgttgacaacacatactcggaccaaggcttccgtaccatcatggcaaaggaccatctcacagtcaattgccaacatagttgacttcataaaattggtaattttgccttcacgcagcactttccatccctgtcaacatgtcagtaaatctggagttatagaaaaccatagacatctctaatcttcgcaatgggtgacatgaagtcagagaaattctcctgtattaaacactactgaagtacagtagatagacaatactccctacatgtttt

SEQ ID NO: 58892 - DNA, 963 bp, Oryza sativa
gggatcgaattggttagtttaatgcagtgatccaatgcaaattgagttcacgttccggccgatccatttctttcgcgtgtcgattgcttcgaaccggctgaaatgaatcgacgagtcagcattctagggaggtcggaagcaggcaggctgcaggcatacgcgttgaactgagctggcctccaaaacctaacctagtaatagtaagatcatcgatgacgccatggacctgatcagatcgcacaacccaaaagctgaggcgtatctggaggctggagcccagcattctcgcaatctcgcccgtgccaatcgcctaatccacgcgtgcacttgcatttcttaatgcgattgatatccatcctgtcatggccaggttcttcgtagcttagctgctcgtgtcaacgctgacattgtcacagttcaaagtcagatacacgctcaattacacagccagtacacaaatcaaaccttccatctgacagagtagcaaaaaaacaagtactgtatgctgtactacgagcatgcgtggcaatctggtctggatgggtgcggacaatctgaagcatatccctgacgtgtcacagccaagtaagtgccagcctcatcgcaaattcgcagagcgatcggcttgtccgtgctcgatcccgtgtcgcaaaacgcgattactttgtctgacgaagtgagtgttacctccagcttattagccttatctccggctttgctattggtcaacacgatgaggtagcatgctcagctccaaccaaatggcggcacaaagaaataatttaacgactcgtgcacgcgcattatatttcttactcgtgccgataactacgttgatgcatgctaatgcttgtgtgtgacgtattcttccccggttatagcatgtgtgcccatgcgaaggtacgtgtttggttcatatgtaactgatcgattatccatcaccggttaattaaacataactgc

SEQ ID NO: 58893 - DNA, 6890 bp, Oryza sativa
ttttttttccccctccaaacagtgaaaaagaccgatactatttgcagactatgacttgcaaggaacaaaagataaatgagaaaaaaaatatcttttcggttaagatttttaacggcaagtaaaacgatattcaatagtatatgattaattgagtataaattattataaatttgaaagatgaatttgtttatcttttaaaagaaatttctatatagaaagtttttgtaaaaaaaacaccattcagcagcttgaaaaacgtgctcgcttgaatcgaggaatttactaagtccaaaaatcaaatagaacacaacttgaggccccctttgattcaaaggaaattcatagaaattttaaaggatttcattcctataggaattttttctatatagccctttgaatcaaaggaatgaattctctgtaatcccatgaacttcctatggaatgtctcttctcatgcaagttttggaggaaatttagcatgaggttctacctcgtgttaagaatcctttgagtctttatctctccttaaattcctgtgtttttcctgcagctaaattaaacggtcattcttatatttttcctgtgttttgcaatcctctgttttacacttgtattcctgtcagaatcctatgtttttcctattcctctgttttttcattcctatgattaaaaggggccctgattgtttaatatcgtgaatgggctgttcgtactccttctctctcaaagtaaaagcatttctagaatggaattgccaaatcacgtttgacagaaaaatacagttaaaaatcttgtaaatttctgatcttcaaattcacttcacagcatgtgtcaagcctcctcctcgacatcgacaaactctggcgataggagatggcctgacgagttaaggtttaggttggcgttggggttagggtgagaggggagtaagggggaggaggaagagatggtcgtgagaagcaacaactattgattagcttaattaattagatgatcttcaaaaaaatattggaggggtcctagcctctgcatgtgcctctgtttttgccttagcactgctcaagtcgcgagatagatagtgggtgatagatcagcgttgacagcaactcagcaagggtaaaactaatctaccagttaggaggcagggacggtgtggttgcaactggaacacattcccgccctgtcctgaaagccatacggtagtattgtagtactctagtactctctccgtaaaaaaaaaaaacaaaccttatgtttatgtgtcaacgtttaactgtctattttatatgaatttttttataattagtatttttattgttgttagatgataaaatataattaatactttatacgttatttgttttttaaattttttatattattttaattttaaataagaaggacagtcaaacgtcggagtcgtcttttttggaagggtgggagtagatcgtttaaacgtttgaggtttcagctggctggtagctagagagatcgaggacggggactggcagagcaacgagcacagctagcggaggttgagttatggctgggctggacgagcgggccatcgagtcgcaaaagtagcggacgttcgtacggggtggatctgggaggatcttggcactggggcacaagaccttcttggggagccgtgcgtgcgggtcatcaggtcaggtccaccaacgacgccgggccgccttgtccgacgcgaaaagtgggggaatccaccggccgcgcggccccccggccgaccacaactggagggaaacggacggccgttgcttggttggtatctgacgcctctgcttctgcttcatgctcgcctgcgcccccgcgtcatgtgcggtcgaaaagcgcggcttgcctgctgcctcgttgtcctcctcgtgcatcccgatgctcacggccgccatggctttcagcgctcggtacactttcgcatgagatggagtcgtggaggcccaggtgtgtacaccgagcaattctacacaaacttcaatcgcgatttctaaaaacctgtgtaacaacatggttaacatggagaattaagcaggggacctttgtctgcttgagttaaggtctttgtactttgctccccgtttcttgccttcaaaaatggcttgctatggctggtgaaattccgggggacaccagccgcatgacaaattgacaataggcagagggacaaacaactcaaaacaagtcgaccattgttctatagctcgtgcatgctctaagagcaggtacaatagcagactattagccggctgtaaatatattttaatgaaataaaagatgagagagaagaacagcgggctacagatctgtagccagctgcagcgcaaactccaagacgcaatgtgcgtatgacaggtgggaccatatattaattacatataaaaagcaattattgtatgaattaactattaaattggctatagataaattagagctagtaatgggctatactattaaacttgctctaatctctatagtcaaatcaaccatttttctatgcagcctgcactttgtagcagtgtgcaatttgcaaatagacaatggcagtactaccactagtactggaatgaatctgcgtgagagtcagtgttcactgcaccctccactcgacagccgtttcaaaacttgcatattcctccagttagcttacatacatgcgcgcgcgtacgtgtggaaccaactcagcctagtacgtttccttaattcttaatccaaccagatcagattaaataatcttctccatgctagctgctcggcgccaaggcggctgtctgtcttgtctttcctccctaatttgattcattgattcttagctccagataattaggatctgtctgtctgccattcgtgtgtggtgctgcacgagtacttgagtggtaattgctactctcgctttccattgcacttgcaaagttactgtgatgaaaaggaagggtttaacccaagtaaattttggttttaatctctggctcatcgagtgctcaaaagctttgcatcagactggcctctcggctcatgaagtgcccggcagggctgcgcgtggcggcccgtccatcgggagggagtgatggggagccacacgtcagcctcagcatacagttccccgggcccacatggcagcgaccggcacagtgacgccggagaagagggcctagtgccacgaatctgcatctggctgcttcctctcacgtgcgtataccagctggtattactcctactacgtactgtactgttgcataggccctgttgagattcaaaattttctcttcaaacttctaacttttacatcacatcaaacttttctacacacaaacttctaacttttccgtcacattattccaatttcttcaaacttttaattttgacgtggaattaaacacagcctaagcttctctctcttttttttcttttgatattcatggctaccgcactcgagtacagagcagtttgttgatggagtccaaagattcggatcttggagggaccctgaagacgacagcttttgcctccgtttcaacatcagattccaagatgcacattggcagagatagatgccggtccaggacgcaacgatcgaatcaaggctcgccacaaacaaaggattccagcaggataagcagtggtccagccccgggggttgatagtggctcttcgccttgttttcctagtgaaattgctcacgtcttcagacaaaaagagtgaaattgctccagaaaatggccgatccattttgaaagtgcaatagtgtcaaaactcaggtctgtgacttgattgcatgagaacagtagtgttagtgaaagcgaaataactaaaatgaatatatgtagagacatgcttatgtgcaactttttaatctcagccactgatgatctttaatttccgtgtaatttttttttcgagcacataagcacatctcgtatctcgtgtatgtattaacttcgaaacccgataaataaatctttatattgtcacttttgtggaatagtatgcgcttactgttgtatggtgatgacatgtaggtttgaggttttcaactacagtggcagtcactctagaaatgtcagtgtcttgtggaaaatgaacatgtctcggaacttctaaaatttttagggttgttcagattgataccgttttcaatcatattattttttagtaaagttgtcaaaaaaatctacgtttaatttgttgctaattttggtaaatacataagaaatcatgctaaaattttagcaatattaccatcttgctaaaattttggtaaaatttattttggctacaatctaaacatgccctttactccctccgtcccaaaaaaagacaaaccctggtttccgtatccaacgtttgaccgtccgtcttatttgaaaaaattatgaaaaaattaaaaagagaagtcacgcataaaacattaatcatgttttatcatctaacaacaatgaaaatacgaattataaaaaaatcatataagacggatagtcaaagttgtacacggaaattcagggtttgtctttttttaggacggagggagtatgtcatatgtgtgttgcttgctggagagaactgataccagcatccactcctttgggacgcaggtgaaaatacgaggcatctctcactgtccctgatcaggacatacacctggatttaaatggttattagatcagatttaacatgcaacatgcacacatattcaaaaataaaactaaaaagacgaaagggcactaaaagcatcctttatgtgggacaggccaattactatcatgctggagatggaaagcaacggattacagttttaactcatagtgtgcctaactttgacatgaatttgcgggtattttatcctacgcgttaacccctagccagtaaaatctgctaagtgctaacgtaatccttgaggacaggatattctgagagttttcaaggaaagtacgatgctaatgtcaccaatacgtggaatattcatagtaaactaaactactattggtagtggaatcctgaagattcacttaataatgctcatggaatgacatcattcgtggaaagaaaccagacatcatcgcgcagtatccttcctttcaggtttggagggattgcagtagctaatttcattttgctgactaaccttgactaaaagagttatttaatttgtaaagcacaattgaagtactgaaagattgcaatttggagtattgaaagttcagagcgcaccagcgaggtctgaattgtaaacacctttttattacccctttttttttttaggaaaagcactagcgaggtgtcacgtctacacttagcgtagcagaagcgttcactgtaattgcgatgaaaagttgacaggccacgttaattctgcttgctccaatcgatcaggaaatgcgctattgtgcatgtcacgtccttagttggatcgaaaaagatgcaagtgcgtcaccgattcgtttggtctgaaactatattttgcttccgaggagattaaaacgaatctgggaagaacatgttcttgtttatgcctcgttccaccggatcagctactattgttcgtccaaaaagaatgcaagtagcagattaattacactccacgcccttaagaattcgatcaaaatcacgcacgtaattactctgcagtttccacggaatccttgtttacactttcctcattgtgacagatacgaatcagggtgctaaaattaaacccgagattacagcggagtatattccgaagaacaggaatcttctgagtttactccagatataagcatttattccttgcctttaaaggcctgatatctcacagaatccattagtttcattttgagagtggaacggctgccatttgtaaacaaccttccacaatatttcgctgtgtactagtactatactactatacacagaaatctaatatgcgtcacaaacaggaaagaactggcagaaaaatatacgcctcccactttccttgcaaaactgtaggatatccaaatgcatcgcgaatcgcagcaaaccgagaaatcccacgggaaactattttaatccctcgagagaatatcccctcgttctttgtatgtcactcaaatggtcatgaaaaaaattgaaaaaaaatgagaatgtgtattaacatgtgatataatactctacaaacatgtaagttcaaattcaactcctatatatcgtaacgaaagaaacaaattaaactgtagctagttaacatatatttagagtcaaatttgtttttttcattgtgagatgtagaagttaatttttttacttgcctgtttgtacagtgatatatcacatgttaatatattttcttaaatttttaaaatttttttcataaccatttaagtgacaggcaagcaacgagaggatatccgtccgagggatcaaaatcctcttccgaaatcccacccaaatttcattcctgctgaaggaactagaagctttataaccgcgataaaaaatacaagcgacagcgatttaggcagtagaatcccccgcgacccgaggagattagtctaattaacaagtgcagattccctagcatctcgtgctgtgtttaactgcgtgagtgcgcatccgcccctgattcccaacttgcgcctgcttgtctggattccacagaatcacgcctcggatcttctgcgccaacgccgccccccttcccaaaagaaagaaaaacaaacaaacaacggcgttggctacagttgggtgtcgcccagcctggctcgaaaacacacacgcgacgcggtcgcggtcacgcacaaaatacacgacccatgcggtgccccctcccggactcgagttctccataacccaacccagcggcggaaacccctcacgtccgacccctataaatacccaccatctgccgcgccatc

SEQ ID NO: 58894 - DNA, 1905 bp, Oryza sativa
ctgaaaatgaaatgaccagtccgatgcatgtgccggaaaaacatttttcttcactaaacaaaagtaaacactagaaccaactactccgtggcactgtagcaactactagcatgtactaggatggattctatgcacagctaggcaggctctccactgtgccagattcggcgctgctcctgtttctttctgcccggtcgaattttggcaggaccagcagctgcaggaggaatccgtcctaccagcgtggtccacccgaatcctgcagatctcacggtgtagtggtggctgcgtagccaagtacaggagtattagtagttaagaaacgtttttaagatagatttgattataatcaaaatggatttggactggtctgattttttttctctgtggtcactgtttgcagggtctagaggtcgtcgacaacagctacttcatcaccgaggacaacgtcggcatgctgaagctcgccaaggaggccaacagcatcttggtccgtcgatcattacatttcattgactcatgtacattacttgaaaattgctgacatctaacggtgattaatttggtacgagcagtttgactaccgtatcccgctgtccgggtcggagacgtgcggcgcacaggccgtgtcgtcggacaacagccacggcaacggcatggtgatgaacggcctccccatcagcatctacgcgccagagacggtggggtgcgcggtggtggactccagcggccacaccgcggcggccacgtccacgggcgggctgatgaataagatgacggggcgcatcggcgactcgccgctgatcgggtcggggacctacgcgtgcggcgcgtgcgcggtgtcgtgcacgggggaaggcgaggccatcatccgctccacgctcgcgcgcgacgtcgccggcgtgatggagtacaggggcgccgggctgcaggaggccgtcgactactgcgtcaagaagcggttcgacgaagggttcgcggggctcatcgccgtgtccagcacgggcgaggtggcgtacgggttcaactgcaccggcatgttcagagggtgcgccaccgaggacggattcatggaggtcggcatctgggagtgaggtgggcagcctttgtgcgtgcgtgcgtgggcctgtggccatcatgcgattgccatagagtggtgtcttggggtcatgggccgcctcccgtgtgttggtgggctagaattagtgggtattaattagtggattggggagattggaggtgggcttgaataatgacgatgatggcgataattcgtctggaaataataatgtgaaaagttatattgctaccgaggtgtgacatgttttctgttctgtagctatttcctcactgtctctctcaattctgtacatcaaatcgctctaaactggagttagcgtgtgttgcgctagtttaggatatgttcggttaatcctgaaagggaggaaggaattggaggggatttattccacatctattatggtgtggatttatttcccctcagacaccttcaatccccttcaaccccttccgaaccgaagaaggtcttagggagaagtttactgtagagcaaagggtttctttggttggacttcctgctattgattcctggactgtgatcttgtataggctttccaattgctccggcccataattggttgtcgcacatagatataaggcccatctatcttacctgctctgactttcaagctctcatcatttccttattcagcatcagttgccaacatttaaattttttaaaaataaattagagttgatatcaaagttttctcatcaaagtttattttttgacattagaatttaaaccgctaagagcatatatatatatatatatatatatatatatatatatatatatatatatatatatatatatatatatat

SEQ ID NO: 58895 - DNA, 1399 bp, Oryza sativa
ccacccaccaccgcgtcctcctcccgtcccaccaccaccaccgagcggtgcctccctcggtcctccgcctcccgctccgcgccgcgcgccggggccgcctctccgccgccgccgcggccgcggcgcccgccgcgtcgaccgcggcgccgtcggagcccgccgcgggtgccgtaccggggaagccgacggtgctcgtggccgagaagctcggcgccgcggggctcgagctgctccgggggttcgccaacgtggactgctcctacggcctctcccccgaggagctccgcgccaagatcccgctctgcgacgcgctcatcgtgcggtcggggaccaaggtggggcgcgacgtgttcgaggcatccgggggaaggctccgcgtcgtggggcgcgccggggtcgggatcgacaacgtcgatctcgccgccgccaccgagcacgggtgcctcgtcgtcaacgcacccacggcgaacaccgtcgccgcggccgagcacggcatcgcgctgctcaccgctatgtccaggaacatcgcccaggccgacgcgtcgctcaaggctggtgagtgcgcacaccctcctcaagtctggaaaagacacctctttaaaaaatgatactgtacttgtctcgatctctgtttaaagcattaaaaaatcttgcatcaacgtggcacctgtaacagtggatcgtgctagaacgtctgtttgatgaattgctagcaaatcgagaaacacgaatgggtgctttttcactagaagcagtcctcagagattactttcgttacttcattcaatttgacataatcagaaaaagttaatatctgcttcagttgacaaagctagatgcatgaagatgtgaaaatgtggagtaagggtagtcttagatgaagcatctgccatgcaatcttcgaatggcatcttcggaagaagggcaacataccttttcaattatgatgagttcccatgttcttaacaatgtgtcttgtataggtaaatggcagcgcaacaagtatgtgggtgtatctctcgttggtaaaactattgcaattcttggatttggaaaggttgggtcagaagtcgctcgtcgtgctaaaggtttgggaatgcatgtgattgcacacgatccgtatgcttctgctgatcgtgcccatgcaattggagttgagctagtgagcatggaagacgctttgacaactgctgactttatctcgttgcatatgcctcttacccctgcaacaaacaagatgctcaatgatgaaactttcgctaagatgaagaagggtgttagaattataaatgttgcgcgtggtggtgtaattgatgaagatgctctagtcagggctcttgattcaggaatagttgcacaggtatgtttgattctcttagtctacatccttttttcattt

SEQ ID NO: 58896 - DNA, 1781 bp, Oryza sativa
ctcaagagtgtggttgcacctcaggtattaatttttgctctaccaagtgtaattattattgtgtactcttcacaactagatgctaattgaaatgttatgttttcagattcctccagaactccatgattctttcattgcagcaattgataaaggaagcataaggacaatgccaaataggagtatgccagctgctccacttccaacccctggcgcgctgttgatgggtgatgcattcaacatgcgacatcctttaactggtggtggaatgaccgttgcgttttctgacattgttgtcctacgcaatcttctcaagcctctcggcaacctgcacgatgcaccttccctgtgcaagtaccttgaatcgttctatacactgcggaaggtcagacttcactcttcatgtcacagttaaccacctagttttctcagaatgtgtatacggttttagtaaatacaatgctattatcttttcagcctgttgcttctacaatcaacacactggctggtgctctgtacaaggtcttctgtgcctcaactgaccaggctaagaatgagatgcgagaagcttgctttgattacttgagccttggaggagtcttctcaaatgggcctattgctcttctctctggcctcaatcctcggcctctgagtttagtagcccacttctttgctgttgctatctatggcgttggacgcctaatgctccccgtcccttcacctaaacgcatgtggatcggcgcgagactggtttccgtaagttcctcaaatcttcttctttttttaacatcctcaaagttcaaatgcacggtcatttatacacagaaaactttgtggcagcctctctgacattttctcatcaaaatccatacaactgcagacgatttcattttctctacataactgaattttcactgcagggtgcatgtggtatcatcttcccaatcatcaagctgaaggtgtgaggcaaatgttcttccctgctacagtccctgcatattaccgggcccctcctccaatggagtaagaatctccatgttagcctatggtgtttgctgttctttagttcttttgagctgtcgagtgtgctcattagagtagtctgttcttcctataggaaattgggatgtgtatcgattgtcaatactaagttgtatatccctctgaacttgctaatgcgtcttgctcattatctcttttagaatatttgaggtgctctgcttgtctctactgcaccgttggaatgagctagttccttgtttttatgggcacacttcctaaatgccacgcttttttgaaaaaaataatctttctagaagttttttttaaaaaaataaatgattttttttttcaaaattgtaatagttaatcataaataattatgtgttaatgacttatctcatctcgtgtgccgctgaaaagctcaactcaaccactaattcgaacagtgctttaccctactgaattccatggaccagaatagtgtttgatctgtaaagccctgtaggcttaggctggctgggaaatctaagagcaagttcaatagtatagccaactactagctccaattcatctatagccaatctaatagctcattcatataatagttacatactacactattaatacctagtcccacctgtcatactcacaccgcgtcttgaagttcgtgctacagctggctacaaatctgtagcccgctactcttctctctccttatttatctccttaaaaaaatatttgcagctggcttatagcctgctattgtacctgctttaaggggg

SEQ ID NO: 58897 - DNA, 4461 bp, Oryza sativa
cttcttttaagctgcttgttttgttgaaaaactgaaaatccgttacctttgttatgtcttatttgaagaccttaagattttaagtagctgtttgttagccatcttaagagaatatagagaaacggtaaaacccaacttttgacttctgttttttatttaattgtgtacctatatcgtcttagagaatatgatggactgtttgcgaaaatattttaattctgaaaaaattatagctgttaaaagctctcctaagcggactcttaatcgagactctagttgtacaaagaaacaaaaaatcttgtatgcaactaaagaagcaaaatcattcaaggaaaagatatagtagtaggacaaccacctggacaggttgaccagaaatctagagcacacctccaaacctgacgtatgaactcctactagtaaggacaagactagtgagcctctggaagctctttagagcaggttcaatagtatagcctactactgacttcaattcatctatagctaatttaatagctaatttatacaatagttgcttactatactattaatatatagtttcacctatcatacatgttgcgtcttggagtacgtgctgcaactggctacaaatctgtagcctactgctcttctctctcatcgtttatctcattaaaatatatgtttataactggctaatagcatgctattttacctgctcttagccagatccggataacgcatatcaatgctatcctgcatcgatcatgccgtttgtgtcccctgatctcggagctgctggaagcagaaaaaggaacagaagtaccgtgtttgtttcggcatcgaactcttcccttcaaacgtctaaatgcatgcacaggcgatatgacgtacacatacatgcagtaattaagcgccggtgggtatttggatatttggattagcatacccacgtggaggtcgtccaagaaaacgaccacttaacctcgtgtcaaaatcggcgtgtacttccgtttcgtgtcactgcagctagagtggcaaatttggccacttccctttcgttgccactgtgaactgctagctgcggctgtcctgctgctacttgcttcacgcgtgcgtgaaagtacattaggagaaatcaacatctgatgtttatggattgggaaaggaacaacgacgtcaaggctgtcacaacttaaaattaattgtaaacgttgtacatcaaaacagttgccttcaatcggctttgtgcataattgcattcaccgttcgcgtgcctagatgactgagtgactcggaattatgcatttgttcattagcgtactattcagttatctcaaagatttggcaatgacaagattttattggccacacagagattacgcagtaagatgatctgcatttgcttcctgttcgtccaaattccacttgcgctgtgatcactgtcgctacaggaagatatataaaacgacaataatctacattggatgacatgaggaataatcgggatccctttgcccataatccatccttaatctattgccactgtccatcctttcttgtcctcagccaggcccatctggatggacgtcagagtcgtgtgcagtgtctgcgataacgtgtcatgtccagtcctgaactcgtacctgcacacgcgcccaagaaaccgatacaaaatcgtcagagatttgcgggattcagaattcagatcgatcctgtcgtgaacgatcgactcgcagattttacctttgcccatggtaagtaacactcgatactggggcaacgaccaccgctgttccggtgcagaacacctcgtctgcgccgaccagatcgtcgatggagacgagccgttcttcaacctgcttggccaaagagatcacaacgatttcagaattaatttttttttcgcgaatactcaaaataattacacggaaaattttcagaattaattcagatgtgctgtcgccaaatcactgatggatgcagtgctctgcgtagattgattggtcacctgatagccgcggtccctggcgagctcgatgacgctcttgcgcgtgatccccggcaggatggttcccacggtggccggcgtggcgacgacgccgtccttgacgatgaagaggttgcaggaggaggcctcctccaggtacgtcttgtgcaccgcgtcgaggtacagcacgtcagtgaaccctctgctcttggcgtccatctgcgccttgagcacctgaacacatttagatgtaatagatattaattcctccatccaaaatattgttacttagtatggatcccattccaaaccaaagaatctgaacataacctctagccgtcagatttattgttttagtatggataccattatagatcaacgaatttagacataaccactgtccagatttattattttaatatggatgctattatagaacaacgaatctggacataactactctctatatttattgttttaggttataatattttgggacggaagtagtggatatggtatcttttgtttaccggcgcgtagttggtgatcgtcttgaccccgccggtgccgcccggcatggcccggtgtatcgagtcctctacgacaaggtttatcggcgctagaccctcctgaaaccgatccatccatcgagtccaaaatattcagatttttgctagctgctgcagcgttcagaaagacgaccgagctaatgaccgagttttgtgctcaccttgaagtacgttccaaccggtgcggcgtagatgaggaacgtgtactccggggcgggagccagcccgagaatcggtccgctcccgatgagcagcggcctgatgtacagcgccccctttccttgcggtggcacctgatagaaaaaccacgcaacgcgaccgaattaccacggggaattcatcgagatggcgtgcgagaattaattgacggtcgtgttacgttcgtcgtacgcgcttacgtacccagcggcggttggcgaggacggtctgcttgacggcgtggacgaactgctccaccgacggcgacggcatgcacatgcgctcggcgccgtgctgcatccgccgcgcgttctcctccggccggaacagcatgtacgacccctgttggttcgccgccctgtacgccttcagaccctcgaagagcccctgatcatcgagcacatacgtacgtacgcacgcagccatcaccctcgttcacttgttagtccggtcgcctggatcgacgtttcgttgcatggacatgtgtgtggactggagaacgtgacagacctggccgtagttgatgacgccggaggaggggctgagctcgatgttgccgtagcggctgagctcgccgcgggagaagacgccgtcctccagcgagcaccgcatgacgtacatgtagtcggtcggcgtcagcccgaaccccaggttgtcccagtcgatttcgccgccgctttcctcatcggacctgcacgcacactcgtacacgccccggcggcaatggcataaacaacactaaatccgaagcggacgtgaaaagaacaaaaatctcgttcaacggagaccggaagagtagaatctgcatgcatgagtagggggctcacctgtcggcggagtcgagctgcggcagcgacgacctccaccggcactggagcagagaccacctgcctccggcctgcacatccacaaggcccctaccgtgagccccaaccgatcgcatcaacacagaaaccatctcgatcggacagaacgcgcgcgcaacccaccacgagtcgaagagaaactaagcagagcgagtgggatccgaaccactgaaaaagtgcgggtaatcacacgtaccgtcgggagcgccccgcggagaccgaggccgccgccgccgccgcatccctgcagggccctggccagcgcgtggtgggcgtcgcgtgcccacgggaggagcgcgcgcttcgcggacgacgcagcagcagcagcagcagccatgcaagagacctgtgcggctgtgcgaacgggaagcgcgcgtctcaggctcagctcgtcctcgttcgtaaccaaccgttggcgcgccaaggtgaggagagatatacacgagtcgtttcacggaaacagcttcgcgagtgtgtgtgtgttttaaactactctcggacggggcggcggccgtttgtggtgttccggtctcgcgttgtacgtgtcaggatttgttggtggcgatgcaagattacaacgaacgacgtttgacgtcacggggctatcgatcgatacggagtggagagtaccatagtactatcacgaataccaataacttgtgggcaaaattggttatatagcatcgaaagttcacgtttttagttttatagcatcgaaagttaccggttcattttaatagcacctaaagttcaccatgttcccatttttaatactttcgtcaattctcgatcgttttccgtccgtcttgatccagccacacacacgatatgacgtttctacccctcacaagtacaaata

SEQ ID NO: 58898 - DNA, 13825 bp, Oryza sativa
tataaaataaaaacgtgaactttcaatgctatataaccaattttgcctaaacggtagcaaccttttccgtatatatggacagcacagcgacgggcgaggggtgtggacggccggaccacctctgggcccgcgagtcagtgagagggctgtagctgcggttggtacgactttgcgctgcacgcgtgatgggtaatccgggaggaaggcgtcggctcacggctctgacggtggccgttggtacggctcttaaaaaatattatcttcatcttaaaatataaaataattggttgatagccagtttctaaaaatctaaaaagattaggtttctggcttttagtttgttttctgaattctacaattacaatttctcataatctagactaaaaactgaattgtttagggagctactgattttaaaaaaagttacatcagctaaaagtttccaatatgcatagttaaaactagatatattttgaatggaggtagcaagtaatatacctctctctagagtttttaatgggaattgtggaggaaggagtgccggagtggtgttattgttgttgtttgaaataaaaaaatagatgaaacaaattaaataagaagagatggtcgtgattggtgagataaagaaaaataggtaaaaagttactatattttaagacaaactttaaacattaaaaaatggtatatgttaaaaatggctatatgttaaagacggagggagcgagggagtaactagcataataagagcaagtttaatagtatagtcaactattggctccaaatcatatatagtcaatttaataaccaatttatataatagttatctacaaatatatactacactattaacatattggaacattctgcctctctcatgccgggcccactaacatctgatgtcttttttgcacactttgtcctcactcgtgtgcacccgggaagaatttcctaaattgcttcaggccaagcacgcttaaccctggagttctttggagatcggcttccggaaaagaagttgcaacttgttgatatgagtattctattaatcccattaacctctgagccgggatgtcatatcctcaaccccttacctcttggccacgtccatgtgtccagtaccagcgcatgtgccatgttgtgtgaccactccgggtccacaccagccgtgcgcaccatgcctgcgccactgcgacacacgcgctcgtgaaaccgcgactacttatatctgatagcttttaaaggtcatagactgccctcacagaccaacacatgtcttttctgcacactttgtcctcactcgtgcgcacccggaaagaattttccggtcggtcacccatcccaaattgcttcaggctaagcacgcttagccctggagttctttggagatcggcttccgaaaaagaaattaatatgagtattctattaatcctattaaactctgagccgggatatcacacatatggtcctacctgtaatacacacattgtgtcttggaatctgtgcgacagctggctatagatttgtagcccgctgtttctttctcttctattttattttctcgatatgtgattataactagtttatagcttattattgtatctgctctaaataatctcttcagacttcacctaaaattgcatatcaagtggtgaagcgtgtcagcgtgactgtgtgagccactgagcccaaacgggcgcctgaaacaaattattgattatattagattactgttatgagttctcaacttgattaaataataaattaaatatttaaaaataaatttaacatatactccagcttaattagaactttgtggtctaaataatttcatagaagaaagtttttgagaaatagtagtaacaatatccaatgaataagctaaaaaaggtgggactgctattgaccatttttatacttaacaaataaatttctttacgtaaaaaaataaatttcttttccagaacgtagtaaatatatttattcttcacatttgtattacttctttatagaacatagtaaatataaactcacatcttaaattgtactatttcttttgtgttgcaaagattaaggaatatggatgaaaagatcataatacctttcattcctttagagcaaggttaatagtagcccactactagctccaattcatctatagccaattcatacaatagttacttactatactattaatatatggtctcatctgtcaaacacactgcgtcttggagttcgtactgcagctggctacagatctatagcccgttgtttttctatctcatattttatcttattaaaatatgtttacagctagctaatagtttgctattgtatctgatcttaggtggcttagaaagagtggctttgaaaatggtaggatagccatagtagtactaaataatctaccgtataaaaaagctatactacttttttgggacgggacagagtatatctctttcacggttatactactgccttcgctttcaccagttgaaggtgttctgaactttctgatcgagttgcgtgtaatttgtttcacagggaggatcgacgagttttccagctcccagcctcccaccaaccagctaccgatatgcttttgagctggccgctggcgcatacagtctcgatcctaccttgcttatcctcttcgttttcttcttgatcgttggcaaattgtctcttcagctagtcatccatgttgccatatttgcatgcaacccatgactgtgggttggtgatcagctacgggacagatcacagatcgataggcatgcacgccatgcagtcattattgtggattggatcggctgactctatgtctacgtgtacatgtctgtgcaagtggattatccccccccctcccccccggggcgccccacccacccaaaaaaaaaagccagaactccaatccacggcttccacgctcatgttttctatgatttcatcaagctgagtgcatactgcatacgtatatatagtagttttgtatgtattttatgaaaatttaacaagaaatggaacaattctcatacacaaaaaggaggaaagttcctacgattcaaaaaagaacgtgaaattcaaaaagaccctgccacttgtagcaatggaccagtagtggagctagcttaaacaagaaatgggaagggccaattaaaagtttcatttatagtaggaactattatgctacggagtattttgtgtaacaaatatgtgtctaaatttattaatatctatatgaatataggcaatgctagaaagtcttataatatgaaacggagaaagtattatataatattaacaccttaattaacttctctactgtataattcatattattatatcctcaacgcaacaaacacacgaatcatgataccatcgaaaatcaataaacggttggcaatataaatactaatggatagtatatgttgatttgggcggatctaccataggacataggacatggggtatctacctaaaatttttggcaagtaatctatgtaggtgcaatacatgcatatatattattagttgggttagaacaaccattccctaatgccatgtacaacgcatgaccttagcttgtggtctcacggctctacgtcggagccgagctgagctggcacgcccgctcgtggtctcgcaggcgcgcagcgagcttgtagaaaaaccgaaagaagcaccgcgcctgcgctcgggagccgtgaagccacgagccgaagcctcgcgttggaggagtcggagccccggtcgtcgcctcgtccggacccccgtgcaactgccccaaatccccatctcgtcatggtcgtcgtcgccaccaaatctgctgccaccgccatggtcgtcgtcgctgccagatcaacgcagccgccatggtcgtcgtcgtggtcgtcgtcgtcgccagatccggcgccaccggtgctccctgccaccgagctcgccccggagaggggaggggagcagtcggcgagctccccgccgccagatccggcgccaccgctactccccgccgccgagctcgtgccggagagaggaggggagcagccggcgagctcgcgctcgagaggggaggggagcagccggcgagcccgcgccggaggggaggggagcagccggcgagctcctcgccgccagatccgcctccactgctgctcctcgccgccgccagacccgtcgccaccgctgctccccgccgtcgacctcgcgccggagaggggaggggagaaaccggcgaggggaggggagaggagaagagaaccgagcgacacgatgcggctgtcggtggagaaaaatcgaagagagagagaggggaataaaaaagagagggatgggaagagactgacagtgggtcccaggttgtttaggggtgtacatatacttcttttggttactctagggttcaaaatataaagtttcaataggttttataatacaagggctgacatataaatagataggggctgatatgcaaaatacgttttggagtggtttccactgtaggtagtgtgacctttgtgtgattctatcctacttgacgtcttgagaccataattgcttgtggctaccattgtacgtgacctaataaacctagaatcgtagtacaacccatgaaacagcttcggcagaatccttttccttgaccctgatgctttgctgtggttcaatcgttgagggtaatgccagtgcgccccactgcaacgcgcggccatgcaggcgctgctcgcgtcgagcaccaaccaccaagcagcagaaaagcttggtgcctgcgactgcgatagactgatagggagctagcgcctagcgctactgacaacaaaccaacaggcaacagtgagtcagctgtgctataggctgtgtttagattttaacttttttctttaaatttttgaatttttccgtcacatcaaatatttggacacatgtatagagcatcaaatatgaaaaaaaaaatactaattgcacagttcgactataaatcacgagacgaatcttttgagcctaattacatcatgattagccataagtgctacagcaatctacatttgctaatgacagattaattaagctcaaaagattcgtctagcagtttacagtcggaatcttgttttgttagtagtctacatttaatacttcaaatatattttcgtatacgtaaaaaaaatttagccaaatttttacagtatttaaacacggccatactctcaatatcgagattgttcacattggccatactctcaatatcgagattgttcacattaaatcagtggtgaacccagaaaaaactaccataatcctatacgtaccaaatttttaataaaatctaatatactaattaacatgatatataaattactctttctatttcttattacaagtcgtttgacttttttttgtcaaacttatttttaagtttgaccaaacttataaaaaatataataatattttcaatacatatcaaatatattatcaaaatatattcaattttaaatgtaataaaactaattttgtgtcgtagatgttactattttttctataaatttgattaatcacgaataattttaaaaaagtcaaatgacttataatataaaacggataaagtagttatcattgaataatttacctgggtcatatgaccccgttaagcggttcaacactgcatatattccaaaaaaaaaaaacgttatgcacttttcctagcccatctttcaaatagttaatggttgattcaattgatatttcttgaccacactttgaagagctcgtcaagacacagtagtgatgccgccatcgcccatctgaaaaagatatggtttatatggttttcacccagagaagctcgtcgagaaagggaaagggtaacccttgacaacgccccaaagaggttatgacgtccgaagacgtagcccagtgaaccaccggactaggctttcgcctgggatcctacaaccttgactgcaggtcgctgtccaccaactcagaaccaccacacaggcaaatggcagcatgtagcatccaccacaccgcactgacgcccctccgtcggccgacttcatcgaaccaccacccctgagagctggcccaggacccctctgttccaccacccgccggccgcctcgccagtttttgccaaagaggaacccaggactaggtgtcattgcttcgacagcctgagcttcccccgccgacgagttgccgcctcaatccaacctagaatctccccgcaaagaaggggaggagctccaggaagggcgatggtgccgaccggcaacgaggaagacaacccaccgccgccagctcccttagcactaccatctcgccgccggtggcggtgccgctccagaccggcgccacccactggccccgttatccggccgcgcgcctcacctagccaccgcggtggcatctcggctgcccggccaccacgccgagccgtcacctaggtctggacgctgaggacgacctaccttgcacagggggcggtcgctgcgtcctgggctgctgccgggcggccaggtcgagctggggcgctgctaccgagccgctgctgccgcgtcgggcaggctgcgctgccagccgggcacaccactgccgcctccgtgcgcgggtcggccacgccgagttgcggccgtccgccgccacagcgcccgggctggcctcgccgagccacaaccagccgcctcgcccccggccaaaagccgctgccaccacgcccgcacgccgccgcgctgccgagccgccgctgccaggttgagcgggggcgccgctgccgagctgccgctgccgccttgggcagccggccacgccaccgccgcctctgcgcgcgggtcggccacgccgagccgtcgccgagccgcgaccgtccgccgctttagcgcccgggccggcctcgccgagccaccgcccgccgccgactccgcgcccgagccgggccggccgagccgcagctgcctgccgtctcgccgccggccacatgccgccgccaccatgcccgcacgccgctgcgccaccctaagccctcgcgccgccgccgcgcagatccaggtgggggatggccggatccggccttgggggcgccggatccgccgcctcggaccgtgctggtgggggactttgtcgtcttcgtcccgtccagttcgcgctgaggaaggaaacaccacgaagaaaaaggcctcaccgccgccttccctactcgctgccggcttcaccgccggcgagctccagcggtggcgaggaccagggatggagaagaggcgtgggcagctagggtttttcaccccaccgagccgcccgcgcgagagcgacgcggggagagagacgatgcctaaatatatccatcacaaataatttttatttctctatgacggataagcttttgtttttacggtgaaacaattttctattactctgtacctctatatatctctaaaatcatgcgtttgccactggactgtggacgaacatgccaatcaacaagactgttggtgatgcatagattagcaagtggttgtgtccagcggattcatatcctctgacttttcgtaggattaatatcaccgcgtgagatctccctatctaatccgtccatttgaaaccaatggttgagtattagggaatttaacttcacagaatcacaggtcaaggcgttgtgggtcaattaatcctcagccattgatttcaaatggatggattaattagggtgaatggctaatttagtccctcaagttttaccgaaggctcaatttggtccttcacgtttcattttgtccacatagctcctctaaatatttgttttggcttgaaatcattcttgggcccacttaatatgccatatggctatttctagttaatatttcattggaaaatgtcccttttgctcttaatttgtatagaaaatagaaaaccaagatgaataaacaacagtgcagatgtacttcctattattttaacatgtgcacatgaaacttaagctattgctatcgtatacactttatagtacataatttatttttgttttacataatttactatgcattatctataaaaaaagttaagcatgcaatttttctcttatatatgtgaatgatgggggtataagtatcatttatcaaaaagttgttggttaaaggataagttcgaactaaactgaaaacttaaaggagtaatacggatagattgaaacatcaaggactaaactgagcatcagatgaaatttgtaagacaactttgactattcatccattaagataggaagaatgtcacgcggtgacatgcattaatcctacggaagtcagaggatacgaatccgtgtcgagcttgcgtggagttgacatggattacttgctaattaatctgtctctaccaatatgtagcgaatagcactcttgttaactgtactgtacgcagtataaccgcgcacactttacacgtcaaaccatttggatccgtaacacatacacaagaacaatcttagctagaaagaaggtattcccaacatttgtagatacgtcgatcctcttattattcaataactcaagttgctactaccttctgtccaaattgatcatcatatattaaattcaaaatttctcaaattaattatcatataaccgtataaatacggatttcatcggaacaaaattaatgtagcaaaggagaatatatgcatatcaaggatataattggcatagtgttttattcgatacatgtattgtgggagattgtgtgcattgtgtcttgattgatacgatttaaattatttttaatcttgctgaataaatacatatgatcaatttgagatgaagggagtgtgacggagagtactacttaagagtatttgctgagcagtaagcacttacggagtacccctacacattcggagtaaggggctggaatgtgataaaacagtagcaaaatctgagcagttctgtactcgtgtggttcccaaagacctggggggaatgatacggctggccttaactcgaccgttcatggggttcacggctgcttcccgagctctcacttcttggctgcttcctccactgcagacaaaatagaaagacgaatgggttgaaggcatcaagtcacacttgacatcgatcgatgacaaggttgcggtctagtctccacatcagcaactgaaaagggtacatccccggggcagtgaatggtgcaatggccatgtttagtttatattgcaaaattttttaggccgtcacattaaatatttgaacacatatataaaaaatattaaatgtaaaaaaaaccagttacacagattacgtgtaaattgcgatacaaatcttttaagcttaattacgttataatttaacaatgttgtgttacagtaaattttgctaataacagattaattagatttaataaattcaactcaccgttttttggtggaatctataatttattttattattagattgtatttaataatttaaatatgtgttcgtatatcggtgtgacaacccaaactttcgcccaactaaacaaggccaaagcctcgcacttttacagctacgtgaggtcgagcggcgatgctgtaacgcaggagattcctaggacaaaaatgtgagggcctcgttgccgtgtgaagttttgtgtgtttgacgcagcctgacatggacgtgacatattagcacggctggacgaaaacttgattctcgattttaatagtcgataaaaaaatgtcgctgttaaggtactgtgtagaactttttacaacgacgcggaaaaggactgggttgattgcactctcacattttttctactctccctactttagatgaccgtaaagccgtaaagagaggattaagcttagtgatctagtactactacaagctttctttgatcacctagttcgcttgaaatcttaagctaaacgtgtagccggaatgataaaaaaaaaaaaaaacgtgtagccggtactgtaggcggggacttcccggagtccgtacatgggccggacccacttcctatgtccaggccagtggtgatgatatagcccattaggctgtcgacaaactgggcccgttggacatgtcgactctcctcgaagccccgtcaccccgtgccaccgttgtcctccgtcctccccgcctcgcacggcgcatccgttcctcgcggcgccaccgacacccgctgggcttccaccgtgcagcggcgaaaataatgctgcagccgcggcacctcgaacgcgcggcgcggggcgtctcctgcaccggagccggctaatcacgcagaagacacgggcgcaggcgtccccgcctagtacgcgatcgttgtgctgcggccgagccaaaccacgtacgcgaagacgctgcccggtgtgacggtgccctgcgcccccatcaattctaagcgagtactccaccaacactagcctcccgtgatggccgaccacccaccgatcgagagagcgtctcacgccgaacgtatgagctattcattgcacgaggaggaaacatgctcacgctgaacgaatgggcgggcggaagggaagaagattcacgctcacgcacggctcacgggatcggcagggaaggccctggcctctcggtgaaaatcagcccaggagatggtcacctgagcccagcgcgcagcccatctagtcgagatctaacgtggcctcgtttccagggctccttttggtccgttcgatcgatcgagaagctgcgatgcgatccgcgtacgtatgccgatgccgtgccggtgcagaatctctatggacctcaactcgatctcctgcctgcctctgcctacctcggcttggcttggcttggcttggccccatgattcgaattctctgctgcactagatttgctttcgccgcccacgtgcattgctccggagcatttactactgtacgtgtaatagtatctgtcagtggaaggacggacccacgacgggcttgcgacttctgggccgcggatcacatgatcgacggcttggattaattgtccgccgtgactggggcaccatgcccgctttgcctcggatgatctactcattttcttttaccacgacgcgtgatgtgtgactactataacttactttagttgagataaacaaagaacttactttacttcatctagaaaacttattacttgacccaattaggctatctcgcactttgtcgtatggtcgtggcagattcacgacatgtatctctgcaccacatactaatgccacccaaaaattaccataacgtaagtttctgcgtgctgtgttatggtgtcatgcggtcacattatgcgtagacaggtaccgaaagaaatatattataaaaaattaccgtttgatcggttcattagagattagacgaagactaaaaaacacatgcaattccttttgttttctgaaccttggtgttctctcgtgggaaagcagaggacgttggcaacgagagaacattgtcgtcagccaaggttccaattccctgcggatatattccatatctcatctgattgacctgacgtgcgggcagaaagcaaatctctccacatcgcaaatgaacagtgacgatctaaatataaaatcatcaaaaaaagcctgaggataatgttggcagaagcgagacggaaatctacgggtagatctcctgcattgtattcctctcctgcaaaccgcccgttggtgccctcaaatcaatcctgagatgacagtacagagggcagttttaatccagaaacaatattcctatcgccggccggtaggtacgctccatatcatattcgatctcatccaatttcatgtgcagctcggtacgtagaattaggatcgtttgattgtacaactactaccccgaaacgaataaattgtcacgcacgcacgatgcgagaaagataggtacggaaagtacgtatcccacaaagcctgaggtcccgagggctgagcccaatcctgatggccaatgattgcgtgaggcacgtcatgtgggcatgccgcagcgagcgtatccacaggtaaatccgccgcgaatgatgagaggctgacacagcctagtacagagagagagagaggcacaggagatggtcccgtctcgatgtgccgctccgcccaacgacccgcgcgctagtacagacctcgtcagatcgttgcctcagatctcgggacaggctcgggcgaacgtgccggcctttgttgctgacgctggggcgaaacgcgccgatgcgcgtacgcggcgctggtgtccagaactcacaggagggcgcgcaggtcgccatgatgcgcgccgcgcgggggacaggagcgacgacgcgtcgcggaggcgcgagcgacacatttaactctcggggacgggaggcatgtggacgtgcatgcatgcacgcgcgcggtgtgaccggcgtaaactctcgtttgggctcgctcgcgcgcactccggccgtttcatcgccttcacggggaaccggccggcccccgtcagatgctttggtgcaagtccggtgctgccggtatatgtgatatactactactagtcgtatagtatattgtacggagaatagaaaattatgagatcggggaactatctggagttcgatctagactagagatgccaaagcgacatcaaacgtccagatcagccaataagagctaagctcaatcatatacgtgtacgataacaaagtctcgcttgtttgtagcgccaacgcatgctacatgcatgattgatcctcgatatatactatcgtcatcgatatattgtttcgtgcaacacacaatttataaagggttatagagccaacacaacggccagagtacgtgccagatgccgccgcgcagcgcgcagcgagagagagagagagagagagagagagagagagagagcaagccgtcagaaaaggaattcggctgccaggttaaatttccaggagagagatcgatcgaacgcgcgcatgcgtgcgtgcgtgctcccgcgccggccatgccagccaagcccgcccggctcatatttcttggcatgcctcccatattaactaccacgccgcgacgcgaagctcctttttacgtgtcatgatttggtcgtgccatccctcatcacacacaccatccgcataattttcctgtgtaaattagttagtccaggaaggcaggagctagcaagggcaactagcttcgacgctgactatacctaagtgcagtaattactcaacgaactagctactactatagtatgatcgcacggaaaccgtcagtgtccaacagtacgtgcaaccggccgatcatgtatgtgctacgtacccgcagcaagagtcgatcgcgagtggtggtgtggccgtacgtgttaaaattgccttgggttaattaatatggcgtgcagcagagcagagatccagatggctagctaccgctctcaagtcctaattaagcaaacaaaaagatgagacgagagggcgaagtcccgctctctcttcctgattaaccaataatcagcagagaggcgaaagcgatggcaactcaataaatttttgaagttggggagccccgacacacacaatcattgagacgtatatccatacaaaagtaaacacatgtacacgcacccgacagggccgagcgaacaggagggaggcaggcatgctagctaagctagctcatgtcgtcatccgatccaacactgtgcgtgtgtgacactatctaagaattttaatccatcagtagtgctagtatacaagcttaatctatctagctactgcactgccccatgatgatcccctctgaaaattaactagcctgtgaaacaaaaaagaaaagtaaagctaactagtgatgagaggggggcacacagttacatacttacatgcatgcacaaaaa

SEQ ID NO: 58899 - DNA, 888 bp, Oryza sativa
  unsure (1)..(888): unsure at all n locations
ccatttctctgccgagaccacgtggttgtcgtccgcgttcctgttgttttggttttcatcattgccaaccgtagcgtgttcaagtaaaacgcaaccccctcatccgggaacgtgtttggacgcactcacccggtcgtgttcaccactagagctagcttttgccgtttctctctctattgggtccacatcgttgttggccacattttcgttgttctggttttcttcgttgccaaccgtcgtcatctatggatgagtcacatcatatggcacatctagccaccagccttgtcgtcgtttggtgaattgaaaaattttaatatatgttgaagaaatgggtacccgtccagaactaatggatctaattttatttatgggctaaaataagttttcttttttttaaaaaatatctagctaattttcaattgttttttcatttacactattagttttactatttgatccactaaaaaattgttgaaacttacaattttccttcatattgaattatttatagctaatgaaaaaatgaggactttagcactatattgaattatcctccggccaaagttatttatagtttcatgcttatttctatgattatatttccttcgtcatttatgtcccgttgtaacatatggtttaagattttaatgtatatcgtcggtgaatgttatttagaacccgttgcaaggcacgntgcattacgctagttgaatagttgaaatataattcggatagctacgaaaccaatatgcagggcttatatcgatcggccagccggtcggtcgatacgtggtgtagttacgtgcatgatccaacgctcgatcgatctctcgtgatcgagactacgctgcttgctgatcgatcaatgtcgaaccagtcgatgag

SEQ ID NO: 58900 - DNA, 2552 bp, Oryza sativa
ctaccaatattttggtagggtagaattgtaaatgagtgtatttagatttatgccattgaaagccaaattttaaattgtggtgaagaatattctagaattatgccaaattgagtattggcattaccaaagatttggcttcaaaccaaatcatcacatttactatttaaaccaccaaaaatttggtatggcaatattttggtatcaaaccaaaacaccccttactattcaaggtatcaataaattggtagggcacattttggcatcaatccaaaatggcccttcttgccccagaagtttgctgatgggaacaggcgatcatgttctcagcttcgtcagaactacaaggtgcagaatgcgtggacaaacactaggaactaccctatatgaattcataccaaatcatatactccagaagtatcatagtagtagctatgggtgtgtttagttcacgctaaaattgaaagtttggttgaaattggaacgatgtgacggaaaaattggaattttgggtgtagaaaagttttgatgtgatggaaaaattggaagttttgtgtgagtgcatatactcatggacctagggaaaacagaacagtatggacactaaaatacaactctgcaatagctctgaagctaccatcctactaagtgtgtttagttcacgttaaaattgaaagtttgattaaaattggaacgatgtgacggaaaagttagaagtttgtatgtgtaggaaagttttaatgtaatagaaaagtttgaagtttgaagaaaaattttggaactaaaatcggcccaagccaatttgagtatgcactgatacaaacatgcaatgatccaataaaacttggctttctgaatgtaggagttgatgaaaatgaatataggcggtgtttagatatagggtgtaaagttttggcgtgtcacatcgaatatatggatacacatttgaagaattgaacgtagtctaataacaagacaaattatataatccgcctataaaccacgagacgaatttattaagcttaattaatccgtcattagcaaatatttactgtagcaccacattgtcaaatcatggtgcaattaggcttaaaagattcgtctcgttatttacacgtaatctgtataattagttattttttttatatttaatactccatacatgtgtccaaacatttgatgtgatagagtgtaaaattttgccgggatctaaagagacccatagagtagaaaatttgggactcaaaaaaatgtctcattaataagggtgtgtttagttcacgttaaaattagaaatttggttgaaattggaataatgtgatagaaaaattgaaagtttatgtgtaggaaaattttgatgtgatgaaaaagttgaaagtttgaaaaaaaaagtttggaactaaacccggcataaacccaactgaccaactgtgctgaactgacagccatttaaagttcaaatgtcaactgactactaatcatcgccaactaataaatttgacattttgattctttttttcaaacttatataactttaaccaaattagtttgattaaatctaacatattgaatatacctgtataatatgtttatttgtgttataaatgttgctatgtttttacaaacttaatcaaactaaatgtttttcgtgaacgtgcaaaaactttgcacatcactaaaacttaaagaattttaagttagaaaaaaaaacaacgtcatatagagtaatatgtaacggaaggagtactaaacaagtgctcagccctgaacttacatcttccatagtgatcaagaaagggatgcatagcatcaacttcaggcattcaatgcaccaatggataatgttttttcttactacacaaacatcgagtgatgagcaatgaatgattagagaaatgagcaaaagatctcatatgcatgatgcatcacaaactgacatttagcaggatacgcagaggaacagcgctagaacataaccacatcaacttattccatccacaatatcacacaaaaatggaaagaattaattagcatatgctagaagtttagcataattgcataaaccttttgatgcagttcaagcttagcatggagaacccaatatatagacttaaaactactcgagccacaacagcagtcaagcgctgctcgcaaacttacacgagaagagtcaggggcataaaaatctctccgtaaaaccaaaactcgaagaaggaacaaaaataatactagcaaaatggttcaaaattcagaggactttgctcaaagatatcctccacccaacaatatataaactactgaaaaggaaaattaactgaaaacatcaccaatgacccggagagcggtggcaagcaaagaaccttttagatccgtacaatactccgccgcctccggccgtacctatacgccttgtatatacggtacgaacgcacacacgcacgtagccttcttctcgatctcccttcgcatcctctcatcgttggtagtagacagtagtacaactacaagtaacgcctggctccatcctgtctgcctttggtggcggcggcggcggc

SEQ ID NO: 58901 - DNA, 14281 bp, Oryza sativa
agaagcaaatccatggaccaggtctagagagaggatgggcctagtgggcatggttccgccagtgatgggcccacacggagatagagcgtgtgggtccttggtaggttgaatggggagatgggctatgggcctatggaggcctctttcagttttctgttggtggggcccaacacaggacattcctccctgtctttcgttttcatcgctttaaccccaaacctcccaaatgtaaagcccacaacgctcctcacctcttaccgtccctttccttccacctctactgtatgtggcgtcgaggaggaaacaacagtgctagtatgctactactgttttatatggctaattcacctgtcctaaaatataagagattttagattaatgtaacacaacgtccaaattcgtagtacaacctggttgtgttaaattcatttaaaatcctctatattttgagacagaggaaaaacttttctttagtaacatgcatgtttgttaggtaggaaggatatcaaatgtggtgtttttttaatgaagatgaatataaaattaggacatataaaaacaagaaagtcattattgtaaaattaggttagttttagttattacaaacttaaaaataattgatttaatatttttaaagcaacttttatatagaaagtttatgtacgaaatacggataaaatctgtatgttaatcagagaagaaaattgtgtttatcatatcacgagatgtcggcaagtttacgattgccatgcttaggtctgaagaagctacccaaaaattgtcctaccatttttagcgtgtagaaatgatcctttttctattactatgaaattcttatgtaatggatcggtccatttggaaccctatgcatttggaattgaaatttgtactggttggcatttgtggacggagggagtacgagtaactcgtaccgtcggccctatgcccggagcaatatgaatgccgctcagtggtgacgcgacgagcgccgtgcagccggtgcaggcagcaggctatcatctggtcccagccgcgtcaccgattcaatccacctgaagaattcctccagctagcggagcggtccagcccaatctcacgcgaagccatgcacacgcaagcagctctcgggcagagcgcgcggcgccctcgtccgtcctagagctgcccgacgaggccgatggcttcaggctcgccaaagccgcgctcgctatcgctgcctttgcacggagtagtgtctaatctgaccccgcgcccgccaattgcagtacacgacgtagggactgacggactgtggcctgtactactccagagtgtagtagagtctgtagagcatgtaatacctggactggagtagtggagtcgtgtctcgatcggcgcatggagggacggtccgtcgacgtacgtgtggaccatggaggaggagacgccgcctgcgacgctgagctgagccgtgtcgtgtgggcgtgtggcaatgtgccacgcccacgcgcaggagcgtggacctcgcgaattaacggcgctcgtggcctcgtgctttgctcgccccgcgctgcgcgcacccatggctcggctggctcctggcgacatcgtgggatgctggaaacgtgcccagaggcctcgtcgtttgcacctgcctacacacgcgtttgctagtacaatgcaaggatccaagagtatacggcggcaatgtaacgtaaattcctccaaggatttctactgtaccaaccacgttttgtgggcttaaacatgtactgtacatgcaacagagagatgcacgctgtcacacttcctcaactggctcgatgtcacacccttcaattctccttttttttttttcagaggtactcctgacattagtgaagcatcatctagtctagcagtaacaaggttaacgaaaggaaaaggtcaactttaaccgactcccttaatagtacgctgaatttaattcgtacctctcaacaaaaaaaccggatagaactactcctcaaactattaaaatcagtgcaatttgactctctcagtggttttaagtggcggttttactggcatgacactgttgacctgatattcatcccaggtggtgtttatgtggcattagagcatctccataagtgactctccaagttaaattttagcctacacatgaaaaaaactccctccatcagcctagctacttggattgccaagccatatggctggccaaacgagcttctcaactggccaaatttggccagcctcctcccagttgccaaacggtgggccccactgtgggtcccacctaactctttctttgcttccctcttctcttagccgacggccagctctcatgccctctaccgacggcgccgatggctagctcccacggaggtcgagatggccggcaagtggcgcaaggtggtcggcggcggcaccaacggtggaggaaggcatgcaatggggcggcggagggggacgtggcgaccgtgagtgagagagggcgcagagacgacggacttggagggacgtggcatcgagggagggggatggggcgcgatgcacggccgtcgaagaggacgaggccgacaacgccgttcgtcgtcggggacgcctcacgcatgcacggatccaccattgtcgactgccgccgaggagggcctcccgcgccatgcactcgccgctgcctcaaatgcgcgagggcacgccatcgccgtcgccgctcgggtgctgccgccgccgccaccgtcatcactcggcttcttccccgccgccgatttccgccgctacctccacctccgtcagatccgctcgcccgcccgctgacggcacgagggaatcgacgaggaacggtggcgtcgtcgaggtcggcgtcgcaagctgccgccgtcgtcgtcgtcgaggtcgtcgtggcaagccgccgccgtcgccatccccgccccgagctccgccgccgccgtcgccatcccggcgagcgcctcccgcctcccgcgccgccgcgccgccttccgcctccccgcgtccaccgcgcgccatgcgtcggccaccgttgtcatcagcgtggttgacgggaaggaaggaaatgggaaaagaaggaaaggaaaggaagaaggtggggaggagagagagaaagaagaggggcagaggcttacatgtgggtctgtttttattttggagaggattaacagggagtctgttggagtgagtatctagtttgactagctaaatcagatggagagttggccatatagatgtttggagagtccgatttagagaagctgctagagatgctcttagaattacaaaaatataagtgggacctatttgtcatcacacgcaaaaatatattgtaggacccactgacatgtggggcccacatgtcatctcctctctatgacccttcttcccatctccccttatcctcatccggcagtgccctccccattttctctcctggcggcagtgtggaggttgggcacggagatccggaggtagtgcggaggctaggcaagcagacctggcgaggtggcgatggtggcaacagtggtggtgtggaggaagctcatcgcccccctctctctcctggcggccatggacggcgaggaggagcacggcgcagcatggcgctgccatctccctcgctcgtcggcctcctctttctcccagcagccatggacgatgaggaggagaacggtgcgtgcgcggcactaccgtctccctcgatgtcatctcccttgctcgccgatcccctctccctcccggtggccatgaacagcaaggaggagcacaacgcggcgtggcgctaccgtctccctcaatgctatcccccttgctcgcaggcgtgggacatcgtcaacgctaccagggatagagacggagccagaggtggggaagggcaacagaaagggcacgaaggagaggtgagggaatgacttcgtcgggaggaccacaaccaccggtgaggaggcggtggcggagagtgagaggaattgcgctgcttgtttcgcgagctccttccccacacgtggtttcccgcgcgagatcctcccccacgcgctgggataagggagagacagggaggaggaagggctggagagagagaggatgacaagtgggccccacaatatatttttgtgtgaatgacagatggttccagatatattttttaaattctattgctacataagccatgtgggacgaagaccaggtcaacaccgctacgtcaacgtcatgtcagtaaaacctttgagggagttaaatgttctggtttcaatagttcggggagtcatcctatccggatttatggttgaggggtacaatacttaggctgtgttcggcacacccttttcccaacccctctccctcgttttttacgtgcacgcttttcaaactgctaaacggtatgtttttttaaaaagtttctatatgaaagttgctttaaaaaatcaaataaatctatttttgaaaaaaaaagctaatatttaattaatcacgcgctaatgatctgctccgttttctgtgtggagggaatgagttcccatccgtttgatgcgaacacagccttaagggagtccaaatagacttttttcttaacgaaaaatggcttagctcctcgtcgtcgtctctctctcctgcctagctctggcccaataacgatactgggcttcctttttctaatcaacgatatcaccgcaaaaaaaggaaaatctaatcagtgataaacacacactttaagccacgtatctttgattcttttccccttcttttcctgctatcttgggctcttgcctccttggtggactcgccgccgactactctcggagaaggaaagagcgaagaatggccgcctcatcgtctctcagagtaatcacggcgcccccaaaatccctccttttttcctttgttacatctcgttctctaattcgtgttggtggttggttgacgatgcagctaatcctcggctcctcgtcggcgtcgcgccgccagattctcgccgagatgggatacagcttcacgcttcttgttggtgatttgcccccatgttttctggagcttttttactctattattagtctgttttccttgtggtttatttagttcgtacttttactgtttcccttctaccctcccgtggggtttttagagtgcggatattgacgaaaaggagatcagaaaggagaagccggaggagcttgtggtcgcgctggctcatgcaaaagtaactcctttcctcctcctgttattcaagaacttggattctagttccttcgctaggaaggagaagtactgaagtactttcttaggaaggatagagaagagggggaggggagttggacctagcctgacaatttttggtttggttgtagactacttgtctattacaactattaaagagatagaaagagaatgtaacatgttacatgttcactctacagggctagaaattctgctttagttagaggaaaaaatgattttggtgggtttggattatgatagtgtagattggttgcatatacactagaattgttacatttggactattagtgtaattatacttttatcaataggtataaaaattgtatagcagatatattttcagagggatagtctattagtttcacttgtgtgggtcagcaggacgttcggctaggttttactatttactgcgagagaaacattttagggggacattttggaggtttgggcatgaaaaggtctgtccttttatcaacttccattaatttattgtatctgcttcaaaagttttatgttttcctggttctagatacaattttctttcagtgctgtagtgcagaactgcagactacagttcaactgtgcagcacattctgaattaggcattgactatgtactatgttactatggtttattaattttgcaggcagatgctataatggagaagctgagggataatgggatgatgaaggaaattcttgattctcaagagactacactgttgataactgcagaccaggtgtgtggcttacatctacttatgagataactgcttaatagtcagtaatgtgttgtggtgagatgattttaactagtttgtgtagatattgcagccaatttaaacaaacactagtctaggctgaattgttgttaaaagcgttcttgtggctgcatatttcaaaattgggttcagctgcttgtgttttttttctctgtttgattttaaacttatatgccgctcaaaagataatagtattgaccatcaaacatgcctattgattataagggcagtctcatagttattagggtatactaggatgggttctgaaggagtatgtgtaatattactgattgatccatctccagaggcataacctgtttgtttgcctgactcatattcatatgcttggcatcttgccattgttattttgatctgtagtctactcatgtttgatcagttatgcactgacttatagataatcataagcattcctatgtttgtgatttccctatgacttgtaacggaaaattggaaactgaaccttccatagccattgctaactaccttcatctgtttgtcatgactcatgaggcaaactagtttttgtagggcacattattatgacattagtgatttatggcttcatgggtaatcatgtttagcatatgcttggtctaaccgaaatacttagggatggttctgtagtaaaatgcatcattaatggcactcaactcacatgtatttagatgaacattttggttcttatttgttttttatccttctcatttttactttctgatggaggttgtggttcatgatggagtgattagagaaaaacctagcaccccagaagaggcacgaaagttcatcaaaggtttgtgctattgtgtataagctcaagttttgttcagatagtcctttccctgtattgcttgctggctgctgctcaactatattccgtttacaggatactccgaaagccatgcagcgacaattggatctgttcttgttactaatgtgaaaagtggagccagaaaggaaggatgggacaaagctgaagtaatacctaaatttcttgatgttttatttcggaacaggacatcaaagtcgtgcataaaacctcagagactagatttcatttttaactccaactctatttcaaggagagacctgaaacttgaactactgtgaatagttcaaatttgttattcttctaatatgattgggtgcgtgtgtaattatagcttccacttcaaacttggccgagcttttaatctgatttaagtgaactatgcaaattgcctcaagctctaaattctaatgttgtttagtgcttatcacttctgaaatctggtgggctaacttgtatcaaacattcagattctgagtcacttgtgatctttgtaaagtgatgggccagattgagactgatgtgaatgtttaaactaattgtagaacgctaattttttgcatcctgatttggctcagaagtattagctttctaggtcttcatgtagaattaggtgcacaatcagatcacactatcattgtttgtagacaaaaaaaattcaaactaatcctaatgattaaacataatcagttaggaccctatattgccattgatatgagttctggaggtggtttttggcctgataataactttccactataattgtctatgaacaggtttatttccataagatacccgatgaagttgttgagagtttggtaagtttgtagccattggtcgcaaaagttatttcttgctattttggcactatatttttgattccggagtttgattactttgatactttgactcagttgaacaatgtttttcacctgtttatatttcagattgaggagggcgatgtcttctatgttgccggtggcctgctggtagagcacccgctgacttcacctcttgtggaagctattgtgagtgtagttcttgcatatcctgcttcttggttcagcactgaaaatagaaacctttttacacatggtactcgcctgacatttgataaactcttatgaaggttggcaccatcgacagtgtaatgggactcccgaaatccctcacggagaagctgatcaaggagtcccttgaggagccatagctattttttttaccgggacaactgactgcccatgctgaagttcatatgctagaatttttcactcatctgctgcacaaccaactcgtcatccactctgcttggattggaggatggagatgcatcttaccgatgttgtcagcttgactatgctaagctacttgccgtgattggcattattgtagtaaaacctgagactttactatgtggattaatctgtttggattaaattttctctcttggtgcgtgatcatctctctcatgatggatgcaaacccggttcatctattcgaatctctgcggttttaggatgtgtttggcacttgaggttgagaactactccctccgtcctataagggatcttgagtttttacttgcactgtttaaccacttgtcttttcaaaaaattttggaattattatttatttatttttgacttactttattatctaaagtactttaagcacaactttcgctttttatatttatacatttttaataagacgagtggtcaaataatgcaaacgaaaacttaaaaccttatggggtggagggattaatcctctaggcacttaaaacataacggctcattagcatttaaagtaattttttatagaaaatcttagaaaaaatatactgtttatcagtttggaaaggaaaatgccgagtgaaaaacgatgtagaagctgggagagaagggaatatagagccttcaatgtgcgttgggacttgggaagttctgagcgagcgatgggggctttgttccggtttgaacggtcgatgacaggtggggtccaccgtaagagggatggccatgggcccacaaagcagagactgaacgctaccatccatccctggacgaaacactcgaaaatctcgaatctttctcccgttctcctccccacatcgccggcaccgcgaaccaccgcggccaccggatcgcggcgcggcgcggccgccgacgagcgagggctctcgaccgaccagaacaggtgcgctaatattttctccgcgtggtttccgtgcctcgtatgccctaacggaaggaggaggttgccgcggttaataatgttgggttatttttttcccccgcgatttagcactcgtgaatcacgcgctactctgttttggagtgaattgtgaatagtatgcacaatcattttgcttagctgttgacgcgctcagcttgctgtgtgagaaaacactgatgcctcatttatctgcaccttatttttttatggcggtgtgtttgctgtttagattcataggatagccagccactggtcctttgaacttctgggaaaatgttttactcatacgcttttctattggcatacctatgtgatattattcagattgagctgtttagttttgaatctaatcacatacctagagttgtcctctcggcaggttagttcaacagcaatagttgggcacttgagatatatttgtgggtgggatatagaacttatgataatggaaagtaatatcatagcttcatgcgctgcagtttaattttagatatttgtaagcaacacaaaaatggtagacatctttaactcaaaggatgctagcttttaataactattctccttttactactatcggaggccgctaagtattaatgttagtgaatttaggcacgcatgtatgtgcgcacactgatatttttgtgtgtcattaatgactggtggatggggttacttgtgtattggcctttgacttgatggcgccaaatgctttagtagttaatatacatggtaatatatcatgcttgtatgttctataattgcagtttgtgtcctgaacccacatagtatcttctgtaatcctattgtttgactactgcaattgtatttctatgaaggatgcagttatatttttagagaaagggggtcaattcttttttttttagtgaaaacatataacagagtttatacagcaagggaaatagctgctcacaacgcaataaaaactttgtaaccatataagcactaagcacaacaggctatccagatttaaccatggttacatcaaaagacactgctctcagcaacaacgataaccccagcttgaattttcaattcacaattattctatgccacatcgacacaagagtctagcctacagtacttcagacagccatcaccggggtcttttccttcttgctcaacatagactttcttttgctgcgtttaactcaaatttttacataaccaaatctatcttcaactaccatcttattttgacaggcaacaaagcccaaaggacggatcctagaccaacaagcacctactgattttgcatgtcctactacaaaacatttttgtgtgaagtctttgatatttggagcatataccaagtaaagtttcaacaatccaaccagtcatatatctttgagatcctcaatgtgctcaaacagaacactggaacatattatttctgcaaatcacaaaaataaagcatgttttttatagcttaacctgttcgaaactgggtattctttgaaaatagggaaaacaccacatgggaaaatgaccataacaagataattctttttccttgctatgcccatgaaagaaatgtaaatgatcattgatttggtctaccatgcctcacaaggcctttttcattggaaaaagtaatatgaattattgatttggatccacatccttagtaattagtttaaatctgaactaaatcccaaaatgtcccaaagaaatagccctcagaaatttcaaatgcaccttaaaagagataatttatgtttgtcctttatctacataatttccagttaaaagcttgaattattttgatctttgttgttggtgtgttgtgaggtcatggatgtataatggcgagtacacaagacaaaggtaaaactaatggaggtacttgggagttgggaccatataaatttgtataagttacatatcgttgacaaatgtgctgcatgtaggctgttgctgtggaccacttttctgtagcaccagctttgtttcttgactttgtacttatctaattttctctattgagctaatgttacatacacctgttgaaacccacattgaaattccaattggttccacttaatcccagtcaactttgtatatagctggttgtttggttctttcttatattaccatgcttaagagttatacatgaacaaattatctgtgatcaattttccttaggtcagagttttcactaagaacaagtttgcattactaaaaatatccttttcacccatgaaatctctttttgataacgtgcctttcgttgattttgggatttaagaattttattgcagggattatactttatgcaatccttctggcgagcaatctgctcaacccagacttgacaatttagtgaactttgggcggttatgtttcccttcctgttcaggctaaaatttccaaccagtagtggtactttcttgtctgtaaatttgtatcaaactgttactgattttatttgccccacctcagagcatactggatggttccccagtcatacttaataatgtatctgtgacatcttctgcttcttttagatgtccattgtctaacattgatgtaaggacaccgacatccttggcaagagaaaaggaagtggcctatgagttctagccttgttatagtacctcgtttgactccatgggtgctgttcctatatctaaaaattgagatgcacgtggatataatctgtaagttagctgcataagctacgaatttgtatgtttaacaagttaaacattagtgctattgtttgttcactctccttgcatttggtgcctcatagctcatacatggctagaggactagaagtatgtggttgaacttgaaatggtcaagggatgactagttgagtgctatgaatctgataccgtgtcaaccagttgaattctctttgagatagaaggctctagaaagaaagtgaaactctgttaaatgtgcatgaactttgcattttatgcagtgaaggatctttccccttgttttagtgttatactagtgatatgcaacattctcttacgttgaagcacttcaagacaagagtctgttgcatataggctttttagactattattttaccacacttcaaggaaataaggcgtttgcatataatttaggctattataccacagaacacatcagcacatgcactagaaaccaacacactacattagattcattttttcatgaaaaatactaatgtcagacgttgcaatcactgtttttgcatgatcaaattttggaatctgctagggctcagcctataagcttgagctttgccctcaataagcttaagttatggtcaaatgtaatatctgttaggacttaggggttttactagcttataaagataagctagagctagagagtatgctatcaataatgctgtcgagttcttttatcttacaaattttttatttatacaacattatttatgtcttaattttcagagtctgtttattacctattggtcatttaggccagaccgtcagaatctatacaaagtggattataaaagaatcttaagcttggcaaaagttccaacaagccttcaatatactcgcttcgtatagtttgcaggctcttgtaccaagggcggcaaggaaaccttttttttttctttttactaaattacccataattatcatagtactattctagatattaagggtgaagtgctttgatatatgtgtgctccctacattcttttacaaaagcttttacaattttatatggaggagggagtagttgatgtagtgttcttactttgagctattggactccagtatctatcatgggctgtgtggttatggctgaaccaaccaccacgattattgctggaatttttagctgggctaggctgtaagcactccagtggggcatcaatcactgcaccagacttgataaaaattaatatgaaacttgagctgtaccagtttctgctagttggaaatactgcagagctagtctaggagtttctatttgttctttgtgcttgcctgttacctattcattttgaactaccttttttatcttttgcttggtactacccagcagaatgctgtgagttattcaaatttcatcaccctgttttccagggcaccaatgatgtgtactttgttgcaactttctagctcacagtagaatcaatcattttgcaaactgatcataatgatcattaacatgctttgtcctcctcagggaaacaatggtggcaccaaatctactgatgtattatcttgatggtttctcttagtagctagtatcctgttactggctgggccatcttactgcattcttatctaactctgagagtttgctattgttgtgctgcgttgttttgcattgtggaaatctagttctttacaggcatccttggtaatgctaataagattttcaattactagctaaattccattgctttgctacggataaaaggaaaaaatcataatattgcgttaaataaataaaagcatgtttgtgatgattatgttacccacctttttgctacaacgaatactcaatttaattttatatgtggctaaatatatctagttgtgtataatattaagaagtttcacgggataatgtgtaaaaactacagtaggagtaggtggggtggcagattcactgccaccaccactgtaatctttttaaaggagtatagatgacaccaaaatagatggtttcatactaactgaaatatacacaagctgaacaaacttttttcatcagctactaagatgacaaattgagacttacaaagggttatcttgaactctttcatattcatattcaaagtacctattccttgtcaagttgggtacaacttagttgaagcataatttgcctatagtgtgattcatgtgtgccatgagtgcagttttttttttcccatttaccatatgtaaatatgagaatatatccaagtcatatcatcaattaagtgtttgtcatgtttttactgtggccaatgtataagccgtactagaccaggtgttctatctctctgggagatttactgtgatcaattatatgaatgtggcaatttgccagccttttctgcagtagcagatgtgcagctttttcagtggcctggtagcaataatcagagtcactaactcctatggtgctagtagggggtcaaaagtactgaaagcattgtattaatattgctgctagtgcttctgtgcttg

SEQ ID NO: 58902 - DNA, 10461 bp, Oryza sativa
ttggatgcatgcgtgctttagtccatcattgatgtccccaaggtgcaagggatgatatctgaagaaaatatgaggggatgtttctagaaggtactgttgctttacttacgctccaacctaaacttgtgaataacagggcttgaactgagttattttatactccctccgtttcataatgtaagactttctagcattgcttatattcatctagatgttaatgaatctagacatatgtgtgtctagattcattaacatctatatgaatgtgggcaatgctagaaagacttgtattatgaaacggaggaagtactgtatatgtacataaactgcaaaaatgagctatagcacaatgaaaccacatcttggatgtgtttccaggatgtggtttggtgtgatgtgctaattcttaaggattgttcctagtggtggtgtctggatttcctacccaagttgctgacaaccaagatgaggatatggtgatatgctgattgtcatcaccgatagagacaggttgtgcttctgtttctgcggactttaaattttggcattttccttttaaatgcccgtccatcattatcccgaataaattcctgcatttggcgccagcataaggttctgaagacacctgattgctttcaatgcaatgccacagtgacttaaatgttctgaaaatgttagaaagccaagatctgtacggcggtggtatttactattgtcatcttgagcatgtgtcacattggatatgcaataacttctgtaatggcaccaatacaatcaaaagaatatgaccaacatgctacctgtaaagaaaaatgtagtttttgcacaggcctttggtggtacaaaagtgtagtttttgcacaggcctttggtggtacaaacattttgagaaattccagagaaagggaagagtggtactgtaacttgggttgatggtttgttacttcagttattcagcggtcactgtataatttcttcacatatcattgttcaaaattatgtagccttgactgatatcgaagggataggatgtgagaccccttgtgcccattggcacaaaatgccagctatatgatcaaatgataggggcaatggtggtcacacttaaccagattttaggagcaccaagcccagctggtagtgggggcaatggtgagaggagcattacacacatatactctcaccaggcagaattgccatataagtcccagcagatgcattcaccattggaacatattctgttcatgccttgtccttttttaaagagttattgattctgcaagatatttgcaaattgaactgattctggtgtacccacaacaacctgtttctgatgttagtatcttgtagaggttgtcaatgtatttttcaagccatgaagtagtatttattcatgtattgaactgttggcgattgcatgtgatctaattggccattactgtatcatgaacacagatgcaaaaaatgataaggtcatcccttggaggtctacggaagataaacctcatctggaagtagggttaaagtgtgtttgtcataacgtgcatctgatcctctctcatactgcagcgacgagatttaaaggattatgctccctccaaaatgttcgcaatttgtcactttatccgttcaaaagcaatgctttctatatgctcaagaaccaagcttcacaaaagacatttccaatccggaggggctcctgtggggcgtggtaagttgctgtagttctgtttgaggctagacgtgcccatgtcataatcgatatgtcacatgaagactgcagctgtttgatctgaatcaggtcccaagttcagtttgtggccccaaagcagttcttatttttcacctttagctgactttacacattggtaaaaaaaattcttgtcgttacttgtgaaaaaaaataatgattgaacatctgatgctggacctaagattaattgaacatttagaatggaaaaccatgttttcgtctgcagaaatggaccaatgtaggctttgagggtgggccatggtggtctggtctgcggagatggtcctcagatttggttttggttttaggctgctgcgtaattgtgatggcccaattgctcaccagatatgaattgcaacctaacaaacatgtagaattgtgcacaggaagtgactgaaatgtgcttctttttttgtaacagttgcacagggcgtcgacagtaaaagccggccaggaggataatcagggtgcccacaacagcagcagtagtactccgtacgtctctttacctcctctaatattatctgcgcggcttctttctctgtttgcttcgctaggtgacaaactagtaggagtagatgctattgcatttctccaatcttttcttctttttttcccctctcgcttgttaatcttcttgtctgacattgctagtcgttatgcgtgcaaagctatggcctacgggctatgttggccttcaccagagtaacgcccatgtccaactccctttgctgctttacaaattaccacaaatactgcacatcacatgcttcttattggtggaagtacacgcccgcgagtcattttcccgtcagatcatcgtgctgcgtcctgtctcgcgtcccagccaggggctattctagctagccagccagcgtgtcgcctattgaacgacgataaggaatgcccccgtgtcggcatggaaccaacaagctaccccggtcacatctttccctttactcaccgtgccggaagcaaaagctggagatgataacagcagcagcagtattattagcagctactcttatctatcctactaaaatatagcaacatctccatctacttcattattttaactaattataactatttctcattcaaagcaaaattgattttatatcttaaccaatcacatctcttatttaattcacacctattcttttgttttttgaaaaaatgtagaagtacttgtattttgggatggaattttttaagtacttatattttaggacgggaagggaagagaagaataggtggctaatttgtttagaggaatggcacagaaggcttagtaggtggctaatttgtagcaacacgcacgctgtgccctgcagctgctgccgctgcttcctcctcgtctctctccgtcacatctcctagctggtggatggcaacaggcatgtgatgtgtcatgtgtgccatgcccaattggcactctctgtcagcgttatcactattactcttcgcccaaatgcttaagcccaagctgacacgctgtaagctttagctgcatagtatagtagatgggccaaacgtctcaacctcccaaacggctatgatcaccattcaccaggcgcgtcgacgcgagaacaagcgcgcccgtgtaaatgtaggtggcacgcacggtggcgtgaacacgagggcagggcatggcagagctccatgcctgcagccgcgcgcgagagacatggcgatggtgttacgtacggggtaacaagcgacatgatccctggccggacgccctgcctgactataattggcaccaccagccacctcacgtagtatacacaaataatccgatcgatgatcatatcgctcgccagccagcagcagcagcagcattgcgcgtacgtcgaccaggttgaattgcaccgtctctccgtcgcgtccgtccaccatatacatatacacttgactccgactcgatcgatcaacaaacagtcaatcaacatggtgggcacacatatccgtagatcatgtcacatggggcgcgcgtacgtacgcgcgcgcgcgcatgcacaggcaccacagtttgggttgggtgagcctgcagcagctagcgaacccctgttggacaacgcgtacgtacgggggagcttctagtggttgccagctagtatttccgtgacgaatcctagcagtagtgtgtaccaccatagcgatatgccgcgtcccgcccgggcgcgctccgccgctgcacgcactgtccgcgcgcgcgtaccggtcagcaaagggggggaagtgtgcgtacgtacgcccgccacgcgcgcacggcttttccatcgcgcgcggccgggcgccgtgcatgcgagttccagaggctatcaatggacgcgagatggcggtggtttgcgcgcgcgcgcgcggtgtgtaattagccgcggcatgcagctgcagggtggggtgggcgcatatgcatgtgcgtagctagcggtgctcccctacagccaactgctccctgcctgctaaccatttaccatccccacacacacacaccgcatgcaaacaaccacttgcattgcatcgcattcatccatccatctctctctctttatcaccagtattcatctcctcttatctctctggggctggcagtagttgtaggagtagtggtataggagggagaggaggccatggtcgatcgatgatgatcatgacgtggtacagggggggaagagggcaggcagttaaatggggaaagtactcaggtcccccgggcgagtcattgcacatgcactttgtgtccacttgattgaattcttcttgtctcttccccaccctctcccccctcgtgtccttgagatgcgtgcatgccatcgacatatgcgtacttgcacagtgccttgtagactactctgattcgcctacattttatatatgcatgatcccggccagtacgtacacgtacatgtaggccaccttgtctagctaccattattgtttacctcaggtaaactaagctttatccatgtgcaagcattgctatatgtacccaatgcttgtacatgtatgtcgagaagcttaattataccgggaggagtagcacgcctagtctttgtattgacctcaagagtcaagattctcgcactttcatctcttccaaatctcccacatgacgaggttgattgcggaacgtacgttcttttgttaagatgcctctactgtggttgctacagtattctttgatagatatatatatttttttagaaaatgaaataaaacctagcatccgcatccaaacaggatgtacacggccaattctttgatagatgtgatgtccatttcgtgagagtgtgtcgtgattcctccaaccgcgttccacaccctgctgtgagtatttgaagtaggggaagaagcaattgcttgctcctagagtgaatcggaggagcaggaaattgtccctacaattcacgacctatattgtggatcgcaaggcgaagaattgcacttgagtggtgggacacatttgggcctgattggcttattcaaattggtagttttcaatataaagaattgtgcattggtaccaaaggtggagatgtattcaccatttcgccttgaggcatcagcttccacacaatcttgaccaaatgtatatgtagttgtgacttgtgagccacacaatttgtacatactctctctcaaaggctgtagaagtacattcaccttgaggcatcagctcacacaatcttgttcaaatgctatgtagctgtgagctacacaatttgtactctctcacaggctgtagtacatctttagtgttgagtagacactgcctcatcagtcatctagatgtgaaggatccaattccatgatctataggacattttggattatcactttctttcgagctaagatggcacaaaggcttggaaggtgtctcatcgtgggcattgtcaatccaaccatgcgagttgtcagaatttgcataattttattaggtctagcaacgcatctatcaagttataagagaagggtaaatggagccactttgtccacgttgaaggcctagaaatcatcgcggtatcggagaaagagaaataagatctatgatgttgatcgtagtgggtctagattataaccatgcagatggataagtatgatgtatatgaaattattgcatttatatatagagatcacaaaactacatatattctggtcaaaatattgcaaaaatacatatttaaggtggtgtattacaatactacagatttaacatcaaatttatcaaaaaaatagatttaagggtaagaatcgcaaaactaagtattttaggatttaaatccctacaaataatgttatgtttgaattatagcatccaagttttatgattaaattgacactagacctatattttcatgatattttttagtactaatgctttgtttggcaatgctccatattccagatccatgctaaatttgaagtttctatgttaaattacattaatttaaaatttaaaatttcttctcaaatgtgaacaaaacaattcatcagaacactattaacgtaatcgcagatccaggtcgatccatgggtttgtggagctagaaatatccagctctacaaatatcttggattcggagttgtatcaaacaagtcttaaatttgtagttgtgcgatatcctagcttaaatatgtagttccgggataaatttggtgtttaagctgtagtgttgtaatacatcatcttaaatatgtaattttgtattagtttgatcaaaatatctgttgttttgtgaaatttactcttatatatataatgtgtacaaaatcattgtatttatataaacaggagctataattgtatatcaaatacaaagatacttttagataaactttaatttatctcagtacaagattgtgctggaattttggctagttaaaaataaaatttaatgaccaaagttgtacctggagatcatgttggtatccaaaacttactgtgactagagagggaacaatttgatagaatctcaactctggtttaaagaaaaaaaaaagggtaattggtactccagctagcattccaattcatccctgagattgtattacttgagacaggtgaaacatttttgttgtgcataatttgactactgtataatttaatattaattatattggttttctttgacatggagattttgtcttagttatgagaaaatttaattaattgcgcagatatttttggaacgacagctagctatttcagcacagagagatactagctagcattacacaataagctgctgcagcttaagtgggaggcactgaaatgctacacgttagacctgatactctttagctggaggattcctcctgaacgccgcaagaaggccacctggataaaaaagggcaatggaggtgactcagtcaagttgagcaaggaacaaattcagtatgcagctgcatatatcgggcaatcttacggccagggaagcaaatgcaaagtccaccccaaaactgttgaggatgctttgggcgtttgcagcagaactgtagaaggaacagatactactactacaactactgaaaagctttgctccagaatgcaagagaatgaaaaaggtacaacgaagttagatggggagcaacaaggtgaaaggttggtggattgtacttgtaaggacgggaaaatcaatcagctacctcaactgtaccattgccatcttcagattaaaatggcagagaatttcttcttaagaaaaatagtactagtaaccaaattcctgcaggcttgcaggtaaggacgacagggcaaagagtaaataagagtacatgcatgcatttttctgcacagatcaggggcacagggtcgcaggatgcgcatggtgtttaattagaacaaataaatcagctctagctagatcgcaaaatcctgtactggccatcagaattcagaactaaggatcaatgctagctgccactctgaaaagagggggaggaaaagttattctcctcatttctttcacagggaccaccatcagctgctgtgctcgagtagcagtgaacaatggagcgagagacaaagctataggcagcagcgaggagtgagctagcactgatactactgggcgtatatgatcagctcgccattgtcatcgagcatttgagctgagctgaagctgaagctgaacttaattctctcctctctcagtgctgttttggtattgaatgtaggatcaaccgatcgatgcatcaattaagctcgcacaggcgcagggccctgacgaacggacgaactaacgagtaacgatgcttatcctagcctcgctcctgtcattctgtgcgtgaactcaatgcagtacacttcaccagtacagccatcatttctgggtgcccctggctgctgtgcatatcatgtaaatgcttgcctagattagcccccctcactgacgtccatccaacgtcgacagcttagcccatgcacgtatgtagtagcccgtcctacacctagcagtagtcacccccacaagcaatcaaaagtaaaagtgaaaacaacagttcacacaaattatactcgatcgtaatagtagcactactcgccatgtcccgacctcagattgatctttccgtccgtccattcgtccatccattctaatccggcaatcgcatcaagttcgccggatggtggtggtgcagttaaatcaggcgtactagtggtggtgaatgttggcgatagaggtaaggtttaactccactggagcgggatagtagctagccgctggacccgttggttccgacagtggcgaaaaatatgccattccgcggggggcgaagagataggggaattttcagacagccgcatatatcccccgcttgggctggcgagaggcgatcgatcgatcgatcgggcgagatatattccgttccaccccccggcagacacgctctcgtctccctcccccacgcacccactcgtgcgcgcgcgcgcgtgtatatatatatataggcagaggaggccacaccctccagggcaacccaaatcaccaacaccactacactacacacaccactgcgacctgacctgaacctgatcacacacacacactctctctctttctctgtgctcagtgctcacctctctggaaggagaccaaaaggccaaagagaaacacgagcaccaaccaacacagctgagccagagcccagagcgctagagccagcgggagatagccagtcaaatgtacttgtagcgctctctcgcacagcccggcgaccaatctccagaggacagcgagcgagctgcttccttcaagctttgtttcttctcctccaaacagcgcgcgctttttgtgtactccccgagagttgacagccgtcgtcgtcgtcaccatgtgcaactccggcaccagctcctcgccgtcggcgcctgcgccgccgccgccgccgctcacctcgttcaagcactcctcccacctcctccgcctcgtggacgatgacgccgacgacggccatgcgctgctgctctccaaggtaaaacacgcggtacatatgctgtagtaatacttacccgcggcttggtaattttgatggcgtgaacagaacatgtaggccattatatcaaagagctaatgcaagaagcacgcatagcgacatagctggctggctggctggttgtttaatgcttatttactagtagctaggcatcactggcagtaacagtaacgagaaagaaaaggaaagctccagctgttgggaaatggcagagctgatcaatacgtccatgcacacgaacagctgatcgagacgacgacgacgttgctttgcttgttggtttctaacatgcgtgagtgcgtgtctcccaggtggccggcgaggcgcaggcgatcgggcgggtgtcggtgccgatggcggtgacggggctcgtcatgtactcgcgggcgctcatctcgatgctgttccttggccggctcggcgagctggccctcgccggagggtcgctggcgctcggcttcgccaacatcaccggctactcggtgctctccgggctggcgctcgggatggagcccatctgcggccaggcgttcggcgcgcgccgcgggaagctgctggcgctggcgctccaccgcaccgtgctgctgctgctcgccgtcgcgctgcccatctccctcctgtgggtgacgtccacggggtacatactgaagcagctcggccaggacgagggcgtggcggacgcggcgcagacgttcgcggcgtacgcgtcggccgacctggcggtgctcgccgtgctgcacccgctccgcgtctacctccggtcgcagaacctgacgctgcccatcaccgcctgctcgctcttctccgtgctgctgcacgggcccatcaactacctcctcgtcgtgcgcctccgcatgggcgtcgccggcgtcgcgctcgccgtcgcgctcaccgaccttaacctgctcctcgcgctcctctgcttcctcgccatctccggggcccacagggactcgtgggtggggcccacctccgactgcctccgcgggtggccggcgctgctccgcctcgccgtgccgaccgccaccgcggtgtgcctcgagtggtggtggtacgagctcatgatcgtgctgtcgggcctcctggccaacccgcgcgccaccgtggcgtccatgggcatcctcatccaggccacgtcgctcgtctacgtgttcccgtcctccctcggccagggcgcgtacacgcgcgtcagccaccagctcggcgcgggc

SEQ ID NO: 58903 - DNA, 6860 bp, Oryza sativa
cagcgcccgcccggccagcggcgcgcgcatcaacctcgcctccttctacctggtcggcatgccggtcggcgtggcgctggcattcggcgcccgcctaggttcgccgggctgtggctgggcctccttgccgcgcaggctgcctgcgcggtgtggatggcgcgcgccgtggccgccaccgactgggacgtcgaggtggcgcgtgccaaggagctgaccaaggcgtccactacaggcagcggcaccaaccaccagcacgagtgcaacaacagcaacaccaacaccgccaacgcaaaggctaacaccaaaacgacaacgtctcccgccgccaataacatcaatgccggtggcggcggcagcagcgacaaccgcggttacgtgcccatcagcgagagcggccacaacgacggcagcgacgacctggagaagctggaggaagggctcatggtggccacgagtggcggctgctgcggctgcggcgacgcgttaggcgtcgacacgaaggctggggacaagcagcagtgcagcaacggtggtgccggtacggcggagggaaatgcggggcagaggaggggctcggcgtcgtcggagagggccccgctgatcagtgtgggggacgacgaggaggccggggaggagaacgacggcgacggcggtggaggtggccacgtctagctagctgctaatcaaccagcgtggtcgatccatccatcgattaattctggagaggttttgatcgtacgtacgtaggctatgtttgacactgatcggccggtctccatttcatctttctctccatcttgatttgggggtgaggtttagttttgtctgtataaccaagctgagcagctaattaatgagagtattcaggaaaaaaaaagagggagaaaaaaacatatatattcttcccttatttttcttaattaattatacttctatgtacaaatactaattagtttgggtgtaaattataattaaatcaattgatggtgattaattaagaattgacaagtgcatgcatgttgctgtttggcatgatgtggcagtactgtttgttgtgttgagagtgggggtgtgtgtggctttgggacctgtatatatcgctgttcccctagtggttacatacgtgacaaccaatggtggtgccccatttcggccatttcccaactgttccaacatcgctaagagaaaaaactcgcattggccctcctttaagttttctccgagatggctagcacagctacctagctagctacctttcttccttttgataaagtcgcaaccatttgatatctacaagcacttgggcgaaaaaaaggcacccttggtgttttgcgatttttaaatattactactgcatatgcacctttttatttatttctggctcctcgtgcaaaggaaagatggtgcgtgtgactcagtttctcatgtcttctatattgagataaaccttttgatcaaaaggctcttgccacaaatattaatttgccattgctcaccacacaagaagtgctctctcgagggtaaaaggatcacactagctagcatgaatttatactttctgtgcagatgtagaaatgtggaatataacccttatgtgggaagaaaggatctatatcataaccaaaatttgatgatgcttgccttagtgtccgtagcttataagatgagagagagagagagagagagagagagagagagagaaacctagagtgctagaaattcttgaacttaaacaaatcgtatggcaagctcttaatttggtgagccccggattgcgactagcatgcaactgttggggacatctaaatgtgttccagccctgctctatcataaaacaattattgttaaggtgtttattcctcggcccgctctttctatgagtggttcaaaaacatacttttgttcacaaatagatgtcatttgaggaatatttttccctagatatataggccctcttataagttgtcgagactcgagacttgtaatagaactagtgggcgtgtggggctattaattgcagttaacaatattagtttgaaagtggtaaatttgtcaaaataatatgatttgattgacgaccgcttcatatgcccgaaactaatatgacgttcaagaagaacggtgcgaatattagatcgcatttttcttaagactataagcgtacgtggtccaacatatcttttatcctttagtgttttcttatctatatttaactagttgatacccacactttgctatgagatatgtggataaatgcatgttatacattatagaaataatagatatatatatttaaagaatgtaaaaaataatgtgaagataatgatttgacattatttgcatattgagttataaaaatatagcaaaatcgtgaatgatatgtcatgtttgcatcatatttaaaactctagataataattgctagtggtgataatgtgatacacttgcatgttgagttttagaagttagtggacatatatatgtctaggttcgtatataaaagttgatttttttttcaataacaaagggaatggccacataggagcgttaaggaaactattcactaattttgtactcatatactagtataagacccttgctggactaaaaatcacacatagcagtaaagtttgccgtccaaggatacctgcaaaagcaccatttgcacattcatctccctcatttgcacctgctgaccagaattccctttttcaaaaaaagaaaagaaaacaaaagtcccctgatgagactcctgcctacagtttttatccgagaagacttggggtgtttagatacaggggtggtttagcgtgtcacgtcggatattatatatgtgtcgcatggggtgttcgggtaataaaaaaactaattatataatccattaataaattgcgagatgaatttattaagcctaattaatctatcattagtaaatatttaatgtagcaccacattgcgaaatcatggagcaattagatttaaaagatttgtctcgtaaattagttgtaatatgtgtaattagttatctttttagcttatatttaatactttatacaggtgttcagacgttcgatgtgacatggtgtaaactttttaggagggatctaaataggccttaaaacaaaaaaaaaaacaattggaatactaccgtgtttgagagtaccatggatttcagtagcagcagcagtcaatccacggacaggccaggaggcaggcaggagtgcagggcagagaagcagagtctgcagagagaaaatagattactcctacttgacaaggcgttgccaaaagacgaatcagaggctgcccaatcgccacgccgatcagatcagttgcgacgagacgcttcgggcacggcatggagagacagccgatcacaagcgcgaccaccatgcatgtcaattttgtcatgcatatgcttgcgccgatccattagaccatttacagtccgttctcctcattcgaggtgcatcagagtatcacgtagactaaggttatgggtctaaaatcttaattcttcacagtgcaaatggctttagttctaatatttttgtttcagttctaatatttttcataatttgtgtggatgtccaaaatttacactgaacaccctagaatctagaaaaaaaaataaacccctcctcacccctctctctcctcctctctccctactatggcagtttggcatcctccttcggctaccccgccgccggtgcccctctccccctcccctcctctctccaccgacgtcgacgccggtccgagcgtggttggcaaggggcaagcagccggcgagctccaagctacgtggtcggcgagctccgaccgacagagcgggctccgggtggcgtgctcggcgaggggcaagcggccggtgaccctgtctcctcccatagccggcgcccctctccccctcccctcctctctccgctgacgtcgacgccggtccgggcatggtcggcgagggacaggtggctggcgagctccaactgacacgacaagctttgggtggtgtggtcggcgaggggcaggcggccggcgaccctgtctcttcccacggccggcgctcatcatcttctcccctggtcggcaccctctgagctcggcggcgcggatcgaacgcctcgtcaatggctaagaaatcggcaccggatctagcggctcaccaacggtgtggttgagtggcctcagcggcgagcgggcggcggtaggcaggccctggtagcctcctcttctcccccggtgcttgttctcgcttccgacgccatcttgtgttgctgctctcgttctcctttccgctgctcttgcacgagagaaaggagagcgcgggaggggaaaaggagcgcggccgcttgtcgaagccacgagcggcgaggccctgacctccacaacacggagctgcgcccctctcccgcgccgcgcgcccttggtcaggccgaagaacgggtgaccagttttggctccgcgttcttcacgggacaacgctggtagatgatgtggcggcaaatattctgttcctcacgctcgggccgaacgacacgtccgcgcattgtgaatggccttatgtcacagagttgcaccagctgattgtgaaaattcggttatttttacaattaaatttagcttgtgtcaccattgaaaaacattttcgattatatgtacaaacaatcgataagaaatcatgctcataaaaaatcatgggtaaatatttaggaccatctgtgaaaattgttttaaaaggatcatctattaaaatagagttattttatagggatctctttagaaatcgtctatagaagtcactattctcacacaaacccctaagggaacatatattttcacaaatggttccttataatggatggctatgaaaattgtttgactacattaaaatatgatgggccgaataagcgggtaagtcctccctcccttcccgcaattccctcctagccttcatgcttatcgtcctcctttctaccatccggaagtggcggatcgacgataactgtggggctcgggagcgcatatcgatggtggcagggccaagaagagtggattcgacatcgatagatctaagtagcagtggatcgatggcagcgagttttggggctgccaaatttagcggcgtcggcctcgggaccactagatatagcggtggtgatcctcaatatggcttcatttcagttacagcaatgatgaccgcaacagggtctaagactcgacaataacatcatgatgatgaccgtagtaaggacgtcgtctcggctgttgctaccacttttgcaaagggattatgaagagggacttgggaaatttgatcatgacctatgtagaactgcgattcgatgtagttttcatatttttttttacaaatatatttgcaagtaaagactactgtctatgaggcaggtaatttatcagaggcgagcgagtcacccaaccgcccacctgtacaaaccaaaattagtcacctgtatacaatggtagactggtagtgctttcgtaatagtgtgctaatcaaacaggaatacgatgaaacttgtgtactagaattgtcagataaagcaccctgatcttcttagatttctttggttatctttcgctttgcatggtagtattatcaaacccaacccactagataggtggcgaactggccaagtttatttatgtcaccactcaccgagcatggcccaaaggcaatatgggtccacaagacaagtcctaacacatatattcatctgcatattgtagagaaaaaaaataaatgtgcactttgcacatcactatatatcttttccttcttttattttttcgtaagtagatagcctaagttgactaaagtgttatttaatagtatcttgccgataggacatatgacttggtgtcttgcagattggactagtgtctaatgcatttataggatcatgtcatggtgtcaacgctttagtgatactatgttcattatttatgttttccgaccatagtgaaaaattaaaggtccacattattctaaaaaaattgctggggaatacgagtcatcaaattaactgtttgctttatatatcatacaggaaggaggaagacaaatgggtgtttgtaacaatatactcactcgggtcacagtctcacagataagtgaatactacgtaattaatttgacgctttcacacaaacacgacattgacacgaccgatctaggcctcctttgaaacacatgaagtaatgtcaatgtcctgtcattaacgcatcaataggtcagatattatggcttattaaaccctacaggaagtgaatcctcatgaatttgtaaaaaaaagtgttattcagtagcactacagaaaaaacatatgaattttgagatacaataagagaaaacatgaaatcttgtctctggctaactttcctctaaaatttatatgaaatgagctattctataggaattccaaaggatttttttgaaggtcatttatttcaatccttcatgattcctccatttttttcctttgttccaaagaagcctttatttcttatattctccttcttacataacctagcaaaattttagtatcataaaaaatatttctgagactaatttacttaaaccattttaacattttctttacaatgaaaatgttacacatagctagacgttggcaacaaggatacgaccacaaagttctgttttaaagaaatagagaaaatacgcaaaatgaggtgagctattagtatatgattaattaagtattaattattttaaacttcagaaatagattaatatgattttctaaaacaaatttcatattttttttaaaaaaaacacatcgtttagtagttcgggaagcgtgcgtgcggaaaacgaa

SEQ ID NO: 58904 - DNA, 1282 bp, Oryza sativa
ttcctatttttatgttttctcattcctacgattcaaaggggccctaactttccttcatttcctctcatcatccagcagtgcagctaccaatatactagctgggtttggctctccttttctccgagattgccattcctgccgccgcccattgcctccccttcgcccaagttctactaataagcagtaggcactaggtaatttggcctcttgttgccatctttccacaacacctcgcggcttttccacatgggacatgaacacgcccctggaaaggtttgcgtttggtgtggatcaggggctgttagctagcccagtgacaacttttttaatggcgggcttggagttcacatccgtgtctccgtccatctcattcccggtcgccgcgatcgtccttgttaattagctagctgacctagctagcagaattaattatggcgcgacttctgctgcttcaattatatgctggagaggagcaggagaaggagtactatttacgggtgctggtttaacattttttttctaattataaaaaagagacacgcgtctatatattaattttcttttaaaatatgtcattattttttaagatacgtttgactattctttttttaaccttttttcatagaaaataggccaacctttagcaataaatcaagtcacaataaaataaatgatacttatatatatcaaaaaatattatatatatcaagaaaataggccaacctttagcaataaaccaagtcataataaatggttaaacggatataaaaaaatcaaagatcataccacattaattctacataattaactagacacttttgttcgataaattatcgttggtcaaaacctgatttattggtaaagtaagaactggtaattatatcataccgtgtttggttggttggctcaatttgtggaagtaagaagaagcatgtttggttgagtaggtgtacgtactggacgagagcctacacccacgggtgaacggactatcaacctaggctaaagaggaccacaaaattcgagctttgcttctcagtccggccgagcttgggtactagctagctagttcatgggcagttgtaggcagggggtgcaagtctactcaccttcctctttcccattcacctcatggaacggtaagggtcttgaccaagctcgagggatgccaccactacttctttcatcggatctctacctcctctcctctcctttcctattctcattgtcgttgagctttttttctcatgttctcagttggaccgggcgggcacaagggtgc

SEQ ID NO: 58905 - DNA, 2270 bp, Oryza sativa
gatatactcaggaattagcatatacatgggcaaccgtgcagttcagaagtagtatttgggttatacttataattcacagtttttattcttctctttatactctgtgggcccctcagaaatggttccttgattcctttctttggggctaatgctccatgaagatatagattccgtttctttttttcttctctctctagcattttagaacctaaagaaatgtaaaagacaagagaaaaaaaaagaagtaaggtgatgaagatgcactagccaagtgtcaaattcttgttcaaagaaaaattccggtctagtgccaattcatgcatgctggtcgaagaattatagccccaagtggaaagttagagaattagatccttctgctatataggcccgtggttaggaactttcatgcaaatgaatcattaaactaaataagttgatcaataaagctgtaactgttcaggcttattagccagtttataagctaaaaagtttaaacctaaacaaacgagtagcctttttgtttggctagcttttctaaaaccaaaagccactatcacatgttaagccaaaagttaggttggagaaactagctttttagcttatttcaactgagggtataacttcaccattaaacttaatgctttaggcccttttttaaatttataaaccaatttacgagccgaaaagtctaagccaaaataaacattcttcgtttttttttcttatgtgggatggagactttgactccaccattaaaccataactttaaatccaccagcttataaaatatataagaaaaaaaagctgccatagtgtcatcggcttataaaacatatcaacggaaacattagcttaaaaaccaaaccaataaacctaaactcaaacaaagaggcattttagcctctcatcacccgcttgttggcttattagccctgtacaaaatttgacttaaactaaagtttgcttaaggctttattttttcgttgtagtctctctatatattctagcatgggcttttagaaacaaattaacaatatatagatatgaaagtttacatgcaatttatttttattgcttcgttaattaatatttcgatggttatcggccgtacgtaactcaaccaatcagagcctattgctctaatataggtatcataagttcatcaaatgattgatacttcttaaaaaaagaacaatgtataggtatttcttatctatcaacttgctgtaacttaaaaaaagaacaatgtatattattttgtccttttggctttgttaaaagccgagtattataatgccttttataaaaacaaagtgccaatgtgaaaataaaatgcatattatagagtatcatggttacgagtaaggcatacctcataacctatgacttacggaatatacggatacgatataccttcatatatacgatgtgtttccatatgcgtaaggaaatctacaagacattatggaaaatatcctcacgggcaagtggttatcagagtcctactcagagaggattgggtttattctatatcgtgcaaggttcattgtctccgggttctacttggagactaaggtgacttatggtgtaaaaggcaacaccctctgaggggttcagatcatcgaatcatagcgccaacacacccgccaaagtctacgaagccggagggacgcgaaacctactcgcccagggatctcatcaatcatctcgacaaggatctagccggtaacgccggattcatctgttctcattgtattatgtggttttccatatcaatctcatataaactggattagatctattatcttacgaggggtctgaaccagtataatctttgtctccttgtttgcttgatgtcgtatcgtgtagatcctcgtaccaacgtaccataataccctatttatccggactacgggtatcccatcgatatagacaatcttaaaaacacagtataggtataagccgagagatgtattaaacaaattaagtaaaccaacacatatttaattttatgcaaatttagaatgtcctctggacaagtttagatgtgtactactctttctagtctaaatacataacttttctacgctaattaatgaccagagtaagaaaattttagataacggatctataaacagagaaactacatatatcaatgttcaatcctcagtttgctaataagcggatgattcattgcgcagtttagcgcgcatggtcatgctccatcatgtgttaagcacataatgcatcaatgtaatattaatcctgtt

SEQ ID NO: 58906 - DNA, 24904 bp, Oryza sativa
  unsure (1)..(24904): unsure at all n locations
ctgcccttccataacagaaaaccaaaagaagaaagaagctatttttctcccgtctttaatcttgctcctttgaatctgccttttccatgcactttacaggacaaacccggctgcttgccaatattatggtttatggacagcactctgccacttgtaagaagaaaaaaaaaagaccccaaatcatatattccctccgtttagtattataagtcatttgattttttttcttactcaaacttctttaaatttgatcaagcttgtagaaaaatatactaatatttttaattaaaaacatattatcaaaatatatatttaatattaaatttaatgaaactaatttggtgttgtagaaattgctgacatttttaataaatttgatcaaaactaaaaaattttgactaataaaaatgttaaacaacttatgatatgaaaccgagagagtgcggtcttcgtcccaaagtaataaagtttaaactctgtcttaaaaagtatatcaaatcctaccttcttatctactctcgatccatgaaataagaagttttattctttaatgtcccttacttaccacctgctaatggtcaatactacgactttcctgtttaatgagaatcattgttttcttttttactttcatgactaaaattgtctcgtgatgtgagggtttgattttctttgcacatagagatgtggaaaaaaaaatcgaaaggagtgttttctttttttgtccaaaggctcttctagttctgggatagattaatccacatgtattttacatatgaaatcctattacgggcaaatataaaccacagaaaatcatatgctaccaagttgctgttttcttgcttttgcacgcataatcggaagtttcgtagccagaaacacaatataggctgtgttcgcttgagcttgatgagaactcattctctccgcacggaaaacggaacggtccattagcgtataattaattaagtattagctattcttttttcaaaaatagattaatttgattttttaagcaactttcgtatagaaactttttacaaaaaaaatataccgtttaacagtttgaaaaacgtgtacacagaaaacgagagataggggctaggaacaaggggttgcaaacacagccatactccatttccaagagtgactctacggtggtgttttttcccctagctaggatacataaaaaaagtaattaacgtacaacaaattaagttttaatattttaaagtaatgtatatatagaaagttttcataagcagcttgaaaaatatgctaataaaagtcgagataaactatgtattttaataaaaagagaaacaccactacactgaaaaatagcaggcctgatactgaaagactatgcatgccatgaaggttccctaaagcgaataccatgacaacacacgccatatcaaggtcgacatggcagtcggatgatataaaaaagaccaaaataaaaacgttttgagatatggcagtataagggccccacaaggatttgcctgaacgtgagggtcctctatgcaaagtggccgcaaggctcgtctctttcgcatctgttcgttcctttgccccaaagcaaaggcgaaactaaattttaagcaagtgatctcacgaacccaaaccgaaccagtgcatgcatatgctcccctgtggcggcgcacgtactcacgtaggaacaattaattaaacgagactaattaatctaattaaatcgcaacctttcgatcgagctcgcagatcgtatatatatgcgatacatcctaatattataaagctagataaaaaaattatctaaattcatagcattataatatgtcacatatattcaatctaaatcttttatattataagacggagaaagtcgtagttaatatcccgcgctttgctgtgaaatatatggatcaatgaacgcatgctatatattatataaatgatagatgtatatgtttaattaatatgaaaatgatatggagataatgacttacattatttgaatgttaagttcttaaaaatataataaaattgtaaataatatgtcatatttgtatgatatgtaatataatatagataattaaggtacatttgcatatgattctggcgaaaaaaaggtagcggttcgcaatgaatcgtaaagccgctgcccccgtgctatatatttagctcgatgatcgctagcgagctcgcaacgtcgccatcaaaaagttcgcttggatcgcgttatctttttttttttttggttctacttttttgtatgatccgacgcaaaatatcgaccagcgcggccggctgctggactactgcgagttggtttgttagcttaggcgctaagtatctgcagcctagctaattggcagcatcgaaagccacggaagcagtagacccgagttcaagattagtttagttaatccgttaatatcctacgtgtgaatggattaagtagttggtcggttggttttgtggggcatgttatttgttttgagatgtacttagtactttgacagtgtattggtaaggggtgtgtgattttaattttaaggtacattatttaaattgtaacatgctcataatttcttcttcaaaaaattgaaggacgtctctcccttgtcattttcttcaacacgcttctacagctgctaaatgattaatataattttcataaaatttatttgtttaaatattatttgattttataatagtttgtttgtatccgtgaatatattaaaatcattcagttattcggtcactgaattatatatacataaaaatacctatctataagctagcctacaatatgtatacatatgcgtgtcattttatatagtacgagtacatcacaactacggtaaatctctcatttacactaaattcctactccctccattttacattacagatcttttaattttttaagttaaacatgtttaagttcgcgaaaaaatataacaacatttcaaacataaatcaaacgtattatcaaaattcatgtaatgctacatgtaatgaaattattttggtggtgtagatgttattaattttttttataaacttgattaaacctaaaaagtttaacttaaaaaaatcaagtactaataacgactcatgaataatatttgaggacaccgggttaaatcatcccacctttaggccccgtttggtagggctccaaactccaactcctaactctaaactcccactccagtgagagctagctcctgtgggagtagatacccattgaaaaagtgtttggctgactttttagctccagatctgaaattgccttaaaaaaaataaaaatccccaatccctccccgcgcgcgccgcccttcccctgccatgcgccgccctttgccggccacgctccgccacccgccgtcggcggccctatccccgcccttgcgtctcccacgcgctgccgccctgtccccgcccgtgcgccatcctcgccagtcgccgcccttgtgtcgccgcggtggcggacgagcgagctctgccctttcgccgcctgcgcgccgtccccgccagtcgccatccgctcgtcgtcctgtctctcgccacctgtgcgcccgtgcgctgtcctgcccacgcgtcgccgacccgccgccgcccgcgcacctgctgtcgtcgccgccacccgctgccaccgacgcccgctgcccgccgctaccgacgccgacgccaatgccgaacgccggtgtgaagggagaaagattgggaggagagagaacgggagatggggtagatagggtagttcaatggtattttggtgtaaatatccttaaaaaattaaagggtagtgggtcttttagggtggagtggagctgtggagcagcaaaacccagctccacccccatagtacaaatttgtagagcagctctgctaactccgctccagaaaatagagaatctgtaccgtttggcacanntncanntnttggtnannnnnatttnngagctggagctgtgccaaacggggccttaatgtcttctcaaccagttgctgacttcaattcaaggatttcagccattgaaggtcgcctcctgacgatcgttatacgcctaatataatgcacgcaaaattccactgcttgatttttttttccatcttacacgtgttctcttggttcggaccaatgtgtacgtcgtgccaaactaggtcaacgtagcgatgcttggctagcagcagctggtcaaccagcctcgttaatttagccagtggcaaaacaattgtcatgcgttgcgtcacggggagctcaatcccaaaacggctgatgaattgcatgaagggatgaacaagttcacgaaaaatcccgatcaaccgatgctcgtttctgatttctatcgatcgactgatcaatatgaaatttatagtcatcgtgaacgaactgcttcatccgttccacaatgtaagccattctaatatttctcatatttatatctagatttattaacatcaatacgaatgtgagaaatgctaaaaagacttatattgtgaaacgggagagcaataaaacttatataaatgaaaacggaaattgttttggtgttgtatcgtccatttatttcgtattccaccttatttttataatatggtaagtacaatattattaaaccccctttatctacataatatatactctctccgtttcatcatttatataatgtgaaaaatgttaaaatgacttagattctatttgatccatagtttagaggcacattaactcttcaaccaaattctttaacttgagtgcatatagtaatgtagagaatattttttatcagtctgcaatcgacgtcgatatgtttatgttcatttttttcataatttttttaaactgttttttttcttgttttgctgtttttattatgtttagagtgtccgaccacttcttttctcggggcattgccaattcaagatcaaaatatcttccgcacatgttgaaaacatctctgctcgtattattgggttcagtgcattttctggcaagtcaggtgcttcacgcatgcgtggctggcgtgcatatctctctatacctgcacacaggaatatcaacatactcacgcggcacacatgtgcgtgtctcacgccaaagccatccattggtattctcgcgaattagacgtgacactgataatctgatctccagtaacaaaacgtacgttgatcggacactacacagtacacacacgtcgaccgactgattttgtaggcatttcgagagtcggtttccgatcccgggacttcttttggtttggattagttctacacaaatctgacgacatccgatccgatccccacaatgtttggattagagccaccattttctaatgtgtagttcttacgactaattcagccgaactgcccaaacgggtacgtacgtacttcacccccaagtcttcatatgtttctgcggtttcttcttgatgaagaccacacgacgctaatttcaaacggtttcccccaaaatttgcgatgccttttttcactagcgaaatgatgatgcgtgcaagcgatccacgtacaacctgtcacgaggaggcgagcagagcagaaaaagagaaagcgaactgctactccagcaaagccgatcacgtgaggtgttacaagtgggtggtctctgtatttccggaactgacttgaccgtcacgaagcacatcaatccgtggaggagtacaaacaaaagttgccgaatgccaagtcgaacacaggtcgagcacggcgcacacaaacacacgaacttccgtccgtactaaaatataaatatttttatactttaacatgatctcagagatactaatttaattaataatatatataaaagtaagatgttttaaataaaaaaagagttacacattatgatagattgtttaataataaatctaataacatcaattttatataattaattttttattaatagttaaaattgaaaacgtttaactcgccattatactatccagacgaaaactcaaaaactcccgtaaccgtaggatgatcagatggtcaacggcgatggcaaaggtcagcgtttggtttaccacgccttcgtccggcggtgggccggtggggcccacctggaagtctaattattactagaccgagaaataaacaacttgcttcacaagaacatcgtgggtgggaacgagcgaaagcaatcttaagcgccaagaaaaatacgcacaagagagaagagtaggcgcggttttgtggccggagagaaagccacgcgccggtttcgtgccggagtatcattttcgttttctttttttctccctttctttttttcgcattaacggacgtttcgtactaagctggtatacaacaaggagaccggctgggcgcctgggcctgtccaggtgaagtaaagggcaaagtcggtactaatcggtatagtcagcgtgcttcacatgcgacaactctgacccaaggtgaagtaaagagccaagtctttatgtacgacagtacgagcaaggactagtactagtagaagtgctatgctgaattttgctattgttaggaaacaattttttggtttatataattaaccaaactcatacaatcaaatgtgtatgcatgaaattgaaatgtaaccgttttttagaccaattttcttatattaattaatttattatagaggagaaatatttttttctttttttaagggaaggagcactattctttccgttcaagtaagtagtagtccagaccaaaaaagaaataaaaaaacaactggcgcaagtaaaacaggttcgggggcaaactagacatttctagacttctctaccaaggcatctccttctgtccttcatcaggggcaaaaccgccattaccattaccaacaaacgcaaagaagactcgggcgggcgccgccccagaacacaagtgagaaaaaaaaaaaaccgacctcctcgccgacgtgctcttcaagagaccgaccccccgccgcggcctcaacctatatattcatccccacctcctccgtcttccgctcccacttgatcccgatcgccatttctccacctgcacatctgcgcgcgcgcgcgggagagcagaggcggcgagagagatccgggtcgggaggggtgatggacttctccggcgacgtcaagccggcgatccaccggccctctgtcgcggcggcacgcgggggagggaacggtggggcgatcccgctcctgcgtgggtggcaggcgttccggaggagcggcgcgccggcgaggctcctctgcttcgagggcggcgcgtgggcggacgtcgcgggcgaggtggtggggctgctgcggcgggcgttcatggaggggaaggccgtttgcgaggccgcctgcggtgggagggtgttcctgttcgacttcatgcggatggttcggatcgatgaggccaccgccgaggaggccgcgctggggtggatcgacgaccgcggcgcgtgcttcttcccggctcccgagggcgggaggaagaggaagagggagagggacgaggcggggtcggaggtgaagggggaggatcggcggcggcggcagccggcggcggaggaggaggacggggacgaggcgtcgtccggcgtggaggagcggtccggggagagccgccccgaggcggatgagcccgacaggaagaaggcgcgcgggacgttgtgggggaaggcggtgaggctggacgaggcggacaagttctacaaggtggtggagaagctcttcgtcagccggatggctcccgtggcggcggcccgcggcgtggcgatcacggcggtgcacaaggtcgcgcaggggccccgggcaagagccttccatctgcagggacagctccttgccgctgctcgcggcgtcggcgatggcagcaacgccaagttcgcgtggtacggcgcgccggcggcggatgtggccgcggcggtggagcacggcttcgggaggacgaacgggcagtttctcggcgggcgcgcacacggcgacggcgttcacctttcgccgccgcagtaccctcacgctaggtgagtttcccaaatgctttcaactctttccatctgcaaatgctttgaactattggggagaacatttttagtaatttctgaaaattcaccaagtgcctcatatatttcatctttcgatattaccatacgaatcttgagtaaaattattttctgcctgccatcttggtgctaaacaatgaaactaccaatcgttgttttgcatctaagtttgaatttagagcaaattagacagtatggtacagtagctacctaaattgttataaattgggatgaaatttgtgagtcaatgttcaactaagttaacgagttaattaacttgtcttcgagcagtgcgatgctgaccaagccagacgagaatggcgaggcacacatcgtgctgtgccgcgtcctgatgggccgtccagaggccgtccctgccagctcaccccaattccaccccagcagcgacgaatacgacagcgccgtcgacaaccttgagaatccgcggtggtacgttgtatggagcacagacatgaacaccaggatcctcccagagtacgtggtcagcttcaggtggcccaacctgccgcagatggaaggttggtctctcgtgtctgaaatttgctggatggaactgttcccatttggcactgccataacagtgaaactgtggttttcaggatcatcggggttgggatcgaagctgaagaagccatcaccagcagctactcgcgacatgttccctatgcttctgacggagatccagcggttcgttccatccccgaagctgcagactttgcagaggacgtacaactgcttcaaggtaaactggtacttcttgctgagcatttcatttctagatagatgattgattagaatcttgcgctagcttacacaaaacaaccccttcgcgcttatgatcatgcctgtaagtcaaaatttaatataagagttgattttgtggtttttttagttgtttattttaccgcatgaacacgtataaaaaaggttttactatacctttttttggttaataaattgtttggataagtaaaagcgaaacaatgggctgaaacacaactgctgatctgctaggtgaatttaggccctgtttaattcagcttaggattattataatctggattattaggattaagctgaaacaaataagtagattattatgttagattattataatttataagccagattactataatataataatctcctctagaggagcttagattactataatctaataatctcctctagagaagctttttctagattattgagtagctaaagacccactacccttagatgcctctaataatccagagaaacaaacaactcgtagcttattttatgttagcttattataattcagcttagagtaatctgatttaataatttagattacaataatcttaagctgaaacaaacggggccttagtcttacatatagttgaacaattttgctctgcctggtttgtgttgtattcaggtctaactcttcactatacgcaataattagcacgtaaaaatgttgatttgtaccgcactgctatggttttaatatgatcatgccgactttattctgtagtaatatgctgccgactttattctgtagtagaacagaatcatctacctgtcaatattctgtgcaaagcgaattcagctcagcataacggcgttataactttaagcgaagctgaagtcctgaaaatccaatgacataaattttctttttgtttcagagaggacagatgaagaaggaccagttcatccggttcttgcgctcccacatcggcgacaatgtgttgaccaccgtggccaagaaactccgagggtactagtgcaaggtgcaaatttgtctccactccgtggctgaattcgactaactccgtagaatcgaacagtgcgtgtcgtgtaccaatcctgacagggtttattctcttctgatgctgctttagtttttccggtgctcaaatgtttattgtcatgaacatagagggggtttactgtgatcttccaattaaccaacacaaaagggtatatgtgatatgatgcaaattatgcaattcttgagttcggtcatagttttacttattttcagcaacttgtaatttgtacagactcgattctgttgagcttttgattcaggaaacaatcaattcagtttcgggagtttacggagctttgatgtaaaattgtattgttgtcttttccccgttttttcgactcgggaatcgggatcatgtggttagtttagcgcacgatctgcgtacgtgctctccttggtagtctcgtagatcgcggtcatagtgtgaaacgcctccgtgatccccgcacagattagccataatggctgcgttctttcaggggagatatgggagattgtctcttgtttttcgtacgcacatttttcaaactactaaacggtgcgtctttcgtaaaaattttctatagaaaaattactttaaaaaaccatattaatccattttttaaagtttaaaatagttaatactcaattaatcatgcgctaatgattcacctcattttacgtatctttccaatcttctttatttccttctcctcaaacaaatggtctgcagattgagcgtacactgttatctcacacgtgtcctgccacgcggcatacggatcgtgtttggtcggtaagcggcatcctcggcggccgcgtgaatcaatgatatgtttttaagcgttggaatcttctaaaaatgaaaatgaaataaagattactaaatattttatataaaacgagatggttataactgtaattaattaagttttaattattagaaatttaaaaaatagattaatcttatattccctccgtctctaaatatttaacgacgttaacttttttaaacatgtttgaccattcgtcttattcaaaaaatttaataattattaattattttcatatcatttggtttattgttaaatatatttgtatatatatatatagttttacatatttcataaaaaaaatttaaataagacgaacgattaaacatgttttaaaaagtcaacggcgtcaatatttcgggacggagggagtattttgggccgttttggattgaagacaaaacatgaccctttatccacgctcaatttggattgaagacaaacaattcgtagtgcccacgctcaatttagctacattctagaatcttttttactctcatactaaattttgactttatattggtattaaaccaaacataaactagctaactttgtcctaccaaaaaattgatagtgccaaaatttgcctagattttggcactaccaattaattggtagggtagagaaccaaataggccctttataataactttcatatagaaagttttcgcacgaaacgtatcgtttagcagtttgaaaagcgtgccactttcaactaatacctctattttagtttataagattttctagcattgcccatgttagattcattaaatctatataaacgtgggtaatgctagaaagttttataacctgaaacggaggaagtaaaactttatccacttttcgttgaagaaaataacaggcacaatgaactctgcctgcagcaaaccgatgacaatgacaaacgtcgtgtgcatgcttcgttcgcgtggttgtctactttgagtccatctacctgtcccgctgtccatggcaaccaagcaaggaaggattaatttcgtcgatctgacggtgccacagcccacagaacaaaagagagaacgatgcaacgccggcggcatccgtgaactcttggagcagatgtactgtgtacaacggcgatcgcagcgtctcctccagcggcggcagtcggcctccggccatcagcacccgctcaccagtcaccatagcgtaggagaggtaaccaccgccgcgccccgttagttttaccttctctgcccaccgccgcctaaatcttcttcgctcgagggggcaaggggatccatcgtccaacgaatccatccgcgaggccggccggagaagcggaaacctgtcagcgagaggacagctcaacagccggccatctacatctaccattctaattttgagaaaacatttttcagggcttgatccgaaacactggggatctaagtgcatttttcagggcttgatccgaaacactggggatctaagtgcaaagctatactccctccgtcccaaaataaatacagttgtgggtttcatgtccaacatttgacacatccatcttatttgaaaaaaaatatgattagtacttttattagtgttatatgataaaacatgaataatactttatgtgtgactattttattttaatttttcataaattttttaaataagacggacggttaaacgttgaacccggaaacccacaagttcatttattttgagacggatgtagtgtaatatatggggatctaatggcaacaatgctacacgtcaggcgccggttgctttcaaaaatatcgaacggtcacatactcggtacacaatatatgcttctttccctctttgtgcatgcacgtaggagtaagtataacgcgagctttaaaattatttttttcataaaactatttatctgatctatgatttgattatatttttgtgttctttataataacatcgcacatgattatattctgataaactcttaatttgatgtttggtgcattagagtaaatgtttcaattggtaattgaatttgttgcacatatttaagtttttacgttgcattagagtaaatctttcgccgccgcagtacccttatgctaaaccaatgcgaacaactaaacacctacacatgtatcctcttgtctagactaaacagtctttgtgcatccaaccaaacaaaatcttcatatagtatcttttgtgaaattaatcaaacaaaatcttatagtagctaggctaaaccaatacgaacaaccaaatgcatgcacgtgtatccagcggcggagatagctcccgggcaggtcgggcggtctcctgggctccaccgctgccgtttcaattgccgtagcagtcggtcactaacaaacgttactaatcgcctaggctttacggcggtgttggctccgtcactgcgtgtatcttttgtccggtctaaacccaacctagatgagagaaatgggctagactagaaggatataagcaaccaaacacattctaaatcggtgcgaagtactggtaatactgtagtagggaccatagtgcaaatatgatcctatttagatgggccgcatactgcactgacactggataacaagtgtgggcttttacatggtccacaattcgccaggacgtacgggatttactgcagcgctctgcaccctcaccccgtctgtccacggacgactaatctgagcgagatcaaatcctctgcagctcagttaatttatctaaccaccacccaaaaccgatccacacaaaagcaaaaaaacccatgctacttgtcacgttgccgtctcatctcaccaccagcatcaacacaaaaaattactcctactacttcacctgaccaccaacagggtcactgtcgcgtttgctcgatactagcaatcctcccccgttgtcgccgccccaccaccactcacctgaatctatggtcatgtgtggcctaacccaaacccgtctcttcctgcaagcagctaccgacaacgatggcttcaacggcgacgcactgaatcgagacggccgtgcgtgtgcgcgcatagtttttttttttttttttttgtcgttccatcggttggcgtccgcagaacacgtttcccaaatcttgtactactacgtactactccatcgacgctcgccaatgcgaaaaaagattgcaatttgagtagcagcacggctgtggacagcagcggatgtgaggcgggtaggcacggaggaaaatggcagtcgacctcgtcgcctacaaatacccgctcgctctcttcctcctccccttccttccactcgtctcgccattaacaagaattctttttttccttcccccaaatccttctcgagcaacagctaggggggagtggttcgcttcgtaagaagccggctacctctgctcgatcccgcctttgcctgcggattcccaccctgattttcgccgtttgtttgtttagtttcttggggcaaattcgagacgaggggaggagagtttttttgggggggagttgttgcggccttgcgggcggggtatgcggctgcacggggaggtttccttcgatgaggacgaggaggaagtggtgatggttccggcggcggcgctgtcgtcgtcgccgctcaacggcggggccgttccggtgacgaggctcgtggtggggtacgccctcaccaagaagaaggtgaagagcttccttcagcccaatctgctgttgctggcgaggtaaaaacctggatcaacgctcaaagagatgaacctgctgattcgtggccgtggtggaggattttgggagacaatagagtatttttgttggatttcttgttgatcgagtggcaacgaaatttttttcactaaaaccagaattttttgctgttggagggaaatggtaaatgatttgaggggggaatgcatggtttatgagatacagttttgcattttgagtctttgattaaatgctgtaattggttctatttctgaagcccagaggatttttgcgagaacaggtaaaaaacttggtagttccataacaaaatggggggtgggaatggaatgcaattctattccttgtagcactaatcaagtagtgatcgaatcgaacctctactggagtataaagttagcaggggcggctagtgatagtggattctgggcgaagcttgctgcatttgcgatatattgtaaactgaagaatatggctagtgtttattaggaattctggtagcatttgtagatgcccccttacgtgcgtctcatgttgacagttccactgcatgcgggggtctctatagtctataattgtatattatcatgccaacttgtcaaaaatgggtcttagcatgcaaatctttgctacttggtgtctgggattctagtttggaatattcccataatcccatggataagcacatcacatggattacgacagctttagtgatggcaatgccttttctgggatcgtttacaatttagtgactgacttgctaggtttgatggcaacatggaccgctgacaaacgatctttgtgattgtcttgttagctccctgaatcaagatccaagctgactagctgagtcaatcatttgctagttgctcggtaggctgcagacataagcaacacaagctgaaatatagaagggaaatgaaattaatatatgaaatacttatgcaaaatcaaaatgtttttgcttaaaactatttgtgtattgcatgcctagtttgtgcttttgtttcgatagatttattgtttagttattccaagaaaataaaggaaaaaatatatatttatgcaaaatccaactatattcattcaaacaacctgcatattctctaaacgcttttttatatccctgtagtagtcttattttcaaagtataattgagaaatactctgttgcaaggcagtttaacttttttttatcattcttatttatactatcgatagagtataaatgtagcccaaacgacatgttatacatggagagatgatgatgtactaaaaaaattcttgattctgtgagggcttggacttggtcaagatggctattgtacttccatatggatgttaggatccatttctgtttcttgccattcttcttgtataacactatttcatgatgtttcattatgtactgtgtcaggaagaagggaattaatcttgtagcaattgatgacactcgcccgcttgcagaacaaggcccatttgatgttatcttgcacaaggttagtcgtgacctttttaaagctggactaaaatagtgctgcccattggccctgtatgatgcattttgttaaagaataacatcatctatttatgagctttagttataattaatgttttctgataattatgtcattgtaatttggtaaagtatatgcatattttattgaagaaatttctttgtgcagattactagcaaggaatggcaacaggttctggaggtaagatctgagtacgtatgcagaaatctgatgatgcacagtaaatgaccataccatcgttgccttttttctacttgttcactgcctcatcatggggaaatatgttatcaactgaggaaatgagcagtagatgtttgtcactgtatgtaatgattatatatccaaactatttgattgcagtgccctattgtaaagctcaacataaatccataattcttggaatttgctgttggcttctaatctgtgttgcccatttattgaaactctctgttaacctaactcctttcactttcctgaaggattatcatgaggaacatccagaggttactgtccttgacccaccaaatgccatcaatcatctgaataatcggcaatctatgcttgcagaagtatctgatttgaacttatccagtttctatggtaatcatgaagcttaacatgtatatttatatgctataaaatggattcgttattttactttccatttctaatgtttataatgttagttagtgtctgtttaattatcgaatatattcacatgtcagggaagcactggtcatgtggtgtagtcgtaggtactccacctgccagggttcaaatcctgatgctcacgaatattatgcacacccaagtgggctttcactagaaacttagtgagatcagcgattgtcgttggtttctgtctcttagagtgtgtgttaggggcgcatcagttgagttagtgtggtgcgcgcgcgtgtgcgtctgccgtgtagtcgcaaaaaagaaaaatatattcacatttaaacttctgtcctagaatggaagaaacttttgctttcaaaagcgatgtgcagaatatttatccttctaagataaacaatatatattttctattccttgtgaacctcaggattcaggaatttccattaatgctgctatgtaattctttcttcaaacaaaagaaatttgtgttaactcttagaaatgctgaaattcccaatagaaacccatagatttttttgctttgcagagatttcaaggacaaatgttgcttgattgggaaacattatttctttgcagctggttgtgaatacaatgtaccgagatagtaaaaggcagaattccaaaagtgtatcatcaactaaatctattgagggcatatctattcataccaatatatgattgtttatgcattgaaccattgcaggagaagtttgcactccacgccaactggtcattatgagagatccatcctctataccaaccgcagttgccatggctggactaaccttgcccttgggtaattggtcataatctacatcttaaaactatccatttcctctagataagaaaacattgccaaatcatgcgaatgtttaaatacagcggaaaaatattcaacatttttattccggcaatattttttcacctggccattctcagttcgtttttgaacatgcggtctgtttttcagataatatttaagcatggttcgttgatagttaattttgggagatgttctcttttcattcttggaactattgagcttagaaattgtttgatgcgaagtgcttctgtctatacagttgcgaagccattggttgttgatggaacatctaaatcccacgaactatctcttgcatatgatgaggcatccttatcaatgcttgatcctcctctggtcctccaggaatttgtgaaccatggtaagttctgttccccccctgtaactgtagtacttttgcatatcctgagactttttcctccaacggtagaagttcggacttaaactattccctctacaggtgggatcctctttaaggtgtacatcattggtgaactatacaagttgtacggaggttttctcttcctgatgttaacacttatgacttattaaacaatgttggcgtctatcgatttccaagagtttcatgtgctgcagctagtgcagaccatgcagacctcgatcctcatatctcaggtgagacatctgcagtattgtagttaatcttcattttggttattattgatccatgcttcatatgtaagagggggcactaaattcaaacgcaaactttctttagaaccttaacgcagtgtacatggtaaagagtttttatgtttccttaccatatatcaagtcgaggacagcgtttgttctatgacatcgatacttcttgatttattttgcttttgatgagtagtcgacggcaccagataaacttttgctatatattgatcagaactttctgttacatgatagaacttcctccaagaccactcctagagaaactgggaaaagagcttcgtggaagactggtatggccatgtatttatattaaccaagctctgtttcatatggtcgtcatctgacaggcttaaaaatttcagggtttaagattgttcaacatagatatgatcagagaacttggaaccaaagatcggtactatataattgacatcaactacttcccaggtgtgcagttattttcccactgccttcataaatggcatactatcatttgcgtttcttttcttctcttcatatgttcgtgcagaatttgttaggcctgattttattccagcctaaggggaaaggaggatacatcgctacacatacctggacttctaggccaaattaatactgatccagtttatccagtagtactttgtcgtctcgaatttctgtgttcttgttatttaacacagcatgatcattgttctgcagcagcattttcttgagtgtacgctcactccctcttgcttgcgcagggttcgggaaaatgccaggttatgagcacatattcaccgatttcttgctgaatcttgcgcaaagcaagtacaagaagtgcttaagcggcggctgaagtgcaaagagtcctgctgaacattaacaaaatggaatgtaacggtctagcagtcagtgtacatatctcggagaaataagtttaatcccaaggctttgaggaagagagatttagggtgtcttcccagaaaatggtggcacttaccggattagagaagagatgaaaaaatggatcgattttctaatgccgagtgcttgtataaatcactaacactgaatgttcccagcgtgccttcgtcaaggcttctgtctcaataatttcattatctttttcatgagcaatccttttagaatgcttggttctctctggaaactgcaatgtggtgctgtcaactgtggcttctgtctccataattacagtgcttgtttctccctggaaactgcaatgtagtgctgattctccgctgagtgctgattgcctgatcattaaatagtctgcgatgtatggaggatgtcattatcaaactgttcttgtgaagatattgagatgatggaacgaagtagacactagcattcataccgtcgtttatttgtttagccgcttctagttatttatatatttattttcgctaacgctgtattttgtttggcatgtttgctaataaacgcaggcagtgacaatacttattcctcttcctgcaaccctgtttccggagcccatcggaaactttcttcttgtatctgatgttagcccagaagactagagacaataggagcccaagagagcgtgaagcctcaactagcgtaaaacggcgaggattctgcggaggaataaatccactttgactctcttaatttaaggtaaaatctgatatgtatccctaccagatatcttaaccccttaataactattaaaactgtgaaatttaactttgtcgacggttttcgctaacatgtcacattggcatagttcaatagattaagttagcatgtgagacccacctatcagtgattcttctctttctcttcctttccttacctctcctctcaaatgtagtattttctctcggcagtagggtagcagcgagacaatggcgggcaatccttcaggcgctcggctgtgagcctgtgacgagccccccaccacctcggcagcttggacagcggagccatgccaccgtagctatagagcttggtccagtgcaaaggaggaaggggtgatggcgggcggtccttcaagcgctcggccacggtgagcctcggcatggatggcagagcaacaagaaagttggcctcgttggctcggtgtataggagggaggggagacggatggcaatcctccaggtgctcatcaggacaagacccctgccacttcggcggcttggatggtggagtcgctccgccgtaacgatggagctcggtcccgtttggcccgacgttgagaagggagggacgatgccggtgatggggtgttggagaggcctggcaccgttgcactagttaagggggtgggggtttacaatagggggctagagatggcaggtgaagagaagtggcggtggcagcgaggagacgaagaagtggcgcatgctgactccacaaactcctcaagctccgcgacagcgacatgatgagttgaatcgaggacgacaaccatgaccacccgtcttctaacatcgttgaaggacaccaatccacaacgtggacaaggacggccactgctccgcgcgtggcagcagcgggccagcggcggggggagcacggggtgggaggggtcactgatggcactgctggagcaggcgaaacggcaatgggtgacggtggccggggatgccaatcggaggcacgtcgtggaggaccacgcgatagcggcgatggcggaggaggaatggatgaacaagggcgtcctcgccgccgatgaggtggccgcagcagaggccgggcccgaggatgtagagcagagggagggcagcttgcacggaggatgtggtagcgttgtgcccgtggtggcgcggctgggtggacatggaggcgtgaagaggaaagaggagaagaaaggagaggaagagggactctgacatgtaggtctgtctcagtcagttggactagtaacgagccacgtcagcaaaaactggtctaaaaaccatcaagagagttaaattgtacggttttaataagctagagggtgaaaatgtatggtattacggttgagagatacgaatcatattagacctaaaattgagggagtcagagtagacttcttttgcggaaaaccggtgccattcgtcccgctaatccgccaaggatcgcgcggtggaatcgccgacgccgcgccgctgtttacgtaccaatcacccggtgccgctcagagcaggtacaatagcaggctattagccagctataaacatattttaatgggataaatataatagagaagagcagcgggctacaaatctgtagccagctgcagtacagactccaaaacacactatgtgtataataggtgggaccatatatgaataatatagtaagcagctattatataaattggctattagatttactatagatgaattggagattgtactattagacttgctctcacgcacccgcgccccatgggccaaagccccaaacaccgaaacacgggctcgtcgcggtgttgaacgcgtccccgcgccgtgagtttgtgaccgcgtgccgccttctctcccgcctgggccggcacgcccgatacggtagcacgcgggcccggaagcgtttctccatcggcttctcacttctggcccaggccgtgttgccgtgttggttcataggttctactcctacttctgtctaactaatccccttcatcagcgacaggctccgtctccacccaccacacacatcaaggctgctgctgctgcctgccgctgctgatgcatccaaccacgcgcgatttgactccccaaccgagcagtgaaacaaccggggaggggaggacatgttcggtcgatcgccgtcacagcccattagcgaccagtgtttaggtacgcatagcccagtagacaagcacatatgcatgatgcatgcaacttaacccttctcttcctctcctccttacgtctgatctatctatctatctatcattagttggtgcctgctcacgcatctcacatcctccatcgatcgattgttttcatctttttttttctttgcccccatgtccctgtctcctaatcctgttcacccagctcggccgacacggcttaaacaaaaacgcatgacctaccctgacctgacatgccaacattatccaggaacccccaacacaaagccggtcactacctgtgcaaaaaagctaacgcatcgtcctgccgtgccgtgcatgcgtgcgtcacccggcacggcaagattaatttacataaaccccaacttaacagagagctctctgcctgccgctagctacgaacttgcgccattgtgccttatccccgtctccctccaaaaggccggaattttcaatcgtgccgccgctcaagtcgccggccggcgacgcgtggatcacccgccggcatatattcgacgtatccacggccaccttagtttaacgatctgatcttttccggttattgtcatttagctcgctgctaaagttaagataagaaaaagtaagcaatttttttctttcttacaaaaccatactttttgatggcattagtatagtaaaatccacatcctataaacctatgaaagttcatccctacaaagtgtagttaataccacttctcttttctttcataagccacatcatctcaattgcttctaaccttggatgttgtatatatggttcaaattatcttactccttttcttctcttaattataaagtcatatcaccttaattttgtatttgaatgatcaaattatattattttttcttttcctcccctcattaaatcacatcatcttagttttttttaaactatcaaccatatttgatttaagttgttgtaaaccacatcatcaaatggtttatatatagctcctttttttttgcatagttgatcatagatgaaaattatataaagtgtagctattttatatgttagttttacatgttatttctactaatattatacaaaactcccacaacaatgcatggagtttcatatagtttataatttgtttcaagaaacccgggtgttgagacaaaaatgcttcatatataagaccccaaatttatacaaagtattttataccccattgtattacacggagtattttttttaatagagtaaattttaaaaaatcacattttctatggtcaaagttaaagaaaccacatgcatgcattatgacttgtggcaccaaccatagattttatgatctaagtgcttctaaaaccccacacttattcaaatcgtaactagttttatcaaatatttttttaaagtagtgaagagttaaatcaataaccttagtcattagtcaaggaatcaataactacaaatttaatatagactattttaaaaatcgaagtaaatgtgtgctcaaacatgtaaagggtagggtttgtggaactttagaaccataaaaaccgagattatgtgccattagtaataatatcaggtgttttatgcaactttagccataaaacatggtatttactaaaatgtactctttttaagaaatacctgtggcttgaaataaacattttcaccgtctagtatctttccttctcactctcccatacaagaaggcaaagacaacaatataaactgcagttgcaatgacacattaatcggttacatgttgctagctagcaaccatgtttatggagaaagtggtcagtttatatttgtacttaaaagaaaacgatctgctattttgtacaagtatgtttgtctctataagtaaatactatagccaaatatatgatatagacacaaatatggtatttcatgaaacctctacgccgtaataaaaaggaaaaatctggggtttataaaaacatgtcgtaaaacctcaaattcactttttataaaaaaaaagggacatcgttatctctacctacgccttacagtgcatcatgatagcgccggagtctttctgctatcaccatggataggccgcgattcatcctctgaccttctcctcatctcctcctttttgcctttccttttgtctgctagatcatggcgccgctcggcgatggcgtttgtgcgtgacgcacacacgcacgcgcttaatttgccggtgtgtggtttttccgactcgtgcttgaaggttaagtaaggtgtattgtgttggtctatttggactaatctgcaggaccaaatctgcaactgcaaatgataggttctgactactactagctggtagtgtgagagaattcgtgtacgaccaagtagtataaattattcaggaatcaggacattcagagctggttttgttttttgatcagtcggaaatggactacatattaaacaagaagcaaatgattaataccgatgattggtggtttttgattagtattgccgactaatcattatcgtccctggatattttgatctgtccttgtaaaagtacacgattttcaggctgacaggagcacactgggaaattctgtagcttctgttgtgctgacacgtacacaggcaacatcccaacttgcaatttcaataggcagatattgttcggtggacttcgattttttcaaatgggttaaacattgagaactcccagttgcaccttggctggatatggaagcaggtaaaatcatgatctgacctcaagctcttttgctgccatgtctcttctgttctccaatcagtttgttcttgcataagcacatatgtcaattcgatgtgtagtgacttattacctagtccattctgttcttgtgatcacactgtgatcgaacacttgttttcaggaaaaactcaaaaagatatgctttgacaaaattatctccggtctagatcacttattctatcttgcaaccccccactttgtttttctttgttcacacattacgcaatcaacccgggg

SEQ ID NO: 58907 - DNA, 2730 bp, Oryza sativa
ctgaaaaagataaattcagaaacgaagtatgaactgctgcaaaatgaactgaatatattgctttctacagagtccacaaacgtattttcaggatttttctcggaggatatttcagtacctttctcatgatacgtcagaaatcagaatttctttctgctcatcatgatgtctgaagttattcatcagcataggattccacatggcccttggctgcattttcggcagcattgcaagtaatctaagccacttttggcacatggaaaatctatccccttgccttatcacatagaatcccctcttgagctgggaagaatttggcgaattagttcccgcacaagagtagatttccaaaggtctcaagagatagatgattcacctttgtgttaacaacacatttctcttgctggaaattaccataggccagatttctatttgcttgagaaatcaagtagtcggcaaacaaacttgcaagttgcatcttgtatagagctagataagaaccgcacacagaaacttggttagatcatgatcgaaagtacgtagaaaaatacgaatgagtgcaaaagtagtgatctatacgttttagatggtaatttaagaacaaaaggattagttaaacaaatgatgataaaggatggtagatcggcctgctatatcatgaaaaaggacaagttgagcaacattaccaagcatagagatattcagatatataatgaacttggttaacaaaggcagattagttgagcagctcgatcagctgacccaatcatgagaacagacaaaggaaacgcaacaatacgtggaagtgttagaaatatttgtcatgactcatgagtccgcctatgtgcaattataatcaagaatcgtttcaggctcagtttgaaatagattatatatttgaccggattgttgctgcggttatctacttgaatcataggaataaatagaatattttgataaataaacttaaaaaatcaagtggccttatagtaaaagaaagtttcttgagaaaatatatttttcaaagcattgagcaaataatccattttaacaacccggtaaataatatgaaaagaataagccttaggcatctttgacgcagcacccggcttatctattttttttagagaaattttacagttcttaatagatactaaaatttttaatggaaattttccgtacctccaagtactactaaattttacgctagaaaatatagatcccagtatttgctcaaggactgtaaaatcactcattatatatcttaaaattaatttaaaattgagaagtcagttttaggataatacagaggaatatacatcgaaatttgagcaaaaattactcgaacctagttatgtggcatcctacaagttggcaactactattacagttggatcttgtgcattgcacataaatctctcttgacaaagaaagaacttatgaatatgattggtatgcaattgcttgaagaattctggtgaacacacttataaagtattccttttctacttgatctagaagagaatatattggtgaggtcatggttcatgccggcaccggcaataatttgagctactagtccaagatccccacaagatagccctagcagttgcactccaggctccagcacacttatgtaaaccataatgtcggtcttatggattgcagagtttaacagttctatttgtaaaacatatcaggaaaaaaaaggaaattcaaggagaaaaaaaaagaacaagctttaactgtgtatgtttcaccagctttagggcttctctaaaatgaagaaattatttatttaaaaattgcaggattttgtttagtttctaagaaaaaaaactctgaaactgctctattccaaaagaggccttaatgtttctattagcgcgactaaaagaactgaaatttcattccaaaattttacaccttggtgtcatatatttgttccatccatgtggttttggatggatttgcatgcatgctgacgctacagagagggataaaaacgatataaagcaatatcatatctagtcagttaggaatttttcatattcataatttaactatttattagcgacatcagtactatgatactacagatattagaaaaaaaaatatcaattttatatggctagaataaaaaaaagataccactattgtagaaatgattctcagtaggttggaaatttccgtgacggttttcatttctctacagcacgatctaagagatgagaactattggagaaaaaaaaagtgatacggtggtttgggtcgcagtcgtgattcctgaagagagtacaaggtggaaaaagcatggccatgacagattgttctggcatggtgaattggtgtggtgataaggttgtgattcaaagggcacgtgaagattggaacccttgtcccctatagcttcctagtagtagcaggcacagagagaggatggtgagactggggtctgccacttgtaggaacagcaattttggcccaaacaaaaacttgtgccccagcatttgcaaacattggtgataactattacaaggtggcgatgattggatgttgacccagaaggaattgcacaaacatgaagatgtgttcatgacgcaaactctccttgttttccctcactaaggctgcgttcgtttgtgtgatatagggtgagaaagcacatcgttttctgtgcgcacgcttcccaaactactaaacggtgtgttttttgcaaaaatttcttat

SEQ ID NO: 58908 - DNA, 1849 bp, Oryza sativa
taggatggatgagtggtgttgatgtgaaaacacgaggcttgggagatctgttaactccagtgcaggtccaaaactcgccttcgggtatgctagcgtgccagttgatttgatcctgcaatcaacaagaaacaaagacaaagaaaccgtggttaaatccataaatgatagccgatcggctaggtgccgatgacatatcatttatctttgagctgatgtcatatatgcatcgatcgacagtcacaaatagaaaaaaaagaactaaatctactcgatcggctgtagataccaatgatatataatctttatgttgatatatacttaaatcaagtgattgggataaatcggtcgccatgccgagacagtataaatcacttagatcgaagtatatactaacaatgagactatatacgttcatagcatagccgatcagatagatctaacatgtatcggctaatactccgataccactctatattaagatatcaaagcaagtagaatataccaaacgaagagcccaatatacttaaatgcaacaagatattaacataaaaggcggatttaatatatcaataaagcatataaaacaaatatagttaaatcaggtaagatcggctgaaaccccgatactaccctaatcggcaaccaagaagcaggctagagattgagattctaatcacgactcataagatcaaactcaactgatgcagctataagtataaaaagaaggacaatatctagacaatcaagccatgggaagtttcatagagtggtagatatcatatataatttaagccaacgttgatatttaacttaatcggctgccttctattgatagatgttagcccattgtaggtagatagcaatattgccagagattatataagatatatgataactcgacgaattacataagcaagattagagtatcataaagatggaagaactaatcccgagaacgcaagccgtcataacaagttttacctcttgttgaagatcgaaaccgatgcagctcaacccgaaagtaagaactcgtcgaaataaaacgaaagcaaaaagggtggcgatgcgccgagattatattgaacgtgtgttagtttgattacatagggttcgggtctatttatacccgaaaattacaagatatgtccatatcggacacgactattatctctaacaaactctaagataccataagtctttgcggcagacttttgcccaaacatatctctaaggaaattacatgaaatatcctaattaatagatacaatcgccttctcaggactctatccatgcatggcaatcatcttgaagcacgtcaacctaacccgacaatgtatgtcgtgtcacattgtcggattcggctcaatcggctaaccctgtttgactcgatctctgtcgaccctagtcgcagccgattcggacttcagccgatccttactctgtttccgggacgatttccatctcaaattccatctcggtttcttcttcatctccgattcttgaattaccaaatttggtcgttaataagtggttacaatcaccctttcattagaggtggtgagtatacctcccttaaaattcaccaaaccaaaaaaatatcaatctactacaataaaaaaaatctgaatagaaataaaaagatagaaataaataaaaacggaagaaaaagaaaaaaaaagtcttcttcaccgaccgccgctgcgcctcctctccacccgccggcccgcctcttctcccgttggtcgccgccttgtctccaaattgtcgtctcagtcgtcgtcccagtcggtcgccgtcgtcatccagatctagtcgccgcctcgagcgctaaggctcaccgccccgcctt

SEQ ID NO: 58909 - DNA, 1246 bp, Oryza sativa
aatttgaaaatatacaactctaaatttatcatcacctcaattacattactggcatgtactccctgcatcccaaaatataacaacttatagctatcaggatttgtcccaaaatataacaacttttccaccagcattctcttcccaaccaattataactttccaccattcacttttcccctacctccactactcattcaattataaccttacactgttcatttttacttattttcttaacaactgtatccaactttaaaacttcttatattatagtacggatagagtatcatatttcatctttcactccagcggtaggttagaaactttttggccctaggtgtgttcttgttttttaaaaattttctctctctaattgcgctagcaattattcgctagcaaattattaattttttctttaatcatggtacactcataatgtccataagtaaattacacaatcttaccgtaataaaattacacaatcattagtactacgtgtattgccacaatcgtacaatgatttggatacggcagatccggcagcagaagagaacattactcattacccacccaaccacctgtgcatgtgtgcgtgcacactactcgctccgtttcaaaatatttgacaccgttgattttttaacacatgtttgatcgttcgtcttattaaaaaaatttgttaaatatgtaaaactacatgtgtacataaaagtatatttaataataaatcaaatgatatgaaaagaataaataattacttaaattttttgaataagacgaatgatcaaacacgtacttaaaaagtcaacggtgtcaaatattttgaaacgaagggagtactaatttactaggtgtttgtggttggcctgttgcacggtggattcttccccaatcgatcgatctcaaattaaaggccctttgcttcaaagtaaaatcattggaattttagaaaatttcattcttataggattttttttcctatatagcactttgaatcaaagaaatggatcttatggaatcctatgaaattcctatggattggctaatgccatgcaaattttagaggaattctaacataaggtaaaacctcttggaaactttcctttgagtctttttctctcctctaattcctgcgtttttcctgcggtccaatcaaacgaccattcctctgtttttcctgtgttttgcaatcctatgttttacacttccattcctaccaaaatcctgcgtttttcctatttctggg

SEQ ID NO: 58910 - DNA, 1692 bp, Oryza sativa
aatcccatgttgcattccagatatcaacctcatatatatccaagctgagtcaacctcttagccagactaacccttgcccctgattacgggagcttaagattctgagaatctactgtttggtagccagcttctgagaatttggagaagttggattttctagtttctgggttctagttcattttctggattctacgactacagattcttagaatctggatgacaatttgaattgtttaggagagatggagattttgtgagaagttgtagctactggaagctccccaaaacaaaccccttatatggatggctcgacatccaagatgttaggcaaccaaataatcccttagggaatgtaaggagttttttttagaaaaaaaaagataaatgaatgaagggaggaattaagcaagagagtatatatatatctagcgtgcataactgcactacgaatggttagatgatcgagcgacgcgtacaccgtatcgatcaatcagattctccgtgcccttcgcccatttttactagtagctgcatgcagtagtggtgtcgtcgttgttggcatgcatgcatgcatgagtgcgtttggaagatctcccaatatttgccgctagcatgcatgcactgagccctgattcgctttaatttgacaccaagagagagatggatggcattatattgcattggcaagagagaaggacgctccaactaagagcagctacaatagcaaggctataagctagctataaatatattttagatataatagaagaaagagaagagcagtgtgctatagatttgtagccagctgcagcacggactccaagacgtaatgtgtgtatgacaggtgggatcagatattaatagtatagcaagcaactattatatgaattggttatagataatttggagctagtagttggctatactattaaacttgctctaatggaggcaaatggggctgtggctaaatgcaccgtggcccccggtgtctcgctcacgagggaaaaacaagatgatgtggggcctaacacatattgcacggatgacattgcaaccagtaggggatttgaggctgctttgggcactagcttagcccttttggccttgctcccctaacttttcgcaatagtgtgtttgtgtgttgatgtggccaatctatctcgagagagccgctgagccatggagatggtgcatgatgagatatgtattgtcacagtactgtgtactttgtaccatgaaatggggggcttctttcaatggccagaatgggcgtaattatatgatcaccatcagatgcctcatggccagcttccaaccaacccggtctaaccaaactatactattagtcccatcatctcacctaaatagctgagtataagtcataacgattattgattaatgataaaagaataatttatatgtatgtgtattctagtgatttataagctaaagctataaaataaattacaatgaacgaaaaacatcaaaatcatctccaaaattaattcttaaaatttaaattttggttgcgtttgataaacagaaaagcaaacaataaagctgatgtgtgaaagcgccaaaatatgatggtagagtcatgggcatgtatgtgacttcatcgctttgtttaaattctgatacacatgatcatgaatataaccagtgggcttttaacacaggatcttaattagt

SEQ ID NO: 58911 - DNA, 22868 bp, Oryza sativa
  unsure (1)..(22868): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagtacagcgcgttcctttatccggtctgtgaccagtcacagaccggtcagatcacgggttaggtggcgacaggcggtcagacgcatgcttcgccccatcctgtctagacgagagcttctaggcactcgtccccggctggagctagcgtgttatatcccagagatgacacgttagccccggtcgatttataccaggcttcatcctaaccattacaggcaagatgttgtgtgaagaagggcaaacatgcaagttgctaggctgacgcgtggtgggcaagaatgaccgatttgtgaccggtctgacattggtcatgtcatcggcagacagccacgttcccacgacgcgcctgcctccggcagaaatggaggtaggtgtgtgctgtcccgtcgggaagatgttcggaggacgaccgtgcaaatctcggtccattgatgaagagaaaaaaagtccagtttggaaagagaggggcgcatgtggtatccccttgaagtataaaaggaggaccttgcccatagagcagggggttggttgattgattctttccagattcagagcctagaacaagggataggccggctcacactttgtagctcctccatacacaaatccacaaaaacacaggagtagggtattacgcttcgcagcggcccgaacctgtatagatcgccgtgtctcgtgtgtcttgcgggcgggtaatctttccacactcggagagagagagagagcttgggattgcaccctaagcccctggtcgaaccggcaaaggggggcttgcgcagtctcccggtgaggggccacgagctccgtcaggagtaattatcatcaagaaatatatatctataacatgccacataaatgacaatcgaactagtactaaaaacatacaaagaagtaggcacaatacgtgctggaacagttaaaacgatacttatagactttttcccacccctatggagtggaaaaatataaaaccaacaacttttgctgattataaaaaaaagagtaaattgcgttgacggtacaggaacttggcaggtgggtgcgattaggtgtaaaaacttgaaaaccgagcgtagcggtacaataacttggctaggtgggtgcgctcatggtgcaaaagttgccacgccattgttccacctaagcgaaagtgccacattagcattgaccatctcattttacagaaaagtccatagtaacttttatattacgatcccattgttcggtagaaagattggaaagataggccctgccgccgcccgccgcggcgtcgacggagcaaggtcatcgagcaggcgacctcgacgtcctacaggttcggcaacactggcggcgccatgaccagtgccgcgtcctgtgctggctccttccttccacattcgctgggcgcagatcgagtctccgacaacatcaaatctctgttcccctcctcgtccacagccagcggcgccgcctccgccagacacgacgagtacaggggatccccgccgcgccgctggacacgacgagtacaggggatccccgccggacctcctgtcgcaacgacaagcaaccagcagacgcagtcacagtcacgcaggagctatgcctcaatctggtgagcaattttgggactgacgaagtgacatttctctgtgttggctgcctatacaggggtttggatgttctgcaatatatgtacctagaagtatatatgcaagtgatgtatagttcctgtaggttcttttgtaagtactttgggagtgatttcattatgtacggaattatgatgaaagtgatataaagttcctctgtgcttttattaagtactctgtaagtgatttccaaatgcatcaaaagctgcctcacataatttgtttccaaattggtacgaaaaattcagaattgtatgcttctgtctgaatgagacatttggtacactttatgcccaacagcccaagcgataatctgtcataattttgccagcttgttttgaccaccacttgcaatgtagggaatttctatacacatatataatgtgggacattttcttgtccataaataaatcaaggtagaaattttcatactgaaattcaggaagaaatcaacatgcccataacaaaataaaaggtgcaaaataaacactgttcaagaacagggaaatcagactaatgtagcttatgaaacatgtctatctggttggtatgaaactaaataaaactctctgactgaaacatatgctaatgttttccacataaaattgattactagctgttttcattttttctttgtctccttccttttcttcggttctgcttcattatttggtatcgatttcttattaggtggtgcatttttcttccttggctctgccatcctcttcctaattgttgccctgccctctttggttgcggtcgtcattggtggctccactccagcccttctgtttgtggcaataaaatttgattccggcaatggaccaggggcaactctagacgagctgttgattgtgttctgcacaaagtacttgaaattgtggaaaaatgtttcacaaagttacaaaatggagaattgagaaagcattgcctaacctctctaatcaaggaagacaatatggtattgtctaactggttgtagtttggctgactagttagaatactagtctgactattcagaatatcaggcatgacctgcaaaggcataacatcttcttgaacaggctgtagagaaggagcactggcctgctgctttccactttttatatcttccttcctcttcttgcatcccttcttattgtgattaactccttggcaatagctacagtgtagttgcacaccatgtttgaatatttttgttcctccttcaagctcttgaggctgctttcttctacatctactaggccttccgactttcttttcataaaccggtgggttgaccttcactccattcatcttcgcccaagcagttttgtctctaacaggcattatattaaatccatatgcttccataaatttctctgttgagtaacaaaaggacaccacgtctttaggcttgatcctctcactcctcaagcaagaaattgcatggttgcatggtatccctgttagttgccatctcctacattcacaatgttttgctatgatgtcaacaatatattggtgttctttctcagtaacttggaacacccctttaccagcaggcaagacatagcatgtatttgctatttctgcatttttctcaacctttttctttatttttgggcatatatttcccgaccacttctttacgcactcctcctgcttattatgtatcctattcatgatctggctcctaatcttctcaagcatggacaacattggaagctctctaggttcaagaatatacttgttgaatacctcagaattgttgttcagcaaaatatcacacttgggaaaatcactaaagaattctctgcaccactgatttggtggtatttcctccaagtatccataagcatcagtactaagatacttcatcttttccatgttggattcccattccggtattgaactggaccttgcaattgcccacaattggttctttagagtctcccctttatgcaaaacatggaagttttggtatagatgcctaacacaaaatctttgttctgaatctggaaatttatccctcacagctggcaccaatccctacaatttaattaaaaataaggtgaattctagtccatcatcaagtttaaaaataaaataaaatatgatgaaatagagatgtaaggaataccttttgtctatctgtcataatagtatacggtgccgtgttgtcaataaggagatcttctttcaaagtattcaagaaccaaccccaactagctctactctccacttccacaattgccatggctataggatagatgtagtcattggggtcaatgcctactgcagtcaataaatgtcccccaaatttggttttgatgtggcatccattaagaaaaatgataggtctacaaccacttaagaagcctcttttgcaagcatcaaatgacaaatagcatgtatggaagcacatattctgtaaattcaagaaaaatttgctacctggattagatgtcctaagctcttgtccataatcccataacatatcatactgagctatttcatcaccgtgtatagcctccaaagctaaccttctcgctcgtcctagtttgtatcttgatggtgttacatttaggtctttttgaactactttacaaaactcttgagtgtcatcttatcattatctctaaagctttcaatgtacctatttgcaagatatctagcagtacataattcaactcccactctttttgacatttgtgaccatccacatattgttttatcataaaacattttgtcctgctgtcctcagaggcatttaacatccatgggcattcttcagaacatttggcctctattcgtttcttggtgtttcttgcaaatctgattgcaactctatttttcacactatattgttttattgcctgcctaacttcaatagcatcattaaacaacatcccaaccttaaagataggtgactccatgtccacatcagccacaaagttcttaaatttcaacttgatgcccccataatcttcatcagatgactctggtagcagcaaaccttcatcatctggatcacatgcaggaagctcaactactagcttgctagcctcagcattttcagtttggtcaacacaattgtcaaaaacatcatcatcccccttgtcagcctcataatcactatcaataaagtctggatctaattcactgtcatcctcatcatcaattttatcaccttttgcaacttgatcatcacaaaccttctgactcattgcgactctcctgggactagccacaataggtaaagtagttggggctgaaagagctacatcatcccaattaatcgattccacaatatcctgatgatccgtgtacaaaagcaatgatctgaaccttggtactaatgcaaccatgctgttagtgcttgcatccgaatttattctccttagcccatcactaaatgttttcccaggcaataaccaataaaccttaaccttcctcttagaattatcatatcctagttgctcaataaaatcatcaagccataaggaagaccatgtgtcagtgtcgcaatgatcaaaccagtccaccttctcatccaaataaattctgctactgccaactccacaaaaaaacccaccatgatgcagttcaattgtgaattcttcctcctcatggcctgcaatatgaaataattggtgatgtgttatacccgcataaggaaaataatacactaagattatttgcagattattgaactaattatatgctgctgataggggtacaaaatacatatagcaagaatttatcattgccaatgttactcttatatcgtatacagctacaggaaacaccaataattacagtacaaccaatctcgtggctagtaccattatatcacttcattgcattgtaataacaaataacaggatattcaagtgaaagaccaaaataatgcagccatcgtacagatcaatgagaccttaactttgcaatcatccatcaattgaacaaaaaatagaaatctactaccatcagcaagtgatttaccataacaaggagcagaagctccaagaactcaccgagtcggagccatcccaaagcttgcagcaatcacgtcgacagcagcagtttgtggacttgaattggcttggttatggtttagggcttgaattagtgtggcacacggagccctcgtcgccgccgcgatgtagttgcacggtttccctcgtcgtcgtcgtcgccgtcgccaagtcgccgccgccgccaccgccgccgttgcgtctccaccagtgcaaccacctctcgatcaggatcacgtaagaaagatgaagggagatatttgtacgttaagaaatcatattagggggttttctataaaatgagataggtctttcgcgtcaatgctaatgtgccactttcgctgaggtggaacaatggcgtggcaacttttgcaccatgggcgcacccacctagccaagttattgtaccgctacgctcggttttcaactttttgcacctaatcgcaccctcctgccaagttattgtaccgtcaacgcaatttactctaaaaaaaaaactgataccaataatataaatttcattttttaacaaaatgatacccaagtaggggttaaaagtgcgggtactttaatacaaccgaaccgagacgagcggaggggagtgaggaatctttttcggcttattttgctatatttatgtcgccagattttttttaatggatctcagtcgatttgtgggcaatatgattagcgctacttgcaccattgctctttgctggccttgtcggtggctgcacctctccgtcccatccccttcccaccggtgctcgggatggccggatccaacactgcccctccccaccggcagtcgggaggggctggatcctgtactgccccacctcacagtggcatggcgggaggcctcccatggcgagggagtggtgggtggcctcctcacggtgtgggcttggcgggaggcctccatggagagggagtgatagatggcttccaacggtgagggcgtggcaggaggactccacgaaggcgcagagggccacctccccatgtggcacaacgggcggcttccccatggctggcgcggtgggtggcctctcttcttcacgaccgacggctttaacggcagtgcagtgggcagccttcctccggcggcgcgacgggcggcctcaccatggaggggcgcagtgggtggcgggcggccaaatccggctagggtgctccacaaaaattgcgtggtgggcgacctctcctccgcggtgagcggccttgattggtgacgcaatgggtagccttgatggtggcgcaatgggcggcctcaccatggcggggcgcggggggtagagggcggctagatccggctaggttgctcgacgatggttggcgcactcgcgggaggattcaccacggcaagcaacgatgtatttctcttccttgttgattcttgattttctaattttggcctctctgcgttgttgttggatggatggtgagattgtgagaaatgtattcttggattcttggtacatggatgttaatgaatgtgttcttggatttggatgatggtgagctgctcgattcatcggctcgaatcaagccaattcatcgagctggattttcgctggcggggttatgaggggtgaggggttacggactgccagcgaaaatcgattttcactggcggccacgctaagaggcccgccataaaaaatagctctattttcgctggcggcggctccaagaggccctccataaaaaaacgggttttcgttggtgtctgattttcactggcggcaggaaacagcaccgaaataaaatttgacgctataaaagcaccacccccacaccagcgaaaaccctgttctctccgcctcgtccttatcctatctcctcctagggcagctgcatgggtttgatttttgctggcggttgatttaacacagccgccagcgaaaatgaattattgcaagcggtcggtgtaaggcaaccgccagcaaaatggatttttgctggcggctggcttaagatgatcggcagcgaaaatgaattatccctggcggtcgataccgccagatcttcgctggcctttgctttgtggcggctacaaattccgctagcgaaaacctaaaatgtccgccacaaagatggttttcgtagtagtggtacttgttgtggggttctcaaccggcaacaatatgtgttatcggtgtcggttctacaactggcaccgatgaccgaggtcattagtgacgcctgcggagatgctggttgggaaatctgacatctatggcgggttctcaaccggcacaaatccgattttctgtagtcgtgcaagtaattggtttcgttgatcatcaacttgtacttactatgttggatacgtaccgcaccattttttctttttgcagcagataaaaaagtattaaacaaacacgtaaataaactttcaaatagaaaccaatacaaatatctgcgattttaatttccagccttccaaacgggttgtaccaagatttaaatcgtggacattttaaattaggataattaaaggtaattcaagctgtgaatacagggaacactagaacaggttcggtcatctgtaaggggtctaaagcctaattgttggcggctgttaaatgctaattctataccgccaacatctgcataaagtttagataataaaacatccaacatggtgataagtgcttaatctcacatattccacaagtgttggtgtatatttgtatgcaggtgataaaccccgaggttgggaagaaatctagactaaagtgaggagaattatgtatccatacaaggatgggttgtgaacttcatcaaaatatcagaaaatctgcccaaaattccgggaaatggatagaggagagtccagggagtccacaggccgaaggccaggccgggagggcccagcccaggttcggccgaacccccctgatcaccgttgatcctggggtttggcgtggacgctccagatgatgtcctgatggtggttgcggggcagttcggacatttccccttctcacaacctttataactgccctataaaaggagtttcactccttcactctcacacacacttccaatcttgagctgaattataagaggctctattgaactatattgtataatagaatagtaagtgagtagagtagaagaagtcagaagaattccagagttgtcggtaatcttctctcatttcttttattctgtttattactctgaattcaatataatattcttcctgagtaatttagatttatcttgtggagaattatctcttggttagttcctaaatagcatacgggattattgttcactataatcaacaaaaatatagtgattgctttgatgagttataaacactaaagtagatattaattgcttagacgtggtgtttaggtaattgttatctagtaattgctgcgtatcccacagtacgtttgaggtaggtgtagaggtggtgacagccctcgagatcacttaagtcctccttgtccgggtacgtagtagagcgacatctgggaacagcgggttgccagtgcccgaagtattgcgttaggattaaagttaagcttcccttagacactgtttctcactaataaatcctctctatcctggcctatcatgtgcttggtgtccttggatgaaccggaggaagatctgaccacacacgtttccttggattcgattgcctttggaatactccgtaggggaagcgctacagtggtatattcgtgcgcttgcggattctatctgtgatcgtaagaaataccaacactcatctctatcgggtagtgcccccgtcactaagcaaaggtcactaatgtgagaaaatatctcaatcgggcatccggccatcacggatgacacacatctcaatcgggcctaaattatagtccgtcaatataatccaaaaaaaaaaaaggattcgatagcctttggaatactccgtaggggaagtgctacagcggtatatccgcgcgcttgcggattctatctgtgatcgtaagaaataccaacacttatctctatcaggtagcacccccgtcactaagcaaaggtcactaatgtgagaaaatatctcaatcgggcatccggccatcacgaatgacacacatctcaattgggcctaaattatagtccgtcaatataatccaaaaaaataaattttattttttggctagtctcagacctttgctagccacgcccgtggtcacccatcccgaaattgctccatccttagcacgcttaaccttagagttttttgggatcgacttccggagaagaagttgtacattcattcacatacacaaccatcaatatatttcacacaaccacattcacataatatccattttgatcatatatttcatacccattcacatatttcacatatttagctagcaaaatcgagttaattggatcaaatatatatttagcaagtattaaaatgatgaggaggcaaatcagacttctaggcaaaaaaatttcaaattgaattttatgatactaaatgaggtcatatgaaaaaactatcaaaaacaaagttgaagaactcattgagatctaccgattttatttctgtcatttctccatccgggtttgattgaactatataaaatttgaattttaaaatataggaaattcaaataattttttggatagtagatgatttcaaatggaaaaattgtcaacgacaaagttgtataacttatcaagatctataacttttattttggtcatttttctatataacatttttttgaacagtttgaatttgaatttgaaaatatgacaactccaaataatattttcaaatactaaatgacttcaaatggaaaagttatcaataacaaagttgtataaattatcaagatttacaatttttattttggtcatttctctatataacatttattgaataatttgaatttgaatttgaaaatatgacaacttcaaagaacaatttcaaatactaaatgatttcaactgaaaaagtcatcaacaacaaagttgtataactcatcaagatttataacttttattttggtcattttttcatccgacaaagtgatagtaacattgtttataaaattcacatatctctcatctggttttataaactataacacagatatatcaattttgtgaacaatatttctaacactttgcgggatgaagaaatgaccaaaataaaagttatagatcttgatgattgttgatgacttttttagttgaaatcatttagtatttgaaaatgttgtttgaagttgtcatattttcaaattcacattcaaactgtcaaaaaaaagttatatagaaaaatgatcaaaataaaaattgtaaatattgaaaggttatacaactttgttgttgacaatttttccatttgaaatcatttactacccgaaaaattattttgactaataaaatgaattattatactacagttaattattttgcttcatgtcaactcacaaatataaacatttcatatgaaaaatggaaaaatactaagtcattgtcagggttacggattagggataccccttacccttcgatatatgttacatatcgatatggcatacccgtgcatacatggacattctctgtacgagttaaggaaatccttcgcggaattggcagatgtaaagagatctactcggacaagactaggttgtcagcgtaccgtgtgcggtttgatgtctccgagtcctgcttggagactacttgacctgcggtataaaaaggaccccctgggaggacctgcggggtcgaatctcatagccaacaccaccaccacagcctacgaagtcggagcccgcggaagccagatcgccgagaggtctagtcgaattgactcgattacgatctcgtcggttttatcgagttccattgttccctttgtaacctgtgatttccatcatacaatcccataccactggattagggctattacctatcaaggggcctgaacctgtataatcttcgtcttctgtttgcttgatgtcgtactacgtagacccttgtaccaacgtaccccaatactctctatatccggtctacgggtatcatccgtcgacagtggcgtgctaggtagggggacttggtgctcaaggatctactactatttcatccagcctcgtcgacaacagcgtcaacgccaacctcaactacgagcttcctgcctcgacgacgcttacgtgcactcaagtcggcgaaattgtctttccggtttacaccatgatgccgatctcagctgggccgtcgaggaccagaaacgagaacgcagtggctgtagcccaagatgactccacgtcgaaggatcctcccgccgaagcggagaacggaacatcgacgacatccgagctcgagaagaattctaatgcggccaaaccttgtcgttccgacaagaaacacaggccgacgagaataacttccgaggtgacagggtcctggtgccctatccacaaaaccaggaaacacactttgcaagcctgcttggtcttcctcaacgcccgcaccgagatccgcgcctgcaaagagcgtggaattcagcgtgtttctccaactcgtggtgtctattgtcctattcacaagacaaagaatcacgacctttcaagctgtaaagatttcctcatcgtcaccaagatgtcatctcccaaggtccagcagccaggcaagacccttagagatgaagacaaagaacgaggaacgacgttgaccccagattgtatcgtcggtgttatcgacatcggttcttccgaaccatcggtcctacatctactcgaagactacgactcctcgtcaacaagtacgccgcgtgaggtcttggctctcgacggcacaggcacatcggcacgcgctaacaccggggcggaaaatcaaacatctacaccggctcagcacatcaggaccctcaacgcgatactgagggaaaccccttatgaccccgtcctacacgatgacctcgcacaatggacggaacggttacgggagtcagtgaccaccctcagtaacgcgtttgaggaggccgccactgcaacccacccggaacagcaaccaactgctgatgtcaacggcgaaaaccccgaacagcgggaatcaccccatcgggccgccctccacctcacggcaccagcgatctccgcgaccacctaaacggccgccgagaagctcgtcgcacacgggaaaacgagaaccgttcccggcatcacgtctcttcacgacaacacaacaatgaagaacgaggaggccactcgagccaagactgagaccgtggtcaccgccacaatcgtcactttcgcgacgatcgtgagcgacggacgccggatgatatcagtcgaggacgccgccatcatgacgaggacgacagagaacggcgccgggacaacaacggagggcgacgacaagactctcgagaacccggccggcgttctcgtaatcctacaccggaaccaagcgacccgtcgtcgtcctcatcctcttcctcctcctcatcgttagacagacatccacaaaggacatacgatcactgacaacccactgcccccagtgctgggtgtagggctttcagtcgttcgttgcgcgatgtccgatggcctgagaggttccgaccgggagcaatagaaaagtacgatgggagcactgaccaagaagaatttcttcaagtatactccacagtactctgtgctgccagagcggacgacaacgtgttggcgaattgcttgccaactgcgttaaaaggctctgcgcgttcatggttgatgcaccttccgccctactcgatttcttcgtgggcagacctatggcagcagttcgtcgccaatttccagggaacctacaagcgccacgcgatcgaagacgacttacacacattgacacagaactcgggtgaatccttgagggaatatgttcggcgctttaatgagtgcagaaatacaatcctcgaaatcatcgatgcttctgtaattcgcgccttcaagtctggtgtcagagatcgctacactacccaggagttggcaacgagacgcatcacaactactcggagactattcgagattgttgagcgatgcgcccacgttgacgatgcacttagacgcaagaacgacaagccgaagaccgggggcgagaagaaaccaaccacggacacacctgagtcaagcagaaagaaatatcgcaagaacgcgaaaaggaaagctcaagcagaagtactcgcagcagaatatgctaaccctctcaagcgcccagaccgacaaggtagtgacgcaaggaaagcatggtgtcccatacacaggtcgaacatacgttctttggaagactgccttgttttcaaaaaatcgctcgagaagcacatgacatcggaacaaggcaaacgagtacgcgtggtcgagaaggatgcggagatgactgctcaggagtcggacccagcgtatccagattctgacctccacgtctcacacatcttcggaggctctacagcgtactcctccaagcgagagtataagaaagtggagcgagaagtctgctcgacgtggcagggggctgcacccaagatgaagtggtctgaacagaagatacaattttcggaagatgaccatcccaagaccgccgttatcccaggacgctacccgatcgtggtcgaacccactattcggaacatcaaggtcgcgcgggttcttattgacggtggcagctcaatcaacctcctcttcgccagcacattggacgccatgggaataccacgaagcgagttgacacccaccgatcaacccttccatggaatcactccccggtcttcgtccaaaccaatgggcaaaatcacgctgcctgtgactttcggccaagcaaacaacttccgaacagagaatatcacctttgatgtcgctgaattcgatacttgcgaagttcatggccacatctcactacgcgtatcaagtgctcaagatgccagggccgaagggaacaatcaccatccaagggaacgcgaagctggcggtacaatgtgacaagcggagcctcgacatggtcgagcaaacgccaagtccacctgccactaccgagccacccaagaaaatgagcaagacaaacaagacgccgaaaccggacggcgcaatcaagatcgttcctctctctagtgccaaccccgacaaaaccgtcaagatcggggcatcgctagacgagaaataggaactcgcgctcatcaccttcctccgcgacaatgctgacgtgttcgcttggcagccgtccgacatgccgggagtccccagggaggtgatcgagcacaaactcatggtgcaacccgatgccaagccagttaagcaaagactgcggagatttgcaccagaccgaagacaagccatacgagaagagctcgacaaacttctcaaagctggctttatcagagaagtacttcatccagagtggctagccaacccagtcatggtgtggaaggccaacgggaaaatggagaatgtgtgtcgacttcaccgacctcaacaaggcgtgccccaaggatcatttccctcttcctcgaatggacctactggtgtgagctgttgagcttcctcgacgcttactccggctaccaccaaatcagcatggcgagagaggacgaagagaagacagcattcatcaggccgtttggggtattttgctacgttaagatgccattcggaatcataaccgccgggaacactttccagcgcacggtctagggcgcacttagcgatcagctcggcaacaacgttgaggcatacgtcgacgacatcgttgtcaagaccaagaaaagcgactcattgtttgacgacttacgggaaatgttcgacaacctccgacggtatcggctcatgctcaatccagagaagtgcaccttcggagtaccatcgggcaagctgctcggcttcctcgtttctggcagaggaatagaagcgaatcccgagaagatcaaggcaatcgagaacatgaagtcgcccacaagactcaaggaagtacagaagctaaccggatgcatggctgcactaagcagattcgtcgctaggatgggagaacgaggacaacccttcttcgctctgctgaagaagcaagacaaatttgtatggacacaggaagccgaagaggcatttattgcactcaagcgctacctatcaaatccccatgtactcgttgctccccaacctaatgaagaattattcctttatattgccgccacgccatactccgtccgcactgtaattgtcgtagagagagagaaagttcaacgaccagtatactatgtcagcgaagctctccacaacgcaaaaaccagatatccacagatccaaaaactgctctacgcagtaatcatgacgtcaagaaagctacgacactatttccaagcccacagagtcacagttgtctcctccttccctctcggtgaagttgtgagaaacaaagacgttgtcgggcgcattgcgaaatgggtagtcgagctaagccagtttgacgtccactttgtaccacgaacagccatcaagtcccaagtactcgccgattttgtagctgactggaccatgcccgataatcaatcagataacaagatcgacgacgaaacatggacaatggcgttcgacggtgcactcaacagccaaggagcaggggcaggattcatcttgacatgtccctccggagatcatttcaagcacgcaatccacctcaacttcagggcgaccaataacacagccgagtacgaaggactactcgccgggataagagcagcagctgcacttggggccaaacgactgatcgtgaaaggggactccgagctagtcgcgaaccaggtacacaaagattataaatgctctaaccccaagttatctaagtacctcgcagaagtcaggaaactggagaaaaggttcgatgggatcaaggtccgacacgtataccgcaaggacaacgtcgagccagatgacctagcgtgacaggcgtccaggtgagaaccactcgaacccggaacttttctagacatcctaacgaagccatcggtgaaagaggcaatcggcgagatcaacacagccgcccccgacatcagctcggaggccacagagcggaacgcgccatcgccgatatcgaggtcacagacgactagcgcaccccactgatcaaattcatcagcagcgaagagttgcccgaggacgacgcagaggctgagaaaataacccgtaaaacgaaaatctactgcacaatcggcaacgatctatacaagaaagcgccaaacagagtacttctcaaatgtgcctcgtccgacgacggcaaacatctcctcctcgacatacatgaaggcatctgtgggtcacatgccgccggtcgcacattggtcgggaaagcctttcgacaagggttcttctggccaaccgccctcaaagatgcatgcgacatagtccagcggtgtgaagcctgtcaattccacagcaagcacacaaagctacctgcacaagcgctccagaccatccctcttacttggccgttctcgtgctgggggctagatatactcgggccattcccacgaggatagggcggctacaagttcctatttgtggcgatcgacaaattcactaaatggatcgaagcgatacccacgggggaaatcaaggccgccaacgccatcaagttcatcaaggggatattctgcagatacggactaccgcatcgcatcattaccgacaacggctcccagttcatcagcgccgacttccaggattactgcatcgggctgggagtcaaaatatacttcgcttcggtttcccatcctcaaagcaacgaacaaatcgagagggcaaacagcatagtactacaagggatcaagacctatgtctacgacaggctcatgtcacatgacaacaaatgggtcaaagaactcccatcagtactatgggccatacgcaccacaccgacaacatccaacaaggaaacacccttcttcctcgtatacggctccgaggccatgctccccagtgagctacgacatcagagtacacgagcacagaagtattccgacgaggaacaggaagagcagcgaaacgacgatgtgaatctactcgaggaacatcgcgaacgagttgccgtccgagcagccacctaccaacaagcccttcgccgctaccacgagaagcgcatccgagacgcatactttcgatcggcgactacgtcctccgaagggttcaaagccaagcagggcgaaacaagctctcacccaaatgggaaggaccatacacgatcacacaagtcttgcgaccaggcgcattcaaaattgcagacggcaatggccgcgagttggcaaactcatggaacattgaccaactacgtaaattctatgtatgagtcaataccctccatacctgtaagacaacttacatcatcaataaagcctatttttcaggcgcatattgcaatcacagtgtcctgcccgacaatccctcacccagatgacacctagcgttgacacctgtcctcatgtccctttacgccatgctgacaaggccttcgaggaacctaagggatcttcggctggggacgcccagagccgataaggccttgtcagattctgtagagacgaaagaccatgccagccgtggtcgtgtaagagttctccccgtgcgtattaaccaagccgcgtaatccgaaatgaattttccaacttcgcggctgggggctaggatcagcgtttgttcaaccgaggaaggtcaaaggtccaagagccttgtcctctgagaatcattctccgacgacaaggctgggggttagggagagtgtacaactcaaacgactggccaaagtcggaaactgaggaggcactcttacacactacatccagagtaagaaggactcattaagatagatttcttttctatttcataagatatttcttacaattttacacaagtccaaaagcatattacacttttccctaagatgtctatcgcaggctaccaggaaggccaacgccagtccatcgactggaagactttctccgctagcggcgccatcgacttcgccaggtgatctatctctgccggagtcctccgagaacgagcgaacccatcacagagaaactcgaggtgcagctgcggacgatgctctcggatgcaagccaacacatgccctccggcgtaccggctcgaccgacggcattcctgcttcagggcttcgtcaatgcgcttgccgacgccctcgagctgagtacatgccccattcagccacgagatgtagccggccgccgattcctcgggatctccacggggcacccggagctccctgcaaacatgggccatggacgtgcagcaactcttcagataagagtcgaaccacacctcgcgacccttgagcgcctccacggcctggtcttttttcacctccaccatcgccctctcgagttccgcgacttcacacttcgtcttccagtattggatgcgacgatcttggtcagcaagtctactctcgagatctgctcttccattccgagaacacgaaaatcaagtcactccgggaggaaggatgaaggagatgaaaacaaagatcaccaacctaagggagccatcgccacacccgtctccacgggtgagtttcgttccatgtcgtcctgcgagacacgcgtttggagggcaatcgccggggcgatcaccggtgagtcgggctgctcacgctgtgggacatcctcgacatcaacatccctacaaacgacaaccaaaagtactcaggacaagagtgctaacagagatcaaggcagcgattacacgaataaaggcggtcgaaaccgacgaatgttatacaaagtatggtctattacaacagagctgaggccctactcttcaaaaaacgggagaacagactctcccagttcgccaacctcctccatcacgcccttacgagcgtcgttggcggccccccgatccaagacctgccgaagatcgtgttcggggtgtgccagccggacacacgctaggacgtgacaggccccggtgtaaatccagttcgacgtctcctccacgatcctggccgcatgcttggagggtatcgcctccatcgccgtagccagttccgcaagcgaggacgtcagcgagaactcgtcggggttcgctgggatggttgtcgtgacaccacactccccggcgagctgatgaagaccggtgtaggtgacccgcagcgacccacggatctccgacaggttgttctcgagttccgacattcggtcctcgagcccccgccgttgccgctcgttaccggccaccagctccctcatcttctggagatcctcgcgaacctccgccaggtcgcgctccagcttgtcggcacgcgtgttcgccgacgacgctgccgctgtcttcgcctcctcgatctcgcgacttatgccgcgagccccagcctcgaggatgcattgcatctcagcctggagctccctccaggtgaggacgttggcaggcggcctgcgactaggcccgagggcactggacggaccgcttggcgtcgcttcacggctccttggcgcgacaacgacgtcggttgaggttgctgcaggagacgctccggaggccccttcggacttgtccggcgtcgccctcgcctgcgccgacctgcagaggatcctcatgtccggcccttaaatcgcgtcaccggaagaaaaacgaggagaggacttctacttccgtttacttacttctcgccgagcgtcaccagcttcctccgccgcgggggtggcgaagacgcgtccacggcctgggtaaatcaagcgcgagttgaggttgacacctttcgaatacgaagttaacgaaccaagggactcaccgatggggaggatgctctccggcgactgccgagcacggaggtaaaagtccttcccgttttcgggacgcggctgccactggtcgtggcagcagcggcgacggctgcgtcgggcaccccccgagcggcgctcaccttcaatgaggccgccgcctggtggtccgcgagcggtccgatgacgtcagccagagggagagcctgtatcacatgaagtcattttccgacccaggagacaaagacaaagattgtggtttcgcgctcggtcgcctccttatcgcaaagagggacggggacgtcgctggccgttgtcaggccgctgatcattaactgaccgacgcggcgctccacggtggcgtcactcaagcctgcagatcgagaacagaactcgataaatcaagaagaacatgaacggaaggggatcaatttaaccaaacaagaaaaataccccgaggagaaaaccgggtcacgtcctctggtccagagtagtcaaaggctggatgggcacgagcctggagccgctggatccgcctactaatgaagtcggcagcaacttcgtaccctgacaaacctcgcgctcggaggtcatcgatggcatcgataaacaattgaagagcaggggtcaaggtgggttttgcggtccaagatgggattttgtctggctgttcctcgggaacgacaaagatcagatctgaatcctctatctgaaggtagaaccacctcgcccgccacttactacgagaagaagggctctagaaagggatgtatcgcgacttcaggccatctcgaagtcggaaacccacacatccagataccctggtggattccatccaacacaactcgtagtaaaagcggaagaggtcgagaaatggctctaccccaatgtaggcctcacaaagatgggaaaagatgctgagaaaggcaatggaattggggttcaaatggagcaaagaacggccgtagaaattcaagatcaagagaagaaattcagaaggcgggggaagaaagccacagagaatataatcctcgatcgcaaccatacggcccaggacaagttcgggttcagtacctcctggttccctctccatggttccacggccgggaagggcgccatcctcctgtagcttcttcaacgatgcgctggtggaggtggacttgccgagatccattgccgccggaaatcgccggagaaggggccgagatgaacaagctctggttttgcaggagcggaggagacgaggaatgcctggaggctggagagctttcttccacaatgggcggacttcaaagtggatcctcaaaatcctcttaaatagatgcgcttccgacggtgcgaatttcaaggaaaggagagagattaccgccggaaatttctaggtccgttacgcgcggcagtttttcagacttcagtttaaattcactcatgaccgttgggtttcacatggtattgtcgattgcgtcctgtctccacggttcatacaccgagaacgacaacagcttcgacatcagaagtcgtgatcggtcacatgagttcatttaagcagaagtagggggctactgtcagggttacggattagggataccccttacccttcgatatatgttacatatcgatatggcatacccgtgcatacatggacattctctgtacgagttaaggaaatccttcgcggaattggcagatgtaaagagatctactcggacaagactaggttgtcagcgtaccgtgtgcggtttgatgtctccgagtcctgcttggagactacttgacttgcggtataaaaaggaccccctgggaggacctgcggggtcgaatctcatagccaacactaccaccacagcctacgaagtcggagcccgcggaagccagatcgccgagaggtctagtcgaattgactcgattacgatctcgtcggtttcatcgagttccattgttccctttggaacctgtgatttccatcatataatcccataccactggattagggctattacctatcaagtggcctgaaccagtataatcttcgtcttctgtttgcttgatgtcgtactacgtagacccttgtaccaacgtaccccaatactctctatatccggtctacgggtatcacccgtcgacagtcatctcaatcaggcattagtatagagcccgtcatggatgagtcatctatgacgggcctaattgttgagatatggtcgcacagacatgttagatgtgcataaaactcaggcccgtcacggatgacatatatcagtgatgggtcgtagtttaggcccgattgagataacattccatatctcaatcgggccgcaagttggcccccgtcatggat

SEQ ID NO: 58912 - DNA, 2352 bp, Oryza sativa
tcgggcataaactacggctcatcacttatatgtgtcatccgtgacgggtctgagttatctcaatcgggtgcttttttggccgattgagatgacttccttgtgacggccgctaattccaagtatgttagaggccgtcacagatgtaaggttctgtactagtggaaactacaatctttgcattttattttcccctccggtttctatgtagttatattaaacctcatctagaaaaaagatcagatactaggagatttttgcatggtgacgaactccagctgttcggtgtcggtgattttgacagatttcatttaatttaaataatgtcaaacccttccctgttcaagcaaatatcctggaaatttctcgtagacgtggttttagcatacatgcaatcaaacttcaaaaatatataactatattaagaaaatatttatatatgatatgtaaaaattatattaataaaatcataatgaagaaaaatactctcacaattatattttcaataaatctcgtagataaaaatgattgattagaaagagtttcgatcacaactataaattttttagatgtttttaggggaaattcatgtgctgccgttatgaatttataatatatacttcgaaaaataaattttctaaaaaaatcacgaggataaaatttagtaaggtcagaaacttttttttaaaacatagtgtaaatgtaaacgctcacaacacgcacatactcacatttatgaatacacatatgcataacctacccctataaatatctccgaaagacctggttggcttataaatatctccgaaatttgacacatactcacatttatgaatacacatatgcataacatacgctcgctatgggtatcactgaatgaatagttagccgtaaatagaaacacatgtgtcaaatttagaacttgaatccaggtgagctagttccaccgcaaggaagctaactcattgagctacgctcacttcacggtaatgtcaaaaatatgggtgcgtgggctaaattacgtgaacctgtgtcaaatttgatttgacatgtgtatgtgggataaattacgtatgtgctgactctgacttgggctatatattgatgcaaagtttaacgatagaaaggccatggacaaccttggtggcaccgccaaacttatatattgccacgaatcgttcttctacattagcaatgacaaaatattattgcgaatgatccttgatagtaccaacggttcccagtatttgttgctatatctaagactcgttgcaatgattcaggtcgttgcaatacctaagacagctttgcaaaaatatcgtttcgtgttgctatatacaagagattcattttgcgacactacagttttgagttggaataacatagactcttttgcaacacatgatgtaactaataacaatgatttatattcattgtgacatggacaactcttgcaaccattataaaagcgccataatcacgtcgccctaattacaaagcaaatatatttgttgtgatatatctgacttattgcaacatgcgttgtatatattgcaacgttgcgatatatctcacgacgacggtgtgggttttgcgaggtgtggatgcagcggtgggcgacagcagatgactgcggcagggaggaccgacggcattgggcttcaggccatgggggatctggcgctggagagagcttgccgagcgaagatccgacggtcgggatcgatctagggtttccagaatgcttttttgataaaataaaatgcaccaaaaaatctttttgtgtgtcgtgtgtcgtaacgtgcccgcttatggtggtaagtgcgacccccaatctcgtggataagtcttgatttccccctcaccctattcctccgctagtctcatccgtctccatgccatgccttgcgggagatttgcaataatgatactgcaaacattaatctttgttataatgacactggacccatatttcatagacacagatggactcatttgtcacccactcaaagtgttaaaacagcgaagctccaatgtttgcagtcctaatattacaattttctccatgccatcatgcatggggccactggtggtgtcgctctgaactccttcctccgcactgggaggatgccaagcatcgctccgacggcagtgaagaatgtatttttaccgacgatcatcataagcctgtccgcatgcgaagaatggatctcgcaggtggccggtgttccgtcagtggaaaggctctatttttactggcggtggcaggttagtcgcatgtggccggcaacgaaaaccgtttcgcccgtcagtgactggctttttggtattagtgaactacaattagctctcatg

SEQ ID NO: 58913 - DNA, 866 bp, Oryza sativa
cccattaacaacaaattaattactggagaagtcaaaacaataacgatgtcacataaaactgtctacatactttatctagctaggagagggtaaattagatgggtaattttagcatctttgaaaaagtatcgagatgtattatatttttagtgtaaaatcttttataccttcagctattatatatcttgaggtattaatattttggtatagtacttacatattcttcctaagtactgtaaaatttcttagatagatttttgctcacttgattttgctccagcacctcccagctgctggcttttgctactgcttatgctgttatagtagtactgatctgcagtcttcgacttgtaatcagaagattgctgcgcaggcacccttcctgtcgtgcttttcgatgatcctgcagacgcacaaaattagtggtgtgaaaaaagagagcttaaaaacacctggaaagttttctgattaccatcatattaattatatactctttatatataactaggaaggtagcccgcgcattcgcacgggcatgcttgttatttcttttcgaaaacaggtctaacaaaatgaatttaaattaaagttatgtatttcccttcttaattgaatgctcattgtttattttttcttaaaaaatcttaagaaactttaatttctcataaatatagttttctaccatcctgctgtctttaatttattgattttgtattgataccttagaagcttatacatgcaagtcatggaatttagtaaattcgtttaattatcattgacattcatttattgatgtgtcaaagcgaaatatggcttgtatgtagagaagcataaaaaaattgggaaagaataaaaccgggggatcc

SEQ ID NO: 58914 - DNA, 2104 bp, Oryza sativa
aacatgtgcaaagaatgcccgtggagatcatttgtttatgagtgcgatgaacacaattgttcattcaattaaaaagttggataagtggcttaaagttgacattttacattgattgattatgaaagtaatggtacatacaaatctttgtgcccgtataactatttgccaacgatcaatagaacttgatagttactttcggtgttccttttagtatgtagcaaattggctacatattttacaacttactgtatctttggtgagatgcacctgctatttttttctatatgttggctagattgtttcattgttattaatcgataccttgggtgcatgtgacactatatatatttcaaacaaaaaagccttctcgggtctaaattgatttcgcagtgtgggagacaattcatttgttccgtgcactgtggtatgattgttgtcatgatttaaatatttttgctctaaaatttatgattaaacattagaaatttacgtgatccaaacgatcactgtttgtgattttatgttagctaacgtgcattgggcatttagtgacaatatttatattgcataatcttaaatgtgaagcctaccatgcttaccctattttatcttttttgtttgaaagaattagccatttatacaatcatagtagtttgaatactaaatagtttttatcttttaagtttctaaaataattggtagataaagctcttagctcggtcatctgtgatatacacctgtactcccaagctaatttggcccctatcacacatgtagtcacaagctaatttggcccccatgctgatggtgttcccattaatgtcgatgggggcaaaactgtgaccgatcaggagtcttaagcgtttctaggatgttcacgtggtggcttgagagttcttttaggaggtttaatggacttttagtatataatagataaatataattatattattttgacttaccatagttttagaatgcggggaataattttttttaacaccactcatagttaagtttattttacttttaccgttgttgatctaatttaattattgtgaatacgttgataaaaatatatatgattattttttcatattttttatatttatctaaatgacacatataaaagtcagaaattataaccaaaatgtgacttttttgaaagttgaaatataatgaatatgatctttaaccatatatttagtcataaattatctaacgatataaacagataaaaaatatcaatttagatttgtggtttctaaccaacattgcataaaaataggaataagagagggaacagagaaagagaaaaagagggaccgcggataacatgccgtacttacgactccatgcgcactaaaatttttaattacatgaaaaaatatgtattattatgagtattgtgcatatctaatgtgatgaaaagatatgttcgagagcgatgaattctagactaccaagagtgatgaattctaccagcatgtagaaagatgcggtgtttttttttctttttcatggagataattacaaataatccacaactttgcacgacaaaggcgcatgcacattattctggtgctcataacaatcatatgcgtatactgatagaatttgcaacaacagtagagctaattaagtcgttttaccggacagggagtcagcaatgccattggcaacgcaatacgccacggactgtacggtgatcatggggttgatgcccactgcggtgggcagcacgctgtcattgcacacatacagctgctccgcctcccagctctcgccatgggcgtcgatggtgccgttgcccaccgtggtgcccatccggcagcaacccatgtggtgcatcgagcagaagaggccccacgtctcttttagagattgatctaatggttaaaaatattaggtccaccggattaaatgaaattcaatagtttttgcctttttctaagagattttaagaatttctctaatttatcagagtgccacgtggtggcttaggagcatttatagggtatacgtggcagcttagaagcgtttgtagaaagtttcatggacttttaatgtataatattatgtaccaaaacatggtcaatatggatca

SEQ ID NO: 58915 - DNA, 1284 bp, Oryza sativa
tcaagaaactcatttttctaagtagaatattcaaaaggtttaatgagctgtagaaaaaaaacactaactatatatttattggcatatatgtatgtaatggtgataggagctgtatttatggggggggggtgataatgtacccaacattttagtctacaaaatatgaggactgagcctgaaaagggttaggctaagatttaatagatttttgagttaaaaatatttaaaggctgaggtgggttgtgaaagagcccatgggctctgacccattaccttccctagctgtattctacagagattctaaacttatatatatcttggcttgcacatatgcagaaattctgcagaaatttgtgaaaggtaatctttaagcaaccaacttgtgcacatatgcaggacttgaaggttttagtacacctcctcctcggaacaatggtcagggtgctcacagcctcgtataccaaatcaaaacactagcgcccaaagcaagtcaaatggacttcctattccaggtaaggacttacagggaattctttttttttttgtatgttcatgttaaatatatggtgcatgcatggtaaataattaaggccatgttaaaacacattgacaagtcgaattcttttcccacaccaggtaaggacttgaccggattggccatataattaaggcatatgacagaagaagatgcagtgattgtcaacaatggttcatcgttcgagcctgtgtgttactacaatatcatgtacatatgtatataagtagtacatatagtaaagaataatgtaaatagtagttgtcaaggtcaacgcatgcatgggaaggaaacaattgtagaagtacatgtaatttgtttatttaatttgttcaaatttgtttgtatatataaaatgtgaagctgtatatattgatacctttgacaataatgtacagcacaataatgttgaataactcaaagtgaatcattttatgtttccaaatataccaacgaaggctgtattcgaaactctagtttggctcagctagtcaatggcacgcaaaccagagctagtgattagcgtatacttagttaagtattactccctcggttccaaattatagtgcaccttattttaaaaagaatcaaactcggtaacttttaactaataatcaaatttataatagtaatttttgtataactttaatgtgataataattttatatttgttagaaatataacataaaataattaagagttaaagtatgtcatttgaaaccatgtaaaaaaatataggttttataatt

SEQ ID NO: 58916 - DNA, 3253 bp, Oryza sativa
tggcacggcacgttggcacgccacatatgcaaaagtggcaaatacttaagaaattacctctctccagtggcaaattattaagcacaaacctaagaggggtatttggataattggcaaacctaaaagtggcaaatagttaaattcccaagtcccttgggcactggcagcatcaacctctgcttattcaacaatagtatctttagtctccttgaactctaccattttgtcaacagcgtagatggcgagctaagagtaaaggtgttcctttgccatgtcgtggccctgatgggaccaatataatctgcaaaaggttccgagctcagttcggacgtcattcgtattctccaatatgccatcctccgggatacgagggagcttgctggcatggccgtacctgcttgcccataggcaagaacatcgacggcagccttcaagcgcacccaccaacgatgatgccagcggccccacgtactaccatactccattcagaatacgccacggtagggacgctttcggcaggaagggctgtagggtatgcccaaggtcgctcgaggcaaagttgtagtacattacttgcctgcacagtgaattcccatgcctaaagttgtatagcttgagcacgggctacctcttccagagcacacaagcagcctccttcttcagccgtgctacttcaccctagctggtacgaagctcgccgtgatcaactttgatctacccttcatgtacatcgtaatacttgcgaaacattactttgtccgccgaagtctctttcagctattcctcatgttaccccattccttctttggaattcataagcccctccttgagaatctgttggtccttattgaaccgatcgacctagttcgtagtcttgcattggcaaagtttgatcttgtcaagttgagtgtgggccatcaggtcatagctattggctcgcataaatattgtaatacaaagaaatatgtaagaactttgaggaataaacaaaaaaagggccaaactaattgaaagggaaagacttacgcaggaagtaaggcttcaaaggaagaagttgatggcgtcatggttgagttatcttcaaataccttctggacggacggtggcgaatcaacctgagtgagcccacccacaaaagctgtaagctcactccagctctcgaattccttcaatgtgaaattgaggtggcaaagaacgccctctgaggcagaaatgtcccacgcaacctgtttgattgtttctccacccgctaggtaggtgggccaaataatggaatgatatccttcctttactaagagggatcctactcctggcactaaacctaccaccttggctcttacgtgtacctttatgagattcaaaacttctcttccttcatagccaaaaggaacaatgatgacggtgtgtggacccaaggaggccttggggttgatggcggccaaaggagttcacatgacaaggttgggcgacggcggcgaagaagattcactatcgctgaaaccagtaggacatttaacataatatactttcagttttgtcaaatccatgtaggaaggttgtacatggtgtaaagactggtaggtctctaaatgggttcattccatccgtgctaaatgcaaaccttacatttttcagatccttagcaaattctggatgtagtgaatcaaacgtcttccattggtgagcatcggtggagtgtcgaatcataccatctatcttacggttcagttgatgccatctcatcaactcagcatcattagggtttcacaacatgctcttcatgcgatctttgctggcaggtaccacatcaccatggccggaatctttttctttgtatgcaccaatgaatctaggtcgacaacctcagtatcagaggacctgttacctgttgtcggtatttattacgaccacagaattatctgcaagcgcatagataccgttgtagccttcacccaacagtattccagggtatcgtattcacagggaacatatatgtataatctaagaacatgattcatccaaggacaaaaactaaatggtaggctgggaatagagagtgttcctacggattaattttcttaattacgttatggtaaaactctatcaattgcttcaggcgccggcttacccctagtcttccaaggagactccgaatgtgaacgattacaaaggacgaatatggctgtcaccacctgccgcctacctctacgcgtcatggtgctcatggtatcagcggtgatggcagggcacacgggatgatggagggagctggctgcctaccttggcttggttgtgccatgcatgcaagtggctatctggcccagatgggagggtgtcaggagtggtagaaggaatggttcgattgggaattttagcccatgaaaaatacgatgtcttttaggaatttgaagatgataacttttcgaaggttgaatttatggactattttgagtttcgaggctgagtgtaaatgaagttttataggaatttttgccgggatgaatagcattgggtttgatggaaacaaatttcaaaggaatgaatttggaattttgatttggagcttattcgaaggtaaagcaaaagggacttaaaggagtaggctaaggatttggttgaggagtttcatgggtataagaatttgaaatttgtgtggagcaggatataaaataattagtttctaggaattaaacaggaaagagatgtgcttacagaataaggttttaatcaaagataaattgagatgtttataaagttagaaatgaatttaaatggatgaatttgaattggaaataaaactataggaaatttataaaaagagccaaaataaaactttcttcttgcctacaattttcccaaaaaccccataacaaattccctatatcccctctacagtggcaattcgccgctatcagcaccctaaccctagtagttgttgcagcagtagcagagttgcaattgtcatcgccatcccgtggactagtgaatgcaggatcaacgcattagggaccagcggccactggatccgccggcccatgttctcgtggctacctacggatacatgcacccaggactagcagccagcattgatccactgctccaaggacttgccgtcactagatccactcttcatgggcacgtcgcgtctatcgacacgtgtggttccatccctgagctacgttggaccaagctgttgtcctcgcctccaacgttgtcatcgcgtagccccatcggatctagactgagctgtcat

SEQ ID NO: 58917 - DNA, 4577 bp, Oryza sativa
catctaaaataagcgtatatgaagctttttccatcattttgactcctcatatggatatagatttaaaactaccacggtagcacctataacccattataagtgccttttcttaaaaaaaatggcaccaataatgtagccgagccgacggccacgcagggtagccgagtggagcacaagatgggaaagaaaaattctcgctcttatcccctcgcatgtcgagccaagctgtactcctctccctaatcctcttgcaccttctactcttcatccatcttctcctttgcctctcccactcccttgcacggctggccgacgctaatccctcccccctgcgtggtcccgtggtggtcaacgcctctccttctcccctgcgcgcatggcggctagcacctttccctctcgcctgggcggcaagcaggtgcctctccctctcccctagacatcgtcgccggtcggcaggaggtcaaattgttcgtggcaaggaggtccgacgacgcactacaagataattgagctattgccaccaaattatacaacaaaaaatatttcgtagcaatatattgtactattgcaatgataatttttctgtgacaaataattatattttattgcaatgattgtaacgatctacaatcgttgttttatttaaaatacatgttctatagccacaattttaattttttggcaatttacataatacatggtactttcactattttttgttgccacgatcaacaaattcgttgcaataaaaaaattgtcgtctcataatttagcttaattttttcatatggatacggattgagacaaattttatatgaaaattgtagctctcgacaagatctataattttatagttgataactttttcatttgaaatcttttagatattcaaatctatgattcaaatatcagttaggtaggctcaaatggaacgatatgcacattccaacagaattgatgcataggtgagttggtaaaggagatcatgcgtgaagggtaggtcttgggttcgaatctgagccaagacatggtataaagaaataaatataaatagataggatgatagattaatatttgaactttcaatttggtacgtagaactaatgccacatatggagtggtggcaataatttttattacaacgatgtaaagtgttgcagaatgattttttgccacatccattccgtggcaacatctaaatttattaccactaaataaaaatcgttgcaataacctattaccacgctatttattaccacggctagcaacaatttaaaattgttgcaacatgtatttattgccacaattttagtattgatgccatgattttttttgtggcaacaaatgatttttctagtagtgacgaggaggtctggcaaggtgttcatctccacccttcctttcctctcctctcctgcgaggtgtaggaggaggcacgccggggcaggggctagattcgccagtccccgagctcgggactgccacggaagcaaggaggatgatgaggacagcgtgatgggtccattggcaagggttttcttgaatttgcgttgggttttcttgatttttggggaaagggaaatatggatatgggttcctgtttgggtccaaacgttgtttgcaacatgatgaacgttcttgatttgtttaatttttgagtgaaatgtgaaattgttgatttttttttcttctatggcttctccatgtatgactttgatgtggatcttaggaggtgcattgactcaattcatcaagacaaatcctttttttttctcgtcgtaggtgtcataggagccggttcctaaactggcactaaaaatgtggcttattagcgccgcctgaggagtgcaggatgggaaatctgatagttatggccgattcctaacgggcatcaatcactttttctgtactagtggagggaggaggtaaaaaacaggaccggcactcctaagacagatccgcttcgtattttaagtctcttcacaatttacacaatcagtcctcattagacctcacacgtagaaaatcgatttttacaggcgagatctgaataagatcgcctgaaatatattaggtaggtttgcacgtgatctttaaatgaaactcctaattggcgtagacgcactagctaaataactggcacatgtttcggtttcggcccattattagtaaggcccaattacactttttgactttcagtttttctgtccgacagtgccgggcacttgcacgtgctaataggaatcaacgagaagtgaggcaaaccgtttaatttgaaactgtttctccacgattagcaattattattagttctaatttttgttttttcaattaggtgacgtgattaacgaaaactttcaacccattttttgaatcttttaactcgaatttgaaaatttcaactcaaattattgaaacttttgacctaaaatttaaaactatcagctcaaattttcgaaaactttcagctgaaaattcaaaacttttatatgaaattttaaaactttcaactccaaaattcaaaaaattccaattacaaaattcaaaactttcaagtccaaaattcaaaactttcaattgcaaaattcaaaagtttcaactcggaatttaaaatttaaatcctcatgttaagtatttattagcactaatcacattattagtgtcagcacaaggaaggcatcgtacgcgggttaattgcatgttttttccattcgctaactaaaataggaacttgcagaaaggataatacgaaaccaccgattcttatgtgcacgcatattaggaggccccctctttaaatcccatgtataaaaaaagtcgatttttacaagaaaaccgttattatatttttacgaacgggttttctagtagtgcgtcgtactttcccatcacattgatcgtaatatcaagattggtactaataaacgtggttggcttattcagtactccgatttctgaactgacgtcatgagaaaaatccaagatattttgcacggacaggtcgtcggcctcttcaagtcttcatggtttgaaacaagaaacggcgaacattttctttaatactgctctctaggacctggactttatgggcttttgatgcaaaataaataaataaataaataaataaagcccatcagtactgtggagcagtgcaggtgcaggcgtccagccatctttcacagtttggagttctaacgacaaaaataaaacacaccttgaaattgaactgatctttctgccgttctttgatggaaaagggaaggaaatcttggccgcatttttgaaacctcttaacttgaacgtttggactttaaagtcggtcacagcatgcagatttaatctcggtgtacatgtcgacgtcgaaattaaacttaactagaaaatcagcgtgcttgttagcacgctggctagttcatagcccgtacatgaagtttcatcttgaatataaaaaatatataattattaaatgagttggagtatttcaattgctataaactccaaataccccttcgaactttggaaggaagtccgtctcccgccctaaactttaaaactggacatccaacccccttaaagtttgtcatacatccatattacccctaaaatggttttgcatattttggaaggagaattattttatttctttttgtcataggttgagagaaatctatataattatatatgctggtcaataattttgttagtttgacgttggattgatatgctacttttctttaccgtgaaaaaataggggagaaaaggaaaaaaaaagtatatttgcaacctgcaatttttgcatataattatctagaatgcgtggtatttgtcaaaaatacatattttagaatatggttattctctcatttaatttttggtctttatattctagaaatatatcaattcgtttagggtagttacctcaatttcctatttggcccttatataatttataaaaaatatttcattaaaatgtttttacttctttattatttttaatattttccttattttttttccttgttcatgcggcgattgtcgatgaggtgggttagcgacatgcttgcaccgtcacgcccaagagcgggcatacgtgaacattgtgaggggcatcgagtgggctggctatggtgcgtgactgggctaggcccaactaagtgctcggagctccttatccttttctcttttttttttttcatttccgctcgtgtaacgttcgatagattggtctagaggcttccgttttttcccctcaagaaccacccccgcattcaccaattcacatgctattcattaagccacgtggaccattcaaattttggcacaacggtcagctttagcttagtagatactcacgcaggggagtatctctgaatcatgacgcgccacgtggcgtttgtctccggccgggaacgtgcatggaattcgtatatagagattagtactacgaagcagctgtgttggacatcatgcaaaatctcctggattgagttcaactgaaacagtgcagaaaaataactgtaatttctgtagtaacttagcccagctttaattagtcaaataattctatacgctcg

SEQ ID NO: 58918 - DNA, 2482 bp, Oryza sativa
actaacggaggctaacagatgatgatggtaaatagtagaagttatgcaaaaattgatggcatattatagaacatgacaaaatcagtggcaaatcgtagtgtgtgacaaacttagtggcatataatggattctctaaaaaaaaataatgccactcttgcatgacgagtttagatagaattaggctaagcttataaaatacttcctctgtcatattgttttcttttccagtcaaatcttttttttttgagaaacagtcaaatctttttatgcttgattaagtttacatgaaaacatagttttgtagtatttttaagacaaaaaaaatatactataaaaatatatttaatgttagatttaagaaaactaatttggtgttgtaaatgtgatattttttgtataagcttgatcaaattaaatacgttgactaaaaaatcaaaatggcttataatataaaatggagagagtatatgcgtttcagcgatacaaatttcaggttaactattctacgtatagtgagaacttaaataggacgatatacattacgattgttcgcttgatgtgggagcaaaggctaaggacattcacaatgtttatctcacaacgtttgtaatagtgtaggcccattaatcaggtgtagtagttgttaccatattccacaatgtatataagcctgtggtgagaaaacaattggggctcattggggctagagccccagctccatcccggcagaacccccagccctgcatgcagagcagcagccgcacagcttcgggagaggagcagcctgaagcaaaagggcagaacgaacaggtcgtaggtaagaaggagcaaacaaagacaacatgtatagtccatctaggtgattaagtggactaattggctactaagccttccttattaagttattagttttttgcttttttttgtctacttcaatggatggaacgatcatgggattagggaagcgagtggtttttactcacgaagtattaatccaacaattatcaacaattgtgttattgaatttgtggttgtgcctttgtagtattttgtcttccattaagtgaaagcattttcatccctcaagagatatcctctatcccctcattttgtgcatgtcatataatcataaaaaaactaattaatataaaatatatcgcttcacaaacatgcaagttaaaatttaatttctataaattgtaaaaaaaatcaaatataattacgaatgtacgataattgttttcaatttattttgttatttttttgcaacttgtagaagtcaaatttggccttctatgtttgtggagtgatatctttcatatcaattaatgttgtcaatttttttttcaaattatttagaactatttagatggtatgcaagcatcgatcatactttgtaaaacacattagaaatgatactttgtaaaacacattagaaatgagcaccccctatatttttattttcgttctagattcacccccactatgtgggaccatgctagctatgacgggcctaaaccatcacctctgacggattcgacccctcatcagagattagtggtcagtgatgactctcttcacctttgacgggtgaagagccgtcaatggtgaccagcccctatgacgggccacgtatagaacccgtcgcaggtaactattatctcaaacggcccattagtttgtgagccgtcagtgatgtctataatccagcaaaaaaataagaaaaatagattgcaacccgtcgcaagtgtgaaaaaaccctagtaagaaaattggcgcacgctgccatggtgctgcttgttgtcatcaaacagaccacatcacaaaaaacttcaaactgaccacatcacaaaaacttcaaattgaccaacagttcattgtcctccatcaccgcatcaccatctcatataccaatcattcacaaagggggatggcaagaatttatcatacaacaatatcatatcattcacaaaaggggcacgctggccgacagttcgtcgtcctccatgacgaaccagcgaagggagatgcaggtggaggcgccgcaccaccaaacaaaaatcaagaaacaagaaaccaccattagagcccacattctcaaaccaaacacctcaaatcaacaacaacaacaacaacaacaacaacaacaagatttaagtaaaaaaaacaacaagaagaagaaaccccaccgaggtggccggtgggtggggatggaggaggcggtaccaggcgttcagatctacgcatccccagcctcgtggaggtcggatccggcggctagcacggtcggtggcagtggtgagggaggcgtcggtggtgttggcgaccgggagtcggggggaggcgccggcggaggtggaggcgtaagtggcggccagctagcacgggcggaggcagaggcgcggctggaggcgtcgccggcagaggcggcgaaggtggagaccgctgccgccgtcgggcctcagccgcctcccctcccgcc

SEQ ID NO: 58919 - DNA, 6581 bp, Oryza sativa
catgggcaagccttgtattgacgcgtgcctgaaattttctataccgcgttgcgttgactgaatatccattgcagattcatcatgtactaatgctagttctcgagcttttgctgaggttttcccgccattttccaccgaacagacgatggtaagttaagtttgaatcgtggacagcttccacatatacgtgttatttgacataattttttttgtaataagcaaatatcctggagatttctcatttctcatggcatctagaactaaattagctcatgtaatcaatgaagaaaggactacgaacttgcatgtatttttcgcatcagtttctactgaaattagatcgagctcaaatctcatctagggggaaagagaaaaaggaacccggacacaagttcagctgtttagtgcggatggttttgacaaaatttcattcaaattaattaatggtcaaaacttgtcgcggttatgttcaagcaaacgacatcctggacatttcgcattccatccacagaatactctgaataaacaaaataactaaatctgaattctaaattattaatgcagggttaggttattgcagctaattttctctcccgtttctgttgtagttagatcaaactcaaatcttggaaattttgcatgctaacaaataccagctgtttccatgttgtcgtcttgttgctgcgtctgaataatctgaaatgtcaatatattcagctcgcaaataattaatccagtgtcgcctgatgttttccttcccttttccatgaataaacgatacaaagatttgttcaacttcaaggtgctgtcatagtctgaaactctgaacgagaattggattgggctgcatggattattggtattgatgggtcgttgacagagcaattgggcttttttgctgtcaccgaagagcccataggtccagtacctttccattctttttttttttttgcggggacctttccattcttctttattttatttctttttggcagatcagtctgacagggtctagaattttttttttttggtccatcaactttttgtgtgtttttacacccttttcctgtcgataattcaagaacaggaacagcgatcgcaattgttttagtttatgttttctttatgcttttaaaaatagaaatactacagaacattatcccttttgaaccggatgactaaataaccatccagttgaacatcttatccataccagtacactacatatgttggtcttatcgtatccctgtgattctcctttccctccactctctctctatctccctccctccctctctccctcccttctcccctcatctctctcacccctctctcaccctcatggctcaccagcggtgagcaccatacagccatccgtctgtgtagtcaacgatgatcagttatgtgctgtcgtggaagaccgactccacttgaggtggaggcattgcgggggcgattcttgaggtttctttgaggtggtggcgaatcggatcgacatgttttttgttggtttttttctgtgtgttttttaagcattttaagaggtgatttctcatgttagtttttctcattattttttgagttagctagccatattgaagaaatttgtgtgcctcctgtggggcgttgccgctgccgctgccacccctcccgccggaattggtggagggaagtgtgccgcccaccgctgccatctctcctcccaccgccgccgcccattgccgtcgacatctcccgccgcctccctcccgctgccacctcccgctgccttcctcccaccgccacctcgagagagatggtgtggtggagaaggagagagagaggagaggcacttgtgtggtggagggggagcagcagcagccgccgccacgcccgggagggagagcagccgccgaggagaaggaggcgagaggggagacggagaaccgatttttttatttataataattactcatccctaaattaaacaaatagtaattatggaccgatatttaccaatatgggaaggacgctaaggtgtgcagcgtccagctgtggacgctgttgtgaatcacgtccactttgggacgctgttgagaatagcgtccacaccatgatccctgatccaaccgtccagcgccatgtcaccgcttgggtcatctttaacccaaagttaattaggtgtcaccgcttgcactccactggcccggtcctgctctaactacggatgctctgacgaattattcactcgccgccgattaaggtttttactgcttatgtattatatattccactatatcttgtcatcgaccaatttatcgatgtgattcagtcattggctctagctagatttttactaacatggtacaaaagagcaatactcgactaatcatgtcctaatagattgtctcctgcatacttgtgtggtgttataaattagtattgagcacattttttttatagcatgtctcactcttgagcggaacaatgcatcaaccaagcaagcatctgaacatggcatgacctgatttctttttgtatgtaaaagaaacatgcatccatgagctgcaaaagttctgttaacaaaaaattgtcaacagagcagctgattctgttagcctctagtttcatgggaacttctatctgcaatttttgcagtagcgtgaatgcatttgctgaaacctcttcctggttacatccaatcatcaaataaatcattgccatagtcttttggggaattcgttgtgtaactttgtaagcaacgattgaacacaaaaagtgtactgagacttgcgtgcgggtgcgccacccacatgaatcaattttgctttgcttcaatttgctgcatatatgaatctgtacaagcctggctgcctggatcgaggccatggcggcagcagccttgtggcttgaggaggcggcctctatcggcgctctgcttgaagtaaacttccccggccaagtaacacggcgctgccggcgttcgagggcagtcgagagaagtctgggctctcgatttgggccgcagctggtgcctgatggacgctggacgtcgtttccggtagcgtccacggttggccgctatttgtgagagcgtccatacctggacgctgttagagatagcgtccttcctattttgtttaatagaagtaaacatttactaattatttaatttgatgattaatatttattataaataaaaaattggggacggagaaaagtaggcgaagagacgggacgtgagacagagagagagatgggtgggcagggggccgggatggataagaacgtgcggctcgggtcggttttacagggtatcggttttttagaaaaccggcacctataagatattataggtatctttttttttaaaataccatcacctattcctgttaccacaaaaatactagttcctaggtaggccccgcgccaactaaaaggtaccgaattttcaataaaaaccaccatctttctctgacaccagtataggtgcatgttctttttaaaaaccaacacctttttgatgataaaggtgccggttctttggattttggcgggcagatgggctcgtgggtggggaaaggcgctataggtaccgattttacctactctggcacctatagtgctgacagcgaattgatgttttgcagtagtgagatgttgtgtgtatatgggaggtaggatcaggtattattggtgtattatatatttatagataactattactccctccgttacagaatatatatagttttagagttggaaacggttattaagaaagtaggtagaattaaataagaaggggttgtgattggttgagaagtagagataggtaggaaaagtgaatggtggagggttgtgattgattgtaaagagaatgttggtggagaagctgttatattttagaacaaatcctaagtgctaaaagttattatattttaggatggagggagtatatgaattggctacaatattggttataaatgattttgagctagtaattgactatacataattaaacttgctatgatgaacccaaaacaaggttcattgttttgatacacccaatatacaactgatcactgaccaatcagtaataaaccaatgaacaaatcgaatacatcttatttaatggctaatgaaccacatgaagaaattaaacaaccctacatatctaggttcgctgctgctcccaaacatgtatttacagaaagatacacgacaacacacagagacttcctctctcaatatgactatttgtatatacggtgcttgtatgagtatatgcaatctgttgattgttcttcatcgatcatcaagcactgccaaatcagttaagatcagcccttgagtgacggatacctcttattcgtgcccttgcctgagaagaagaaacatatattaacaacaaattaattaattactggagaagtcaaaccaatatcgatttcacatgctctatctagatatagcttagctaggagagagaaaattcattttccccgaaaaaaaaaaggagagagaaaattcattagattgatagtttttgctcactttggctgcttgtcgtagtagccagcacctcccagctgctggccttggccgctgcttatgctgttatagtagtaggagtactggtctgcagtcttggacttgtaatctgaatattgctgcgcaggcactcttcctgtggtgcttttcgatgatcctgcagacgcagatggccgcacaaaattagtggtgtgcaaaaggagagcgtgaaaacacatgagaacactacgccagatcctcacacctctgacgggatacctgtgacgggcaaacgaattggtcagtagtgaccgttacctttgacgggttatacgggatgccgtcaccggtgaggcacctggccgcggcccgtcacaggtatcccctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttctggcccgtcacaggtgagaggataccagtgacgggccgttgaatagaagcccgtcaaaggtatgagcaatacctttgacgggctttttttatctaacccgtttgaggtgtgttgggtctataaatacccccaaactgccaactgctttccatcccgaccattgtactgttcacaaatcggttgggagggcaaggggggcgattttttgctaaaattcaaggtaaaaaacacattattctccattcattctcaacatatcgatcatcatttatttttcttcgtatgttgttgatttcagatggatcgtagatggatgtactatgcgcatcgttcgtctaccgagtatagggagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggatttatgaagaaatatacctgctggaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgtcgttgtatgatggatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaattcatgcatgtccgaacgactgcattttgtattacaaggaatacgctgacttggatgtctgccctatctgtggggcatcaagatacaaacgagcaaagagtgaaggtgaaggaagtaagtcaaagaggggaggcccagcaaaggtggtgtggtatctcccaattgcggagcgcatgaagagaatgtttgcgaacaaggaacaagctaagcttgtgcgctggcatgccgaagaacggaaagtcgatactatgctgaggcacccagcagattcagtacagtggaggacaatcgataggatttaccaggaattctcaaatgacccaagaaacatgcgttttgcaatgtgtacggacggcattaatccttttggtgatttgagcagtcgtcacagtacatggccagttctgcttgttaactataaccttcctccctggttgtgtttcaaaagaaagtacattatgcttgccatgctcattcaaggaccgagacaacctggtaacgatatcgatgtgttccttgaaccgataatcgatgacttcgaaaggctatggaatgagggcacacgaa

SEQ ID NO: 58920 - DNA, 4600 bp, Oryza sativa
attcctgcagccctacatgggtcacaggagatttctcccaaggtatcacccgtataggaatatgagaaagaatttcaatggacacagagatacagccggacccccgacagagctaacagggacagaggtgcacaacttagtgatgggaataaccaacgaacatataaccatttggacatataaccattcatggagtgtgtactgctatatatgttgctagacctattgaattttgtggacttgcatttatactcctcctgctgctgttttatgtcaatcatgcaaattctgtacccttgctgctgctgttttttaaattttcatgattgattcagtggttatatacctctacacttgttctttttttatgcataagaacagattttgtgcactctctctttttttatgcataagaacagattttctgcacttgttcatttttttatctacaataatatatgcatgatttatataccactgctgttgttgcccctgtacttcttgttaaatggccaaggatgaattgcttaataacattctatctatacctgttcttttctttatggataagaacagattatctacacttgttgatttatatacccttgctgtctatgtgaatttccctctgctgttgctgtttatgtgaatttccaccctgctgttgctgtttatgtgaatttccaccctgctgttgctgtttatgtgaatctccccttgctgttgctgcccctgtggcatatatacccctactgctgttatatggccctgctactgctcttattgctgctattatatggccatgctgttgctactactctaatttcctgcacttgctcttttccttatggataagaacagatgaactacacttgttctattttattgataagaacagatgaactacacttgttctattttctttgggttgcttttttctcctagtagctgatttcctctttttatcccttcatgcaaatgattataattgatgcatatttctcagcaaaactgaggccatatctttcatagtataccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggactgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataaccgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtccctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgtccgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattgttgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacgtggtcaggctatccgctgcccgtgcccccaaatgatgaaatcatgactttgggcgatgcgcgcaagacgttcatacaatggcctaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgaggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctaccatggtattccaaacggtgttatttaccttttatttaattaaccaaaaagtaaaactggcttccagattttacccattcaccccccggtattaaaggcgaaatgtgcgcctttaattttgcaaaataattaaccagaaaggacgttttcatgcccaatagactcatgaacttggctagataatttattgtgatgtaaaaaaaaatgttttaataatttctgccgatgtaaaaaattatgtttttatagagtgcaatgtaatttactttcatatgtgcaatatttatggtactttactaaattgtcatcacatttgatcaactacgatttatgttgtacgtctcatctgttttctcctttttttttttccttattgacaggttgtgcaggtcgatgacatcatggctttaatccatttggtaagtatatatg

SEQ ID NO: 58921 - DNA, 870 bp, Oryza sativa
caatgcaggcagaggaaaaatttggctatcttttagaatgttttgacatgggtgctcctcctcatggtatgctatgttcaaccactgaactccatgtacatatttttggattagatttgagattttggatcgcatactgaactttctattactactatatgcttgtatgtttcattaagacagtatttttccacaaacaagagcaatctttcaaatcaatcctacttcttgttataaccacaccatcagattttggacagcatattgattctaagatgctttaataaatgcaagcgttagtgatatgcttcttgcatattcaagaaaaaaaaacgtcagcgtttatgcttgtacctgcgtattgccatgtactcatgtgttatagtatgtctagttccattctgcttttagttttggaatgttgagctcaaattccacctaatttttataccatggcaggaggaattgcctatgggttagatcgtttggtgatgcttttggctggtgaaaattcaatccgggatgtgattgctttcccaaagactacaactgctcaatgttcactcaccaaagcgccatctcctgtagatccacagcaattgaaggatcttggcttccgtacgtgaagtgagtgcactgcttgtaacaaggtttgagttatataggaacatccattgtctacaccgggcacccaacctgtcacagcacattcaccttttgcgaatgtgcttctgctcttgagaaattttgaccatggataggctggttgtccatctcatgaatccaataaaaagtttaaagcagatcaatctcttcgtgactattgtcggatagcttgtcaagtgcccaagctatttggctgttgagtta

SEQ ID NO: 58922 - DNA, 1768 bp, Oryza sativa
aatatggattttttaaagcaactcctctataaaaattttttacaaaaaaatgcaccgtttagtagtttggaaagcgtgtgtgcgaaaaacgaagtgctttctccctcaatgtcctccgaacgaacgctgccttagagtagttataggtcatggacgcctgacggatgacgactgacatgaagatggtaagttggactatttagaattttagatcgatatgtttaggataagttgagcttttgtgatgcattgctcgtgtgtgtccatgcatgatgcatccctagctacaaggagtatcgtcttttattttgcttttatacctttagacttcagtatactactactcaagtacttcgtatctactacccaacttcgatcgggcatggtcggtaactcggtatatgctcctgtatgctgtatggctgtattgatggatgatggttcagctcgaaggtgtatttgtagcgaactagtatgtgtgcagttccaggcgcttaactagtttggtgtttgcctcggttgcatctgattaccgaccaattttccaaaaaaaatttagagccgtaaaaaatcttttgcttccgctcagaggttgcttgacagcaaaataaaaatcgtcatgcgttcagttcgtgcgctcatcacgcactaacgctgctgtatgcattgctacctacgcactgtaataaatctgtaatgacacaagtactatctgcgtctgtaatctgcacgctgtacgacgccctctcgcatcacctcatctcaaaacccactaccgcacgcagaaggcgaagaaactttatactatggccctgtttaaatctcacctgaaatttttcaccttatcacatcgaatatttggatagatacatcgagtattaaatatggacgaaaaaaatcaattacacagtttacgtgtaaattgagagacaaatcttttaagtttaattgcgccatgattttacaacgtggtgttacaataaacatttactaatgacggattaattatgcttaataattcgtcaagcagtttacaggcggattatgtaatttgttttgttattatactacgtttaatatttcaaatgtgtgtctgtgtatccgatgggacacgctaaaactttacttccctggatctaaagtctaaacaccccctatgttttggcttagagcagctaaatttggctattttaaccaaaaaaaatccactccaacaacctctctattaggatggctaagctaaatgattagccaaactcatcccctcaatggccaaatttggttagcccaacctgccttgccattggtggatcccacgctgaagaggcttttccctcccgcaatagcactacccgcgtcggttgagagcagtgaaggaggaggatgcggcggtggggcagcacgacggcgagcgcacccgcggcctcctgctcgtcggccgccggcgtcaaggaatggagagagaagcgtgtttccgccaccgcctcagttcccggccacatccgtcggcatcttcttccttctcggcaaggagtggatccgctatctccgttgcctcgcgcgaacgaattcgccgtcgccggcttctcccttctcgccgccgccaccgctgttgactcgcacacacgaatcggccgaggcggagacggaggaggacaaggacataggggagaggggcgaggcgtggaggggaccggggacgggaaaagggggagaaaacgaggaagaagaaaaagttgaggctgacatgcggatactactgtcaggg

SEQ ID NO: 58923 - DNA, 1173 bp, Oryza sativa
ttagtccctgtctttagacactaatttagagtattaaatataaactacttacaaaactaattacataaataaaagctaattcacgagacaaattttttaagcctaattaatctataattagagaatatttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggctcagaatagaaatcagaatagaaaggatgaatggagagactattggagtaaataacaaatttgaattgctaattaaatggagatttggctaaatagacggttggagagtgatttggagaggctgtctggagatgctcttaagctcgaagaggcgctgcccctcgtgcatcgccgacccccgaccataagtatcacgagcaggcggccgccgccgagacatgtgctgctcagtcgctcagagcctcagatcacccacccgcttgctgaagcgctagtactagtgtactaccagtagtagtgtaggcggagaaaagcagttggcaaagctcgcgcaatggcagcctccaccaccgcgctgagcatgaagctgctcgtcgacaccaatgcccagcgagtgctgttcgcggaggcgagcaaggatgtcgtcgacttcctcttctccctcctggcgctgccggtcggcacggccgtcaagctgctcgggaaggactccatggtcggctgcgtcggcaacctctacgccagcgtcgagaagctcgacggcacctacgtccagcccggcgcctccaagaacgcgctgctcagccccgtcgtgctctcgccggcggccagctccaacacctccgtcctccgcttgccggccccgtcttcttcgcagcccaagagcttcttcagctgccgctcctacgactgtttctactacgtgacggacgtgagcggcgtcaagtgtccgtcctgcggcaaccagatgacaacggcatgcacgtatgccgcaccaaccgctgcccagaagctgcaggccgctgcagccgaaggggcggggaaggggttcgtgcagggcatcgtcaaatacacggtgggctgcagg

SEQ ID NO: 58924 - DNA, 2680 bp, Oryza sativa
catcattcatcagtcaacactcaccactcctcttctctttctctgttttatattagtgctttgcatgtacacgttgccatgtccgtgatgctgcatatatgttgtgtttgtgttttgtagggcctggcgatcctgagggcctcgctgcagtccaagaccgttctcagcgacgttttccttgccaggaggcctgcaaagcaagcctgaattctactactacttcaacaacgctggtcgctggcgatgtcaaaatgcaagccatctcgatcgataagtagttaactatacgactgtattggtctttagtgatgcctgtaaattaatgcgtactactagtagtatcttgtgccgtcgtgcactcgtgcgcgccccagatcttttgctagctagtagctgaagtgcagcatgatgaaggttaagcctgaagcaatttgggatgttcaagcaatacccgtatagtagtgtgcgtagaagtcccccttaatctgtgtgaatcaggactctccgctggtaagaatcaccatgtgtactactgtactgctgtttctaatgctaccgctgtttctaatgtgcttgactgttcttgatttgcttgcctctgaaactctcaatttgatccggtgttgtccggttttcctttgctttttggactggaccggtcgaggcttgcatctcttttgctcgagcaatctatgaactctcctcttgctgttgtctttcgccgttcctgtctggttcagttcaagcagcagcaatgctcagaagaactcgaaatttctttctccttaatgaagaatttggactgaattcgaaataatttccacatgagcatgacgtagactacataaattttaaaggcctcctacaagaacgtcgcagaaatcaaccaacgcattatgcttctgtttggtggtaaagttctttcaaaagtaggatctgtttttttgacattaatctgaactgaactagacgtcaaaatcatgtggcatcggcggcgcgctcttctccatctggactgcggcggcggcgtctttcttctcgctcgttgctcgggcgtcgacgttcttgtcgccggatctatggtgcttgtcgccggcacgagccttcttcttcctgttcaggaagacatctgtcaacacggtcttggactgcaacgatgccttcagaatctccaaaccctgcaaattcgcatcaaaacaaagtaagccgagtttagtttcaaactttttctttaaatttctaatttttctatcacatcaaaactttcctacacacatactcccttcgtccttaaaaaaaaagacaaaccctgggtttgcgtgtctaactttaactgtccgtcttatatgaaatttttttataattcgtatttttattgttgttagatgataaaacatgtctttttaatttttttcattatttttttaaataaaacggacagtcaaacattgggcacggaaacagggttcgtcttttttttttttgacggagggagtaacttccaactttccgtcacatcattctaatttcaatcaaacttttaattttgacgtgaactaaacacaccctaagtagtaaattagtatggagaattcgatgaagaatttatctggttaatttatcacctcttggtagccgatcttgaccgtcttttcctcgagcgcggagaggtcctcgacgccgagcttgctgagcagcgcgatgctggagatgctcgacatgggcatgaaggtgaggtcgtccatgacggtgtacgtcaccacgtcccgcacgaaccctttgccagtctgggcggcggcgaggcaggtcgaacagcggcagcccgtgtccgacgacatccccgcgccgaagggcgggaacgccgccttcagagacggcagagacggggtcgtcggccggatggtcgaacactggtaggccgggtggcccggcggcggcggcggaggaggaggaggagcaacgtacggcgcctggacgcgcgggggctggacgagggacgggaagccaccggcggtggcggcgaggcaggggtgcgccggcgccgggttcagcagcgcgtcgcgcgcctccgcgctctgcatgtacgcggcgtccatcctcctcacgctggcgtacacgttcgcgacgccgccgagcgcgttctcgcccgcgagcagcttcaccacggcgccgaccggcatggcgaggagcccgacgaggaagtcgacgacgtccttgccggcctcggcgaagagcacgacctgggcctccttggcgatgagcagcttgatggtcggcgtcgtcgacggcgccgcgtccgccgaagcgcacgacgacggcacggcggcggcgttgcccatgttgttgcctgcttcaaccaagcgccgcgtacgtaaaaccctcgcaggatcagatcgctttgtatagttgttaagtcgagcaaattttcacggaatatatggagcgtgaaaccgattggtgcacgattgccaacaaccgcgatctttccgtatatttgattttgtaattttccattatctctatgtatagttgtattctgcattattttaaggaaaacgatatgataaccatagcgaattcgacggtagatatgataggcaattgctgtgcacgcggatattacgaatctgacgataaatctgtaaaacctagtatggttctaacccggtaatccggtgta

SEQ ID NO: 58925 - DNA, 830 bp, Oryza sativa
ttcaaaattgctctgattgatgtgattattcttttaaaatgaaaactagtcaattttgaatgaaatgtgtttttattttggctcggctcattaacaagaaattatagaaaaataattttgaagaaagctcgataaaaagctgaccaagctttttcccatccctttattgttgtgctgtttgcagtctggctacatgcctacatcgccctcactacttctgccggtaccgtggatcatgattcatgaaagaggcaaggagaaagcatatgggagaaaatgttctgggattcttctaacagagagatttatcttggatgatcaatagaaaaagacttgctgtcctcaagttcaaggccactagtatcactgtatcaggattcgtatacatgcagtgatgctgtagatggactcaaagctagcagcagcgtagaagatggtgtagatacgtgcctatatgatttatgaattgttcctgttttggattctattgtgccgtctatttagttttattgcccattgatttgcactcgttctgctgtattgtctgtcaatgaaaagttgccggatgttatagaacgtattttctgaagttttagaaaagcttcaactctatagtatatttctaccaggctgtgctgatgcagtgatgcttctgcgagctgagtagctgactgctgttgattgctgatgatttattcggtgctttgagacgatcggcctcatctttcgcttatgcttatactccctccgtattttaatgtatgacgccgttgactttttgacaaacatttgatctttcgtcttattcaaaaaatttatgtaattataat

SEQ ID NO: 58926 - DNA, 1441 bp, Oryza sativa
cgtacccgtcgacagcgaggcacctgtggtgacttcatcaatctctccaggattattaccggcccagtcttcgaagatgctcataggggtgagtgtgcgtgcgttgtgagtgtctgtgttgtactgtgtaattctcaaaaaaaaaaggaggaagtacttatcagtcaaaatttaaattttcgatgttaaatttagagttgattttagagctttttcattaaagtttttttttcacctttgcttttacggcccgtttggttggagggaaattttaggagggattgtgagtttagagggatgaggctattaagagcatgcccaacagattacttattctattccctatcctcgaattaaagaaattttaaccaaaattctcatccaacagattccctaacctacctcccaataatgcaggttcccatatccgtatatctcgttactcatttgcagggaaccactttttcttcccaatcgcggtggtcgctgcttcgcgcgcgtagggggaaaatgttcccacgctccttttctcgccctactcaccagcaacaaaattcctcttcctcccaggcgtcagcggcggctttccaggcggcgaagcaacggccaaccccttcctcgcaggcgtcgtcgacggagttccacgtggagatgcagcagtcgtccccttcctctcagtcacaggggttggcgtcgatgttgctccaggcagcgatgtagcggccatacccctcctctcaggcgcaggcgccggcgttgctccaggcggctatgcagccgccgtcctcttcctcgcaggtgtcggcgtcggcgttgttccagggggtgcccgcacgtcgaccaccgctgccggcgcaagccccaccacctcctcgatttggggccgacggccctctgcgccccgcaccgctgcctcgccgtcgtcttcctcaacctccctactccagtatgcaggcgagagagtccatggggggacatgctccatgggagacactgaatcccctctcatacgaagctcctggcatcgatttctccacagcttattctgtgtgtgatgaagaattcctccatatgagcaatttcggtaaggctgtccctgattcgttcgatgtttagattaattttcagagtgttgcagcctgatctgatgtccattctatgactgacttccccggctagaattcaggaattcaggattcagaacacttagaggaaaatgtcagaaagtctgaaatttgtaccgtatcgaatggaagtctgaaatatgcaggatatgctctaaatctgaaagtctgaacacttataggaaatcaggtttcagaatatttagtaatgaaggatatgctctaaatgtgtggtatgctctgaaagtctgaaatatgctgtcaaatatttttgctatgtcaaatgtactcccaaagtctgaaatatgctctgaaag

SEQ ID NO: 58927 - DNA, 1930 bp, Oryza sativa
caagatgcagtccatagtctatttttcaagataaaagaaccacctgcttttgccaatcagactttcagtttcatgaaagctgcaactacagaattataagtacaacaacataagtttagtaggattataataacttatacagttcttagctctaagtacaacagctgcttaattgaagtgatcatctgcatttagtatgcctcactttttagattagcagatgaacaaccacatgcttgtgccaaatattgaaaatagtgtctgaaagatgcaatttcagtatgtatgtgcctaatcactcactgtcgctgacatttattcttctttagttcccttctctgatgccatcatagacagtatgtgctctgaaatattgagaaactacttgctctgaatttttgctatgctctgaaagtatacaagtctgctttttttttttcctcaagtacatgctaacaaggttccccgattaattactgcatgacctataacagatccaccacgctttggaacttcatcatcgtcgaactcaccgtgcactatatcaaccgccgaagaaataaattcttcgtcaccatccgatgaaaactcatccaatagcatttggaggagggtgcttcgacgactcatctcctctttttgtttgccacggtgttggagcgtttaccacagggatgaagtgcaatggagggaactgatggcaggaatagaacaataatcaatctgcaaaattaattatcagatcaaacttaatattttccaacaatatatatccacatcaaaatactgacatagagattgactacggcacaagagattaatgggatttgctaaggattacctccttgatgacacgaattgctacgacatctccttggtgttccgttttttaacaaatcgcagcagtcaggacactggttggctggctggtgatgatggcgctaggtcacggcggcgcaagtgtggggaggaagaagtcgatcggcgctggtgcgggagggagaagacgtgcgcaagtaccgaactgggccccaccttgcttatgtggcaaactaacaaatgatagggaattgatttttgggcttctcttggaggagggggtcattgttgggcccaatttttattttggtattcctaattcagattttttgggaatcaaatattgggtgattgttgggcatgctctaagtgatttgtttggttgggagacatggaaaatttagtgggatagggatggtgaattgaggaaggaactccctccttttcaatacctgggtaggggcaggtaattgggagggaattcctcctttactttttctaagcaaatctgagccatctgtttttattaatgacttaatctccaactaaactccctatcaatttccattacctctaccaaacaagatattgagattaaaaatcaaattcccatcttaatctcattatcaattccctcgtgtaaactcccaatctccttccctcgagttaccaaacaagccgttagatcactaagaatacgtatataaaagttttattcacaaattttttccatttacaaatatgccgatgggtcctggtgatttacttaacaaatgtttgattagatcttcagttttatatacaaattcgttttgtctaaacagataaaattgacttattaatcttgggaaggccgttactcactctagactttactcctccttatctttttttttcttgaacgaacatttcatttcttatatttttgcatagtttttttaaggtagttatagacaaaagtgataatgattgggcttctaaataatgggtaagacttgtctccaacaagtgacccataagggcacctaaatctaaaatgggtttccgatagtattatttcagcctccaacagagtacctatacagaagacctattttacgtgctataagac

SEQ ID NO: 58928 - DNA, 5849 bp, Oryza sativa
tttcgccacgtcagcgatccgcaccgaaatgcatcgcagccgtttacggaaacagcatcgaacgtcacacgttcgtccacgttatcgatccgtggggaaaccactccaccaatcagcgcccacctcaagttcgctataaagtcgtcgcccccgtccccattctcttccccacatcgcagtcttgcaaacacacgcagcaaaatccacaccgcttcccctccccgagaagaagagagcagcatccatggcgcccaaggcggagaagaagccggccgcgaagaagcccgcggaggaggagcccgcggcggagaaggccgagaaggccccggcggggaagaagcccaaggcggagaagcgtctccccgccggcaagggcgagaagggcagcggcgaggggaagaaggcggggcggaagaaggggaagaagagcgtcgagacctacaagatctacatcttcaaggtgctcaagcaggtccaccccgacatcggcatctcctccaaggccatgtccatcatgaactccttcatcaacgacatcttcgagaagctcgccggcgaggccgccaagctcgcccgctacaacaagaagcccaccatcacctcccgggagatccagacctccgtccgcctcgtcctccccggcgagcttgccaagcacgccgtctccgagggcaccaaggccgtcaccaagttcacttccgcttaggctgcacctggtgctattgtgctagtagtaatattagtttgatctatttatctactagctgtagtgcatcaatgatgggaaatggatgttggggatttagtgactgtaagaagaattaggtggggctgcttttgaggaacttctgtttcatggattcgaaatacactagtaatgcttttgtatcatgtgaatatgtgatctctcctatgttgtctttggttgccttgtgctgaacttgtgtttgttttaattaatttatgtctaattttggggaactaatctttgtgttgtagtaactatttgcattgtcttgcaaattcctcgtcatgttaccggaattgattctggagcatgcatgtttggagtttggaactgctgatgtgctcatgtagacgttattatggaagattgctattatttttgtttctgattaccttaattagctaatgtcactggccacaagacgaatttcactgggctccttttggggaactttttttttttctcatggatcaggaatactctttgatttccttgtgcttgaaggtgaactagtgatgcttatgtctagttttgtggaattaatcttcatgctattgctatttttcattgtctagcaaatcatcaaatccctctgcttgttactggaattttatttcttgagcatctattttggagtttggtactgctcgttggattatgttagttttagatttatggactggcactacttttgtactttggaccgtttgtggactgagcatttggagttcatgatgtttgcattcgaaacaaaacagaggttgttagaagagattagaactttgaaaattgtagtaaactttgttttagcttcgtctggtactaattcaaagaaatctaactcaagtggaaatagtactgaaactccacatatattgcctttgctatttcactatttcaggattatgcatgcctgcccgtttgctacatttctgtcctgaatgtcttatggaggttcctctgttgaagattagctaacaacaaatatgaggtatgcatcttttatcaaaccttgctttgggctgttctgttctgtgcaagatgtgctgactgaagagtgaagatgggactcttgtgggacttcttgtaatgcaatccttttattttctattcagggagattatttgaggtgatcaattatctttaaggttctacagggagagcatcctgaatttctgtttggcttgttcaaattaaatattccatgccaaacaactttagctttaactgattactgtggatatgtactagtatctttttctcatgaaaaagctttatagtggctagtacaaatccacagcgactgaaatgatggatctcatatttcttgggtgaacaatccttcattcctatttggttaattgtttgggctattgttcttctattctataattgtcatggatttggtatcctgtgctagaactgtttagatgcgatcttttttgctgctttgtttatgtcgaatctgaaaactggttgcctgggtatttgagtcagggagttaggaaattttgctgctatggttctgtaggtaactaggaattggtattgaattattattggtgctgcgtaacctttatttaacctctaaaatgcacgaccagtaactatagttggccataaggcccgaggcccgaaggcccggcccacggcacgcctttttggcccggcccaagcacggcacggcccgacttgggtcgggcccgtgctggcccggcccgaccgtcgggccgtgcctgggcctccccaccggcacgctgggctggcccggcacggtcgggccggcccggcacgatgggccggcaggccaggcccggtacataaagtatggggactaaaaatagacatataaatgtaactgtctaaagaatagggaccttaaatagacttattttagctatttatataccccagcccaaagaagagggaggtaaaatagactttttgtagctgtacatatgtcacagcccaataggagggaggaaatttagacttattctgaggaaaagcacgacggcccatcgtgccttcgggccggcccggcacggcccgaggcgtgttgggccgtgcctgggccgtgagtgcggcacgtgggctggcacggcacggcccggtgcgtcggtcgggccgtgccggcccgacaagcctcggcccaggcacggccgggcctgggccgtgccgtgccgggcggcccacatggccaactataccagtaaccatggaaccttgtatgcagctgattattccaggtacagtcatcgatactacacatatgcatattgcccaatatttatgaatgttgctctactgttcattgcccgactcaacatttagttaagagtgctctgttcattttcaaccatccaagacctgagatattcatctctgattgcatgaatctctgatgcagcatctggtaacagcattcggtctctgggttgttgctttgagcaggataagccgagcctaagaacggacaccaaacactgttgaataattcttctttttgtgcttgcatttgtcccatctgtatcatttgcttcttcatgcagccagattgttcgatcagctatgttcatggcgctctcaagaaaagaagctgcaacaaacttgtgcagatccattgaatccctgaaaatgtcatcagtgggacttcttccattaaacatctcaagcaacaatatacctaagctgtaagtatcacctgctctggttactgcagaaccttctccatactctacaatatttgcagttaaagttagtttttcaccgtactaccgacatgtaaaagatacaaagttccagtccaacccccacccatgagggaggaggtggagaaattgtaggatataatacaaaaatataatatttttgacctacctggtgcaatatatccaatggaacctcggattccaattgagctttttgaatattgaagagttctagttgtgcttttggggaggatttttgatatgccaaaatctccaacctttgcactcatgtcttctgcaagaagaatattacttggtttcaggtcacaatgaatgatcggtggctgacaactgttgtgaagataatccagtgcgtccaagatatcaaccacaatgctgagtctctgcgaaaggctcagtgtattgctgggagtgggattgcttgacgtgggatggagccgactatctaagcttccgttgggcatgtactcgagggctaatgccttgaactcctgaccctgtgggtcaatacttgaacgacaagtgatgatctttgtcagacaacgatggcgaactcttctcaaagcctcacattcagcctgaaagctccttgaagatcctaattgtttaaggtcgaacacttttatggctacaggttcaccctcatcttgtaaagtgcatttataaacagaaccatatcttcctttgccaagcaagtttgcttctgaaaattcattgcttcctcttgataatgcataatatgaaatcctctgatattgttcctctataaccggagatatctcttggctattttgtcttccttttagtttcctgtgctgtaacataatcagaacaatagctgaagctaacaccagaattgctcctgttgttatgaaagctactttaagatatttcatccgttcttttctgtcctttcttacagcaggaattggacatggagccaagtgaagccgaggtattccaccacacaacttgtcgttccctgcaactgatgcatacgtaaggttcctgaaagcaccttcatctggtactttgccttgcaaattattgaaggacacatctaagtgccacagctgtgtcaaattttgtagggtttctgggattgatcctgacaaattgttgtgagctagacacagctgttgcagattgcccatgctaccaatggcattggggatgctaccagaaaacttgttcatggttaggttcagtatggcgatcccttttagttttgtcaaagattgaggtatgcttccttcaaacgagttgctatctagcagcaggtattccagcacctcacaatttcctatactgtcaggtatttgatcagatagctggtttcctgacagttctatactgtttaggttaaccaaggtaccaacttctgatggaatgggtcctgagagagtattatctgacaagattaagaaccaagaaagtgacggcagctcaaaaatttcttttgggaccgaaccgttcagatggtttatggacaaatctagagcaaatagcttctttagcttcccaagggttgcaggtattgggccttccaaatgggcatcgtatgcggctagtatattcaaattggtaagatttccaattactgacggtatgaggcctgacaatctagtgctgtacagagtaattatggccaagtctgctagcttccctatgctctcaggaatcactcctgacaaagaagtggaccctagatcgagcgtgtccaagccaatcaaattgccaatgtctgtggggatgctcccggagacgctattaccacgtaagaagaacttttgaagtgttgtcgacaggttaacaatagagattggcagctgcccaatgaaagaattttctgcgatatctagctgttgcagctgactgcagttggcaagtgaagttataaattcccagcccttcatgttatttgcctcaagtcggttgctagacaaggatagacgcacaagagatttcaaccttcccacggtaggaggcacaaatccactgaatttgttaccatcaaggtatacgtctgtgagtgatgatagattgaataaggaagaggggatgactccgctaaactggttcacagacagaacaaagtgttgcatgttaggtaatttgtcgccaatgttggcgggaatgcttcctttgagcttgttctcatatacttggagaacagtcagttttgacagattccatatggagggcgggaattcgccagagaggctgtttccgtcaagaccaatcttctgcagatttgggatgtttccgaggcttgacgggatcaggcctttcaggtggttgaagtccaactttaggaactcaagcgatgataggtttgctagcgaggctggaatcggccctgtgaagct

SEQ ID NO: 58929 - DNA, 5376 bp, Oryza sativa
acctaatctgtcaggactcggggcttttacgagtgcattgtgctgctctttccaacaaatgcaagtggtcagggttaagtgcagagcacggtgtgtgctgtccgccatactcgatgatcagtaaagtgggtcacgtagtttttgacatatggtagctgttgacatggacgaggagcaccggacgatacgccagcaacagcagccttgccgtcgtcgtcgctgccaccggtcgccctcatcgtcaatcctccgccattgcggtcttctgaagcacggaccaaggttcttgtttctttgagcacccttttagtgctttttcctagaattggaattcatgatatccctgattatcttgccaactgttaaattttggtgattcatctattgcgaatcaagcattagtcatagcatttgtgatagttgatgttgtcgtaggtgatcagtaacatgcattagtggtgattactgattagtcaggtcaggtgtgtagtttagacatggaaaaaccaccgaaaactgtgttggtagtagaagtgttgaattccgaagtgtatatactcccataatctaactcatgaaacatacagattcacaaaaaatctgtcttctttctctgttccaatcgcgatggcgaagtgatgaggtgcgatagttggcgaagtggaggtgtacggcaattcacagtcgcaaattctcctggtctatattccattaattccagcagataaatatttcactgccatggtgatatatctcgacgagacgacggcgtccagggtcaagcaacaatgacgggggaaacttcgatggtcgacaatggtgatatataggcaacattagagcaagtataatagaacggttgttgctggcattggctcggatcggcagatggcggagtccttgggcttgaagcgtgatggaagcttgcggggccaaaataagtgaaactatatatttacaaacgaaaaataatttatgaataaaatttttatatacgttttcttaactatctaaaaacaaatactgaaaaataaactttgataagaaaacgttaaaatcagctctaaatttaaggctgaaaattcaaattctagctgataagtataaacttaagcgaaaagatgagactcttagaatatccttgtggcaggaacaagattgtgtgaagattggagggagcattatgaggttgttaaaacgttagatatgaaaaggctttcatatcgatgtgtagtaagagaggagtgagtgttcgctgggaatcggcgcgcaccaccgcagaccctgcccactgcactaggcgcgattctcacgtgtatactttacatgttttaaacaattttttcctacaaaatttatttgatctacaattcagttacaccatcatatttggtacaagtaaatcttatatataggctgttacaccatccataattcgattacaggatgtcacatgattatatattttttaaaaaaaatatatccgtacttaaaaaatatataccatatactccctccgtcccataatgtaaggaattttgagtatttgcttccactatttgaccacttgtcttattcaaaaaattttggaattattatttatttttttgtgacttactttattatccaaagtactttaagcacaacttttcattttttatatttgcataaattttttgaataagatgagtggtcaaacactagaagcaaaaacttaaaatcccttatattatgggacggagggagtatgaaatatcaagttaaaacgaatgaaacattataaaaatacttcctgaaacatccagagaagctttgttcggaagttggttactgccggctggcagcagcagcttgaacaatatttttgctgctgattcagttgttgcaggcttgtagtacagcgttgtggctgcacaggaattgttgccgaacacaggccactatatacaattttcacaaataaaactagtgaaacatcgtaaaatacttattgaaacatccaaataataccatcagaaatatttaaaaagattcattgcaacgtaaaacttaaatgtgcaacggaattgaattttggttgaaacattgtttccaatacgcaaaacatcaattttcactaattgaaacatatgtattttatatgaaatcttgatgtagagttttaattataacgaatagaacaatataatcgaatcacatatttgataaataatttagaagaaaaatcattttgaagattgctaggtaaacaattaatgcatattacatgaaatatgcatactcctttatggagagacagtgaatgagcactttccgtggagaggaaagaataaagaacaactcgcgtacaatgtttttccctttgcattcccccaattattttggttgttcaggagcggacactgtgtaggttataggaattcacccaaacttttttctcttgaaaagaaatactatatgtaaatactagaagatataatgatactgcataagtaaatactttgctgggcctaatacctcgttcttaggcctaatactctgctgggcctcctcccgactcaccggcccaataactgcccaggacgcttcctccctaatcgtcatctcctcccggtccccgtcccccgatccccaatcattcctcccctgacgccgcgccgcaactcgccgccactccccgtcgccgccgccgccgcttgtcgaagctggtttgggggattcggggatttgacggattagaggtgactgaactctcgctctcctgctgaaatcataccgtatttttgtgatgatttatggggaggaacctaggttttgatgagagaggcgaacactgatttgattcatccaacgcgttatattcacatcctaacatccagcctttgcgcctacgcatcaggaatcgcagtcgcagatggaggccatggacgacatggcggctctgacggaggacatcctcctccagatcttctcccgcgtgggcagcatcaaggacctcttcaagttcgccgtgacatgccggcggtggctgcgccgcttcaccgacccggccttcctccgcgggctgtgcctggacagcggcgagggccaccgcgcgcgcctcctcggcttcttcttccagcagacgagattctatcgctgcgaaaagatgatcaagatgcgggtgacgcagcagagctcggtctgtccgcccaccttcctgccggcgccgtggtcgccgctcggcctcacggatcgcaccctcacctccttcctcgccgccgacgacgacaccttcaactacgccgagcccctcgcagcgcgctgcggcattgtcctgatgcggcttgtcccccgcaccgcgctgatgatagcgtgcagccacctcctcggcgtctgcaacccgatcaccggggaatgccacgttctcccgcctctgaatctctccggcctccatcgctacttgaccagctacgccatcatcacgtccaccgacagcgacctagatgggaagcagccgccatcatcatcatcgtcagggcgctccacgttctcgcagctgtacctcgtcgtccaacacaagaaagactgtaacgagtacttctactcctactctgctgctacgtgcagctggagcgctcccaccatgtgcgtggacggccgccgcttctccctggtgggtgagagatccgccgtcgttcacaagggcgcggcgcactggctgtttattgatcgtgtatctagcgcaacccaagatgacatactgtacaaactcaccgcggcggtggacacctcagaaatctccttgacaaggctcccctttggtgctggaggctcaccgctcctctgcgtcagtggagacggcaaactttcggtcgcttgcgtgtttcccatccacatgagagtttggactcagcaagatgacacccctgcaacgtggctccgcactgtgatcaggataccattggcggtgccttacccagactattcccatatatgtcagccccgcgagaagtggtttaacttcaacaggggatcaatgctcgtgctgtacaggagcaacggcgtcttcatcctcgacctcgagaagaaggtgatggaaaaggtcatggactgcttactgcccctattcagtgataaactgaacaggacggctgtggcgtatgagatggacttggttgagttctttgtgctccagctcagtggtctatgtagagggtctacaggataattacagatgttatgcagtgggaaaatatatgttctagaataagcaagtttaagttaaacaacagcatattacatggatcatatgcaaactgtgcaaactggcgagtgatatatcttgttctgtagcacggcattgtcattttgatatggtttgacctttactggtttccactgtaacatcccttcactggaaaaacaaattctcttgatcttacagttcacaactacgcaggtggcatttgcggcacagttcacaattttctttgtttgcctgttacgcttgctagcaccttaatttgtcaacttattgctagtgttaatacttatacatctgatggtgtaaatcaaaatagtttctttcatctgagaatccctgattgatctgtttgtaagctgtgttcttgttttgtatggtctgagtaccagctgctttaggtagagtaactgactgtcagttcctgagaatgccgtaatgctagttgtattccatagaactgtgattccttgcagtttacattgtctttattttatattcgatttcttattattattcggctagtaaatgcgagtttcctctggaatctgaatgtaccactttgagctcttaggagttgaagtgagttggagctagattgttagatcctgacgtttttttcttgttactgtgaagaacctgtttgtgctttctctaaaattggacttatatgcacgatatccttgattattttgtctactgtcaaaatctgatcacccatttatcagaaatcatgcattagtcacatttgtgataattgatcgtaggcaagaagtctatattgatgtttgacatccttgagtagtggttgctgatttgtcagctattgtctagacatggaaaagctactgctgaaaggccttcgagttctgaaggttatatactcctacatcttacatagaatttggatagaatgcgtctgttttgtttgtagttagtggcttagtgcacactgttgaatttgatagtatttgcaatacagtgttatatgctgctaaactaaggctgtgttcgtttgtgtgagatagggtgagaaaacacctcgttttccgcgcgcacgcttcctaaactactaaacgatgcgttttttgcaaaaattttctataggaaagttgccttaaaaaatcatataa

SEQ ID NO: 58930 - DNA, 1837 bp, Oryza sativa
atgtcctgaatcctgatagcatttttgtgtatgactgtatggtactagtttcatcgtttgacctaataagttttaaaacaatttattaattagaaaaaaaattgtctttcatatatatgtgcatgtgaaaaatgataaaaagcctcaaaatctattctaaattcactttaaaattcaaattttgattgcggctaataaccaataacaaacaatgtggttttagtattgtttaggacatccattttacatgcgacaatattttagtaattcgctacaattttctttcttttttcgagacatctattttttcaaactgctaggtataaaatcacttaaatttgaagtttggattagttatggcaatgtatgcgataagattagctcaagcctgttggtgtagcacagttacaccccttcataatccattagctagattgaacttgcgaaacaataatatgtacaccttgatgcttggtccatttggaacgaaaggaacaaccgtgtattcaacaattgcatacggttatggcctaaggttgttggttttgttgcagccatggtgcaagaaaccaccctttggcggcatgcccatcccttgtcgctcacactccctcagggtagtatactcggtcgctaggtcgtcacattgttagcgagagaatagcctcaagtattttttttaaccaagggcacgcgtaggacactagcttgcttgtgtgggtaagcagagtccaacacccagttattcaagagacatgtagatcgatctagccttcaagcttgcctacctaggaagcaggcttcaggccaatgaaaacgtcagtcaggacagtcttggattgcagggaagccttaagaatcgccagaccctgcagagaatcaacaaatacatgcataccgcctaaaaccaactgatattaagttccaacaatcaagtagagtcatgtgtacggttacgaatgtaatcacctcagtgtagccgagctgcacggtcttctccttgagcgcgcccaagtccttgaccgcgaacctgttgagcagcgtgatgctggagatggacgacatgggcgccacggtgagatcgtccatcaccgtgtacgtcacgatgccctgcacgaaccctcctcctttcgccccttcggcggcggcgttctgcgtgttctgatcttggccgccggcaacataggtgcatgccgttgccatctggttgccgcagttaggacacttcgtgccgctcgcgttcgtcacgaagcttctgcaggcgttgctgctgtagctgcatctgaagaagctcttgcttgactgcgcagaagacggcgccggcaagcggaggacggaggtgttggagctggccgccggcgagagcacgacggggctgagcagcgagtccttggcggtgtcggcctggacgaaggcgtcgtcgagcttctcgaaactggcgtagaggttgccgacgcagccgaccatggagcccttcccgagcagcttgatgcccgaggcgatcggcagcgcgaggagggagaggaggaagtcgacgacgtccttgcgtgcctcggcgtacagcacgcgctgcgccttggtgtcgatcaggagtgtcatgctcatcagatcgctacttgccttttggctggttgtttcagaagccatttttgcagtagttgcagtgtgcagtggcctgcgtctgaactctgaagtcgaagtctcgttttgcctgctgcattctggaatttacagcgtaacagacgagagcatcgaggttcacggggaagaagagagtaatttatttgcaaattaaccgctcattgtgaactttaattcctaatcaatcaatgccgtt

SEQ ID NO: 58931 - DNA, 16057 bp, Oryza sativa
gaaacgctaagcgaataaacgataaaaaataatagatcaatcgtagaagacacgagatttaacgtgaaaaatccttttaaaataggagagaaaaaaccacgggcgccagccagcaaaatatattcactatatctgaggtgagattacatcgccgcacggcggcttacaagaggtacatatattgtggaaccctgaaagggatcaagcctcccggcgacgggcctccgctccactacggtagaaactggcctttattaaatgcaaatgaatttgtatcaacatgagcaaatgaccgtggtgccaaagcgatcgcgtgaatgtgagatacgatcaactgcactggtagcgataaagagaagattgaacgcactgattctagtcgtccgttcagcgaaaagcccatctggtttaccagttggcacagcctaaattaaatcacaacccattgatagcaattacgggccaggcccatctctccatcaaaagctcaaggccatctgtgattttgttctataactcgtacagaagacatcacataatcaacaccaatgtatcttgcctaactaggtaataagtagcagggctaagtagtaggtctttataaagtgggtcccacgagaaaaaaaatattgctttttaattgctttttgtccaactcagcatgcagtagtagcacatcttgtgttggaaggagagagtgaaagagattttaatgtttttttattcttatgagtgggtcataagcttactacctagcattagttactacccactttcacaatgcttattactaggtcataggaatattatattgcctaatacctgctttttcctaacattgtggatgccctaagagtttcaaatcgactggtcacgcttgcggcttgccagcaagcaaaataaacaacaagagaaggaccaacacaaatggccatttcttccgcttcttgccaaggaaaacatctgtaagcaccgtcttcgactgcagcgacgccttcagcatagccaaaccctgcagtacagtgtaaaacaaaatggttaataaaacacaaatcaaaatgtaccaaaacttcatatgataacaacctcagtgtagccgatctgcacggtcttctcctggagcgacttgatgtgagtgacaccggatttgaccagcgcgatggtggacatgggcgcgaccttgaggtcatccatgacggcgtatgtcaccaacccctgcacaaaccccgtgcctgcgattgcagacggcgcactcgcggtcgccggcacctcgccgccggtggatccagcaatggtggtgctcgacaccatcacatgcttcaccggcaaactcatcttgccgctgcactgcggcaactgacaaggcaagccactcaccgtggagacgtagttgcagcaatcaccgaacctactcgcgctgccccggtaaagctccgtggaggccggcggcggcgccgccgcattgatctccggcaggtggagaaaattatgaaaaaaattaaaaagacaagtcgcgcataaagtattaattatgttttatcatctaacaacaataaaaatactaattataaaaaaatttcatataagacggacagtcaaacgttggcacggaaacctagggtttgctttttttttgggacggagagagtaaagtgctaatgctaacatttcgtcatagataggtgttgttctgagacaaattttttgaacgaacaacgaattttacaaccacacgaggagaacgtccatgtatgtgcacatttctactagtgacacgtgctaaatactgtttctagtatttaaaattagatgcgcagattaacactctcattattatttagtttgttttcattaggaatttactgtttccaataggaaaattaattcgtgagacttgcatatctcttaaacatgtgttgaagggggccaaaaaacttcaaatttttaagacgaatactactggtgcgttacaaaattcgcgtgaagtacgacgttggctactttgctgatctgatcaaattggcctcgattcctcaaaccagcataggaccagcggtgtgcagtccgcctcgcgccgaggaagacatcggtgagcactgtcatagaccgcaacgacgccttcagccacacttaagccaaaatctctaataccgattgcagggttagaacccttgctattgattgggccacgtggcatcacgcatagctcacgaccagattctcggctggagaacatgccacgcattcgaactgtcccatagccgtccgattacatacgaacggtgagaaaaggcctagcggacctaaatataaattgcaagttttaagaagggtttttaacaaaatgcacaatcttatctagaacagtccagagtatatgaaaaaagacccagaatcagaaaaaaaaaaatccagcaagaacaatatacagtattcccctttcctaatcaccatgccgtcgcgtagatggcaaatacggggacgatgagctcgagctcgattgacctggtgctccttggccccgccctgccttgatccgtgcgaggcgacgatgcgcctagacgatacgggggaagcgaaggatccgacgacggagttgtagacgacattggagggagcccgctgagatagagagcgccataggggatacctccgcgctggtcctggagcttgacggcccgcgcggggccttgatacgcgcctgctcaccagctagcgctgcctcatatagacgagtagggacggcggcggaggtccacgccgtcgctacatccgcggggatcagctcggctcaacgccaccctgcttgtcgccggcttcctttaccgcctctgcgatcaaccgctcgcatcgtctcctcgatatcctccttgccgcttctgccaccatggccggtcgcaccgccccctcgacccttccgccaccaccgcgacctcacctcatcgccgagccgctcgtcgccggagatcggaggcggagacaacggagttggtggtggcaggacggccggcagtcaacccgatggcggggcctccggctcactcttaacccgctgccgttcgaccacgccacctccgctgcctccgtgatgcatgcagagctggccagcttgaagccttgaacccagtgaccaaagaagccagttacctcttgcatttgcaagcggcctcacccatcagttctttctcagcgcaaatccatgctggaaagtggaaactgaaaagcacaagccacaacaatagtagcgcagtaggtgcagtacagtggagtacgagagaagaagagtgaactgggattgaaagcagaggtgggttctcaaaaaaaaagaaagcagaggtggacgacggggcatatgcatgcatggagcacgtcactgctcccaattcccaatggccacctgctaacttacacgtgccatcaactcctaacaaattttctttttcacccctaataatatttttttattctatacttcactaaatacaaaatattttaaaaaatgcccctaggttagtactcatgtatttatgtttaggaccttagaagttttgacttttcaagacttgtttgtctgtctgagtctgaatcgtctgatgtacaaagagtaacataaacatattatgactctatattgagttgatgataggagtcatttacttaaaaaaatatgcattctaaattttgtaattttcatgtaatttgataaattttgtaaatcctactaatttaaaagacatatcttccaaagtagtatttgttaaaggcatacagatacacttaaagaagttaattatccgttacaaatcttttttaaaaagttgaaatataattattcaccggacaagtactgctagctaaatacgacacataagaattagccaggcataaactaaccatatttactcttattgttgacaatattgttataattgtattctattttatctatgattagctaatcaacctgacaatctctatattgtgagataaatataggtggagggtatatcatatactgaccatataggtaagtaggtggcactaatagtaaacaaccttaagctttcagtcctctaaccatatctaatcataccaattataaatatatgttatttactctgtctaatggaagagaaaaaaggtttgaaagtaaataggcaagtattacaaataaaataaaataaagttttttaaattttttttccgtagtaatgctttaacaaagcttaaaatctttatatgaatagggttactacaggttaattgttcctcaaccttttcaaaagtcattaaatagtttcttctaaatgaacaagtgtatatatttttttctaaaaaaagtaaaatattgcatttgaaactcttaacagcaacaacaataactattataaatatgtaaatatgtactagctataagttggttttccaacgggcacgctgattttcttgaataggaaagcagggaattggaaaagactatagaaggaggatttggggaatgtttaagtttgttgccactttcaatcttaccgaattttggcattgccaaattttggtagtaaacacacttcaactattacgatgttacccaattttggcagttccagaagctctctcttaaaggcatcaaaatgtagtaaaggcatcaaaccaaacaaagcgaatgttaccaaaatttgataataccaaaatgtgttaaaattcgacattactaaaatttgatatggtcaatttttcaaacaaagtgtacaaaccatttatatctatttccgattctaatttttagggtgttcaatgaaaaatgttggactacttattatcgaaaccattcctaagccattatgcattattgggtaagttgaatgtaaaattttgtgattatgtagccttttttatatatatacaaatttagttatgatcaattcgtaattaccaggcttcataattaacagtgtactgggttcatgtaattgagctggcctatgtatactaaggcgtggcaaagccgcggttattttctagtgtatatcagaaattaatctctattgcaaatatctaaaattaagtcgatcacctgtaagtagccgacctcgacggtcttctcctacaattccctgatgtccatcacgccaagcgccacgagggcggcgatggcggagacggtggacgacggcgcgacggtgaggtcatccatcactgtgtacgtcaccttgccggggttaagccgaatagtactagttagagcaaataatagtatagtccactactagctccaatttatctatagtcaatctaatagctaattcatacaatagttgcttactatattattaatatattgtcccacctgtcatacacacattacattttggagttcgtgctgcagctggctacagatctatagcccgctgctcttctctctcatcgtttatctcattaaaatatgtttacagctggctaatagtctgctattgtacctgctcttaagcgggcctgacctatctctccctggataccccaaggcccatatgttcctattcaggccccctttgattcaaaggaaattcataggaattttaaaggattttattcctgtaggaatttttcctatatagccctttgaatcaaaggaatgaatactatggaatcctatgaaattcctatggaataccttttcccatgcaagttttggaggaaatttagcatgaggtagaacctcatattaagaatcctttgagtctttatctctccttaaattcctgtgtttttcttacggttcaatcaaacggtcattcctatgtttttcctgtgttttgtaatcctctgttttacacttatattcctgtgagaatcctatgtttttactattcctctgatttttcattcctgtgattcaaagggtcgattttgttccggaaccggtacagatgattgaagaacatacgatatcaatacgtgacaaactgacaatagaacggcaataattcatagagttcggaactctcactccccggcacataaaacaaagtagcgtttagtgcgtgattaattatggtttagctatttttttcatacatggagtataattttataagtaactttcgtatagaaactttttgtaaaaaaaaaagtaccgtttagcagtttgaaaaagtgcacatgaaaaacgaggaagaagagttgtgaacggctgggaacgaacgcatcctagatcgactgacaaaagcaccaccaacacataagatagctcaatggccggacaaggaacatgaacgttccaacaaaagcaaacgaggctcccgcgcaggcgatcacatcacatcaggccttcctcttcttgccaaggaagacatctgtgagcaccgtcttcgactgcagcgacgccttcagcatcgccaagccctgcaatagtgttgtacaaaattgacaaacagatcggaacagagagatgagagtacgcactgcaagcaatacacattgctcgtagagaaatagtagcactttacctcagtgtagccatctgcacggtcttctcctggagcgaggtgatgtcagtaacaccgaaggtggtgagcagcgtgatgccggagatggtggacatgggcgcgaccctgaggtcatccatgatcgtgtacgtcaccaccccctgcacaaatcccgtgccggcaacagcatatgctggttgcgccgcctcgccgccgctggccgatccggtagctgtagtgctcgtgctcgacaccacaagcttcattgccaccgtcatcttgccagggcatcgagcgatctgacaacgcaagccactcaccgtggaaacatagtcatagcactcgttgtagtcgcacgagctgcagcggtaaagtttcgtggccagcggcgccgccgtctccggcagctggaggagcttgccggtgtcgaagccaccggccggcgcgagcagcacgttcctggcgtcggcggagcggacgtaggtggcgtcgaggtcctcgacgctggcgtacagctcgccgatggagccgaccatggagtccttggagagaaccttgacgacggtgccgacggggagggtgaggagggagaagaggaagtcgacgacgtccttgccggcctccgcgtacagcacgcgctgcgccttgctgtccaccagcagcttcatgctcagcgccttcgagctggttgtctccgtcgccatcgtagcaactagcaagtgcttgtggctagcttggattggcttgctgtgtgagcagtagaatttatagcgagcagagacgagcaggaaggattacggacgagaggagagtaattagccgcccactgtaaattttcttgatcgatcaagcttttttgcatgcaaaaattgcagtcccaatatatgcgcgcatgtagacggtcaaattaataccgatcggttcagctccgccgcacgtagtatcagcacttgaatgaatcacccatttatgcgaggcaaccgaagcatcatgaatgcgactaccggtgcgtagaggaggttaatttgaaaagaaccaataatttgttttttttttgcgagatgtagaagttgaatttaaacttgcatgtttatgaagtgatatatcacatgttaatacgtcttcttttttttttcaaatttatttaagtgacatgcaaataacgagatgatatcctctcgagggataaaaatccactccccgaattatgaaatcacttttcctaataaaaactttaatgactatttaggtgtcacgcccggaatttctatccaaaattccaaacgcttacatgtgtgtgaacccttgtccaggaatcagccgaggcacacaataacaaattgataatagagtacaattattactctaattaataagcgaataaaatgtcattacagaggtagatagttcctctcaatcaataaagatctaagcagcggaaaataagataaacggcgcagacggctccactccacaggcagcttgaccaaggctacacctaatcctccacaccatcagcatcattgtagaactcttcctctaatgaatgattgcaaggtgagtatatgacatactcagcaagccacgcagcaaatatgtaagtgcacatgataacaaaggatggcatagtagggtttcatttgcaaaagcagcatttagcaaacatttgagaatttaataaaacagttaagtattaaacaatatttgtcggtgatatgggaccaggagtatcatgaccagaggcttgaggcagacgcaatcgcccacgtggcctggcaccttcggggacgtcgggcccgagggtgaggtgtccgccctcctcctgatttcccccgagggggggtcgggttacgcttgccccggccccgagggccgaggcaccccgaccccttaaagaagtctgcgccacatgtatgggataagtgagcacagctgtgctcacctaacagcatttattacagtctggtcaagcgtgtcacgctgcatgtaacgcagtacagcacgctcttttatccggtctgtgaccagtcacagaccggtcagatcaagggttaggtggcgactggcggtctgacgcgcgccttgccccatcccgtcaagacgaaagcctctaggcaactcgtctcaagccggagctagcgtgttatctcttagagatggcacgttagccctggttagatttataccaggcttcatcctaaccattacaggcaaggtgttacacgaagaagggcaaacatgcatcttgttaaactgacacatggtggacaaaagtgaccagtctgacactggtcgcgtcagcaacgggcagccacgatcccacgttgtgcccgtctccgccgggagtggaggtaggtgtgggctgtcccatcgaagtgtcattcgaacagcaaccataccaatctccgtccataaagagaagaaaagtccagtttggaaggaggagggtgcatgtggtatccccttgaagtataaaaggaggaccttgcccatagagaagggggttggttgattcttttccagatttagagcttagaacgggggagaagttggctgacacttggtagctcattcatacaccaatccacaaaaacacaggagtagggtattacgcttcccagcggcccgaacctgtatacatcgccgtgtctcgtgtttcttcctggcacgcgatctttccacacacagcgagagcttgagatctcaccctaagcccccggccgaactggcaaaggggggcctgcgcggtctcccggtgaggagccacgagctccgtcatctggcgcgccaggtagggggctcagtgtgtgttttctgagctctcatactcttccgtgtgcgccaagtttcccttgttctgcctaatggccgagcaagcaaaggcgcacgacctctctccgagtgtgagcggcgacgacggggagccaaacccgcgccgtcgagctcgtactcccccacctcctccacgccaaagtcctaagcagggggaggcgctcgagagggttgataaatccgcagcatcaccggtcgtgggtgatgcaggagaacggcgagatggggagcgtcgcctcctcgtctacggcgacggcagcacgcctcagggcgcgcttcaggctgctagcgcgctcctacgtcacccacccgtcgtccatgaccctgagtctccagctcagcgatggctggacgacgtggccaacttggtcgtgacggcccagcagcgcctgggtgctggtggacggtccgccaccaccaagacttccggcgccgccaccaccggttccgtgtcatcaaggcggagggcgcggcgagcggcggcggctgcacgtcattcggctgccactccctcgtcgacaccttcgactcgggaggatcagcatgaggagccggatgcccgcctcaacatcgagcgccggcgtaatagccggcgtactccccgtgcaacggagggcgcctcctcgtccagagtgtcacctcgacatggacgtgaggaccagccctccgtgcccccggctggtggtgtcggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcacggggttggctaatgaacctgccacccgcgtcggtccactcctgggaggatctgtgccagcagttcaccatgaactttcaaggcacttatccacgcccaggtgaagaagcggacttgcacgcagtacagcggggggatgatgaatcccttcgctcgtacattcagcgtttctgccaagtccgcaatactataccttgtatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccactcgaaaggggaggcctgcgtgcgacaaaaagaaagaggctggtactcccagcagggagcgccccgccggcaggtggtgctccgtccacaacacctccctccacgatctcgcggactgtcgcgcagtcaaaaacttggctgagcgaacgaggaagtgggaggaggacaggaggcaggaacgccgtgaggacaagtccgcggcagttccctccggtaaacggcgaagtgaggccagacagaaggcccccgccgttgaccccgatgacggtgatgatgacctaggtttccaagaacctggggccaccatcgccactgtcgacgggggagcgtgtgctcacgtttctcgccggagcttcaaggctatgaagcgagagcttctggccgcggcccctactcatgaggcgacgcgtcgggcgcggtggtcggaggtggccctcacctttgatcagaccgaccacccaccgtgcgttgcccggggagggcagattgcgatggtggtttcccccactatctgcaatgtgaagttggggcgtgtcctcatagatggaggagcggctctcaacatcctttcccccgcggcctttgatgctatcaaggccctggggatggtgctccgaccgtcccagccaattatcggtgtgacgccggggcacacgtggccattaggtcacatcgacctaccggtcaccttcggtggacccgccaacttccgcacggagcgggtgagcttcgatgtggcggacctcagtctgccctacaacgcggtcctagggaggcccgcgttggtgaagttcatggcggcggtccactacgcctacctccagatgaagatgccgggccccggtggccccatctctgtccgtggcgaccttaaagtcgcgctcgcttgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaatagggagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccagaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaagattaagttgatctatacaaaagaggcatgaaggccttagaagaaagaaaaagaaaaaatcaaagattgacgggggctcgggggctcattccgacgcgcccgggtcgccggcctcgtcgccaccgtcgtcctcaccactggcatcgccctcctcgtcggagctaggggcgaacgcgagccgaggggccgagccctcgaaaccgttgacgatgtggtcggcggcatcccggacgcgcgcgcgcgcgtcgtcctcggtcccgggagggaactcctccagcgccatccatggagagaagttggggtcccgggcctggtagctcgccagcacgagttcgaccgctccctgcgcgaggtccctcgaggatgacttgatggtcttctcaagctcctcggggagttgttcgagaacccaggccatcctgttgaggtgcggagcgaggccttccagattggtggggggcaccgacgtctggcctctccagaggcccgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgctttcgcccgcggccgccccgccgataggcgccctcgcgtccagctccttttcccgcgcctcgaggtcagcagcccgctgttccagtgcggctctctcggcgcggacgcattcaagattgcggcgcgcctgctcctcctgcgccgcctcgcgaagggacaggctgtccgccagccgtttggtcgtggcctcagcctcctcgagagcccgctcccgctcagcgagtgcgtcctcgcggaggcggagcgcgcactcctcctcggcgcaggcggcctcgtgcgccgccagcgtcgcctcccggagagcagcggcggcctcgcggtccatcaagcccctcaccacggtgccggcgtgttcttccagcgccatggcacgggactcaagggcctcctcgcgccgccgagacgtcgcttcagtctccgttacccgccgctctcgggcagcggcggagtcaaggaccccttgggcggcgtcgagctttttcttcagctccgcctcccagattgcgtgttgaaggcggagggtgtcttgcgcctcgatcatcgcggtggtggcgataagggcggcctctcgctcctcctccacctctcgggcgatctccgccagcgccgccttgcgggcttcaagctccgagatgtggcggcggtgagccttacggcccacctccaccatggcgtccaccgagcgccgcccctcctcaacgcgcgcccatgcggcctcgagctccgctcgttccgcacgcagggcctccacttgggcgttgaacccatccagcactgcggtgtttgcggcggccagggcctgcagaaggggctcggcgctcagcggggcgacagaagatgaggaaaagagccgccttggagaaaatgcgacgcggcttggccccccggaggatgcgctgggctcggggatgtcccccgggcccgtttggtcctgggcgtcgcccggtgaggtaggcccaggcgatgcgccagcggcctcgtcgcgagccgcctcggaggatgtcgcctgagggccgcccgagggagtgggcccaagtgacgcgccagcagcagctgtcgcctcagcctggcgagcccgggcggcctcctcccgggcagcttcttcggcttggcgagcccgggcggcctcccgggcggcctcttcagcttcccgaaggcgatctgcggcttcacgccggtcagcttctcgcctccgctcctctgcggccgccggatcttcggcctcggactggccggacttggggtggcgggaggaatgtgacggggcatcgctgaagcagaataaaaaaccagaagacaaacaagatgggtaagagaaaacttgcttaatgggatagaagaaagacggtcgcaataagaatggggcgaacctgcgagggggtcggttaaatgaccactttggaggggaaatcaggtttccccgggatggttccgtctcccccatcttgcggagccgcttcttcttgcgctccccctcgggctgcgacgtcggcgcggccccctccgggcgccgactgctggcacgcgccgccccgccccctcggggaggagatgtgggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgtagagggggaggatctcctgaggaatgcgagacgcctccgcggagctaagattcagcaccctttgaaccacgatcttgaagtcctcgggagcccaatcccatctggctccctgatgggtccgcatgtagtcttcaggcccagtgtactcccaggcgctccgggcgcgccgttggagcggcgcaatccggcggcggaggtaatcgccgtacaccatggccccggtgagcccctgggatcgcaggcccgccaggcggtcgaggacggcgtcgtagtcctcccccagatctaccggcgcccgccagctggagacctgcgccgggggctggcttggaagtcggaggcgcgtttcgttggcgaggggggtgtagaaccagtcgctcttccagtcgtcccacttcttgcggaggacgcaggggatgtagcggttcaacaccggcccccgcggctggaagtagcagccgccgaccaccgacggcggtgacaccgactgcacggtgaagaaccaccggaacagctgaagagaggggcgcaccccaatgaacatctcgcacaggtgcgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactcaggcatgaagcggcgcggcagtccggcgtgcctctcgttcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggagcaatggcgaaaggaaggaagcaaatccttttctcgatgcttttatacccttgccatcgctgggcctggctcctcgtttctcgcgcccactacctcgctccttcgtatctcgctatctcgctccctcgtttcccgtccccacgcttccactaatcccattcgcccgcttacggcgcatgaagtggatatgcggttgaggcgatcgaaacggattgtatcgtgcgcgcgttaattacgctcgccgaccgaagcggcgttgccgtatctccgggcgagacgaatctgctcgcccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcaccaggctttaggggtggtgtcggtgatatgggaccaggagtatcatgaccagaggcttgaggcagacgcaatcgcccacgtggcctggcaccttcggggacgtcgggcccgagggtgaggtgtccgccctcctcctgatttcccccgagggggggtc

SEQ ID NO: 58932 - DNA, 1263 bp, Oryza sativa
agagaagggggttggttgattcttttccagatttagagcttagaacgggggagaagttggctgacacttggtagctcattcatacaccaatccacaaaaacacaggagtagggtattacgcttcccagcggcccgaacctgtatacatcgccgtgtctcgtgtttcttcctggcacgcgatctttccacacacagcgagagcttgagatctcaccctaagcccccggccgaactggcaaaggggggcctgcgcggtctcccggtgaggagccacgagctccgtcaatattaatccaacgctatataacataccctgttgtataggctcaaccattctgaacaaccatcccggctgcacagttctatctccaaaccaggaatataccattccaaaccagaagctaatcaaattattaccagttagagcaccttttattatgatgagaagggtgagactaatcacgaaagacattgttagacccgcccataaccgcgggcacggctattcgaatagttttactctgatcagaggtgtaccactatacccacaagacacaaccccacatcatgtcaccatgtgcctcaataccaccacagtacctcggaaaggagttgtgacaataccccttgcacaacacaatccattacggcacacctttcctggatcataatcacccccttataaacaagacatggactccccagcgacccccgtgggcttatctccgccacttctcagtctggtgctccgcaatgaaccatgctatacaaaagataaagccgttgcccacgctggcttgtggttggcatggttaatgtttcacaaccgaaactcgtgaaccggtccttaattgtcatgagcacgactctcaaaaccatgtgctcacaacccaccattatcaagttttagttggtaagtaattaattaacctaatcacgattgaccatcgtgaactatcattatgccatcattaaataatagtgagtcataagttatcccaaaagtgtgctaatgtttctaagcatggctaagcaactataaataacatctagctgaaccaatccaatatataaggtccatgctagtcaaattataacccataggaaaataaagtcatcttcggccataattaaatgggaaaggctcaccacccaatgacattcgaaaacaatgcataagttgaaataaatcaatagctttaaacagattcaacatgctcaaagggttgtgtctaggatctgtgtgacttgccttgctggcct

SEQ ID NO: 58933 - DNA, 1559 bp, Oryza sativa
taatgaattatttttgaaaaggaaaaatagatttattgcgtcagcggctagggtttgcggttgaccgggcgcacggcggcggttcacgcgaacggacggccgagatcgatccatccaaaacggacggccgagatcgatcggtccacgaccggctcacgggagacggggacgatgacgtcggcaatgacgtcaccaccggcggcggcggctcggcggctcgacagctcggacggcgcaagctcaccggcgaacggcggcgctagggcacaaacggagggcaccaacgggtagcggacggcacggcgaactcaccggcgaccaaagcgacggcggaagaggaacggacggcaccggcggcgaggttgaagcggcggcggtcttcgggtcgacggcggcaacgtgaaggaaggtttagggttcggaggagagagacgaaaccgattcgatctcgaatccaacgatttccaaaccgatttagccgatgtttccaaaggagaaaaggcggaggagatcccgaggatcatttcccctctatcaattcggccggagaaggaaagaagcggccggatttggaaggaaacgacggcggcgcggcgctagggtttcggacggctgcggcgcgacgaagacgacgacctgacaggcgggacccacctgtcagcgacagcgagggcgcggctgcggactgggccggactgggccgaggagagagagaacggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaaaaaattagatcttctcttctaggcttttaaaaataaattctaataattccaattaaacaacaatttatatattaatgattttcagggtgtgacattagataacatacacgacatgaggggatatcccctcgaaatagtatgtgcatgtcacaaattttaacacatttgttaatccatgcaccaaaattcctactttaaacagaaacttcatgctgaaatccctcccactatggctccatcctaatttaatgatccacaccaagaacaaggacaacaaaacaatgctccgttgattcagtccaacaaaaaataattcactgttgcatggcttgaaaccaataaaaaataattttgattagtactttgttagatgatgattatactaggaaaaggggtaaactacattttttttaagacgaatacaggtgctccacaaaattagcgtgaccatatggccaaaatgacttcatgccttcatggacaacaaggtactacaacgttggctacttgtttgctctgtaatctgatcatcttggcctcaaaccagcataggatgacgtcggtgagcagtccgcctcgcaccgaggaagacatcagtgagcactgtctttgaatgcaacgaaggctgcaggaa

SEQ ID NO: 58934 - DNA, 4924 bp, Oryza sativa
agagcttgcctcgccagacggcgccgccggcgacgtcacgactttggcgccggcgccggagacatcgtccggctcaacaagactcacctcggtcgccatcttcttcttgcacaccggacacggcgtgccgttcaccttggtcacgaagttgtagcagcttctcgagcaggcgcagccgctgcaccggtaaagggcgccgccgccgttgtcggcgtccgccggcgagcccaaccggagggcggccgtgggcgcgagcagcgcggccttgacgtcgccgcggcaggcgtagtcggcgccgagcttgtcaacgacgctgccgtagaggttgccgacggagccgaccatgtcgccggcagtgagcagcttggtgaccccggcgagcgggacagcgaggagggagaggaggaagtcgacgacgtccttgctgccctccgcgtacagcacgcgctgcgccttggtgtcgacgagcagcttcatggttagagtggcagctttagatgtttttccggccatctcacggtcacacactcttgcgtacgagagatcagaagcaccaaactagaatggagaaggtttggattgcagcgagatttgaagcaacctcgaaatttaaatggtctttttttatagtggagctgtacgatgcaggcacatcaatgcgaatgacaccgtgcacgtcgcttcgtttcccggccgtgacatggaccggcgcacgaagtcacgaaccgccggaagagggggagagagagagaaacgagaggagactagaaagcagacgatgggacgagaaaagtcgatgatgcatgggtcctacctccatccatatcccttctttctataatataaagttaaggccaaaaactcaaaccacatgcttctacatcatcatcaaatagtgaaccgttggataaatgcattagatcgcttctcagatgttggatagaatgtagcatagagctcaacccattagtcaccgggtgagtctcttcgcctcttcagtgccaaatgtaacccacatgaacacattggcccatctccacacacatctatatgtatctagcccgtcaatctgtataaaagagctttatgactgaatgccccttcagttgacatgtgctacctaaattatctacaaattttggatagagctgctaaaaagaatttattcaagaaagctatttgtttcttctgtttctttttgagattgtacctcatatctaacaatttgatgttaaccaagtctcgcagcaacacgcggggcatcctctagttggtactatggctgtgttcgggaggaggggtcttcctccccggcacgcaaaatgaaacccctcctccatctcatattactcgctttaagtttctgtttgtaacgaaaatgtttgatcattcgttattcactctattatttattttgtttgtgacttactttattattaaaagtgctttaattgaattatctatttttatatttatactaatttttcaaataaaacaaatgattaaacgtcgaagaaaaagtcaaagcgatttttattatcgaagaagatagtacgtcaatagaaatatttttttcaaaccatcaaaagcgtttatttgcattggtttttaaggtgcgggagatgttattggctttgaagatgccggagatgttatttccggttgtgtggtttagaaagacaattcaatgaggaagagtcaaaatagactttttccctccgataacgtgggcattcgtggtgggccgttatgtaaatgggccgagaggagtggtccgatttactacaggctataaaggaagcaaacctactgctcgtgctcatcgtcctcgccgtcgattccctcctcctcctcgccgtcgtcgcaggccggcggctgcggcgggcaggcctgcggcgggcatcaagggcaatccattgtgtgagcgagttcctcaccgtcctccgtgctgtacattctcctctcaccttacagattgctctctatttttgttttccttacgcgcgatgaatctgccctacctgattatttcgtctagtttagggatcctcgtggtggttgtttctccaccttattttcggttggtttttctcctaatatatatatttttatcgtcagccttgcaagcgcttggaggttttggggacggagggttttgagtatgtgggttttgggggagggaggttgtatgagtaaatacagatttcttttcacattttccatattggagactattggagtatggtgcgtgattgtccacaatttattcacacaactatggatgcctcattgattttcataactttttgagtatcgcgtgtgatttgtttctcgaagacgatatggcgtgtgattttccacagtttattcaaacaactacggatgtcccgtattgatagcagaccggagatctagcaatgcaaacgaaatgattatttgtagttgaatattctagtataatggagtttcctagcatgatccaactgtgaattctagcccaaaatataaaggactacccaatttgaatggaagaaataaaaagtaatataagcctgatctttggtatttttagtttgtgtctaacactatgttccactaatctttgtatgtccttacctgcttatgcaacgctgcaagcctgcaacctatgagtttgcctgtaagaacatttataagattgtggtttatccgtttttcctgcttttccaaatgacatgttcagaaaagcagactactgcactgaattcatttttctttcgcgaacgtgtaaaaggattgcatggcatcccatttagacgaaagcaagttgaacccatttttccatatcactatttggaaaatattaacaaactgctctattattaatacttatatgaaatttggaaattatgttatatatgcatgaattgttaccttactccgcaggagaatttgtatgtaggaggtcattttttccccttactttagagcagctatcaaccaatataatctagatgtttcaaactttcaatggaatacaatctggaacatgtttttgctttatctgctttaaattataacgctttctctgaacatttggacgataactgtagttaattgaaaacccatttaattttcttttgctggtgattgcagaagcaatcaatcaactcccaagaaatttaaagaacttcgaataaaaaggatcatggctgccgctgaattgtcgatcaagctcgtgattgataccaaagctcacaaagtctgctttgccgaagctggcagtgacttcgtcgagttcctctccagcctcctttgtctccctgtaagcaatatcatcaacctgcttaccaaggaacatatggttggaagcattgcaaatgtgtttgacagcgtggagaagctggacgccgatcatgtaatctcaaacgaaagcaaggagccttaccttaagccaatggttgcccctggagcgctctgtcctttgcagcagctgatagatgcacagctagacaccgataccagcttcttcacatgtgaagggaaattgaaccattaccacggcattcgtgttgcttgtggatattttacggttatgaaaggcagcatttgccctaagtgcggctacgcaatggagaaggcaatggcacatgtcaaagccactgggtttgtggttgggacagccaggtacactgtcaaggatgatctctcaattgttccagcatccagcgtgtcaaccatcagcttgcttgcacaatgcggtgtcaaggacttgagcacgctgcaggaaaggaccgtgaagattggcaaggaagaggtttgtacatatctatcagaatcactttgagtgaagagaacagtcgtagtcgtttttcttaattggtgtggttgatgattttctgtgttacaatgtaggcactggagatactccttgcatccctgaggactaagaccgtgctgactgatgtatttctcctgaagaaaaaagttagttgcaagagggaggctgctacttagttagtatgatacatgtatgatacatgagcagttttaccaggcatcgcatctgagaaattggaaagttccgtacaagttacagaccttcattgtgagcatggagtaggtttccatttgtcttaaagggaaagcatcactttgtattgctcatttttagattagtcttaaatacacttggaatagtttttttttaatagaaatgttacaacccagccagtgaaatcttactgtcaatttgcgtctcgctataaatatgtttctgcttgccttctagaggtaaatgtaacaggtatgacttcattttttttaaaggattgattgcattcgagggtagaagcaccaccaaggatgaaggttgagatgcagcgagattttcacaatgacggatttaaaaagaaataacaggaggtctgaacaaagtaaacacttcctatctagatagaacaaaaaattttagtaagacctcgtagggcctctcatgattctcatgccgatagtggaggcttagccctctcatggttctcacgccaatagtagaggcttagcccccgtcgtcatcatgagttaatatttccgtctcaaaatataacaactttcggtgtatgaaatttattttaaaatataacaatatctatcgcatacatttttgtcccgatcaataacaatctttcctctcgacgaaagcgatcacaatcttttttcatttaattcaatcaacttttttaataaccttattcaacttccgactgacatcgtgcacgtcggttcgcttcgtttaccgaccgtggctgcgttggggagtgagggttaccaacgctactctctagcacgcaaaacggagcaatgtttagcgcatgattaattaagtattagctaattttttttcttaaaaatagattaatatgatctttttaagcaattttcgtat

SEQ ID NO: 58935 - DNA, 1113 bp, Oryza sativa
atcgatcaactcttgattgataccaggctcagaaagtctgctttgccgaggccggtaatgatgtcgtagagttcctcgccagtctcctttgcctaccaatgagcaccatcatcaacttgctgaccaaggagcgtatggttggcagtatggggaacgtgcttgacagtatggagaagctggaagacaagcatgtaaccacaaaccagagtaagcaacgctacctgagcccgacggctgcccccaacgcactctgcccattgcagcagctgctggatacagagttaaatgccaataccagcttcttcacatgtgaagggaaattgaacagcaccagctacaatgccactcgttttgcttgtggatatttttcggttgtgaaaggcagcatatgccctctttgctacactccaatgcacaaggcaataccacatgtcaacacctcaagggttatggctgggacaggcacatacactatcaaggatgatctctcaatgactccagcgtccagtgtctcaagcatcagccttcttgcacagtgtggtgtcaaggacttgaccacgctgcaggaaaggaccatgaagattggcaaggaagaggtatactatactactttgtacatatctgtcactttgagtgaagaaaaaaaaatcttagtcgttttttttattaattggcatggttgatgatttttgtgttcaaatttaggcgctggagatactccttgcttccctgaagtctaagaccgtgctgactgatgtttttctcccaaagaagaaagaaagttgcaagagggaggtatctgcttagttatgatgcattgatgcatgagcagttttaccaggcatcacaagtgaaaattacaacagcttgttattaagccgacagtagatttcagtaggtctttattgtgaagtgtcactttgcatttcttattgtatccatttagcaaaagtagtatttccttcgttttcgttaatgaaagcgggagaggtgcggcctctttttatcaaaaaaaaaaaagaagcaaaagtagtcttgcaaatagttggcttactagtttggtagtgatatgcaattatgcagtatccacccaatgaaatctttctactatca

SEQ ID NO: 58936 - DNA, 2906 bp, Oryza sativa
cccattgaacgtagcacagggaagtcttacaaaaaaaggttcttacatttatttttattgcagttttcaaaagttagttctagccataaagtttttcttttaattggaaaaaacaaggagataaaggaaattaactacatccatctactggaagataattgtgcttaacgatggtaagacaattgatatttgagaaagcaattattacaccagtgaacccaaatatgatttgggtaattaggtctttgaaagttgccacaaataaaagtgaacgaaaaagcactgcgcatttttcaacagaagaaataaacgtgttataattgtctgtttaagtgaaaaatagttacagacaacttacctgaactctcgatgggacaagatagtcccgagcaccttctggtgtagacttagataaaactggagtctcaatctaccttggaacatgcggtaactttggatcagacacaatagaaacaataacagatacagacattataggcattgcaaggtactaagatattattagtcattgtgatgtcttatattctaatgactcgctgtaaaggagatacaacagcaaagaaggcatacatgacccatctatttcaactgatccaagttattttaactagcaaattgtacaggaaatgattaaaaaaaatttcatgtacaaagcaaacaaagcatacatgcactctgtaaaaaaaaaaaaagatgattaaaattggaattagagccctaagcccaaggtgcaacatgaccttcaggcattacatcatgaaagcaagtatcttgctctctctactgcaggcactgcatcgaaaagaaagtattttgccgtcttgcaaatttccgttcatctataggaccagactacttggatatattgcattccatagtggaacaaaatgagaagcatatagccaaaggcagattatgttagaggtgcaaactcagcatgaagtaattaatgagtatataattggtatacagcatacctcaacaaaatcatgtctatcctccaagtatcgacgaatatgcttgacaacattatggcgcaacctcaagtttgactgcatttgtggtcggcgtaagtccagcacccggaatctagacatttacaaatatggaagttaaagaaaaagattggtccttaatatatggaacttaaaacccataatataactatattcaagtacaatggtcgcctgctgtgaaagaagacattgagaacagggaaaagtgctttaggcaaactattaaaaacattatacaaacagattcaagcataatggtcgcctaaaatcttgaaagaaggcaaagagaacaggcaaagggctggcaaacacagaaaatgtacatcttctggcaaggatggttaaatctggaacaaatttgtggtcaggattgcagaatgtcatgacatggtattgcaacagagtaaagggtggtttaacagcagtatgtagttaaaaacattcctatacactagcataatccaaatgatggtagaaaattccaaattaaactgaatatgacagccttcataatgaccgccaatatatcgatctagtgaaaaaatattggaaccttggaagaacaaagatccatagaatatagcaatggccatagttcagcgtaaatcagtaactggggtgaatgattaaataacacaaagagattgcaaccctcacggagtgaatgatgtgccatgtttcacagtatctccaaagccactattcacagggtaaacatgtgactccccagaaaatgggttaacacctcaacaagttgtgtcccagtagttagtgtcgtaatgcaacctaagtattattttggcacctaaaatcttatgcacaactttgaatgtgcaatgtaatcccatttatgcatgtattcaacaagcctaatcaggcgttaaccaacaatcaaccaccatatttgaggtattcaatactagtatttcttttcttcaggatacttaatatatgagcataaaaagagtgcagataacaatgtattttacctcagtctaatttcttctggaaacttctcttttacagtatcagcagtggtgattggaaaaggcaatgaacgagttactgagttcagcacatatatattatctgcagcaacctgcataggtcagcatgtaatatcatagttagagagcattttgctgtatggaggaacacaataaaaaaattcaggaagtccgcaacaatgaaagaaaagaagtgttagaattacaaataatgttgcacgggctattccttatcctatatattagctcttatagcatctatgtgctccgtacatatgaacagcaaactttaaaagtgtggaatttctgtactagatagtttgaatttcaaattcttcacttgacatatcatctcaagcttctctctctaaactgcaaaataaagtaacatacaaccagtcaatacctctatagccccagtcttcatatctgtgttgatggcttctgttgggcgtgaccgaacaaccccctcgaccgcaaccactgactctactcttagtttgttcaccacagcataaacttctggatattctggcaaagttgtcacctacacagagagaacaattaccgataagaccatgctatcttgtagatgtttatcagtctaccaatcactacagaaagaaaaaacaaatcaactcccccataacattacaaattgatgcgattatatgacttcattttgccttcgtaagttattagatcactcaacatcagtttattgggaatttgtagctgcaaacgttgctaaaaccactcaatagaacaggaaaacagtaggtaatgtcagtgctacaaatactattatactccctccgtttcgaaatgtttgacaccgttgactttttagcacatgtttgac

SEQ ID NO: 58937 - DNA, 2642 bp, Oryza sativa
catttcgaaacggagggagtacgtcattaacttgacaatacaaccgaccattcccgatgacacatattgagcaataaaaatgtggaaccaccagctgttacaaagtactccatctagagcattagcatgtagattaatttaatcactaacgagaacgatcaaacaacaatacacatgcgtgcaacaattagaatcacaggctcgcagctactacatatgggcaacaaacaaaaccgcaaaattatcagcaccagtctatcactaacagcgactcacctggaccgtgccggatcggtcacgaagggtgaggaaggtgaggccggcgtgggcgcggtggagagcgacccagccgcagaggcgcacgcggcggccggcgtcaccggcgccgagctcgccgcacagcgcgtccctcgcaggccactgcagcggctgcagcctctcgcgcttcgcctcggccgcgggcgccgccgcttcctcctccggcggcggggtcgccgcgtcggtggccgctagggttcggagcggagacggcgagcacgaggccgacgaggtggaggaggcggtggagagcagtaggaggcggcggaggtgcgaggcggtggggctagggttgagcggctttaggcgggagaggagggagagcggcgaggcgcggaggagagaggaagccattggattgggctcggagacggtgggaaagcgagcagaggaggacaagggcttgggttgggttttggaggaagacgggatgggatcgccttatcctcctgcacgaatcttacagcacaagtttttcgcctgcctgcaagcacaagcagatagaaccatcgccagaattcgaaatcaaaagctcttcgacaccaaaatcaaaagtgaattcgcgccggaacatttcatgagaaacgtaggagtacttctcagcttatttaatccaaagtaaactgcacgaccaccgtgcttcaccaaattggagcagcaataggcgtcaaaattgtgcttacaaattcagatcccgccaaggcagaaccaaattttgaaaactgcacaaatcacaaaacgcgcaacaccagtagcaggggggaaataaaattggcgcgatgtagagacaattttttttttcagagcgcgcgcgttcatcaggcgaaaaattcgtgaacatcgtgaagttatcgcttccaccgttccaggcgcataacatcaggacaacgaaagttttgaaaccatgaaatcaaacagcgcccagattcactgccagacttcacaacaaattcaaattaaacatcgaaacatgcactaaatgaaaatgaaatacagccccaacgaggctctggataggaaatttaagacaaaatattcagagattttcagataagcaaagacagcgcaggagcaggagcaggagcagattatcgtacaaaccacaggattggaggcgacaggggaataatcaagaacatgtaaaaggcaagcagattaagccatcatcatcataattactactttaccagatccagataacaatattgtcctaaatccaccaggatatttcttacatgaacccaagatagtcaaaagccagaataactacagcacagtaccataccatccaaaattccaacctaccacaactaccattagcagcaagacgagaaaggggcctatgagcctaagcggaggtgaacttggtcacagccttggtgccctcggagacggcgtgcttggcaagctcgccggggaggacgaggcggacggaggtctggatctcgcgggaggtgatggtgggcttcttgttgtagcgggcgagcttggcggcctcggcggcgagcttctcgaagatgtcgttgatgaaggagttcatgatggacatggccttggaggagatgccgatgtcggggtggacctgcttgagcaccttgaagatgtagatcttgtaggtctcgacgctcttcttcgccttcttcctcccagcgcggtccttcttcccctcgccggagcccttctcgcccttgccggcggggagccgcttctccgccttgggcttcttcccggccggggccttctcggccttctccgccgcgggctcctcctccgcgggcttcttcgcggccggcttcttctccgccttgggcgccatggatgctgctctcttcttctcgggaaggggaaacggtggtggttcttttgctgtgtgtggatcgcaagatttgcggttgggaagaggaggagacggggccgattggttttatagaagaggggatgtgcgccctgattggtggaaagcatgcggcgcggatcgatgacgtggaaggattcgtgtcgttcgccgctgtttgcggtgaacgggtgggatgcgtttcggcgcggattgctgacgtggtgaaatatctgggcgcgaagagacgagcgcggggcgggattttctcgcgcgtgagcgaaattgtggaagggcccatgggtcatagggacgcgacgatttttgtgtatcgagaattacaattttttttagagtactggatttttttaagttttaatgtatacataagaaattttgaccaaatattgatttcaaaatgtttcacgataaatgcgcaattctataatagattctaccatggtttttatgtggtactattatgctatta

SEQ ID NO: 58938 - DNA, 1684 bp, Oryza sativa
tttgttctgccaagtgccaatgccttggcttccctcactgctgctcttgagttcgcgaccatgtagtcgttgtcgcttcagctgctcgtgttgatctcttagctcgatgctgcaaccaagataattgccttcacattcgtttatgccatgcgccactaaaattattctaataacaagagaaaatcccttgcactcccctgatatttgagtcgatctctaacgtgtccttcagttttttttctttccatggtataattatattatttttttgaggagaacgacggtaggagatctgccaaaatttaacattaggagagagaaattacaaagtagcacagaggttcagaggttacaagccaaggaatggaaagataaatacagctacaggaaaagctaaaaaaaattattggggtttaaaggccaagcagcgcatatcaatagcttgcttgataaaataagctacttcaatctctgaacaggaagagttttggaaaattcttctatttctttctaaccaaatattccagcaagtagttagaagagtttccctgaccaactgcacatccttcttagagcctgcaaatttggttccagaccaccatgttgacacatccaggacaggatttattccgaccgaagtcaagttttggaattgacaaattagggtctacacttgtctgacaaacacacaatcactgaacaaatgatttgtatcttcaaaggcacaaccacaaacgcaacatatccaattgcaaggccaatgcctgtggagcagattttgggcagtcaagttttttgatggagaactagccaaccaaagaattttatttttggttcagtcggggatttccatagagaatcaaactcattggtggcaaatgagccttcgaactggaaaaggtaagcactctcaatcgcgtgagaagtggcagattcagatgttctccatggtataattatggattttgatttttggtctctttccatattcttttctttaattggccatttaatagttatgaaaagtccattttggcatcagcatgaaaggaaaacataatttagaattatctatatgagataatcatgtattcaatattttgttgtgtgaggtattattcatgacaaaatttgttttgcacatagacgatagagagtttaatagttattcctttaattatagcaaatctaagtagtgtgtttttggatgatatatacaatagatttcaatgcgccctatatgggtaaggtataccctctatcctactacttatgtaattttatggatacaccgcaccttcgtgtgtatggtaaagctccatatgcaataaggaaatcgataagagattatggaaataatcctcgcgggcaagtacataacaaagatctactcggaaaggattaggaatatactatatcgtgcaaggtcctaggtcttcgagttccaggggattcacggtgtaaatacatacccttaaggggtccaaggttttgagtcataagcacaagacaccaccaccataatctcggaggacttgaagcctattcaccgatagatctcgtcgagctaatctcaacaaggatttcatcggtaatctcataatcatttgttctctattgtactatgtgtttttccatatcaatctcatataaactgtaataggactattatcttgcgggggca

SEQ ID NO: 58939 - DNA, 2030 bp, Oryza sativa
cctgcagccccaagcgtactgacaagggcttctcttaacactctcctaaaagatatatgaatagcaagggtgagtaccaaccgtactcaacaagccaccacaacaacaatgcatatgatagagggtatttcaaggaatggcttcaggttcttttgcataaagctaattttacaattcttttcacaagcctaaaacctagcatagactgatcaaattttagtacagtgttcactttaaacaacgacggttctgtccaccatccattgtgatcccaaggatagcttcccgccattgaatcgtcatggttttctgaggatgtccaccttccctcctctcgggaagtggctccatcagcataaaattcatcatgcaatatcccatcccccacaagttaagaatttagagtctagccaagtgtaatacatgtcctggtgctcaataaccgcgagcacggctattcgaatagatttggtttactcacactgcagtggatgtacactttatccgcactccgcgactgcccaacacatgagcctcgtcccaacacatgagacgcgtcacggcaaagcttttcgataacctcgcattggcagtatccgctccatgaacttaaatcctcatgcactctaggcgtccatgtttctagcagtgagaggagttctggcactcctgggaaagagaagtctcacacacatattaaattatggttcaagttaagttctctctctcacacactcatggcattcctaccaatggtgacaccgatgtagggcacgcctctcggccctacctcaccggctgtcccaccgtagcgcacctgcctcactcaggggtgaaccatctatgcagggatactgcctccgctcggctatctaatccgctaggtctatacccatacgagaagtgcggttgtacgggggtcgtttcatgcttaacttcatggctcggtccttaattgaccggggacggtactagccttttccagataccacccaaatcctccgtccaccccagtcgaaaacaattgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtgggatgttcatcattgcatgcaattttatttgtaaacaaaacaatttcgcaattgggatcaacatgttcaaggaatagtgatgacttgcctgctcagagtagttcttattcttaatataatcttgatcaaccttcacctcctggaagctgcatacgttgcctcacgactaaccgatacacagtctagaatacgcaagaaaaaccaatattcaagcaacaatcaaatatgcacaaacaaaatatatttgttgaggtcgaacttacagttgctcatattattcgcgcttgctaattgacggagagtgaggctcctcaccgggagaccgcgcaggcccccctttgccggttcggccgggggagctaagtgaggttcttcgccctcaatctgaggaacgtcagcgagaagaatcgcacaacacacgggcgacgtagacaggttcgggccgctgagaagcgtaataccctactcctgtgttctggtggatctgtgtgtaaaggaatacagagagctcgagagcgagagagagttccagctctagcccccctcctccttttttttctcccccttctctcttaggcctgggcctcctttttatctgatcaggggtcaccacatgggcctctagctgcctaagaaaggaaacatgctttttacaatgagggctagtctacagccggaagtgacttctgacaagcagagcacgcgccttctgctccgctcgcccgctttttccgtggacgcccattt

SEQ ID NO: 58940 - DNA, 1362 bp, Oryza sativa
ccgggcatagcgttggcaagggaataaagacgccgaggaagggattcgtttccttcctctcgccattcttccccttgccttcgccacttgcgctctaactcttcgtttcctgtgccctacccttgccatactcgctcgctctcaagctcctcctccaccggcgtcatggcacggggctccgcaccgctcgacggtagcgtgctgccgccttcccgcatcgtgagcgagaggcaggccgggctgccgcgccgattcatgccggaatctgccaccggccgggaggtggtcacgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgagcccatctctccggttgttccggtggttcttcaccgtacagccggtgtcgccgccgacggtagtcggtggctgctacttccagccgcgggggcaggtgttgaaccgctacattccctgcgtcctccgcaaaaagtgggacgactggaagagtgattggttctacacccccctcgtcgacgaagcgcgcctccgacttccgagccagcctccggcgcaggcctccagctggcaggcggcggtagatctgggagacggctacgacgccgttcttgaccgcctggtgggtctgcgatcccaggggctcacgggggccatggtgttcggtgactaccttcgccgccggatcgcgccgctccagcggcgtgcccggggcgcctgggagtacactgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggccccccgaggccacgttggcgcgggcgggagccgcaggggagaacaatctaccccgggggggggtcgtgcttctgggccccgcgacggggacccgggggggagccgccctgccgacgcccggtggaagaggaagcacgagggtacccctcccccatctcctccccgagggggcggggcggtgcgtgccagcagcaggcgcccggagggtgccgtgccgacgccgcagcccgagggggagcgaaagaagaaacggctccgcaagtatgggggg

SEQ ID NO: 58941 - DNA, 1767 bp, Oryza sativa
tcttctgcctcagcgagatcccatcgcaccccccccccccccgccattccatgtccggccggtctgaagccgaggagacggcgaccgcggaagcccggaggcgggaagctgaccggcgagaagccgcggaccgcctccgggaagccgaggaggctgcccaggaggccgtccgggttcgccaggctgaggaggccgctcgggaggaggccagactccgccgggccggggagtccgtccgggaggcagaggcggcacgcgcacgccaggcggcctgccaagcccccgacccgactccacccgaggcgacgatgacttccgaggccacccacgacgaggccgcggacgcgccgctcgggcccgacccctcgggcgatgcttgggacgagccagcttcgggggacgcccccgggtccggcacgtcgatcggcgggccgagccgcgcggcacccacaccgaggcggctctcccctctgccttccgctgccccactgagcgcggagcccctcctgcaggccttagccgccgcgaacaccacggtgctggacgggttaagtgcccagatggaggtcctgcaggcagagagggcggagctcgacgcggcgtgggcgcgcgtagaggaggggcggcgctcggtggaggccatggtggaggcgggccgcaaggcacaccgccggcacgcctccgagctcgaggcccgtcgtagggacctggcggagatcgccagggaggtggaggaggagcgggagactgccctcatcgccaccgccgtgctcgacgaggtgcggaacgacctccgcctccaatacgggagccaggcggcggagctagagaagaagctcgacaccgcccggggagtccttgacgccgccgctgcccgggaacggcgggcggcggagatcgaggcggcgtcccggcagcgcgaagaggcccttgaggctcgcgccacggcgctggaggagcgcgcccgcgccctggacgcgaaggagaaggacctggcggaccgcgaggccgccgtcgccacccgggaggcaacactggcggcgcacgaggccgcctgcgccgaagaggagtccgcactccgcctccgcgaggacgcgctcaccgagcgggagcgagctcttgaggaggccgaggccgcggcgcagcggctagcggacagcctgttcctccgcgaagcagcgcgggaggagcaggcgcgccacaatctggaaggcgcccgtgccgagagggccgcactggatcagcgggccgctgagctcgaggcgcgggcgaaggagctggacgcgagagcgcacagcggcggaacggccgcgggcgacggcgacctgccgcccgcctcgcagccgccgaacacaccatcgccgggctgcagggcgcactggactcgttcgccggggaggtcaaggccctccgtttggcgagcgaggtaggacccggcatgcttcgggacgccgtctcccgtctagaccgcgccgggcggcaggcgggcctctggggcgggcggaccgcgaagtacgccgccaaccaggggggcctcgcccagcgcctctcagagatggccgggaccctccagcgactccccgaggagctcgaggagacgatcaagtcatcctcgagggacctcgcccggggggcggtggagctcgtactggcaagctaccaggccagggaccctgacttctccccgtgggcagcgctggacgagttccctcccggaaccgaggacggcgcgcgtgcgcaggtccgggacgccgccgaccacatcgt

SEQ ID NO: 58942 - DNA, 1188 bp, Oryza sativa
tggatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaaggaaacgatggcacagacacggtcctcaggaaatcgaaaatgcttttattgaaatacggaagagaaaagagataagtatatgcatgtggtagcccccggccaaccctgcacgcccgggggggtgcggggttggcccgagcccgagacatgacacccgacccccactaggggtagaagcgacgaagctgtttgatgttccacgggttaggcagctctgtgccgtcgcccgtggccagccgaacgcagcccggccgggggacgccgatcactcgatacggaccctcccacattggtgagagcttactcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtcttggcgaagctgatcttgatcagcctcgcaataaatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgctgtgcttcttgaggatgttgaaggtcttggttttgaggcccttgaggatttccgcgttggcacgctccacttggccattgcttctggggtgggcgggggaggcgaagcagagcttgatgctcatgtcttcgcagtagtcaccgaagagctcactagtgaactgggtgccgttatccgtaatgatacggttaggcaccccaaaccgagcagtaatgcccctgatgaatttaagcgcggagtgcttatcgatcttgatgaccggataagcctcaggccacttagtgaacttgtcgacagcgacatacagatactcgaacccgcccggggcccgcctgaacggacccaggatatcgagcccccagacagcaaacggctacg

SEQ ID NO: 58943 - DNA, 2765 bp, Oryza sativa
  unsure (1)..(2765): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggaagcttctagatggagatgtgatgagcttgctggaccagaagctgtgtggtgaagcggacttgaaggaggttgagagagtgtgcaagatcggttgctggtgcattcaagaggatgaggttgatcggccgacgatgggtcaagtggtccagattcttgagggtgtcttggactgcgacatgcctccgttgccgaggttgcttcagagaatctttgagaggccgtcttcagttagcaccagcacaccagttttcctttttgtcggtagccctgaacgccaatgagaatacagtatcagtttggaatgtacagtatatctgaatgtctctctctttttcttttttcttttgttttaaggttgttatgtctgaaactttagttcatttttgtagtatgtattgtactatcacaccacataccacaagcagcttataccactgtaatttgatcatcaaagtgtgtatattcctgtattcattttgttttaagaaaaggaaagagattttgcagtcgagaagaaacaatagtacataccacaatatattcttgtattaatgatgcagttgagaaaaaaaaaactagtacctccaattttttaatatatgacgccgttgactttgtacataacgtttgtccattcatcttatttaaaaatttaatataaatatgtaaaagtataagttaatattatagtttctttgatgataaaacaagtcaaaacaaaataaataatatttatatatttgttttaataagacaaatgataaaaatcacgtcaaaagctaactgcgtcgtacattgaaaatcggagttagtataattttggggaaaatttcagagcagtagtttatgctagcacttggattcatttggtacttgttttcaagttccatatctgtgcaggggtcttccggctagctccacaaggtgatgggctagacgacctgggttcaaagcctcaccccttctaattatttgatattaggtccttccctaatattcgagtttttttttaagttccatctctgtgcaattatacaagataacatcacaatttacatccactgctataacacatcacgactttccataaactcatcgtgatctgcatatacaatcttggatccgtgtgtacgtacatgagctaagctaacaacaactctgcatagcacagagctaaaacggatcaaagaggaaaggagaaaacaagaacactggagagagaaagagcatgtgtcatgacttgatctcgccgccggcgacggcggcggcggtgggcgtggctgcaccgacgatggaacggaaggccttggtggtgcaggggatgcagagaatcccccgctgctcgtagccgaactcctgcaccgcgaggtcgagcagcgcgaggaagtgcggctgcttgagctgctccgtgcgcaccaggatcctctccctctcctccccctgcccgccgatcaggatcggcacgtaccctcgcggcgccctctccttcctccccctcgccatcgccatggccgctctctctctctctctctgtttgttcagtcttctcccttgctaagaatgcgatcttgctgtccctgaattatatagtgcttctttctcagaaagagagaattacttagtgtttgattggcattgtgtgtgtggttttgcttttttgaaggaaatgattgatgattggtgctgcattacgtagaaggcatacatgatgagcgtaaaaaaatggtgtgtctggtggaattgcggtctctgtcagatggaatgctttggtctgcagattttgaactttggagtatgtagcatgctaagctaagcactggctgtgttgcagataaggccctgaaattaagtaacccttgatatcttgtgttaactttttttttcctggaaaaatgggcatcttatgttcatagtgaaaggaaattggttcaggccggccagtggctgatttacctgagagatcttgcaatatgaacgtccaaaccaatcgaaatttgcttagaattgattagaatggttaatttgccgcgatcaatatttgaatagatcaattactggtcatgatttggatgtgtatatccttcgtggatatagagaccggattaatgaaaatctattttctaaaaaaaaattactggtcagggacctgattgatgatcagtgaatgagacgaggtcttggctgtgatttctcctcctggctgaatataaattatttaacagacgtggatgagatgtattatccattcttccttagtgtgatgctattaagattcatttgtttgctcgcattattgatagcaaacaagcgtacttcgccggatttgagttttgtttatgctaggtcaacatgatatggcgttgatattttgcatgcatcattgcagcgacttgtatctagtttatactaccccattatatctacttacctagtgctctttttgttgtggggatagagactaagtcaactcagaaagtaaggtttattatta

SEQ ID NO: 58944 - DNA, 4301 bp, Oryza sativa
tatccatttgctcatatgaaatacggagtattttacaaggatatgaaaagattgcaacttagaaaaggtataggtaacatttttacaacttgtaaaggtattgtgaaaaatcacagaaaacgccttttggtgcaagcaaaaccggctgcacggaatctcagccgttggatagtcacgtggacggaagcagattggcctttcgggaaggaataagtcgactctaactccctcaatataggtccgatttaatttgtatcctcgactgcaatactagatatgttgatccccaactacttaaaaactggtgtagtttggctttctggactgttttgacagtggttttcattggtcgattggcgtggctagttaacttggtcaaaatagtcgagtcaccatgtggggcccacatgtcaatgtttcctcctctcttaatatggttttaacagttggagtcattatatttgattttgccgttgagggatagatccgatgtatatttaagggactcaatgcagacttattcctttcgggagtactagtacatgcgcttgggcctgggctaagtgcttttcaattgggtattggaccatatttctggcccaataggaataactgccatctcaggctctcggctgcacggcccattgattggggaaatatgggcttcggccatcttttttcgaacacacaaaaatttatcatgtcatactagtaggaaaaggagtacatctgacattcgtcggaaatgggacaaatccaaaaatgtaaaggaaagctagcagcgaaaaaggactagacggcgaacagtactcataataggcttcgtccatcacttttgcaattttgaggtaaatttctcaatccttttgaaacgcaaaataacatgatttaaacgtattgaaatcaaaatattgtatggttgtgtcgtatcgcatgtgcatccgaacgccagactcgttagttctccagaaattcttacaaacaaaagtattgactccagacctcacccttcatatgccgtaaaaatggttttgtttgtaaaaatggcagcaaaattgtagaaaaagagcttcatgcgcgtaagaatgtcagaattgcactctgtatcacccgcttacgcataacgtaagtcgaaagctgagacagagcatcactgatgctggactcaataacttctttggatcactcaagagtctgatctcatcacacgaacattcaaactgtaatctcaaatttccggataaaatcatagctctatagtctatactagtaataagtacggtcatgtaaatttcgttgcaagagccaagaggtgcatggctacatagtttttgttcagtgaagttgttcttctataatactcagaaaagtaccaagtggttcttataaaactttttttttattatgtcccgttctgaaaagtaacactccttccatctttttctcaaaaaaaaaagagaaaaatatctactaagtcttgacagccaaagtcatggtttggcgatcaaggcaacgactaggattaggaagcttcgtgtcaaccgattaattatctaattaattaattagcccatctgcttacttaaacgaaacaaccgtgtttaattaggcactaagcgtaggcacactgaagaagtaaccatgtccgggcacgccgcgccggcgccgcacgtcgtcgaggactatcgcggcgtcatccagctcctcagcgacggcaccgtcgtccgctccgatgccggctccggcgccggcgccctgctgccgccggaggacttccccgacgtgccgggcgtccagtggaaggacctcgtgtacgacgctacgcacgggctcaagctacgcgtgtaccggccgcccaccgccggcgacgccgagaggctgccggtgctcgtctgcttccacggcggcggctactgcctcgggacgttcgagaagcccagcttccactgctgctgccaacgcctcgcgtcggagctccgcgccgtcgtgctctccgccgactaccgcctcggccccgagcaccgcctccccgccgccatcgacgacggcgcggctgtcttgtcatggctgcgtgaccaggccatgtccggaccgggcgccgattcctggctcgccgaatcggccgacttcgcccgcgtgttcgtcgccggcgagtcggccggcggcaacatgagccatcacgtcgcggtgctgatcggctcgggccaactcaccgtcgacccgttgcgcgtcgccgggtacatgctcctcacccccttcttcggcggcgtcgagcgcgcgccgtcggaggcagagccaccggccggcgcgttcttcacgcccgacatgtccgacaagctgtggcgtctgtcgctgccggagggggcgacgagggaccacccggtggcgaacccgttcggaccggacagccccagcctagcggcggtggcgttcccgccggtgctcgtcgtggtggccgggcgcgacatcctccatgaccgcaccgtgcactacgcggcgaggctgaaggagatggagaagccggtggagctcgtcaccttcgaggaggagaagcacctgttcttgtcgctgcagccatggagcgagccagccaacgagttaatccgagtcatgaagcgatttatccacaaagatgaaggttctaataacttctaaatccaagtaaattaagttggatcagtagagatgcatggttggtgttctcatgtggtctgaatctgtgttctgtttcatcttttgtgtaagtgtgcaacttcgattctgtaaaacttggcaagtagatgaacgatgtcatttatatgcgtgtagcttgtcaaaatacaaagtagaaacctgtatctgaataagatggcattcatgaaataatattatcgattgaacgaacgaagcaacagaatgatcttccaaattgaagcaaaggaattgatggacaacgagttgctgtactttggagctgtaaatctgtagtacttctcaacgatgctatggaccgtgggccgtccataatcgctgggtggaatgagcccactgtccatgtgcttctgcatttggcccgtgtacagcccatataatgtcgaaaaacctaatacgcgcgcgccgccggcgcgcgtttcggacccagaacgcctagcgccgctgcgccgacgtgcgcgcgtctccactttttttttcgttttctttccattttctttcctttttttccattttttttatttttttatctttagcatgttttgagtttgaaagtttttaatttttgagttgaaaaatttcaaatctgaacttgaaagttttcaaatctcgagttgaaagtttcaaatctcgattttgaaaattttcaaaattttcaaatcttgatttgaaggttttcgaatctcgagttgaaagttttcaaatctcgagtggaaagttttcaaatcttaaattgaaagttttcaaaattttcaatctggacttgaaagttttcgaatctgagttgaaagttttcaaatcttaagttgaaagttttcaaatctcaagttgaaagttttcaaatttaagttgaaagtttttaaattttgactttaaaatttaaaacttaaatcgaaagttttcaaatctaacttaaaaaattttcaatctgttagtaaaaaaatctccagaatttttctaattactattattagtgttaagtatattaactaatttagttagttaagagtagactaaaggggagagggagtgctcgctgctggtgcgcacgcgccagctagtagcccccatacaatgtagatggcttgtcgtggctgctgtggcgcatgtacccggatgtacctccaagaatcgtactagtagcatttgcgggcaaactataaactcgataaaatattctatcgttatttacacgtgatttaaatagttatgaattttttaaaaaaattatgtatattaaaatgtgatatatcaccctacaaacgtgcaatatcaaaattaatttccatatgtcacaactaaaaaaacaaatttaaatgtatatgttaattagttatagtttaatttgtttttttacaacttgataagtttaaattataacttgtatgtttgtggaatgatatatatcacctgtaaatatatattctcaaaagtatttttaaaattatttaagtgaaatgcaaacgacaaggcgataacctcccgatagtttaaaactcattctttcgtttgcgtgcgtgactctccaagtactccctccgtcttattaaaaatcaatctagtaccggatgtgacacattctagtactatgaatctgaacatacatatgt

SEQ ID NO: 58945 - DNA, 3812 bp, Oryza sativa
gaggccaacccgccgaccgacgtgtccacgctgaccgtcgagatgaccgaccagatgtggcgtatgtcgttgccggtgggcgcgaccagggaccacccggtggcgaacccgttcggcccggagagccccagcctggaggcggtggcgctcccggcggcgctcgtcgtggcgtccggcggcgacgtgctctacgaccgcgtggtggactacgcggcgaggttgaaggagatgggcaaggcggtggagctcgccgagttcgagggagagcagcttggcttctcggccgccaaaccatcgagcccagcgatcaaggagtaaatccgagtcctgaaacggtttgtgcaccaaggcatttgaatgctcgtcgtcgaaacaagatttcggcaataataaaaaggggtggctatcaagttaggaaagtggataggtttgaagacaaggaattttatacaggttcaggccttcttattcaagaagtaatacccaactcttgtccggggatgattccgccgagtatgttattgattgcataaactggaaaaaagatcacgccctaagaggcacacagacctctccttatataggggaagatgtccgctttacaaaatacagtccatatcctaacggaatatgggattatagataaaatacaatcgtaactgactaagatcccgagtatttccttgacatacaagtttagaatctaacccgagtcctcatagagatattctatctatatttggtaccgtatatccgactaaattataatgtcatgtagatatggggtatccataatctccacagtagcccccgagaccttcgcagttgacaaaatagccttctcgaaacaaaaaacaataatccgagtgctttaattcaacttgctccagcttgccgagtgctaaaatcaaaaactgcgaagggcgaaaataaaacatggtgcatcgagtagatgcacctaattaggtgtaacccccgactatgtaattagttgaaaaactaaacatgtagtcaagaaccgagtggttttatagcgaagcatgcatggtacttagtaaaatacccagccgactgcttctcaacttgaacatatcaaggataaaaaatacaaaaagggccgagtgataaacactcaaaaggtccaaaaatagacatatttgataggaatccgagtaaaaaactcttaaaatgatccaccaaacatgataaaaaatcatggtaatcaatgagtctaatagcctaggctatgacccttaccataactaaaataagcatataacatgctaaaagaatgactattaataaaccagtcatcttaaatcaacccaaacagcttttgcagactaagaaagcttacaaaaacggtataacacctttctgtcgggcacctttttatgtgcatcataataattccaaagaattattgaatcacgttaaaaaggattttaacagcatctggccacatcatcgtgagcacaaattgccaaagcaaaaagcgcctaagtccctagggatcacaacgggccacgctgattataatattgggctgaagtactgtacaggaccaggcccattagtactcccgataccctaaaaacaccgaagtccaagcgtcacatcgtcttccccgccgaaactctcgccattttccccatttcctgctacagtaccaaactgcgccggccaaactagggttcatcaatccgctccaatccatcttcaaaaaccttacgaaatttctccccgcgtccaccgctccgattccccatccctttccagccgtatctcagaccaaattaaaccatccagttcacattcatggcgaaagaaagagaaagctttgagagtcagtgggcgccctccgatgtgacggaagataatctgaaggagatggtggcgcacggcgttcttccagcgaaggagatcatcgggtggcgaccagcattcggcgaagcattcccaacccccgatacgcatgaaatcgtggtatttgctcatttcttctatggcggtttctcccttccaacctcaagattttttcggggaattctgaatttctatggaatcagcctgcatcatctgaacccaaactccatagttcacatcaccaatttcattcatgcctgcgaagcctttttaggtattaggccacatttcgccttgttccgccgcatcttcttcctcaaaccacagccaaacaagagcaaaccatgtgttgttgggggggctggtttccaactcaggggaaccttaagccaaaaatacttctctatgcccttcaaaacctcaaacaaaggctggcacgcaaactggttttatgttcaaaaccctgagcctgctctccccgagtactcctgtcttcctccagtttatcgggatacttggaactcactgccaatgggagatgaaactgcgcaagtagtggaactgatggagaggatgataaagctaaaagaacaaggccttcaaggagaacagatcacccggcactttatcaagtgtcagttagctccaatcaaagagagatctcgcacagccttcgaatttgacggcaagcacgacccaaaccgtgaagatccagattctcttgacttcaaagtcatgaaggaaaggatgtataagatcttctcaaatgctatcgttgtcagctattcacacttgctgccagtcgtaccgttcaatgcattcaatcctcctccaccggtatgtattcgaacgttccaaccttccttaaaaacatgatttcgtctcttgttaaattgcttgacatttatgctcaggagttcgcattgatgaagttagatcctccaatctcccagcaccaatcacctcgccgccaaactggtcagggaagcggaggaccaagaattcggtctgaaacccaaccaagtgcttctgatccagtcggccagtcagattctcgcaagaggaagctggttctaagtgacgacgaaagcgatgataccggaaagctcagagataaaggagtgaccagaagacctccgaagtcaactaatccgaagaagaagacctctaggcgtcttgtaccaaaaatcagaaagtcttctaggtacaaatcatataacaatcttccttgtattaatactctcccatcatgaaaataacactgatagcaaaacttgtaggaaaccatctgacatagatccttctgagaaagactctgacccgactaacatggaagcggattcctcaaaagaaaccgggctgactgcaaaagatcacccaagtgataatccgcaggccagcgactatgtaaaacccagtgacaaacccacgactgcaagccagtcggccgaagctggagtcggagttaaccaggagcccccgactgcaaaccagtcggatacaaggccaagccaaaagattcccgaggttgaagcttaaacaaacagtcctcccggaaaggatgctggcaatgactcagaaaccagatctcctgtgaagacacaagagtccactcgtccccgaccgggaatcatcacaggtaaacacgctatctgaaatcatttcaatccaacagactttatttgattgcttcatctttattcatgggtacactagggccaatgattggtgatgaagaagagatcctccggatacgagcagctgaggattcgcgccctcccattctggtcaagtggtgggatgacaacatgcaacctcaagggatcgtaataaataagcaaaaagaggacgaagagttatgcctactgaaaaaggcacttggtcaggcaacccgcattgtaaatgtaagctctttggcgcctgatctcaaccatctcgtttgccat

SEQ ID NO: 58946 - DNA, 1450 bp, Oryza sativa
gctgctgacgtggttagagattccaagatgtcgactttcggccgactgggtctgataattccgatgatgaaaaaactgatactgattgatataacaatgattttgatgattaatgatgatggaggcacaatttgtacaatactgatgaatttatgctatgcttggtgttccatacttagcttttgatttcttaaaagcctttgtcaagccttattgagcctaaaacccgtaaaagctattaaaaaccttcagtcctcattgactaagtcgaaagaccaagcagggcaatgataaatcaagtaagcaaattgaattgacaaaaatcacactctattattatcatagtagccccccgactgaaaacttcaaggaaaaacttgaagttagcagtcaaagaggaaagatacaaacgaaatgcctaagcataaaatcgacgaaggtgttcaatattccaagaattgtcgataggtgtaccgtcttcacgctttagtcaataagaacctggccgggtgacttcagagattataaatggcccttcccataaaggagataacttgtgccgatcccgtgtagtttgaattttcctcaaaaccagttctccgactaagaaagctcgtgatcgaacgttgcgattgtgataacggcgcaacccttgcaaataccgagtcgactgaattaaagctgcttcacgagcttcttctagtcggttgatgtcatctactcggccctgttcatagcgctcctcgttgaagttccgaaatcgtagcgattcaaattctacttcactcggcagcattgcttctgcgccataaaccaagaagaacggcgtctggccggtagcctgactgggagtggtgcgcaaagaccaaagtacggacgacagctgttctgcccacttgccagcatagggacgcagtcggtcgaaaactcgtgctttgatcccttgaagtatcatgccattagcacgctcgacttgtccgttactcatggggtgtgccacggaggcgtaacaaattttaatgccaaagttttcacaaaagtctttaaatactccgccggtaaattgagtgccgttatcagtaatgatacgattcggtaccccaaaccgatgtacaatattgatgaagaaatctctagctttgtctgcagtgattgtaacgaccggtttggcttcaatccacttggaaaactaatccacagctacaaagagatgagtataaccgccgactgcctttttgaatggaccgaccatatcaagcccccaaaccgcgaacggccaagacagcgggatggtttgcaactcctgagctggtaagtgagtttgtcaggcaaagaattgacaaccctcgcatgttcgttgtcggtgacatggggccgggggtatcgtgactagaggcttgggcagccgcggtcacccacgtggcttgaccccctcggggggggggggggg

SEQ ID NO: 58947 - DNA, 1577 bp, Oryza sativa
aacgggcagtggcgcacagcctctctccgaacgctagcgggacgacggggagcagaacccgcgccgtcgggctcgcaccccaccgtccccctctcgtcgaaatcttgggcggggggaggcgctcagggaggtcggaggatccgcgacatcgccacccgcgggcgacgacggaggacggcgagacggggcgcgtcgccgcctcgtctatggcgatggcggcatgccccagggcgcgctccaggctgcgggcgcgctcctgcgtcacccgcccgtcgtccccgatccagagactccagcccgacgttggctggatgacgtggccgacttggtcatgacggcgcagcagcgcctaggcgccggcgggcggacctccgccaccgaggcctctggcactgccgccgccggctccatgtcgtcgaggcggagggcgcggcgagcggcggccgttgcccgccgttcgtccgccattccctcgttaacgcctccgacccaagaagatgtgcgtggggggccggatgcccgcctcgatatcgagcgccggcgcgacgttcgtcgcgccgcccatgcaacggagggcgcttcctcgtccggagcgccacttcggtccgggcacgggggccggccccccgtgtccccggttggcggtgccggctatcgagcctttgtggcgagccttcggaacgtccgttggcccccaaggttccggcccaccatcaccgaaaaatacgacggaagcgtcaaccccgccaaatcttgcataaccgagagggtactggacgggtggtgaaatgggcaatcgaactctctgaattcgatttgcgctttgaaccacgccacgcgatcaagagccaggccctcgccgactttgtggcggaatggaccccagctcccgagcccgtctccgcccccgaggccacctcgggcccctcgcagctgcctcacaccgcctactgggtgatgtagttcgacggctccctgtctcttcagggcgccggggcgggggtcacgttgacctcgccgagcggagacgtcctcagatacctggtccgcctcgactttcgggcgaccaacaatatggcggagtacgagggactccttgcgggactcagagtggcggctggactggggatccgacgcctcctggtgttaggcaactcccagttggtcgttaaccaggtctgtaaggagtaccggtgctctgacccgcagatggacgcttacgtgcgccaggtgcggcgtatggagcaccatttcgacgggatagagcttcggcacatgcccagacgggataacgcggtcgccgacgaactttcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccagctcccctagattgattgcttggatcactgagatccaggcgtacctcgcagataagactctacccgaggaccgcgaagggagtgaacgcgtccggcgcatctc

SEQ ID NO: 58948 - DNA, 1586 bp, Oryza sativa
tatactgtttggtatttggccagaaagctggtttcctgacagaattaactggtttaggttagctaaagtaccaacttctgatggaaggtgtccagagagggagttgtatgacaggtccaagatccaagctagagaaggcagctctagaatttccctgggaattgaaccgtttaggcgattgaatgacaaatccagattaaacagattttttagcctcccaatggttgctggaattggcccttccaaattggtgtggaatgcaagcagcctattcagtttggtaagatttccaatggttgacggtatgaggcctgacagaccagtgttgtatagggcaaggtcaaccaagtttgttagcttcccaatactttctggaattactccagatatgggattgaaccccaggtcgagtaatctcaagccaatcaaattgctaatgtcgtgagggatggtcccagagaagctgttattctctaaatcgagcatctgtaacgtcattgacagattcacaatcgatcttggcagctgcccaccaaagaagttgtgagagagcatcaattcttgcagctggctgcagtttgctagagaagttacaaattccgaaccctttccgttatctgcctcaagctggtttgttccgatgtatagatacttaagagaatgcaacatccccaaggtgggaggcacaaatccagtgaagttgttatctgcgaggtacaaatctgtgagccttgaaagattggacagagaagatggtatggccccatgaaaacgattctcatgcaatccaaagaagcgcatggcaggaaacttgtcaccaatgttggcaggaatgctcccttgtagcatgttgagccctactccgatcaccctcagtgccgacagattccatagagagtgggggaattcgccggtgagcatgtttgcttccaagctaagctcatgcagaactgggaagttgccgaggcatggtgggatcaggccctccaggtggttgtagtccaagtataggtcctggagcaatgataggttggctagcgagggcgggatcggtccgatgatgctattgttggtcagtagaagcatctgaagctgtgtcaacgtgtttcctagctccaccgggataatcccgcccagctggttatagtcgaggtccaggattttcagactgatgcaggaggtgaggttgacagggaacgcaccagagaaggagttgtagctcaggttgagccattgcaggcgtcggaggcgaccaatgctggtggggatctcgccgtagaggccgttggagctcaggtttagccttcgcgggaaggtgaggttcccgatggctggggagagcgtgccggcgagattgctggatggcaggctcagcgacgccacccgcgtcggcctccggcgactgcaggtgacgccctcccagttgcagaagctggcgccgctgctgttccatgaggcgagcgcgcttgaattactcccggtgagccccgccttgaaagcaagcagcgatgcctcatcgctgcttgacgcagcagcgatcgtcaggaggacggggaggaggggcagtccaagccgcctcatgagac

SEQ ID NO: 58949 - DNA, 4122 bp, Oryza sativa
tgtaattgtagtactaggagcagtgtgttccacttccacctacttccttcttgtgataaaaaaaccaatctaatatgggatgttccgattcgttgcaatagaatgtgttatatccagttttatatatatatatatatatatatatatatatatatatatatatatatatatatatatatatatatatatatatatatatatatatagtaaatttgttaggggcaccatggtgcccgggctccatagccatccaccgtccaaatgctttaagatccgtgcaacacactagaggatgctatcacacattaacgggtctaacccgataagagttgcatgcatatactttccttagaacatgcatgcaggtatttccatttttactgtgcatgtatttacaaatttgcgccctctaatcatgcatacacattatgattagcactttccattttctatatcacatttccatatatacaacgtttgcatgcagatacttaccttttgaatcacgattcgtttttgaaaaatgacgccattccactaattgcgattattgccatctattttcaagattacattccattttcaagatgcacatataaccggctactgtattcctttttttgatttttcttttccacactgtttcacggtccaagagctagctatccacatcgtcttcaccgagttacctcgccgggattgctcgccatgccgtgaagagggccgacgtccgtggttttcgtcaccgacgacgttcgtccacaagcctcttgctggaaaccagaactcctcaaccatttttgtcaagccattacagcgcctgatgtccaagtgccttttcgctgccgtcgctggttgttcgtgagcttcggaacagacattattcaccagcgagctgcattacctgaaaggtatggatctcagtgtttatcactcacacatcttacattcacatgcagtccctgttatgtatagatgatttgccattcctcttctttttatctactaaactgagcacatgatgaatcacctggaacctaaatttatagattttttgttgaaatgcagttgaatttagattgttttaggtatataacatgcccgttcgaatatctttaattgcatccagtgaataaaatttaggtaggtagtgaaacagcagcaatgtctcttttacgtggacatctcaattataatctttgtaaatatagatttaattaattttaaattgaagtatatgacccgaagagaatcatattgcttgttttaataatggtagtttttaatagcatgccgcggcttccaaagtgtgcgagcgtgagaagaaatgtgaagcgtcgttccattcatgatgatgatgactttgtcactccacctacaaggaagaaggctgttcgtgttaaattcgtggcaccggtttcgcgttgtgtaccatcttccatcacacctatcatacagagatttagtgctgaaaagaaagagctggtagctgagatgggttttgaggggctgctgcatatgcccctcataacaaaccatcgtgacttcagctactggcttttgtcacgggtatccccaacacgttcggctatcgaactagaaagtggtgaggttttgccactgtctcctgaggatgttaagaaggtgcttgggattccttgcgtaggggaggagctgcaagcacccaatgttgagtttgtttctcatgtcaagaggttaattgctgaaagaatgaaagttgctagttttaaggacgttaacaaggaggtattggaggatgtattagataaacaccatagagggcaaatgtcaaaggctgagaaagaaagtttcaaaacagcattcctaatgcttgttatgatgaaatttcttgcgccacaatcaaatatggacaataaatgtccaagatatttttctgcactacttgaccccaatgaaatagcaaagttcaattggtctgggtatgtgttgaacgagatattggacgcagcggcaactgttcaaaagaagcacgctgatggcactaaatgtggttatatcactggttgctctatttatttgcaggtatatagactttttcccaatgcagtacatacactaaatgttataattatataatgatagtgagtacactaataaaatttttcatgcaaaggtccattatttggataacgtggactttggaggtgatctaaacttggagcataatatatttcctcgaattgcattatatgatcgtgatacaataaaggaaagatatcagctggacatcagcgaaaggaactattaccaggcaacacagtttggaaaattaaaggtactttacaaaaaaataattcatagtttatattgttctaacccttcacatgtctgatatacttgcactttatatcgatccagctacggcccaaaaatgaagtctgctacaaaagaacgtgcgaaagaacatctgtcactgacagcgggggaaatgaaaatgttcagattgagtctcaggtaagttattaaaaaaatttctaccaaacatgtttatttagtaaatatctagagatataaacttttaatatcaacatgcaacacagcatgctgctgaattaatacagaaggcccaagaattgaaaagtttttggatttcctgcattggcaaccttgataaggcaacagagagtctagttaaggtgacagaagcttcgaagaacatgcccagcgtgaccataccaatcagcgatgaagttgatgtttctaaaggttatacatgcacaactgtcaacgatgatgctgagaatggaatagaggtcaaccaaacaccatctttaggaaatgatgtagaagatgtgagtgcagctgctgccaattgtacaccgatggttcatactcacaacttgaaagaagaatcaatcgacttgaatcgcactgttccacacaggacttatactggtctggacttcgatcctccatcatttgatctaaatattgactactcaccatcaaataacacaggttattttcctacacgtatatgtttgctgcctgattttcatgtttcacatagtaagtacccttattgttcctttttttttccatggctggttgtgcatgctgacagtgaggcgagagaatcatggagtaagttgtcattcaaagttcaggtagacaaagatgaagaagattacaaatgtgtttgcaagttgtttgagcacatgggcatactgtgttgccacgttatcaaggtacgccagctttattttggtccttgtacttacatttttttacctctaaaacatgcctctttcttcttaaattgttttacccatctaccataaatttgggtaagcgtatatgttgataagttaattcttgattcgattcatattctgtcagctttaatccagtgtatacatctgtagaaaaccatagttaccctaaaaaaaattagttttgatgtataagcagtttagtttatcatttccgtttttcattgttcatgtaggtaatgacacacataggctgcagaagcatcccagataagtacattctaagaagatggagtattagtgccagagaaggatctggcagcaaccttgagagcttcaggaatgacaaagatgctgcctcttccaggacacaccgccacacactgctctaccatgcatgtatagacttgtccaaacaaggtgacatatcggttgatgctttccaccttgctatgaaacatataactgacgcactggatgagattaaactagtggccggtaccaacgaatctcccatggggtacactgatcccccaaatgatgaacctgctggaccggatcaaggaggtgaacaaaatgaagaccccgcggctcatcaggccgtacaaagcttgccactgccacctgatcgtcgggcaaagcgtggccgacctaggtccaccaggctgaagtccccagtagatggtggagtccgaaaaaagcgcatttgttcgaactgtcatctgaaggggcactatagaactggatgccccacaaatccggagaacacatcgaagaacaaagtgatcaaggtgtgcacgaaatgcaagttagctggtcactatgcatcaacgtgtggtgttggtgtatagaagcaagtctatcgttg

SEQ ID NO: 58950 - DNA, 1408 bp, Oryza sativa
attcgtgatatgttgtaattcaactatgtatgtgtgtaccaactactgatccagggattggtacggataaacacagatgatttccgatttccaaaatcaggggtccacacggacccacaggtcatagactgccctcacagaccaacacatgtcttttctgcacactttgtcctcactcgtgtgcacccgggaagaatttcccggtcggtcacccatccaaaattgctccaggccaagcacgcttaacactggagttctttggagattggcttccggaaaagaagttgcaacttgttgatatgagtattctattaatcctattaagccataagccgggatgttacatttgtcacatgtgacggcttgcttgatgtcgctccgtagtgatatgactcctcgaggaccaggcatcttcatcatcatgtaggtgtagtgtgggacggccataaatttggctagagccggtcgtccgagtatagcatggtacgctgtctcgaaatcagcgacttcgaaacaaacattttctgtgcgaaaattctcccgagtgccgaaggtaaccggaagagtgatctggccgagtggtgtggctgataatcctgggataacaccgtggaagggtgcattacttggctttaattccgtgcgaggaatctgcatatcgtccagggtcttagcgaaaaggatgttgagtgcactgccaccatcgatgagagttcttcggagcttgacattgcgaaccactgggtctagtatcagggggtaccgccccgggtggaccactcggtcgggatgatccgagcggtcgaacttgattgctatctctgaccaccgaaggtattggggcgtgttgggctgaaccgcattgatctcctgttctgttagcttctgctttctcttagattcgtaagccagaggtccgccgaagatgtgattgagttctttacgatggtcttgaaaaccagtcggggcatcatcttcatcatctttcttctttgatgtgccttgatctccgtctgagggcttacgtgcattcttgacgtattgcttcgcaaattgtttgtagacgaagtagtctttggccacgtggttggagttgggatgatgcggacattgggagttcattatcttgtcgaatgtgttgacgcggggacgttgtcgggaagatggagaggttgttgccacaagttcttcgggcttacgcttgcgatccttgcggttgttacttccactccctcctgcggtcggcgtgtctttccttggcttccaagtggtgcccgactgtttggacgcagtaatagcatcttcggctttggcatactcgttggttttttcaaacatctgcttaaccgtcttgggaggtttgcgtccgaatttgccgactaggtcgtcgtggcgaatgcctttagta

SEQ ID NO: 58951 - DNA, 7290 bp, Oryza sativa
cctgctgcgcggattgcaagaccgtagacggtgagccaggattccgggttggtggtgccgtcatacttctcgattccagtcggcttaaagtcagctggccaattcactcgacgcagatcatttgtgaaggcagcaactccgtccatgtcgtcgtcgtagcggtccggtgaatgatgtcctcttgccgcgcggcgctggttgatggtgtcacgaagatcgatggggcgtcttcgatgtgggaagtgtggtcgttcaactcggcgctccctatgttgttcaggaggcaaacgaacagatcgttcatcatgtcccttgctcttgcgactagatccggcgccggtaatgctgaggcttggttggtgatagtcttgagatcgaagatgagggactcggctaccagtcggggtgcgggtgcttgcggagttggctggaaccgaggcagcgatcatggtcttcgtctggttcaagatgttgacaacatgatcagcttggttgagtgcgtcttccttgaggagggtgtcaaggagagtgattgctgcaaccgcgttctgctggggggtgcgaaaaaccgttgtttcatcgacgtcttgttgcccgatgaggtctctcgctcgtcgcctggattccaaggcgcgttgccgtcgatcttcagcctcctttgcaactcgctcgcgatcttgttgctcacgctgtagtcgttctcgctcttgtcgttgtcgttcttcctccagtcggcgacgttcggtttcttgtcgtgtgcgctcttcctccacttctttggctcggcgttgttcctccgtttcgttgtcagccatgaatacgccgaaaaagagaggcgtgtacttatcctcatagctgtcgtcgaagtcgccgtggtcgtagtggtagccgaagtcgtcgcagtcgaggatctcggttggtcgagaactgacgtcagggaagctaaggtagccatccaactcttccgtcgagactgtcccaagaggttggagtataacgccaacctctctggatctagattggatcggggccgaagccggagttcgcctagatcttcgagtgggagatgtcttggctgtaaagacagcggccaaatcatcaggaagtctcatcaggattgagggataggacccgtcgtcttgatctggtcgcggaggagtagattggatctcgtccgagtggtttgaagccgacccgagagagatgatcttggagtaggcctcggccgagttcggaataccgaacggcgcggggacatggtctctccccgactggttcgaatccgagtcaaggagagagatcttgctgaggttgttggtgatgaagttgaggctatcgaaccggaacgcctgcccgggagggaaggcgaagtcgtcgatgccggagacggaacccatcgtacttagtcagcaaaaacttgatgctgcccctacctggcgcgccaactgtcgaaacaagatttcggcaataataaaaagggggtggctatcaagctaggaaagtggatgggtttgaagacaaggaattttatacaggttcaggccttcttattcaaaaagtaataccctactcctgtccggggatgattccgccgagtatgttattgattgtataaactggaaaaaagatcacgcccccgcacacagacccctccttatataggggaagaggtccgctttacaaaatatagtccatatcctaacggaatatgggattatagatgaaatacaatcgtaaccgactaagatcccgagtatttccttgacatacaagtttagaatctaacccgagtcctcatagagatattctatctatatttggtaccgtatatccgactaaattataatgtcatgtagatatgaggtatccataatctccacactcgtgttattgaatttgcatgtgccatggttgaacccgaaattttcaataaaattaattttactgcttcaaatttatgcctttttggaggtcatatacaaagaggacacagctgacagctggcttgttcaccagttattttcttgtttggacgagaatggtttaaacatttcaatcaaatttattttgaatgctattttctatgtcaatccttttcatgtgacttcatcagcttagaaaaatcatgcctagcgatacaataatggatgctttggatggattggaaaagtacttccttataattgggagtttgtacccataatttgtggacggagtaagtatgcaagtactatcaacatgtaattccatcggtcgtacagtaagtatttgatggtcttatttgtctgtgtctaggataagagttggttaaacatttcaaactttcaccatccattttgtattataaaatctaaaagtttataatattacttctagaggaaaatctactcatacaatctttttttttctttttaaatgcacaagtttgtcataatatgatattacttttgaaggcaaatctacacatacgaaaactatttatggtcaaagtttaagagataatccaagaataccattgacaagcgtcaaatccaaaaaatatcatcgtacaaacgattttgtcccaaaaatgtaatcgttgttagggttccgttcatcctatagcactaagcaatgcagaatggacggaaccctaacggcgataatatttttaagaaaagtcatttgtacgttgacatttcttaaaactcacacttatcaatgatatttattggatttgaatgtttgtcaatggcattttttagattatctcaagttttaaaggtttaactaaatcttacgctaaacgtcaaaatatttacgaatcttgtcaattcttctactaggcgaatataaatggtcatgagtacagacacggaatgaacagaaaccccggaaggccagaacaaagaatttgtaacccagaatttatccaaacaaacatgactatgtaaaacgagatggtattaacgtataattgattgagttttaatcattacaaatttaaaaaatagattaatatgatattttagagcaacttttatatagagagttttagcacgaaacgtaaagtagtttgaaaagcgtgcacggaaatcttaatcttgatctaactcttattggagaaaagaacggacctacgctcccagttgttaattggcatttgtcaatcgatctgaaccacgacagctaacaataacaaatatgaatttggaagtcatatatagagacattttcaaactagtaggccaactgttttctaggctacttttactaaattgataaaaaaagcaatgcaaagtgacgctttacactaaagacctactgaattctactttcagaattatagcaagctgtggtaattttcaggtgtcgttcctggtaaaactgcattataacaaaccagaggcttccctcttgcagctaacttttctcttcgggagaaacacatcagtcagcacagtcttagacttcagggaagcaaggagtatctccagtacctacatttgaacacaaaaatcatcaacagtgccaattaaaaaaaaacaaaaacgactgatttttttttctctttactcaaagtgagagatatgtacacagtagtacagtacagacctcttccttgccaatcttcacggtccgttcctgcagcgcgctcaagtccttgacaccacactgtgcaagtaagctgacgcttgacacactggacgctggagtcattgagagatcatccctgacagtgtatgtggctgtcccaaccacaaatccaacggttttgacatgtggaattgccctgtgcatttgagtggagcagacagggcatacagcgcctttgctaacagaaaaatatccacaaggaactttagtggtactgtagcttacgacggtcgatttcccttcacatgtgaagaagctggcattgacatttaactttgcatccagcagcagctgctgcaatggacagagcacggtgggggcaaccgtcgggctgaggaagcgttccttgctttggcttgagattacatacttggaatccagcttctccacgctgtcaagcacattgcccatgctaccaaccatacgctccttggtaagcatgttgatgatggtgctcattgggaggcaaaggaggcaggagataaactcaatgacatcactaccagcctcggcaaagcagactttctgagccttggtatcaatcaagagcttcatcgataatctgatggctgccatgattttcccccttctatcaaaattctataaatttcttgggagttgattggttgcttctacaatcaacaacaaaagaaaattatatgggttttcagttaactagcgttagagtccaaatgatcagaacgcgcagcacactgacacatagtggaaagctatgcaaacaattttccagagaaatttagagcagagtagcagacaaagcaaaaacacgttccagattgtaatccaatgaagcgtctagattggttggcagctgctcaaaagtaagcaaaaatggcatcctagtatacaggatacaacttctcctgtggacttgtggggtaaccgggtaaggtaacaatccgtgcagatgacacatttccaaataagaaatggcagagcagtatgttcatattttccacatagtgacacgggaaaatagattcagtgcaagtaatctgctttccttactatctcatttggcaatgccaacaaaaaaaaaataaataaacacgaccttataaatgttcttacaggcaaactcattggttgcagaagcagtgaagcacttgagacaaatattagcataacatatcaagtgtaaactagtactatgtactgcactaatgttcaggatcaggtttatcagttacgttttttctgtaagtcaaatcgaatgttcctaaaaaaaatcgatctaggaaaaccttgaaaagacgggtaaatgtttttatcctgaaccatagaaaaatatttcagcaagagtgctagattcatttcgacagcaagatcatgctagcagtctccattatactagaatattcaaactgaaaaataccattccgtttgcctcactagatctacggtccgatatcaatagaaccaaccaaaagtaagggagagaaatcaacgacgatgaggaaaaccaaatcaacgagagagagagagcaatctgcaaggtgagaggagaatgtatagcaccgggggacggagaggaactcgctcacacaatggatcgccgttgatgcccgccgctgccgctgccgccgtcctgcgacggcaaaaagaagggaggcgacggcgaggagtccaggacgatgatggatgagcacgggtagtagtagtagtagcctaatggtttgcttcctttggccatttacaaataccggcccgccccgatgccgccgtaatcggagttgccggaggtgctgcacgttgacgtttcctgacttcgtgtgctgtttcagggcccgcgtaattgtgcggttagcatcaaaataaaattacgttatgatatgattttatctatattttttcattgcatctttaaaatttgtggaaccgtagatttgttggctatgtttatatcaccaacatatcgtattgcatacatatagacatgtttcttggatagagagagtttataaatcagtgatatgttatttctgagtgagtgaaataaataaacaaagcaactaaacggtattacctctgtcccaaaaatataacaacttttgattatgttgtccagattcataactaaaaatgcttataatttaggaagaaggaagtagtaaattttctacttgactaagtatttccaagagactccttatcctactatgctaaaatttaaggattttatagaaaaaaatagccatctattattgtaatgtttagaaagtcccattagccactagcccactaccaacttctcctcgtttgcatgctgtccttgtccatactctttcgttgttgtcgctacccatccgttcgccctccagcgtccgtcagctttccttctcttctttgctgctctttattcacagcctgccgtgactcttaggctgtgttcagcagctgagttttccaactcacatttctctttttttcgtgcgcacgttttttaaactgctaacgatgcgtctttataaaatttttatacgaaagttgctttaaaaaaagtcatattaattcatttttcaaaaataaatttagctaatacttaattaatcatgcactaatgagttattgacatatgggtgacaaatagttaaatgttaaatctaaaagtggcaaatagttaaatgcccccatacaaagagtacacagctggcttgttcatagttattttcttgtttggaccataatggtttaaacatttcaatcgaatttattctgaatattattttgtacatcaatccttttcccgtgagacgtgactttatcagcttggaaatgatgacgtaatcatcttgcgaatggaactacaccttcgtcttattttaagtgtaactataagtttccatgttcaactttaatcgtatgtctttttaaatttttttgaaaaaaattaaaatagaagtcacgcgtaaaatattgttcatgttttatcatctaatagcaataaataatactaatcattaaaaaaaagaaggttgtctttatgattgatcgtgacatattggacccttgagtctttgatagttactacctctgtcccaatataagtgcagttgtggaatttcgtgtccaatgtttgattgtccatcatacttgaaaaaattaaaaaaataatcacatataaagtactacttgactagagtaaaagatcttgtactgaatattggcaaactattctaaactctcgagagaccgaggggatgctatcattatttacatatcacttaaatggttatcaagaaattaataagatagattaatatatgataaactaattatgaatccactctcctgaatattacttagatacccaattataaatacatacttcctccggtcattgtttgggataaaagttactactatacgaaaaatctatgtataatattacttttaaaggcaaatatacccatacatttctttaaactaagcatttgagaaaatattgatgtttaaagtttttaaaaccttgtccaaatcttatactaaacatgaaatatttataacccgagtactcatttgtcaatcctttcaatgagtaaatacaaatggtcaagactaaatacacggaaagatcagaaaccatatcgcgggataaagataaaggctctcacagtgagccccggaaggcct

SEQ ID NO: 58952 - DNA, 3305 bp, Oryza sativa
acttggacacaggagtgtgctaacccaacccaaacaaaaattgatcgtgctttctgttgtcctgattgggatgtcctctttgactctgcgcacatgtctgcactctcttcgtcctgctctaaccatgcccctttattcataactggctgtatggaaagagaacaaaataattccttccgctttgaatcttattggctcaagctcccagatttccggcaagtaactgcagagtcctggaataggccactacagactaccaatcctttcgtgcgactccatttaaaattaaaaaggcttgcaagagatcttagaagatggaaatcaaccagaataggagatataagattgcaattggcaattgcaaatgaagtagtctttcaactggatgttgctcaagacgatagagtattatcggaggaagaacagtgcctccggaaactcttaaaatcaacggtgcttggactggcagctttagagagaatacgactaaggcaaagagccaggatcacttggttaaagcatggagacgttaactctaaattcttccaaatcaaagcaaatggtagaaagagaaaaaatcacatacagatccttcgaactccagatggctttgctgtaactaaagatcaaaagcaggaagaattgaagcgttacttcacacaaaaattaggagcctttgctctcagaaatcagagattaaactggctgctctcaatctccctacgcttgatctctcagatctcgatgataacttcactgaagaagaactcaaaaatgcaatctctgacttgccttcggaaaaatctcctggaccagatggatttattggagcctttttcaaacaagcatgggacataataaaaacagatctcatacaagctgtttccttctttggagatatgggatgtgcaagactgcaagaactcaattcggcacatatctgcctcatccctaaaaaggcggatgcaacaaaagcgaaggatttccggccaataagtctaatgcatagttttgcaaaaatagtcaagctaaatcactagcaaacagacttgcaccaaaattagatgagctagtctctcaaagtcaaagtgcattcattaggaaaagagcaatacatgacaatgtcctgtttgttcagaaaaaaaagcctactcttttcctcaaagttgacatatcgaaggctttcgacacagttaattgggcatacttgctagaggtccttcaaatctttggctttggacataaatggtgcaactggatttccaacctactaggtacttcctcttctgcggttcttcttaatggtatcccaggtcaggaaatagaccgtgctagaggtcttcggcagggcgatcccctttcccccatgcttttcatccttgcaatggaacccctgcacaaattattcaagaaagcagaggatcttggccttctctctagtctgcaaagacagcggcgcttcagatgttctctctacgtagatgatgttggtctttttataaagcccattcgagaagaaatgctagtccttcgtggaattctttctgtctttgcagatgccagtggacttcacacaaacatggaaaaaacatagatcttcccgataagctgtaacggagtcaacctagataactgcctttccatcttcccaggtggaatttcaaacttcccatgtaagtacttgggcctgcctttgcacacaagaaaattggggaaattagagcttcaacctctggtggacaaagtgggatcgagaattcctggttggaaaggtcgcttcttcacttcggcaggtagagaggtgctggttaaaaacactctttcctctaccccaatttatcacctaacaattctccagcaaaataaatggctttacaaaaggatcgatcgccttaggcgagctttcctttggaaaggtgacgatcctgaaaacgttagcgggggcagttgtcttttgaattggacagtcgtctgcaagcccaaacctttgggcgggcttggaattctcaatttagagaaattcgctcgggctttaagacttcgatggctctggtacgaatggaaagaggaaaataaaccctggatcaatatggaaattccatgtgatgagatggacagaaatctcttcagagcaagtacacaaatttccctgggaaacgaaaagaaatgcaagttttggtcagacaattggctgcaaggatacgctcctaaagacatagcgccgacattattcagattagcaaagaggaaaacaaactgcgtagcctttgagctgcacaataatcactggatcacttccttaagaacaatcacttcaataaatgagatcaatgagctggtgcacctaggcagtaagctgcatgagatcagattacaccccaattctttggatagtatcacgtggaagtggactaatcatggtgaatactctgcaaaaagcgcttatgaaatgcagtttgtaggatcagttgccaacacaaattttatgccactttggagagctgaagcggaacctaagcatcggttctttggctggttaattttacatcaaagaattctcacagctgaaaacctccttttaagacattggccatgcgattggatttacagcttatgtacagatgcttttgaggacgcaaaccatttggcaaaggagtgcagtttcactaacacggtttggtcccaagtttgtagctggctggacatcatgcagaccccaaatcaactacaggatgcaaacattttagaatggtggacctcaatcatacattcaacttatggaaggagaagaagaaaactgataggggcacttcttataacctggtggcaggtgtggcttgagcgcaatcgaagaattttccatcaaaagcaactaagtgccacccaagtagctttcttagtaaaggaaaatatagatgccattcagattttgcgccatacataaaggcttgtgcttagctctagttgatagcattatgtatgtaaatctctgaaaatgaaaactgaaaatgtcacctagtggtctactctttcttgacctctctaactgcttctccttctaatatatccggcagagctcctgccgtcttttgcttaaaaaaatatatttcatcttttttagttaagttattttaggtcggagaaaatatatatctgacgtgcctatcaacaagacaacaacgtagagttgtcagcattagcttgccacaggtttgacttgcaagttgcatgtgagtgtagcttcgacgcagcaacctggtgacctggattcgtggagagcaaacgaattgggatgtgcgagccga

SEQ ID NO: 58953 - DNA, 1234 bp, Oryza sativa
catgtccagtgaataaaaagcatgcacatatggcctaatgctcttatttcatctcagcataacattaattacttttaaaagaattatcgatcaatctacaaattgaaaattgaaagcatggtactctcaatagtatgaagtgtcaaatataatacctgctcgggtgagataccgatgatctcaaaaatcctttgttgtacatcacttttgtatatcctcaaactgcctcctccaatctatatttatagcatgcagaacaaaaaagatgcatgttatgattttctacatagatctttacatgaattccagtacatataaagatacacaacttttattgatgtatcagatcagactctgcagtctgcacaccttgtttcattggctattattacagaaaaagggtctaaactcaaaagaaaccagccaaccagtcttacgaattaatcacatctatctgtcatggtcaatttgagatgagtatttagcatctgagattttaaatcacattccaatgaacaaatacagatagacttgtagaaagggctataatgttatcataatccatatttaaactagaagaatgtcttcaataaatgttgaagagcatgtgccatgtatggatacagtccacatgcattacaatacctcaaccccaagactttattaagacttgtgcttcaatgcttacacaagattttgcatcaaggagaatatgtgctaaattttctactatataaatcatgtaaaagagcatgtgcaatcttggacccttttctgaactagtatgtactgaacaaggtagcaagaaacttgatgcagtgaaagtacctccactccattgtaaatcatgtcataagccaaggctcgagctgatggtagatcattcatatcttcaggatttggtgcagtgaaaggatggtgtagtgcctatgagaacaatggagatgctcagagcacgcaaaacacaagacaatctttactttgagttacatgtcaattctctgttttaccagtgtctaaatttcttacatttaactgtttttccttctcagttgttcaggagagcaatgctcattcactgtaagcattaatgacagattacacattttgtaaattttgctattggtatccctatgaaaatttagattgaacatgtaaaactgtgtatgtttgcctcaaaccttccgtgacattgcaatcaaatttgcattctggagacttgtcaatgtccaaa

SEQ ID NO: 58954 - DNA, 796 bp, Oryza sativa
tttaagcgtttatctttttcgatagcataaattgttatggatttgatattctgtgtttaatctgtataattgcaatatttgttgctgtgtcgtatatgttgaatctgagtcagggagttagaaattctgcaactatggatgtgtaggaattggcaatgaaatcttactcacattgtgtaagaagccaaaactctcgtacttctacatcgtgcaatcaacattattgcattctgtatgcatctcttacactgacatgcatctaagcttaatataatgctataacaccttgtgtacctctgattatttcccaatgcaatcatcaactctacatgtggacctcacgtcctcacccaacatttagctcaagtactttactgttcatttcttaaccacctgagacagaagatattcatctctgattgcatgcatctttgacacagcatctgctaacaacattcgatctttggcttgttgctttgagcaggatatgccaagtctaaggacagaaaccaagcagtcttgaacaatacttcgtgttatgcttgcatctgttatatctttattttttgcttcttcatgtagccagattgttcgatcagctatatctaggactcggccaggaaatgctgctgatgcaaatttgtgcagatccaccgaatccttgaacatgtcatcagtagggctccttccggtaaatatctcaagcaataatatgcctaagctgtaaatatcacctagtctggagactgcagaaccttctccgtactctgcaatattttcaatttcagttaatatt

SEQ ID NO: 58955 - DNA, 5481 bp, Oryza sativa
ctcgtgaccctgtggattgatacttgagcaacaggtgatgatctttataagacaacgatgtcgtactcttctcaaagcctcacattcaacctcaaaactcttggcagatcctgattgtcgaaggttgaacacttttacagccacaattgcaccttcatcttctaaagtacatctatagacggaaccataacttcctttgccaagcaaattagcttctgaaaattcattacttcctctggctaatgcataatatgaaactctatgatagtgttcatcagtacctgggattgttgctcgactattttgtctccgtttaagcttcctgcagaactgaattagaacagtagctgaaactaacagcaagattgatcctgttattggcagggcgattttaagagacttatgccaccgtttgttgtttttgcttgcatcaataatgggacatggagccaagtgaagctgaggtattccaccacacaagttgtcgttccctgcaaccgatgcgtacgtaaggttcttgaaaactccctcatctggtacttctccttgcaaattattgaatgacacatctaatttccacaacattgtcaaattttgcagagttgctgggatgggtcctgaaaaattgttctgtgctagaaatagttgttgcagattgccaatcctaccaatggtatcggggatcctaccagataacttattcatggttaggttcaggatgttgagccctttcaggttggtcaaagattgaggtatgccgccttcaaatgagtttttatctagcagtagcgattccagcacctgacaatttcctatactgtcaggtatttgaccagacaactggtttcccgacagtatcaactggtttaggttagccaaggtagcaacttctattggaaggggtccagagagagaattgtatgacaagtccaagtaccaagagagtgaaggaagctccaagatttcctttgggattgacccattaagacggttggtcgataagtccagaacaaataacgtttttagcttcccaaggcttgcagggattggcccttccaaattggtgtagtatgcgtagagcctattcaaatttgtaagatttccaattgatgatggtatgaggcctgacaagctggtgttgtacagggcaacttcaaccaaatttgatagcttcccgatgctcgctggaatcactccagataaggaagtgaaccccagatccagcgtgtccaagccaatcaaattgccaatgtcctcaggtatgctcccagagatgctattattatctaagtagagcttatggagtgtggtcgacaagttgacaacagagtttggaagttgcccgctgaaagagttgtctgagataacaagctgttgcagctgactgcagttggttagtgaagtgataaattcccaacccttcctgttatttgcctcaagtcggttgccatacaagtataatcgccgaagagatttcaaccttcccacagtaggaggcacaaatccactgaatctattaccataaaggagcacaattgtgagtgatgaaagattgaagagagaagaaggtattactccactgaattggttatccgccaatccaaagtattgtatgccagggaacttgtcaccgatgttggcaggaatgcttccttgtagcatgttgtcatttgctgcaagcaccgtcagtgttgacaggttccacagagaggacggaaatatgccggagagactgttctgctgaaaactaaattcacgtagagctgcagctttgccgaggtccagcgggatcaggccctccaggttgttgttgtccatgtacagatactgaagcaatgacaggttcgctagcgatgccggaattggcccagtgaagctgttgttttgcagctgcagcttctggagttgtgtcaatgtgttgcccagctccaccgggatgcggccgccaagctggttaaaggcgaggcccagattcttcatgctgatgcaggaactcagattggcagggagctcaccggaaaacgagttgcctccaatgtccaggatctctagacgccggaggcggccaaggctcgggggaatttctccatacagctcgtttgagctcaagtttaggctctgcaagaagctgaggttcccgatgaccggagggagcccgccggcgagattgccggagggcagcgtcagcgccgccacccgcgccggcgtccgacggtcgcacgtgacgccctcccagctgcagaaactggtgctgctgttccaggaggcgagcgcacttgagctgctccccctgaacgctgccttgaaggcaagcaacgtggcctcatcgctgctgctgctgctgccaccaccagcgacggctgcaacgatcggcgtcaggatgaggacgagggataattcaagcctcaggctcatcatgatcgtcatgggacgtattgtgtttcttgattggtttgtgagagtggtagtgctatatcttagtaccaatggctgtccgtattatatggagagtatagatggtctttgaagcaaatttggagatgatgacagtttgttgattgcattcttttaattccttttttccatttctggaacacttcgtttgactttataatatagtactccctttgtttgtttgttctaaataccttccgttcaggatatgtatctggacaaccatatctagatgcatatcttacatccattatttatggacggaatagtacttgtcctgatacatcattcatactactaatattgctttggtcacttgtttttttttccctaaaaaattacaaatatttttaaaaaaatcatcattaccagtttaccacgagctgcttttgctcatcttagcattaacatttagttaataaaactactactgtcaaagctaaaacagtgctaaatcaagctaaaacagtgctaaatcaacaagaccgttctaaatcaacaaaggtcttggaccgaagtggcgaaagcaatggcgaaggagaccatgctttggaagtcggcttattaagggatccccgctgtttcgtctttacgaggtcgtggtagccaaatttagcacgagatattcctctagtttttcataatgtcctttatcggtccctgcttgttttccttttatccttataaataacttttatttctcttaatgaaaaaaatacgccccttgcgtattaaaaaaaatccacaatgaaaagtatttcgtgaacgagggaatatatacatttcgaacggtcaacgcggccaggtgcatgttgttagtattttcgttgagtcggagagaattgactttcagaacacggcgatttaggcggctaggcgatcgacggaaggcttgcatgatcaacgcactgttacataagcctacttgcagatggagatgggtttaggctagctgcctgcttgaagacgacgacgtcgttgtcgtctcactgggatgttgacgtgggcagattaccgaatacgtagcctaacaagtcgtggagtggctttcagagcaaagaaataggcccaattagcccataaacaaagacagcccgccaagaagcctgacaactaaattgggctggactgggctgtaggcgtacgccgaaggaaagctcaaactctaaaaattcgcccaccgacgcgcgccggaaaccgccttaactcctcccgttcccgctcacatttttcggcatcccaccaacccgtcgaccccggcatccaacgtcgtacatccctccacgtcatcgatccgcgccgcgtgctttccaccaatcaggttgcacatcccctcctctacaaaatcatctccccccgtctcctcctttccccacgccgcaatctcgcaaatcccaccgcttccctttcctctcctctccccgagaagaagagggcggcatccatggcgcccaaggcggagaagaagccggcggcgaagaagcccgcggaggaggagcccgcggcggagaaggccgagaaggccccggcggggaagaagcccaaggcggagaagcgcctccccgccggcaagggcgagaagggcagcggcgaggggaagaaggcggggcggaagaaggcgaagaagagcgtcgagacctacaagatctacatcttcaaggtgctcaagcaggtccaccccgacatcggcatctcctccaaggccatgtccatcatgaactccttcatcaatgatatcttcgagaagctcgccggagagtccgccaagctcgcgcgctacaacaagaagcccaccatcacctcccgggagatccagaccgccgtccgcctcgtcctccccggcgagctcgccaagcacgccgtctccgagggcaccaaggccgttaccaagttcacttcctcctaggctgtacgcctgcatctagtcctagtagtaatagtagtttttatatgtttatgtggtatattgtttaagtgatatccaagattggaaatggatgttaaattgttggtttggtagtcattggctgtaagaagaatggctttgggttgcttttgggaaacacttgcttcacggatcgggcataagtaaccatgcttttataacatgcgaatgtgtgctttctcttgtgccatcattgataagaatttaccttgtgccagtgttggtgatgccttcgtttaatgttgtggaattacatggttgctagtattttgtctcgtaaatttcttttcatgtcattggaatttgatttctgcagcatgtacattggtgttaggtactgctcttttgcgtgtgcctcttttgcgtgtgcctcatgtattgtttagagattttagaagcacacactttgggacaataccaaattgtttttagcctgacaagaaatttagtttcgtgctgtctgcatttgaacaaaaagtttgtacacattgtttggtgcactagtacatgatatgatatgtcctccattactgttttattctgagattagaacttcgacaagtaagtttttcttcagcttttgtcaggtactgattttcaaagaaatatagcgacaaggaaatggtaactgaaacatcacattacaattattgatttttaagattatgttgtgcccgcatgttttctcattccgttctgaatttctgagtgctgctagcttatgagctaactgttaggtatgcatcttataccaaagttttcagtcaggctattgctctattcaagatatgcattgccttaaggcatatgtgttaagattagaccaaactcttgttgattctacttattgtaataatgtgtcttgtcctttgattcactctccagttaggtgattctccctccagcgaagttggaggtgaataagttacatccaaggttctacgtggaatattgtcctgaatttcggttgggcttgttccataatacattcgctgtcaaataactctaatttttatgacagcataaggattaatatggatgtatcataatttttactcatggaataatttcagttgctatta

SEQ ID NO: 58956 - DNA, 2078 bp, Oryza sativa
ctacatacatgtcttatccaacatttagttcaatgccaaccatccaagacctgagatattcatctctgatggcatgaatctctgatacagcatctgctaagagcactcggtctctgggttgttgctttgagcaggatatgccaagcctaagaacagccactaaacactgttgaataattcttctttttgtgcttgcatttgtcacatctgtctcatttgcttcttcatgcagccagattgtctgatcagctgtctaaggctctatcaagaaaagaagctgcaataaacttgtgcaaatccattgaatccctgaaaatgtcatcatagggcttcttccggtgaacatctcgagcaacaatattcctaaactgtaagtatcacccgctctggttactgcagaaccctccccatattctacaagatatgcagtcaaaattagtttctaactgtaccattagcatgtaagatatacaaagtgcacaatccgaccccacccatgagggaggaggtgggaggacttgtgggaataaatacaaaaataaaacttttaactacctggtgcaatatagccaatggagcctctgattccaattgagctttttgaattttgaagagttttagttgtgctgtttgggaggatttttgatatacctaaatctccaacttttgcactcttgtcttctgcaagaagaatattacttggtttcaggtcacaatggacgattggtggctgacagtggttgtgaagataatccagtgcatccaagatatcaacagcaatgctgagtctctgcggaaggctgagtgtattgctagtgagattgcttgacttgggatgatttcagccatccaagctaccattgggcatgaactcaaacaccagtgccttgaactcttgaccctgttggtcaatactcgaacaacaagtgatgatctttatgagacaacgatggcgtactcttctcaaagcctcacattcagcctcaaagctccttgaagatcctgacatttgaaggttgaacattttcacagccgtggttacacttgcaccctcatcttctaaagcacatctattaacagaaccataatcttcctttgccaagcaggttagcctctgagaattcattacttcctcttgataatgcatggtacgaagctctgatattgttcatcaataattagggatgtcgctcggctattttgtcttcatttgagcttccggtggagtaaacaatagaagcacaacaactgaaactaataccaagactgctcccgttgttgttagagccagtgtaagagacttaggccaccgattctttttctttcttacatcaaggattgggcatggagccaagtgaagctgaggcattccgctgcacaacttgtcatccccagcaattgatgcataagtcaagttcctgaaaacaccccattgagcatgtttccgatgttagaaggaatggtgccattgaacatgttttatatccaccgtgagcatgatcagtgatgacagattatacagcgacaccgggagtttgccggagaggtagtttctgttgaagagaagataccttaaacctgcgatgctgccgatgcctggcgggatcatcccctccaggtggttgccgttgatggcaatgcctgaagcggcgacaggttggctagcgacgcaggaattgaccctatgaaggtgttgttcgccagcgcgagcgtgggagccgtgtcagcgtgttgccaagctcaccgggaatgcggtcgccgagctggttgtattggaggtacacggttgtcaatctgacgcaggtggtgaggttggtggggaactcgccggagaaggcgttgtggtccatgtcgagcacccggagtcgccggagccggctgacgctctgggggatctcgctgtggagatcgttggagctcaggttgagccgccggaggaaggtgaggtttccgatggctggtgagagcgtgccggcgagatcgctggacggcaggtccagcgccaccacggacgtcggcctccgccggtgactgcacgtgacgccctcccagctgcagaagctgttggcgctgctgtt

SEQ ID NO: 58957 - DNA, 1343 bp, Oryza sativa
atcaaattcctcgtatgtattttacaacggctaactgggtccttgttatggctttcaatagaagccgggtcttttgaccttctctaaaaaaaaaaaatctgggaccttgtttacctccgattattccaggcaaaatgattgacactacatatgtatattatctagcatttagctctagtgctctattgctcgttgcccaaccacccgggacttgaaatattcatctctgatcgcatggatctttgacacggcatctgctaacaccattcgctctctgggttgttgctttgagcaggatatgccgagcccaaagagagacaccaaactctgttgaataattcctcttgtcatgcttgcatctgtagcatctgtataatttgtttcatgcagccagattgtttgatcagctatttccagggctctgtcaggaaaagcagcggtagcaaattcgtgcagattaagcgaatccttgaacatgtcatcagtagggcttgttcccgtaaacatctcaagcaatattatgcctaagctgtaaatgtcacctagtttggaggcagcagaaccttcaccgtactctgcaatatttgcaacacacacagttaaactttaagtgtaccttcaagacaaaaaaaaatacgaatacccctaattctacttctatctattagaagaggagggaaatgaaggaaataaggacagaattacaattttttttagctacctggagcaatatagccaatagaacctctgattccaattgagctttttgaatttagatgaattttagttatgcttttggggaggatttttgatatgccaaaatctccaaccttagcattcatgtcttctgcaaggagaatattgcttggcttcatatcacaatggatgattgatggctgacagtggttatggagataatccattgcttcaaagatatcaataacaatgttgagtctctgtgaaaagctgagtgtgttgctaggactgcatttgctcgatttgggatgaatccaaccatccaagctaccattaggcatgaactccaaaaccagtgccttgaactcctgaccctgtggatcaatactcgagcaacaagtgatgatctttatgaggcagcggtggcgtactcttctcaaagcctcacattcagcctcaaagctctttgaagatcctaattgttgaaggtcgaacacttttacggccactagtgcatcctcattgtctaaagtacatctataaacagaaccatatcttcctttgccgagcaggttggcttctgaaaaatcattacttcctcttgacaatgcataatatgaaaccctttgatactgttcctcaataac

SEQ ID NO: 58958 - DNA, 784 bp, Oryza sativa
tcccacgataaactggatgaggctttgcattattatagaacgatggagtcgagagggatgacaccagaaccaaggacgaagctattggtaaaagcaatacgtatgaagaaagatgaacctgctacagaagaacctcttaccaggaagaatctaaaattggatccaatttcaagactattccatgttcgtaaatagttcatcaatagattatactccagttgggggcttaggtttatgggctgaccaaatctagcctaagaatgtccagctagcccaggtttatgcagctgtgaagatgtcaatttgttggatattctaggagtttcatggctgaatgtgaggcattgagtagggtgtgccgctgttacttaataaagatagtcactttttgctcaagcattgacttccaaggtcaatgattcaacagcactggcctagcagtcttaagtatatgcctcatggtaaattgggtaattgcatcagaaatgtgtcaagactccaggcaataccctctgtctagctcagagacagggcattactgttgacgccacagatgcactggagtatctttaccaccactgtcagctaccaatcatccactgtgatctgaagccaagcaacattattgttcagtggacatgagcacacatgttggggattcagcgtgtcaaaaattctttctgaaaatacaagcaaaactttgcaatcagttcaattggaattagatgttccatcagttatgttgatccaagtaacagagatccatgcgttggtctcattattt

SEQ ID NO: 58959 - DNA, 2147 bp, Oryza sativa
gggggggggtgagattaatttggcatctgaaaatttgcctagttgcgttcgcaccaaggatgacgggacgctcttattgtcacagtcgaaaagagctgaggaaatcatcaactgatttacctcaccatatcacaactaaagttagccaaatttgattaagttaggcatctgtttggtttgtgccacacttatggcaagattcatttatcataatgtgggtcatatgtcattggcacgtaaaagtgtggtaggcttgctttcctatggctgaagtgtggcttcaattttgttggccacatgttaagcatatgttagctaaatgaagtatggcaagttttgacaatgtgggtatgccaaccaaacccctaaatcctgatgtttatgaatattatgcacatgaaaatatgttctcattaggattttagcgagttaagaaagggccattgtctttccttttttttttttgagcttatgctaggaggcgtatttggccgatgtgcactgtgccactgtcgtgtaatcgaaaataaggccccctttgaattggaggaaaaataaaggaattgaaatcctacactattcatgtcgttgattcgtcggaataagaaaaggaaaaacgtaggaaacttttctattcctacaattctagagcaaaaatgtaggaaagttaacatccactttgacctcttggaaaactttccttgagtctatctctctcgtctgattcctgctcttgcggtctaatcaaacggtcattcctatatttttcctgtgttttgcaatcctctgttttacactttcattcctatcaaaatcttgtgtttttcctattcctccgttttttcaatcctgcgattcaaaaggccataaaaaagagaagaaatggcattcttccctacccaatcccaacaagcgaagctcaataatttcccaatcccaaccaacgaagctcaataatttgctggtgaaatggactaataagaaattttcgccgtgtttagttccaaagttttttttaaaacttctaacttttccatcacatcaaagctttcctacacacacaaccttccaatgtttccgtcacatcatttcaatttcaaccaaactttcaattttagtgtgaactaaacacacccactattatggacacattactattaggaacacgacagttcggaggaaaggatggtagatgaggctgtgtttatttcagcgcaaagtttggattttggttgaaattgaagataatgtgactgaaaagttatgtgtgtatgataggttgatgtgatagaaaaggactgaagtttggatccaaaatttggatctaaacacagcctgagtcactggatctggacttggatatcatatcaccgatatgatctcgctgctgcgtgccagcgcggtcgatcgcgtgaggaaaacggcaggaaaagctgcgttccccttgaccggctagacagataaacgttcttcgcctgagcagaagatcgcgtcaactcgttcaccggcgatggagatggaggacgacggagaggagaagtgttcggtgaagcggcggcgacggggagcaagtgagcaactttgttgctcagcctgtcagataatgggccatatctcgtgcttgcctcgaatagtttgggcctttacacgggcccaaatgtatctctcttggttgtagcccgttgcaaatcatgggctgcgcgctaaccttcttgtgggcctccttctggtattgtgggcccaccaaaatgctaatccaccgcaaggtccattcactgttggacagatcgctcacgcgcgcgcttccgccggggtctcgtgctcacctccgggcaccgcctcgccgccgccgccggaatgcgccgtcactggaagccgtgctcagctccgacgcgtacgatgcccaatcctgtatactttttcttcttcgagactcccgtcgctgtagccacaacaattctccagagactcggagttctcagtctgcgcccgttacctgttcgacagaactcctccgaggagcttactgtccctggccctttgactaaggtgagcatccaattggttaatctccataaattttccacgccacggaccttttcaagtttgtacatatgtggaaagacatggccgtgcctgctgtaatt

SEQ ID NO: 58960 - DNA, 4726 bp, Oryza sativa
actgccaacctaatggattctctgttggaatcagtcaggaagaaattatcaggaatttggtcgaacagagaaggggtgaggacataattggagcgagctaagtcatgtgtgagggccgagggcgacagcgacgagagcttggatgcgtccaagctttccatatccttccagtactatgttacagtaagtatctagttgggaaatgatgtggaaaggaatggcgggaacagtcaaaaaggtaacatgcactgctccaagtcgacatggtatcttaccactcctgtctctctccctgtgagcgcggagaccgctaaacaagtcaagattttgactcggtgtcctcgccgtctcgccaatggcactctgggatcatggcgtcgtggggttaaaatacggtgctctggggcactgcttgtcactccacttgtgtaccttgcaagtttgcaaccaccatggcgatggctcttgctagcttcctgctgctgctgctgtccgtcttcatgtccatcttcttgcacttcatggcagtgcgaggagcagacggagaagacgccgcagcgttgctcgctttcaaggccgtggcggtgggcaacggtggtggcaacggcgtgcttgcgtcgtggaacggcagcgccgggccgtgcagctgggagggcgtggcgtgtggccggcacgggcgggtggtggcgcttagcctgcccggccatgatctctcggggaccctgtcgccggccgtcggcaacctgacgtcgttgcggaaacttgacctgagttacaactggctgcacggtggcatccccgcgagcctcggtcagctgcaccgcctcagggaactcgacctaagcttcaacaccttctccggcgaggtccccagcaatctgacatcctgcaccagcttggaatacctggccctcggcagcaacaagctcgccgggcacataccttcggagctcggcaacacgctgacacagctccaggtgctaggcctcgacaacaacagcttcgtcggccattggccagcttcactggccaatctgacgtccctgggatacctcagcctcaggatgaacagtctcgagggcacaatacctcctgaattcggcagcaacatgccgcgcctttacttcctcgacatctgctccaacaacctgagtggtgcactcccgtcttccctgtacaatctgtcgtcgctaatggggtttgatgcaggaaacaacaagctggatggaagcattgctactgatatcgatgaaaagtttcctcatttacagtctttcgcagtgttcaacaaccagttcagcggggaaattccctcctcgttctccaatctcactaacctcacgagtctgcagctatcaatgaacggatttagtgggtttgtgccacataatctagggaggttgaatgctctgcagaatctgcaactaggtgttaatatgcttgaagcaggggacataaaggggtgggaatttgttgagtcattgacaaactgcagtaagctagagattttagttctcagtaacaacaatttcactgggcagttccctatttcgatcgcaaacctctcgaagactctccaaaaactttacttgggtggcagtaggatttctggaagcatcccctctgatttcggtaatttggttggtctaagatcattatacctgtttagtactgacatatcaggtgtaattccagagagcattgggaagctggaaaacttgactacgctatacctgaataacaatagcttgtctggccatgtaccgtcttctgtaggaaaccttaccaatctgatgaagctattcatgcaaggcaacaacttggaaggaccaatcccagcgaatcttggtaagctgaaaagcctgaatgttcttgatttatcaagaaatcacttcaatggttcgattccaaaggaaatattggagctgccttccatttcacagtacttgaatttatcatacaactccctctctggaccccttccttctgaagttgggagtttgactagcctcaacgagttgattctgtcaggaaaccaattgtctggccagataccaagtagtataaaaaattgcatagtgctcactgtacttttattggacagtaactcgttccaaggaactatacctgtgtttctgggggacattaaggggctccgtgtacttaacctaaccatgaacaagttttctggtgtgattcctgatgcccttggtagcatccacaacctgcaagagttgtatctagcgtataacaacttgtctgggcctatcccagcagtgctgcagaatttgacatcgttatcaatgctggatctatccttcaatgatctgcaaggtgaagtgccaaaagaaggtatttttaagaacttatcttacttgtctttagctggaaacagtgagctttgtgggggaatatctcatcttaacttacctccatgctccatgcatgctgttagaaagagaagcaaagggtggttaaggtctcttaaaatagctctggcatcaatagctgtggtcttgttcttagctctagttatggtgattattatgttaattcgtcgtagaaagcctgtacataggaagaagggccagtccctaaccccagttgtggaggaacaatttgaaagagtttcttaccaggaattgtcaaatggaaccaagggattttcacagaacagtttgcttggaaaaggaagctatggtgtagtctataaatgcactttgtttgatgaggaaattgttgtcgctgtaaaggtgtttaaccttgaacggtctggatctactagaagttttctggcagaatgcgacgcactgagaagtgtgcgccaccgttgtctcctaaagatcatcacttgctgttcaagcataaataaccaaggtcaagatttcaaggcactagtttttgagtttatgcccaatggcagcttaaatggttggcttcatccaaaatctgatatgcccattgctgacaatactttgagcctaactcaaaggctggacattgctgttgatattgtggatgctctggaatatcttcatatccactgccagccgccgatcgttcattgtgatctcaagccaagcaacatccttcttgcagaagacatgagtgcccgagttggagatttcggcatatcaagaatcctaactgaaagcgcgagcaaaacacagcaaaattcaagcaacacaatcggaataagaggttccattggctatgttgctccaggtaactgaattgttatgctttgtttctttgctttttacctcctagttcttacacaaatttaacattccggtgaatctaatgaactccaaaatatttgtagagtatggggaaggctctgcggtctcaactcttggcgatgtttatagtctgggcatattgctgcttgagatgtttacaggaatgagcccaacagacgatatgttcagagattccttggacctgcacagtttctcagaggctgctcatcctgacagaatcctggagatagccgatccgacgctctgggtgcatgtagacgccgaggatagcatcacaagaagcagaatgcaagagtgtttgatttcagtcattggcctcggcttgtcctgctcaaagcatcaacccaaagagcgaatgccaatacaagatgcagccctgaagatgcatgcgatcagagacgacgcttacctgatgttttctggctctctttcagtggacatggaagaggagacgaaacaaattagcagcgatttgaagcaacagtgagtaactaggcctgaagagtgtacaagaataagatatgcttgctggggaaaatgttttaacagctcagctgccgatggcgacttgccagaattccgagaaacaaaagctgagacgctgaagatgtagcattttccttcgtggttcatatcagtcagtctttatttgcgtcagttcatatggctatatgtaatgtaagctaatagaacgttcagtaactgccgatgtgtacattacaaccaatacggcaatactactatgtggagaactgtcagaaagatttttgactgttcatccttttcgtacaaaatgaaaattcaaatcatacctgtaatcacacatgaaaatcagattatgagattgcgccacgtttttgtgggacggaaagaacaggtttcgagctgttttaccaattaccaaaccataacaacacttgaagaatttatcaatcaaaaactttcctgcatatggtccatgcatttcaattcatatgctggtgcttatattactcattattttaccactgcataacatgtgtaatcatcctgtagatgtagaccctcctccacataggccaccaagctggagcagaaagaactccaccaagtccatctcgtacggcacaggcggcagatccatctcgcggccaattcgcaggggcaggaagcagtccatggccctgtcgatcaccttcttgtcgaggtcgacgacgaacacggcgccgctgctcctgtacatcatggccaccgatcccatgtccaagccatgcatcagcggcacgcagtatgggtaaggcgccggcaatgtcatccacatcacgtcgcggcgccacgccgccgcatcgtcgtcgccatcgccgcgtcgctgctgcttccagattctgacgtgcatggggaacacgcaggcgatggtgagctcgccgtccccgccgacgcagagcagcgtggccgtcgcgccgccggcgcggacggggagattc

SEQ ID NO: 58961 - DNA, 1915 bp, Oryza sativa
gcagccagcggcggcatgtggcggcgagcatgaagaggctcttgacgctggccacgcgggagaggacctggaggaggacgtcctccggcaatgccgcgatgatgccgccgtcgtccgccatgggtgtgcgcacgtacgtacgtgcaaaggcgttagatgatctcccgcgattgcatctagtagatgagaaagtcttttctgaatatgaatcgtagcgtagtggggagtgtgtgtgggtgggggtggttggggggtggggggttcgacgaagcatgccgaaacatggctggatgttgggcctaggaaatgaaaattgggccgtttctggagacgacgcgtagatgggccagtggcttaatgggtttcgcgctaaatacctaccgccatcaccaaatatcgagctgcgaagttcaatattagggctgttttggattgagaccctaccaaaattttttaatagtaaacgtgctagtttagattgaagccaaacaattgatagcgcctacgctcaatttggctatattctaaaatcttcttcactctcatactaaattttagctttatattggtattaaaccaaacatagactagctaactttaccctaccaaaaaattggtagtgctaaaagttgtctagattttagcactaccaattaattggtagggtagagaaccaaataggcccttaataaagtagaaaaaaattataaaattataaccctgggatatcgtaactagaaaaacgaagaaaaaataaccaccacccacccaccaacacacaaacccaagagaaaactatcactagatcggccgtcgctaagccaacgaagaaactacagccaaggttgtccaaaagatcataacccaattctaacaaccgacactaaacctcactctagccatatctttagaatcgaggaagatgggtgagggagaaaaatgaaacctcttcctcctatacccttcgacatggccaactttcatattctgcgtgagccttataaaatcccgcatttccggcggacggtcacgctcacctcatcaggttgtgcgtaagcaacgagcaaacgaccagaccataaatcagggtggataatgcacaatgccatattgttaatgaacaaaaattgctgaacaaaggatcagacagtcaaaaaaaaaaggaaaaaaaaaaggtgacaccaattaccaaaccttaataacacttgaagaatttatcaatgataataatatgctgttgtccttaaatcaaaacttacttttttttcccgcacatacccctattctacaattaaccctcgtttttctactgcataacatgagtaattttcgcggggccataaacatgtgtaatcaatcaatcaattaattaattgattatcctgtagatcacctctgctgcatagagccatagaccaccaagctggagcagaaagaactccaccaagtccatctcgtacggcacaggcggccgatccagtgaatggtccattcgcaggggcagcaagcagtccatggccttctccatcaccttcttgtcgaggtcgaggacgaacacagcgccggtgctactgtacatcatggccaccgatcccctgcgtcccaatccatgcgccatcgtgtaacttttggggtagttggacacctccgttggcatccaaatcacgtcgcggcgccacgccgccgcaccgtcgccatcgccatcgccgcgtcgctgctgcttccagactctgacgtgcatgatgaacacgcagacgatggtgagctcgccgtctccgccgacgcagagcagcggcgtcggcgtgccgccgtcgaggacggggagcttcgtcatggagacgcgcggcgtggccgtggctgtgccgcccacctccacgctgagctcttgtacaggtagtcgtctcgggtggcgctc

SEQ ID NO: 58962 - DNA, 3379 bp, Oryza sativa
cggcgaaggaaccaaggttgaaggggcccttcagatccgggagaacgtggtgctcgctggtgatagggttgaagaggccgagaaggtggctggtcgcctctgaccagtcgttggagggggaaagccgcatcaggaggatgccgcggcgcgccgtcaggggctcgccgtcgtagctggaggggatgggggcgaagcggcggcgccggcaggaagccgaatgtcgaggccgagttgcgttgccggtggaagaagaagccgaggaggtcgccggcgcgctggccgccccagaggtcgcggaggaaggcgcgatcggtgaagcggcggcatgttgcggccagcatgaagaggctcttgacgttgcccacgcgggagaggacctggaggaggacgtcctccggcaatgccgccatgatgtcgttgtccgccatgggtgtgtgcacgtacgtacgtgcaaaggcctccgcgattgcatctagtagatgtattgcattgtataggagggtgaaatctggtgattaaaaatcaaaattctcatcttaatctcaccatcaattctctcgtgtaaactcccaatcctcttccctcgagttgcaaaacaagctgtgaaggtcgccgctgcaggccgaaacgcggctggatgttgggcctgtacagctgtactggatatcaactcttggtgatatctatacttctatagtctcggaatattactgcttgagatgtttacaggaaagagtccaacggatgacgtgttcagagattcattagatctgaataagtttaccaaggatgctcttccagacataacttcggagatagcagactcaacaatctggctgcatgtagaaccacgggataacattatacagagcagaatccaggagtgtctcgtttctgtcttcatgttaggcatatcctgcacaaagcaacagcctcaagagcgagcatcaataagagatgtagcagtagagatgcatgcactaagagatgtatacctcatgtttgccaattagcttgcataggtattactagaacagaaggaaaagcctccactgagacaccgaaaacagctacaatagccaagctcattggaaataatcctgaaataactttagtcacatgtagtgtttcagttagcaattgttctcacttctgagagctatatttctttgccagagtatcagaatcatacaatttaatgtaaaattcacctaattgtttccttcgtgcttaatttcattgtttccttcttcctgcttgattgaaatggtagagctcctactgtactggttccttcccaaaattcaccttacattgttagttcaaagtacaaaagcgccaacttccactagtaccaactagcaaacagcaagaatctatccaattcaagcaattgtgtttgtgtccacacataaaacgcatgagtaaaagtgtagaacaccaaacaagccaggagcagcattattcctgaagtgagttgccatgtcctcagttgctacgtatgcataccagaacatcaattttgttccagaaaatttcacagtatcgtagtaatctcaaacagaatgaacaccacaaacaagaaatcgagcaatcacaaaacaggaagcacatagaagtctagaagagcatcgttaatatctcagataaataagcaacagtttaccaaaagcagcgccacaaccgccaactacacactaataagacatccatttctaccactaccagatagtagacagaactaaatactaccaatagatggaatctaagcggaggtgaacttggtcacagccttggtgccctcggagacggcgtgcttggcgagctcgccggggaggacgaggcggacggaggtctggatctcccgtgaggtgatggtgggcttcttgttgtagcgcgcgagcttggcggactccccggcgagcttctcgaagatgtcgttgatgaaggagttcatgatggacatggccttggaggagatgccgatgtcggggtggacctgcttgagcaccttgaagatgtagatcttgtaggtctcgacgctcttcttcgccttcttccgccccgccttcttcccctcgccgctgctcttctcggccttgccggcggggagacgcttctccgccttgggcttcttccccgcgggggccttctcggccttctctgccgcgggctcctcctccgcgggcttcttcgcggccggcttcttctccgccttgggcgccatggatgcttctctcttcttctcggggaggggcaagcgggtccgtgggttttgctttggagcggtgtgtgctgatgtgttgcgagattgcggtgtggaaggaggacacgggtgcggtgagtttatagtgggtaaaagtgggcgctgattggtggagaggcttgtcccgcggatcgatgacgtggatgaatgtgtgacgtccggtgccttttcggttagacggctgcgatgcgtttccgtgcggatcgctgacgttgcaaagaaaaatgtgcagtgggccccgtttttggagcgctgtggtggtgggctgttctttctttgggttcaggttttgggctttttgccatggagtctgtaaccataaacagcatgtaaataagaagaaaataataattaaaaacagggtaaactctatatattttgattaataggtcagtttttcctgtttagacaaatcgaattttgagatgacactaagaattcagcaaacatttattgtcgtacaagataaatctctctgctagagaaaaatccaagaacatttcctctcacattctttctccttcctctttcatggttcagactgcaaacaaacacaacacaaaacaatggagagcgcagaaaaatcttgctcaaagattgaagcacctggtggtatttccagacaccttgttcaatcgttaaactcaataactatcttaccagacctgtaactgtgatcaccaacaaactcaatttccatatgtatcctgcagtcagaaacgcaacatttagttacagctgtgttctatcaatatattggccatagttttatatctagagattaaaaagtagggatacaccaaaataagtcatagtggacaacatacaaggaacttgatgataacctttggcaacggcgtgatcataactagtcttctgttatgcatctttgtgttacacatactcttcaggacatcactgagcacgcaaactctcacatttttttctgcaactagttatgtggagcccaaatgtcatttggtggtggcggcgccaccagaaacgtttaaaggagtaaagaaatacaaaaaatgccatacaccttggaacaaattagaccaatcctggcaattagtaagtttctacaatcttcacaaggaaatcccattttca

SEQ ID NO: 58963 - DNA, 7954 bp, Oryza sativa
attacctctataaaataagagattggtattaaaaatcaaattaccatgctaatctcgccatcagttccctcattcaaacttccaaccctcttccctcaggtttccaaacaagctaagagaggaatgtgcatatttaaaactcatatgagaacccccattaaatacttcatgtagggagttttttttcctctatagacgatttgacactcatatgtctaagacatgtatgacccacatgtaaacgagccattgggtagaacaacttgaaattgccacctgaaagagtgacaaatgctcgtgcttcagcctccccaatttccacaagagatcttgcttaatctgtgccccgtctgtgcatcaccataatccgtcgatgaactggccgcctcccaccatgcaccgataagtcctgcatcgtgattatttatgtcctttttgcattctctcttttctttttctctccctaggtttgatttaatacttggtcgatcgttttaattctctgatttctctttgttggatttgttctagttgtgttttgtcgttctgtcctgatctaacttcttggctctaagtagatttaggccgctgagtgaaaacaaattcccctatagatttaatgatctttttgtaattaatagtagccatatatctcctctagtcgatggtttcatggagaaagatttggtcttggtggtgcacgaaagaggcttgatctaggaagaaaggcgtcttctcagccatggattttctcctccttactcctgatagaaaagatattaacattccccttatagaacttagaaatatcaagatatcatttccttgatttttgattttgctaggtagataggttaaaccaggattttgaaaattcaacggtaactgttcgtttatcatggttattaaactaagtgttcaaagtcatgatgttgcttatgttgagggggtgctgccatttgagacataatcggtagcatgcagacctctaattaagtcaatggtaagtaggccagagcatgccaatcatgcctatggtagcataggggttagagtagattgcaatctaaaatataccttggtcacaagagaacattcatcactactaactactaacatgttaaatagagcattatccacaattgatctagattgcacacaaacacaacattgaacacaaaaaaaagcacaaagaaagaactcacaaacaaatagaacattgtcacacctcctttcttatcgccaccgtgtcaacttccctccgatcaccaggcgcggtcatatcgacctccctccctggccgacaccacgtcctcttttgaaatccgtcgccaccactttatgccttcttcctatacaattgctaatgttcttgaagaggttatatttaaaagagagcctcacatttatttaaaagcgctagttgatacgtcacacattgctgaagggcattgtggttattaaaaaaattgcaaaactttgtggttacaaacagatttggagaaattaaaacaccaaaaatagatgtgcaaaaataatcattgtgcttttcaagcccatcaaacgattagtggcctaatcatacgattagaaagttctcatgccaaatgtaatatgggtgtatagctcatcaaaagatcgagatggctcaaatcagataaaggatatcgatctaacgtgacccatatttatggattatgtggtctcatgtatcatcaactttcgataagtggttgcctcttattggttgtaattatatagataaatagatttgctatgctacttgctatagaaaatcagtcgaggagaaacttctcttttttgatagttgggtttacttgaagattcgtgtgtgggagtttcatttttacacacatttctttgtttgatagtagagaggagaattatatggagtatggatgggaattgaattctaagtgatgatgtacgactcagatttatctcctcatacttagaaggggattccctcccaattacctgcgcctacccagatattgaaaatgtgggagttcgctcttaaactctgcttcccaatctcttataaaactccaacgatttatcaacgaaacaatagacttaacagtccccacccctcaaactcacattccaatgtaactatttcccccaaccaaatgcgtcgtaagcgttgtgcgggaggctggactcgaatccgtgacacgtaatgtgcctttcacgtgccccaccattgagttataatctaatcacgtataatacttttgagttgtattgtaattacactattttcattatataacagtagttatatctaaaaacttttagagaagttctccaaaaaaaataatgtgtttttaacacaagagtctttgcagtttgtatgtgaggtttcaatagaagaatgaaaagaaaatgtctttcacacatatatgtgccagacggacggggtcatcttcctgagctagtcaaacccgtccacccgccgcccgccgcacgccggcgaaaaccagtcgcgcgcccgcatgggcggcagcgctgcggcggcgccgccggtgcccggaggtggctggaggaagccggcgtcgccttcgacggatccgaccgccgcgccttcaacgcgatgcccctcgccggcgcgcgcgtctccctcgcagaggccggccgcgccgtttgctcgctccgcgtgaccgtctagctcacggtacgcgccgcatcccatctccaccccacggcgccgcggtctgcttccgccgcgcgccgccgacgcgcgtccctccgctctcgccggcgttttcttgatttgatttgatttggttttgattttgacatcggcgcggcggcggcaggacgcggaggggaactggcacccgggggcgatcgcggcggcggcggacgacgtgtgcgcagcggcgatcatgtcggtggagggcatcatcaaggtctccgtccactacgacatctcctacttctcgccggccaagctccatgtccgtaaaccaacctactccccccattgccatttttttcctagcaatttcttgtcccaagacgccaatagaggagaaaaaaaaaataatagaacagaacagaacagcgaatagtttaggttagcacgacacaacacgatcacaatcaatcgatcaatggttgactcttcgtatttcttttttcaagcactacaaaaagtaacaagtaaattagattatcggcttggtcatgctggaacaagtatgattatattctgaataataagatttatagtttgcctttgtgttaaggaacctacattaacaggaaagctgattttttttagcgccaagaatttcgttttataactatctttatttaatgcacacacaaaaaaaactattttatttacatacaatgtgcaatactgcaatgtaaagcatagttgtgcttctctggagacttttatgaacaattacttcttggactagttaggcaagctctttcatgatcaagaattgaagattgcaaggttatcattcatttctgtcaattcaacttgggttgcttggttgtttctagtacaagcccctctaagccttttttagctaagatgcaccagaatcagaattcccagaagcaaccatgatacggtgatactgtagtagtcaaaacagcaaaatttgattcagtggcaccgaaagatcagcagttcaatttatagataaaactatattctgattatgtattctaagtttatagacctgaattcaagtcgtgtaaagataagttgttatctttcagtgtcaatgaaaccagatttttccaaaaagtttagtccggaacattttcggttgcagcacattgtgctttaagaacatattctagctagagcccaaaccaggcatctcctgtgtccagacgcttctctgttacgatccaatttgtactcgtcaaattaattccactgaagaaagtacttttcgaatcatgctcgctgctattctcattttcggaaacttcaacagagcaacatcattccattagcttctgaaaggttgaacaaaccttgaaaaagagactgaattgtgactgaggcctggtttagttcctaactttttcttcaaacttccaatttttccatcacatcaaaactttcctacacacacaaacttctaacttttccgtcacatcgttccaacttcaatcaaactttctattttagcatgaactaaacacagcctgatgcaaaacctccctgaactctgtactgcaggaggaagttgagctggacggcagggtggtggagcagaaagggaagatgacggcggtgacggtggagatccggaagaaggattccggcgagctggtggcgatcggccggcagtggatgtcgaccaccaggccaaagaaggatcaagctagcagcaagctgtgactctgaaccaggtatgcctacctagctcccaatggagttcttcagttcatctattgctcaccttagcaaccatcgaggtgattgtaacttttgtgtgttgcaagaaaaatctctctcattttttgtatcctgaaacatactgaattttaacttaattgaaagggtatagagaactagagagatccatgttgccaatgtgaattgtccaaaaaaaataagattctttctgtgattgtgaaaggggacagctggacaggttctatgttctaaaagcctcaaccactaactttaaaaacatctaaattactcctggactcctcgtcgtcgtgaaaggacgacggcaacgtgatcataaataaatttaaaattgcaatcgatattagcaaaatcctatcctatctgaaagggaagccatcgtgcaaaatacacgaagcttctcatcatggaggagatgaagaagagctttgctcggagagtgagccagtgaggcagtcaagctagcattagcaagggcggcgacatggacggcgagtcgccggcggcggcggcggcggcgctgcggctggccgccgtggcgaggaggtggctggagaacccccgggactcgctggcgaggagcagagaggaaggctgcggcgacgcgttcaacacggtggtgatgcccgggttccgcgtctccctcgccgagcccggccgcctcgtctgctccttctgcgtccccgccgccgtcgccgtacgtgcgtcctccttcctttcccggcggccatgtcggtcgccacgccgtgttcgttcgcactccgattcggtctcacctgcttgttcttggtttctgctgctgcggcggtggcggcggcggcgcaggacgcggacgggaggtggcacgccggggcgatggcggcggcggtggacaacctgtgcgcggcggtggtgtacacggcggacggcgtgcacaggttcaccatcagccaggccatgtccttcttctccccggccgcgcacggcgtacggttcctccatggatcatcatcttcatcttgctctcttctcctgtgaatcgggcagccgccattaacccgctcttctccggcgaatgatgattgcgcgcgcaggaggaggtggagatggatgggagggtggcgcaccggaaggggaagctgacgccgccgtggtggaggtgcggaggaaggcgtccggcgagctggtggcgatagggaggcagtggatgacctctactcgggcgaggccggagaagaatggcgagagcaggagcaaactctgaaacgaaaatttcctctaaaaatcgctttctcttcttttctgatttcatcatctcaacacctaaagaaaactgttgtaaattctcaagatagtgataatggcgtccattcgaaagtgccagtaacagtaagtaaactgttgtaaattctcaagatggtataaaagctcttttcttctattaatatcaagtaggagtatatgaatacaaagccagccacttcttttttctgtttttgctagggaagaaatgagtaattcagtatggacatgatcaatatgtacacattgcaggtcatgcaaaagcgtgccaacaaaattaaatcaaattacaagcatatcatctctatcttctcactttattcaccacaaggaatacccccaacttaattattccttaatctccctccaatgtccattaatctgaacaatccttttttgtccaaaataatctcaacaatccttttctccacaataatctcaacaatccgatcaagtcaatccccaagcctgcaaaaccaagacaagcccaatgtgagtaccacaaacaaatctcatcattctcaaccagctctgctctctacaattccttaaccaagaaacagaagaagaaaaaaaaatgcattttcttttccaaacctgaattctgccgtccgatgtcccgacgacgatgacatcgccgtcggcgtcgacggccatgcactggacccggccgctgccgccgccgccgccggcctggagagcgccgatcctggtcagcttctccctcgaccagatctccacgacgccattcctggagccgaggtacaccaggtccgagctcaccaccagcgacctcacctccaccgacgacggtatcgtcccgaccaggctgtagttcgagctgctccatatctgcacccagaaaaaagagaacaaaattcacatcctatttcatcatcaccacatgcctagaccagaaaccacactaatacatcgactgtgtgcatgaatttcacagggtacagttcagttctgattgaaatttcgtcaaactttgctgtgtttcaaacggagcctcgacatatttcatagttttggtcttctataggaatgacattttttttcggagagtttcaagtcgaaattgctatatttagcgcagttgtgttctcagcacgtactttcagataagaggaattttaaagttcttgaaaaagtaccttgaggtacctaaattttacactaaaaattttggtaccttgaaataattagtatctagatgtatcaaattttacagaagaaaacatagtacctctaggatggtaaaattactcttcacataaatgtttccagagttgaaagttgtatgatagagtcgactgttttgtatgaagtacacattttcagttgagagttatatgatttgagttcgaactttggcatgtttcaaactgtcaaaactttatcaagctttccgagtttttcatttttgcttttttattggtaccttgactgatgcgccgtcgagcgaggtgctgccggtgtagaggaggtcgccgtgaagatgcagagagtagatcgggctggccttgccgatgatcctcttgctcccttgctggatcacgccgatcgtcccgctcgccaggtcgatctcctgcacgccgccgtcgttgcagccgcagaagagcttcccgtgcaccagcgccatggatctcaccaccttgctcgcgttcaggaccttggcgccgccaccattgttccagcttagcacctgcaaaacacagaccaagttaggtggccatccatggaagcgcctcgccggatgatgtgatcggcgatcgatcaccttgacgccggagccctgcggcgcgaagcaggccatggcggcggcgacggcgaggctctgaaccgggtccttggcgtcgtggacctcgacgcaccggagggcgtctcggagctgccacacctggtgatcaggtgttcagcagagatgaacatgttaaatttctgaaattttgtgcgatcttttttgtttcatgattttgccaagaaaatttagacatactctgatagttctatccagtgatccactgaacagtttctcctctgagtgtagcactgctaagctggtgattgctttcgtgtgttcttgggattcatggactaggcgaaggatattctcacttccctcccagacctgaacatttaaattccacagatttctaaaactgaaactacaatgttatgatctcaggaaaaaaatttcggaattttgaaagagagaattaaaccttt

SEQ ID NO: 58964 - DNA, 4141 bp, Oryza sativa
gaatttcagattcgctgcaagaacagctgagaaaaatgcaattacaatgctggattcttgtccatctgacagcagcttgagcatctcgaacgcgaggccggacgatttcttcagctccctgagcgtcctgagcacgtccttgatgtacgtcgtgatctcgtgcatcccctctgaaatttcacaatgttaggataaaaatgttcagagattctttctttctgaaccaaaaaataacaaaaaattcagagttctctctctctctctctctctctctcttctgaaattcttgtggcaagattggtaatggacggtgtgaccaaccgcgatcgttcatgaagctcctgagggccaccatggcgagggccctgtcgctgccgtgcttgcctgaccggaggacgagcacgagctgccggagcaggcacaccctggcggcgccgagcacgccggtgtcggggaggagggggagcatgcggaccagccatgccgccgacacgaggctcgccgtgaacagctcgccgttcttggccgccgcgaggcaccccgacagcgcctcgaacaccagcccgaactcatggctgaccagcgcgtacgccgccttcctctcccactccgccgccgccttctcttcctcctacaaaaaaaaaaaaaaacatcgcaagtgaactcgatgtatgaaatccagcaggtttttttatagagaaaacttctgaaaattggcaatgtaaagtacggtgatatctatcagttcaccaaaaattaagttcaaattcgacctgctcatcgtgaaaaaaaagagacaaattcacatgtaaacaatatactattattcacactgaatttgtatttttttttatatctcgacgtgtgagttgagtttggacctaaaattttatagacatgttgcatgagtgttttcaaattttttaaagaatttttcataaccataagatggtttttaagcgaactgaggagacattcccctttagtgaccaaaatagtttcccaatactaccatttcgtcctcgccggcgccgcgagaaatgctgagatcgtgcgacggccggtgcctctctttcaccctggcaagcttaagcagcgatgagcgtgagagtggccggcccgacgaggagaacttgccggagagattcatgatagtctcggcggcgagcagctggcttctcgggtaatccgagttcttgaggcactggatgaggctgtccactgcttcctccctgtacatgctgatcttcctcggctccacctgacaaaccatttgcgcattgatctcgccatcaaacatgagattttttttgacaaatctgaagaaatgttgcgagaaaaagttgtttttactaggagatctagctgaagaagtagccctgcaacgacagggctctgctccggtgtcgtggattgcaggtacacgagaagcgtgtgcatcatgctgaaggagctcgcctccttgatcgtccgaagaagacgatcagcagctgatcgcctgaaaaataagttgagattttgttttagatgtggataattttgtcattcttaagaggatatctgaagataccatatatttttgaatgtaaagtttactacctctaggtggtgttcatcaaaccgttttgaatgtggttaccaccactccacagaaaaggcggttatcgaggtaactgtacggttaccgcgaggtttaccgtgatttaaaaactgagaatgttatcacacatgataattgtgtgatgatcgtacggttttgtaaaccctgcctctaagtagtagggtactcgagattttttttttaaggaccgtaaaatggaggagctttggggttaccgtttgagcttgagcagttcggagaggagccgcacgatgtcgaacttgtcggcgtcgccgacgacgtggaacgcgtcgaggacggcggcgagggccgagttctcgacgatgctgctccggcaatggccgtcctcggcgacgcaccgcagtaggatcctcacggcggcgaccctctcctccacctgctcggcttccaagctcgccgccacgctcctgatgaacctctcggagaccagggcggacttggccaccgccggcgacgagctgtcccggccgccttcgacgaggatctgactcaggaggatcaccgacgcggccttcggcttgacgcacatcttgaccaccgcgccgccgtcgtgtcgccgccgcctcgccggatggtggcgaccagcgcgtcggccatgtccatctcgacaagctgctccggcgagggggagaggaggtggatgagcgagacggcctcgacgaggcccttcttgaagagcgcgacgaggcagtccacgtcggagtccaccctcgtcagcgtctgcacgacggcgtcgtcgcgggaggcgagctcggcgaggaggaagacggccacctggagcacctgcgcgctcacggagttgaagaggatctccacgaagccgttgacgacggcgggcttggcgagcgcggcgaggacgacgtgctcggcaccggcggcctcgcgccatagccgctcgatccggagcaccgacctctccgagtcggcgagctcctccgacgtgcagaggcaggacaccgcggcgcggagctcgccgactgcgctgtcgagggacgcctgcgcgatgacgctggtcggcgacggcgcgctggcctggctcacggtggcgtccggcgacggcgagctgatcttgaacggggccgcggcggcggggctatccatcgtcgtcgtcgccggcggcggcggcgtgggcgcggaggaggaggcggcggggttctggtcgcgccaggcggcgatgaggcgcttgaggacgtagttggtgctggggaggtgggcgccgtggaggcggtggcgcgtgatggggcaggtggcgttgccgcggtcgagccactcctggatggcgcggcgctcgtacgtctgcccggtctcgagcgtgacggggtcgtcgaacacctggctcgtgatcgggcacacgaagtccttgggcgtcgccaccaccggccgccgcgccacgtcgccgccgccgtcgccgcccatcacagaactgcattaagaataatccgccgccgccgcggcgtcgccatcatcacatcgggaacggtgttgctttggaggcgagcgcgaggacgccagctagcttacctcgcgtgctccggagagagcatggcggcgacgtcgtcgtcgtcgtcttcctcgccgcgtggacgcgctctgcctgcaagccgtgacagctgcgaggccgtgtgcttttcctaagagacgagacagcaacattgaaacctcatctatgatctgttcaactctgtattttaaaacaacgctatttgtttatgaaaacatcgcctggatcttctctaattaacaaatggagtgagatatgatgctaatcttagctttcttagcgtcctagattacatattaaacgagttgcaccaagactaattcagagcactgacctctctgccggcgaggagctcggaggaggagggggagtcctccatgctgacgtcggaagaaggcgtcgccggcgagtgcccggcgcgcagcctcgccaccgggcttcctctgccggtcggcgacggcgacgactgctgctgctgcactatgaggtgcggcggcacgcgctgcgggtacaggctcggcggccgcatcagctccctccaccccttgccgctgccctgccgcgggtacaggtcggccgcctcgtcggcgtccgcccagatcggctgcaaaagatcaccggaacatgacgtcaccatggtgtcgacaccgtcgagccgagcacgctgatgggataggtttgtgttcgtagcattacgttgtaccgtacgtcgttctgcgagctgacggtctcgtcggtctccgccgtggtctcgtcgtcgacgtcgccgtcctggtcgtcgtctccgacgccgaatacaagctctggaggcggtggcggcggggagtacgtctccttcgccgcgtcgccggtttcaaggatcttctttaggtagagcgcgtacgctatgcagttcgcgtcgagcaccttctcgtactcgcgctccaggtccctcatctcctgcgcgtgggggcctctcatcaaggagagaaccctcatcgccgacatcgcggcggtct

SEQ ID NO: 58965 - DNA, 3716 bp, Oryza sativa
gcggcggagagcaggtgtcgccggaggagcgggtcggcgatgagctccgcgaggaacgccgctgtgtgcgccaccaccgacgagtacgtcggcgtcggccccgccatgtctgacgagcacttcacacacaaacccatgggaaggttttgtctcgagggtcgtggaggcgaggtgacgcgcaaagactgaactgccccctcgagctccgagtagtcatgcctactcgagcaggggtaggaccgggatttcgtctccttggggtttaaattatggcgggagaggagaccggggcggcagcggccggcagcgcggccgcctgacgcgtggagggagacggtcgccgccgcgtcggaaaggaacgtttcggagggtctcgccgtggctgtttcatggaagtcaatatatgactctatagctatcttacaagttggaagatttattaatccagaggattatgttatgttaatcacatggttttcgaaattaagaaatgaagttttaagttgtctactattattagagtcgatatgactatgtgtgatatttccatggggggtaggtttcaaattaacgctgtaattgtcacccgaaacattagggatggccggatgagaacatgccaaatggagacaagagagacatcacatcacaaaatcagcgctagcgagagttggttgggatataattgatgcggaaaccagttaattaattatcatcttgttatgcaatcttagttcaaagatctttgtaatccagcttaatttaattatactaacttcgctattttttttaaagatcatccatcttattaaaaaaatacgtaaatgtcatttactttgttgccttattttatcatattaaacgtttttaatcataacttatattttatatatttacactaatattttttaaataacacaaatatcaaatatcatgttcaaaaaatcatatatatagcaccatacatttaaaagcagatagagtaattgtcacacttgtacatcggtaatttttttttaattaggtgttatttgtttgtggactatctatatatctatcaatatttttttcttaaatataaatttattataatttagtgtaattacataactacaaacaatataatttgtacatatagcttttagagacacttcaagggaggccgtgggattgaatcccctcatttgtatgtctatgctatgaatttttttccttccttgcttggacgaatctcggaacaaatctaacattccaaaattatgtgaaagttatacatagttatacaaaatctttttagcaaatcctattttttatttggcaaattaaatcgtttgtttgatgtgaggatgcatgcatgggttcttgaaaccaaccagggtgggtgacagccaaaatttttctctggaaacataattcaataatgtgaaagacgtagtactgcattccaagctgaaaatttcaaagtacaaatgagcaaattaatcacggcgacgaggccacgtaaacgtgggcacggtcaattatttctctgcaactagagcacttaacaacggtacggttacaagttgggtttaatttgcaaatcggttgatcatgtcgtcgaagttgcatgcagcagtggctcgatcacatgtccgccgccacggcgtcgtgcgcggcgccgccgtcggcgaggagcgggacgaagttgagcatgacgtcgacggcgttctgggcggcgatggcgaggaactcgccggcctcgttgccgagcgaggagccgccgccagcgaggtcggagagggagcggatggtgaggaacgggacggcgtgctggtgcgccacgagcgccacggcggcgctctccatctccaccggcgtgcacccgaacttggcccgcaggaactgacggtaggcggcgttgtcgaggaacacgttggcgctgcaccccctcctcaccctcgtcaccctcggcgcccgcggcaggcacgtcgtcgcgttcacgcacgccggcagctccatcccctgcaccaccaccaccgcgcgtgtgtcagacaaccaaccgatttttttttgaacttttttaatttttaattttaaaaataatttttttcaaaataaacttattttcagattttgaaccttctgaccacaccagcctgtctggctgaccagggttcaatctttagttttcgaacatatttaatcaaatttgaagaaaatatttccaaatttaaaaaatgaaaaaaaaatcggttgaaataatatcatatcaaaaaccgacggaaccgaaatttcattacggaattttgaaccctgaacataacaaaacaacattaatgcatgacagttttgtctaacgctggtcacgctagccagaccgatgagctcgtcgagctcagtatatgtatgtgtgtaccaaaatttcgttacacaattttgaaccatgggcgttacaaaacaacattaatgcacaccacacacaatgagagcgtgacagttttgtcttgccacacgcgatcaaataacgctggtcacgccagccaggccggtgatctcgttgagctcagtatatgtgtgtacctctagcttctcagcgagggagaagtagcgggagctgacggggacccagaaggcgtgttggcgctgctccggcttgccggagacggggaagatctcctcgggctggaaccagatgctgttgagctcgttgggggaggggccggcggcggtgtagtcggagaagttgaggaagccgaggtcgcgggtgtagtcgccggcggcctcgagcggcagctcgttctccgggccgtcgccgtagcgctgccagttccagagggagaggtgcgcccagtgctccgggatggtgacgtcgccgatctggaggccctcgtcggcgttgcgggcgatgccccagtgcacgatgcccttcaccctgaacaggctcagcagcagctgggtcgtcagcccagcattcagctgcatgatgcataatttgcagattaattaattattcgattagggaaaccgatcgattaataattaatactttctaacgtaaatcattctagcattgtttatattcatctagattacatctacaacagttttagttgagctacttttgataggtagtagcataattgcagtcatgtgtgtatagtagtacgtaccatgctaagccctgtcatgaccatgacaacgttttggcccccaatggcaccgaagcgaaaccttcgtccttaattaattacaaggaaaaatgaatcattagtgtgtgtgtgttaattaacgttttggtcgtgttaatcagttttcttcttgggtaaacgttcgctcgtccatttcaatttctgatcacagtatcaaacattcactattcaggtagcacatctctttctcgccatatgtacgtgagcttaattaagtcacacatatatcttgatcattaattatccgctgatagtgtgatgccactttcaggttattatattatcgcatgcacgctgtaattagcttcacgcatgcatgcatcgtccttaactaactgtccaattaatttactgatgaagaggctatagctgcatgaaattagcatatgcagtaagggcacccacaatggtaaagtaaggtgctctctataaaacatgtacatcttagcaatagactagctagattaatagtaaaccacctcaatagtatgtctatatgggtatttatagctctctaatccattg

SEQ ID NO: 58966 - DNA, 957 bp, Oryza sativa
tacccggctgataatctcaacctccgcctgaaattcacgctctccctgcccactcccatctctcaattgcttcacagcaacctctgtcccattcggcagaactcctttgtgaacatacccaaaaccgccctgtccgagcagattagcatcggagaatccatcggtcgccgctgacaagtcctcataagtgaaagtacaccttgaaaaacccaatgcagcaccaggtgacactagaggttggctgttgtcgccaccggagtaatttgagccagaaccaccactgtgtacatttagtggagcaggaggtggtggaggggaaggatgcgaaggcaccttcttcagcacatgatcaggtggaggtggaggaccattttgctgccaattttggtacaccccaccatagtgatcccctgcagctcagcaagaattgtactgaaaagaccgccgatcatagttaatattccaaatagattttctcaatgcagaatgatatgagaaggatatgattgattgcacatttgtttttgtttctttttagatgattgctcacagattaaatatatgtaaagaaacatattcaactctgtgatggttaactcaaagaatgaaaaagtaagaaaatgacatgctttttgtttgccaaatgatttggcttaaaagtaaggtaacctcaggactacatgaccatgtcaggtcttgtcactttctttccagaattaaccttttgtgttatctcaacacaagtgatgaactgataatccacaacaccactactccatccatggtaaacttagcacaatccacaccaaaacctacatcctgtgtttttttgcctaacgatatgttcttccatcccataacaaacaagaataagtccttcaaaatttttcaataaatccaaaaaaaacatttaccatgacagcaatttagcaaaattttcagttgatagcaacgtct

SEQ ID NO: 58967 - DNA, 8368 bp, Oryza sativa
  unsure (1)..(8368): unsure at all n locations
gacatcgccaccactcactcactcactcacgcactaccaccaccaccaccaccacaacaacaacaacaacaaaaagaacgagtcgaagactaccacgccacgagcaagatgagagcaagaacaaagcggagccaagaaaagagcaggcaagagctttttctccctcgcggcggtggtgatggtggtggtggggaattggagcggattgcgacctgaggggggcgagaactactactaccaccaccacccacaccgtccccagtggagtctactggcgacgcgacgtgggggagaagaagaagagagagagaggagggaataaaagcgcggggaatcgagcgggtcgaagggaggacgagccggggaggggaagaagaacacggcgagaatttctattatttttttgaaatttcttttattttaaaagcaagcatttctaaaaacttatttttaaaatgtggatcttttaatcatgtggttgaatggctaaataatactccctccggttttatagttcttgatgttttagataagattgtagtcaaatttttataactttcaatatcaatgactttaaaattatttaatttaaaagaatcaaaattatatatatatatatatatatatatattcgtctttcaaagttatataataaaaataagaatgcatttatttgttgtatatattatacagtaatagaaaacacaaagtcaaaatatatttcgaaaaccgtgtctttaatttggttgtactgcgttctgctacattaatttggttggcgtggcagaaacggatattgaaaagtattggaaaggtttatttttaaaattattaaaacgttcaaaagaaaaggaataagaaaaaaattcacacggcgacacctcctcctacccgcgcttttcggcgaagcaacccgttcctcctggggcccatctgtcagtgaagggggtgctgtcgagtgggaccgggttgtcaggctcacgcttgcttctctctcacggcgtgattatggcgggggcgttacgcgcgacggtgacttgggtgagggtggcgttactgcgaggtgggtcccacgcgtcagtgaaaggagggttactcctgctgctgtgtcctttttcgcggcgacacttgtcgtgtgagctaagggagaaggtgacgtgtcatgactcatactatgagagtactatatataattattattggatgagagagttgccatgtcaaatgtacgggtgaaaactgaagagtggcaattcttttccaaatgagttgacaaatttgatcgataaaagcaggcaaactaggggaaatatgcggtggtttcaaggaaaaattagcggtatatatatgcatttaagggcccgtttgatttgtagaaaaagtgtaggaacaatcctatagaaaaatttctatgaaagtttttgaaataaaggattgaatcatattatatcctttaaaattcttatggaatgggtaatcctatagagattttgaagagaaattagcaagaggtccaacctcttgaaaaaattcctttgagtctatctctctcatccgattcctgcgattttcctgtggtccaatcaaacggtcattcttatgtttttcctgtattttccaatcctctattttacacctgcattcctgttagaatcttgtgttttttctattcccccgtttttccatttctacaattcagaggagcactagatgatcacattaatatatatatgtaggaccacctagcgtagtgaaattaattgctactgatgggttgggtacgtaggataattcatcaattaccccgtctatactttttttctattataagatgaactttttttggctaataactattttactaaataaaaatatattagtagtacttttaagtacagatctaatggtattaaatttgtcccactgattatatcctaataggaaaatggttggtcatgttataacgaagcaaaatatgctttatttttcttaacagatgggataactaagcttgcaaatacctgggaaatggtgattcaagcaataggcacattattttttctattttttactgtggcatgtcgattttttaaaatacataattttgaattaaaatactcatgttgttctgggttgtcctaatatttgactatcaatttcgataaattattatagttccatacaatgagattccaaactcttagagattcaccataacaaatattctctctgtttcaaaataagtttattttttacatatctcacacataccaataaagaactagaatacccctgctttataaaatctcaatgcaactatttcttactaacttcaatataatgattacttaaaaaagaacttattttggaatggagaaataagtttcgtaatataacccacgtgttattaagctatacagatttttttaaattaatggtacatgtttcataatttaaaataaaggtagtattttgttagcgtggtttactctaggcctcacgtgtatcgcgggtacgcggtttgtgattatatggtctgatgtacagtcacaatatagattctgtgaccaccacaacctgacaaaccatcaacctatgtgtgcacatagtatacaagtgtcagcaccaaagatgatctacgcaacaagcctatggcagctagctagcaaggttaaatttggagtgttgtttgatatgacgtagacatggttaatgaagctatgattgatcttaatatgtggttgatacagctacgagcctatgatgggagtttgaagcatgattggttgatatttgctttatttgatctcttattctttaatcaattacttactatagctaacagtcttattcaagctagctagaatcggtgcgtatgcaagcaaagttaatcattaattgcatttgtcttctgtacaccgtttctgtggctgtgtttacttgcatgtcttataagattgacagcaggtaggagtagcaaatatatggaacaactgaaagtcagcaccaaattaatgacgttttgtgttgcaaattaaatcccgttgggaggttttatgcataaatgtgtgtcctgcaggctactggtagagtgctagtcgatgccctcgttttccacatttgattttggcagaaatactatgatcaattgattagatagttactgcgaaattgaaactaagggtatgtttgccacggctccagctccaactttatctcttctagagttgaaactcagacaaacagtttcaacttcatctaaataagaatggatatagctgaagcgctttcacaaaataaattagagatgtggagctgggtttaagatgctccacaatttaactctaaacctaacttatgaagttaatttaggagttcgagctctaccaacgagccctaaaagaatggcatgatcggtagcccaacgtattgaccaaaccgtttagcatacaaaactcgtgaacattgtcactgtctttggtttatatataagttgcccaaatttgctacatttattatgtctaaactcgagttggttaggttatcataatcagcatgacacggtgccagcgagatgaaaatctcgcagcaccattacacattaatgacacgtgggacctagatagtaaaaaaagtaatattttcatcgcggttgtggctacaaaccaaatgtatgtctaactcaaaggaattcgatcatgataaccaaaatctctattaattgagttaaccacattgcctgcatcatagtccttccaaatattttgttcattgtaatgattggaaatgtttggcaatcatcaactatttttttttcttttagaaagatcatcttatctgagcaattcatcatgcatgtaggacacaaaggtaacatgcaggaatctcagcactcatagcacgtgaattctgatggccaagcacagttctaaatttctaatggtttgagtctcctaagacaatataatcaaaccacggtaacatttcatcaagaatttacattctattgtccacaaattattcatgtctgaatttctctgaaaaatacagttagcatatcagtaaaaattattgaaatttaatttgcttcagccaccgtaggccccattgcagcattattacgccaattctgatctgtagggtacatttccctcatgacctctgctccaggccattgattttttttttcagcagcatagtccaaggacagcacatgcttcttctcctttaagagagggacggaaggtacctacctattgaaatgaaaagcagaggatgcatatctatatacatgattatggattagtttagttagttactccaatagtttctgcgtcaaaccataggttgtctatctccccaattgttattttaattattgtcaacaaacggattttttttatgtgcacaaattttccagaacataccacgaactatatatatcaatgattatatgtagtataattgtctataccttcaatttccttttctttaaaaaaaatataatcatataacccaatgcgttatgttccacgcatggtcaaatttccctgggaagaaagaaagacatattacatcgacctttttataccaaaaacatgacatcaaatcttgcaaagcaatagctcggtgcaaactctacacaagatcacacaacattacgccaaaaataaaaaggttgcagattcgacagtggccgttgctttcgatccttctgcccccaacatgctcacagcatcacatgtgtgtgtgactttgcactggccatgcacgcatgcacacatcgcgcaatatcaaaaatatgccatttcatttcatgcaggatgcaatatatcatctccacgcaagggtggattagcatgggcgcaatgaggactcgaacctccgctacttacgtgagtactattggagccctcataaaggtcactgttcttttctccaactagagttggatgtattaacgtatgattgattaagattttcatgtcacgtttttcaaactactaaacggtatgttttgtgtgaaaactttctatatgaaagttgctctaaaatatcatattaatctatttttaagtttataatagttaaaactcaatcaatcatacgttaataccacctcgttttatgtaaaaaacttaatcatcatcatcatcttcagaagaaaagaacaccaccaaagcccccacaaatttttttttgccacatgtagataggagagggctgtaactttgttctaagttgttcagacccacctattattttttttcttgaatatgccactgtctccactccacgcgtgcgttgtgttgtgtatattctgattcatgcacatcgccttcagctatagacaagccccatatgaacatcttttgatcgttttggaatttggataaacattccaaaggctaaacctcgatcatgtcctcatatgataacggccaccaattaaatatgagatatgaatatgaatatgatgcggtgacgcaccgggccggataacttagcctaatccccctttgtgatactagttcaaatcagtgacttaattagtgtgggattcgtcttgtcgtggaatagattgtacaactactctgcctagctctatccattttatttctgttgctttaagattttaaaatgggttaattttgtccttgcctccttggtggtaagttggcaacttcaaccttttcagaactccagttccgatataaattgaactgattcttgtaaaattcatataaaattcagtaatctcttttgtttggaggaaacctagtgtgtggatgtacgattccgctttgtgcatattaattatgcatgagagtctcagatggttgtatcatcttgatataattgattgagttcaataaaccttttattatttaaaaaatataaaaaaggaaaccaattccaataaaaattgaaccgattattgtaacattcccgtgtattgaaggaggcacggttggatagtaaagctagattgagagatctaaccgtgtccatgtgcgacaaaccatttctccatgaggacaagcaaaattattctccaataattcttttgccttgagggctccacagaccacttacataaaatacatgactacatgaattcctccatggctccatcctgcatgcaaagccatccacaaaaaaggagccctctcccagcacaagtggatcggacggttgagttcaatcttggagagcactcacaccgtctagtcgcgtcaagaaaccaaaaaaatcattgacctcaaggcacatcagccactgttcaggatgaacaccacgccacattggaataatctgtactggtctggcagtggcatgtatgtacatgatgatggcaatattgaagactagaaagaaaaaggccaagaagtggctttgctaggtgaattaagggtgtgtttggttcctaaccatactttgttgtcatttatcaataaatattgtcacacggtctaagttgaggcgattaaattattggccacaccttagtaagtctaagagaatcttgttacatttttctaagtcaatgacacgtgagactcagtttattagaaaagaatcttgtcatagctatggctacaacaaacagctgctaatgggattaaatctatctaatcttagatgtagtaaacagcagtgtggctcgcaaccaaacaccctctaaacattgacatgcaaaacaaacgccgccgtggctgctgctggtagcaagctgcaatcagaggtccaagaggagtactactgtaccagccatgttcactgcccggccagggcagtcaacttgtctgtagttggttaatccaatcaaagtagcagcagatttagtgagatttcaatcagctaagcaattgcaagtaaatgcgtgttagtaaggcaaagtttgcatgcatattttattttaaccccagtgcttaagctgatggaaaattaaagggcatatatggatagatcagttcaacctaaaactatcccctaaaaaaaaagttcaacctaaaacttgactagtagagaagaacgggcaatgcacttaggggcagagctaggtaggagagaggggtgcccagaaacctggccaagaaaatttttttagctatagtttttctatttttactatatatgtacctccttaatccaaactcaaatactcatattagcttaaacttgatttaaagtagagtaaagcaagtgaatggtacatctctctatttcgttttagctccgcccctaaattgtcttatactcccaacgaacaatgcagaagagacaggattggtgacattggggcctcggactcaagaaggaagcttccaccctccaactaatggaaggtgccattgctcagcagaaaaaaagggagaaatcgacacccaacttcggaagtgcacgctgctatcaactctcggaaagaagcctcacgtcgtctccagcttgtagttcagaaaagttgccaacgcatgctccggctcggctgctcatcagcgtgtgcactctccactcaccatcagatatttttcatgaaaaaagcactagcctgtattttacttttggaagaaaagaaagccccttgctcacaatggctcgcacacagaaatccgtacattgtttgtacgaggtgaagtgaacgtcctgcttccccatcaagaagaatcatcactctgcaaggctgcaggtgcaacaaactgcataaatgatagtagtagtataccttaatgcaacttctgaatctcccctgttgtgatcaagaattcaaatggacaaaaacacaggattactgtcttactgatagctttgcttttagctttgaagaagctttccttgtgatatataacagactgatgagtcatatatatacatagcagatgctggcttgattactctcacttactttcagttctattggtggttgcaacatacggtgcaaccgtgcaactggaagcgacgaccagagaattacagtcatcaaaactacattactacatgcatgtacagcagataacattgtccatcgaatctgttcgtgctcagtttagctcagatacacgtttttacaagtcagcttacaaacagtggaatgcccacacaacaaatgctatttacccatttttactgagcacatggttagcttgaccttaaatggtgagtggcagctgatgcttctcaccgttgggcgtatgtacgcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58968 - DNA, 964 bp, Oryza sativa
gcctgtatagatggccatgtgggccgcccggcacggcacggcccaggcccggccgtgcctgggccgaggcttgtcgggccggcacggcccgaccaacgcaccgggccgtccgtgccagcccacgtgccgcactcacagcccaggcacggcccaacacgcctcgggccgtgccgggccgacccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggttcctattctttagacattgacatttatatgtctatttttagtccctatactttgtgtaccgggcctggcctgccagcccatcgtgccgggccggcccgaccgtgccgggccagcccagcgtgctggtggggaggcccaggcacggcccgacagtcgggccgggccggcacgggcccgacccaagtcgggccgtgccgtgcttgggccgggccaaaaaggcgtgccgtgggccgggccttcgggcctcgggccttatggccaactatagcggccggcgcggcggcggcggctgcggtgggcggccgctcggcggtgaccggcgcggcggtggccggccggcgcggaggggaggaggggaggcggcagtggccgccggccagatttttttttctttttttcttttgagatgtgaatctgtgatgtatttttatgtgagatgtgaatctgtgatgaattttttagaaccctgtgatgtgatttttttaagagtttgtgtgtatttggagatgatttgtttgaggatttggagatgttctgtaatatgtgatgatttggatatgggaggggatggtgtgaaattaatattcaatattaaaagcagaaaaaaaaagaaagggctgcaggaat

SEQ ID NO: 58969 - DNA, 15794 bp, Oryza sativa
gatatatcattgtcgatgaaaaagtggttactaataggcttcattgatgtcgtagagggacacgatgtgggtgtgggagggggggggacgaggtggtggcaacaataagtaaatctagaggataggtgttccattagaggttgaactagggtataggtaggaggaaggctttcacctttgtatgagatccaatagcctaaatttgacgggattttgattgaaaaataagcgcctatcaaatacaattcatttttaaatcttttaagtttgtttaaaactcttttctgagtgtttttttcactctataatgatgatttctatttttaactcaaatttctgtaagtgcaccggtgtagaatcgaactaacataaaagagtgggacctagacccatggttcttaaattttggttttgttaggtacctcacggcgtatacaacgtttttatgtaggggccaacatataggtattaaaaatcaatctttttcttctaatgtctcttccatttcccttttttatctttcttctcatgtacattgataagcaatgccaaagtgagtgagtagcctgatgacggtgatgtgaagatatgatttaatggaagccaccttgatctagaagtggggaactctgatcttgtgatggatacacgatctagtgtgcaaagatttggttaattgagtagtaaatgagctccattccggcaacatcaacattcatctagtggctttgaactccaatttgacaacatgacatagccttcttgtcatgtgctgccacctctttccctcgaggtggggactcatgcgtgagcttccctaaggtggtcgcgcttcgatgagtgggctccttcctattggtggtgggtgccaacttatgcatcggttacttgactccttcttgctagtaacaattatgattttgtacgctagcgactcggactagtttagctagctttgttggttcaaaccaaagaatcttgatgttttgtttacttgctccatgctcaaatcgaacgaaatcctcacctctatctctcttggtttgattttatcggcacaagccacacataaatatcctaaggggtggacctagaccctaaacaacttaggccatagcacaagcctcagaagtgaaggcctataaatccaccatgtgaaaatttgacgtgagctaaaataaaatgtgccgatggatccatacgtgaggattgaaagcccactatgtaaggcatatttttatcatgtaaattcaagcacgaagcaaagtgcaataggttgtccccgagccttaggctaatgccatgttagtccttgggctgacccacgagcctcactaaattaatgccagatgtttttttataatggattaaaactcggccttctatatcatgtgcggatatacacggctaacctacacagaatatatcattgatttaaatttcaacagaataaatacttttgtagtgaagagtccaacaacacggcatcatccccatcccaatgagggagaatatgcagtgaaaaacatatacatatacatacatacatacatacatacatatatattggaaatatgaaaaataccgtaggatgaaaaatggacatatgagatttatccacgtaagcacgagtaaaacttttactctcataaccatgagtaaaagtgtaacggggagtaaatattttcctaacaataacggagacaaatatgtaccagacgtctatttttacgtgctaaaatagttttcatatattttttttacactacatattttcttcgcgcaattaccatcaccatgtgcaggaagcatcagcggcacaggaacctcagaagatccgacaaaacgacgtgcaacccagggatctgatctccattgccatgccatgtcatgccaaatgcccgagtgcgccggttgcgacacgggcactcgcaaccatccatcgctccgcttctttctactgtgtgtctgtactcttgtgtgttccagtggtaaggcatcccacctaaaatttttcatcctgtcacatcaaacgtttgaacacctatataaaatattaaatataggctaaaaatatataattacatagattgcgaataatttacgagacgaatcttttaagcctaatatctccatgatttgataattaatataatgctacagtaaacatttgctaatgagggattaattaggtttaataaattcatctcgtagtttactgatggattgtgtaattagttttttattagtgcctgaaccctatacaacatataatataatagccgatgtaacacgttaaaactttaggccactggatttaaagcccgtgcagcgtcccaaagctaaagacaaagcttaagctcagtgtcagtgtcacagtgtcagacacgacgagacgacacgacgacgccccacgtgcaaaccgcagtgcttggcaccatcattaacacgccatacttaacgctgattgcacttattaattctgtagccacgagatgatgatggcaagttcaaacggagctggaggcagagctagagtgagactgtgagagtgaacaagagataagctaagctagtacagcaaccagcaagaacaaagaagagtggccggagtgggcgggggagatgagctcggcggcggcggcgacgaggttcatcaagtgcgtcaccgtgggggacggcgcggtggggaagacgtgcatgctcatctgctacacctgcaacaagttccccaccgttgagtgccgcgccgccgctaatcccttcctctccgttcttgctccggcccgccgtgctggcctatcttctcttcggctcgatttggtttggtttggtttgatttgattcggtttggtttgggcaggattacatccccaccgtgttcgacaacttcagcgccaatgtctccgtggacgggagcgtcgtcaacctcggcctctgggacactgcaggtggggaaagctagctcaagctcaccctcaatctcaatctcaagctggggcttgcaaatcttgttctcctctttgattttattttctcaagtgttgctgctcacttgtgctcagctcagagaaagatctgatttagtgattttgattctcgttttggttggggactgttggttgcaggtcaggaggattacagcaggttgaggcctctgagctacaggggagccgatgtgttcatcctgtccttctccctgataagcagggcgagctatgagaatgttcagaagaaggtgaactgcttagaaaccccttgtcattctgatgcaattttttacttggttggatatgttactttccttcgcattgcgctagtagaatcgctatggtttcctgatgcattgcattggcaagattgtagatatgtagttcagaaatacgcactgtttcaggtattcaggtgggcattatgctgaggaggtatcatgtcaaacaaacatggaagaatattaaaagcattgaacaatttgtcgtgtgtaataataacgctttctaaaagcgtgattcgtacaattgctttcctcgaaaagaacaaggccagttgagccgtggagacttagactttgctcgtcacgcttttcttttgcagctgtttgtgcattatatgcaaggttataatataaagccgaagatgaaattgcgagcaaaggagataatttctgttaatgccgaattaattaccagttgacaaaattgttaggagttgtggctcacttttgatttacttcgataatggtaaaacgcctccggttgtttgctctataatagcttcctaatgtaaataagatatcaacacgaagcttactacctagagacaagaaagcccatttacatgtacaccacattgcatcatgctttgtctcattacctttagaatctctaaagtgtgtactaatgacctgacttcatctggacagtggatgccagagcttcgccggtttgcgcctggtgttcctgtagttcttgttggaaccaagttgggtatgctatgctattcattaattcaccctttaccttctgaaatttcttaattttttgaacgccattcaaccccacgaagatatttgatacagtaaccacagcccagtgacattctttgctgatgctgcattaccgatttcctgtctgttcagatctccgtgaagatagggcctatcttgctgatcatccagcttcttccataataacaacggagcaggttggtgttttgactgtgacaagagaatgacacatttttgccacatttaggttagccaggtttcacatttttaggtcacagtttggttcatgccaaagttgtggctcaacacactttctgagcaccttgtcacacttgtcacacacaatttttccaaatacttgtggcacttgatttgttagccatgctttgtgtgtgttgcccacactttcggaagaaaactgtggcaagatgtggcacacatcctcaacaatgagactttcctgactctttctacatgttagggagaagaactgaggaagctaataggagcggtcgcctacatcgaatgcagctccaagacacagagagtatgcttctgttataccctatgcaggaaaactttggaattttgagctccttcatatttaatcatttactcacatcctaatctaaagaaatgttctttttcttggttacttgtagaacattaaagctgttttcgacactgccatcaaagtggtgcttcaacctccaagacataaggatgtaaccagaaagaaactccaatcaagctccaatcggccagtaaggtacctttgaagtttacactgtctgctcacacttcatcagtcatcacttcatcagtggtgcatcatcttttccagttcagcattttgatttccaatgaggcctttgacacttgatcatgattctgtaggcggtacttttgcggaagcgcttgtttcgcgtagtcaataaccaagaagaaaaaaatgtggtttttgttccatcaccatgatgttcagatggccccatggatctactcagaatgggatagaagatcatggttgaatcaacattgcttgcagctaggaggaacttctagttctctttttttctgcagtggagctccttttgtttctcctttctctttttttcttatgttgtaaaagctccagaaagttttacccttggtaataagatgtgctcttctggatggctacctttacccgtatctcctttcactttgcgaaatgttggaaactactggacctaacagacctaacagacaaacaaaaaagaagccacatgcttcaaccttttcttatatactttggattgaatacataggaagttaattacatcatggtatcaccaatttatcatccatgttaccattaggccaagcaattgaagcaatgaaacaacacgtggctgaaaaaggagaatgcaagtctcctatacatgaatggattacaagaaacaatcaaaacaaagaaacaagaagcatatatacccagcttcttcagatcacacagacatccagaaaaatggcacggcaaaaaagtactgtaaattctccggtgttgacttcaagagtaaggtaacacatcaatctagaagtttacaacacattgataacgagagctagtcgtttcaaccttaacaccgacaaaaccatttctcgccgtcagtcacacacagctcacaacactataaacctccttatggtaattacaaaatgggggagacattttttcaacaaggttacacatttctccttgtacaaacaagcgcactagtatgagtacaactacaaagtaacaggaggacgtttcttggactggcaaaacaaaaaccggatgctgcaccttgcaaagcccttgttcactgtctggcaggttcccatccagaaaatggggcatccacaacttacaagaagcctgcaagaaccatccttgctaacataagtaatcattcttttttcttaaactgataaacttgcaagaagaaaaagttcaacttaccttacagcagatccagcaaagccctcctcttacagtatgactatttggcgccataaagatgaaatgtatgattgtaaatgttcaggaattatgcacaccactttctgcttcagcggtaatccatatactcgttatcgttactgattgtagtaaaatcagctgggttcttgttagttatacagatatcctgtctcacaaaccgatccaagggatgaaccattttacccttgcctctggtccaagattgagctatgctgttcctcgctgataaaaaatctgcactggagctaacagaacccaactgcaatgcattccattttgctgaaaacattccagaattcagggcttcaaaatgttcctttctgttcatctgatgcgatgttattcctgttgacactcctaacttataaccagattgtgtgccacagttctccgaccagtttgcaatttccttctgcagcaaggagccaagcacaccaactctaggatgtgggcgtaaaggtctgtgcagatcatgcagctgatgccgtgataagtcttcgaatgtcaatggaatctttccattcaggttactgccatatgatgtgctggttgatcctttgtactgattatgtgcatactgagaattatgaagttgagactccatctggttcctgctagaagttccatagttggggaagcttgctaatgttgatggatccatcattctcagaagatgcgtcgcaggcatggattctttaggatacaagactacttgtccagcatttctccgatcacataacttactcgcttccatggttgctattgtgcttggaaaatttcttgcatggacctggttaaccgctctttcagcatagcggtccagtggcgcaattactggttggcgagatgcataattgctggaagatcccatgacatgagtagaagtcaagtcaactgcttggataccaggtctaaattgagcaccacatgttgctgctggagaatttcttgtagtggccttaaattgctcccacgttagcttctttgcgtcttacggccccaatgttcagttggtgcttcagcaatatactgatcatcatgatgtgaaaatagtggtgagcttgcagcaatagtgaccatttcttccatccgcaaatgtgtctgctgttcctgagtagactgaaagttctgaggatgtggagactcttgtgtggtcaatgccaaatgaccctgtaactccttctgtgtactttgggatgccaaggacttctgttgggaattagtgtcaaacacacttgatgcataatctgaaccatccttggcagctactattacacaatcatcatcagcagttgtcttggattgaatacggttgatgtcagaacaatcagtctcagtcataagctgcctctcatgctggtttttagctagcagttcaacaatatccatggggatgtcatctatcatggtctgtttttcacgagtcacttcaagtttttgcttctttttcttcttgggtagactctgctcatgaaggtcagacataatttggatatcatgctcagctggagaaacctgagatgagaaatgaggaaaatgtcagtccattacaatcactataatatgagtctaaaaaagaatattgcgccacgcacgtgcacacacacgcgcgcacacacacacacacacacacatgcacacatgcacgcacacacaaaaagagtatcaaaacataagtaaagaagaacagtggaaagcatataaataaacattgtatgcatatttcttaacattgttatgcaccaatattattccttcatacagataaatgttgattcagtcaatttaaaaagcaaaaattcctcatgattcacaaaattcgtacctttgccgagtgactcagaacagagttttcggtttccatctggcattgatcttctgcgctgagtacatgtatgttctgaccatttctggtgctttcaccaccatatttggtactagcagctgaatgtgttttccccttactcaaacccgctgttttcccctttgatgagcacctctgtgtggagatttctgatacatgctgacagacatctgtcttatgcatatttgtgtcaagaccattttcagtatcattctcatcatcatgctgagtactcgcagtgggtgtcacttttttgttgctcaaattcccagctggatgagcaactgtgtgatgcacacttccagttcttttcttttttccattcagccagttcataagtgatgatccatcatctacaacatcagagtatttgcgttttgtcttgttcttacttgattttaacccatcttctcccactgtatggttgctaacaggaatatccatgcttacttccatcgggaccgggatggtacttctatcatcctcacagggatcagcggcattttcacgatgaacttcgtcacttctagaatcctcaacctggttagcatttataatttctgatagaagccgcaccttttttggctttctccgacaaagctttgcatctgaaacatcagcctgggcagtgcgtttcttgctgtgctgctgcttcttcatcaacttcttatccgtcttcctcttagatttggagcttcttttgagaacaacttcttcacatggctcattgcagatctgctcacatttctgcccagacactggtttcggatctttggtcaaattgcactgctcagcaacctgatcacgttcctttccagacattgggttaggatctttggtcaaattgcactgctcagcaacaagagtctcttcagtttttccattttcatcttcatttcttttgaggaccacttcagaaagttttggagtggatggaggttgatctgcaccatttacttctatgtgccatgtaatctggggaacttcaggtaaagccccaacatcaacagaagtgttgtcctcagagacatttgctgccacatcataattttgggctggcccttgcaaatctgagaaaatcacacaaacattagtttattctataccttaaataaaatcctacttaggaatttgaaaggctctacatctaccatacctttcattggtgaatcagtattggcctcagcagctccattcttgccagaaggcgcattgcatttggagtcattgccttcttgcacactctttggaagagttgatctatcagcattcttcccttgagatgattgtgtgctaggagacactttttgggaaccaacactagcaggcacaaaagtgctccgaacaaatgtgatggagcaaccatcacttgtgccattctgctttgcgggaagagttcttggtgctgttccattatctgaagttttcaacttatccaagcacttcgagcaatcccatcgtcgaaactttgctacagaaaatgggcttgaactagctttgtgttcatcacattttttctggtcatggaaaatccgagatagagagcagaattttggatccttcttctgaagaagagcaacataccctctggtacaagaaaaataagattatcattataaagatgcatggcacatatatatagcacattgcgtgcttcagtcaatatacaactgataaactcagaaaaggccctacataatctaaaggatgctgggaggtaggcatttcatacatagcttgtacagtccagaaaaagaggaccttcaagataatctaagtattgcagtttgaattcaaagataatacaaatagcatgacaggataaactacaaaaataataatctaattagttctagaaagtattaaaccaaaacgtgacaagtctatggttgatatatatcatctctagaatctctaaacaattgaaaaggcttaaaataataatggactatcaaatcaaacataatgcaaatatgaagaaaccatcagttctaagaatctcctaggatgtaaacatgcttatgataaaaaagttttatgctgaacctcagcacaaaggaaaaatgattacaaaaatgtagggcccaatatatgagtgtaccccaaaaaggttaatttcattagtaatcagcttgttcaacagaaataatatacaaacacaaatatctagctacagcctacagcatggcctgaataaatgcatgcgcaccccaacacaaacaaatatgatcaaacacctaatgaacacacatacagacatgcatatgtgtagcactcacaatcatgtgctcagattcatacattgaagatattaatggatgtacgtagagtataaagatacatgaaacaccaacatatatgcaaatattatatatattttttgctgctagcctgctagctgtgctatggcataaatgagttcacatggctagatatagagctagtagtggatgtattgacttcctaaatcgaaccaaagtcataagcatgtcgacccagtgtatacgatcgtacaaaacagatgaccatataagtcccaacagcaaactgtgcaaaaaccacgatcaatcatactcttccatcaaacagtgcaatatggcatgacatgccgattcattattcatccacaacgcgatactggaattggaaatacagaaaatgattaccttatggagaaatgctcgcattggtgttgtgccggttcgtctacaccagcttcagcggctgcatcctgacgaggcgtcgctgtcagctccaacactggcgctacagcaccagttccaccacgagcaagcatacagttcgtcccaacaacacgagctccctcctgatctactgcaacaatctccatatcgatcaccacgacgaggagagaatcaacacacagctagcacagccgaggcacaactcaatatcaatccagcagtgatcttgtaacgccgcgaattagcacatcaacaatccaagcacaaaccacaaaccacaaaccacaaaacacgagctctggatatatcacagaagacaatcaatcagctagccgctgcacacgctagaacaacctgaaacagaaaccagaagaaacaaattaatgaagtagtaggcaagaagaagtcaagccgatgtagcaatagcacgcacgcacgcacaatatatatccacttcaatcagctcatggaatataagagcaccagaaattcgagcgggcaaaattatagcaagaaataaattcccccaaaacctagataaacaaagagagagggggtgcgaattaaactaattaattaccgcgccacatatacacaaccataattaaccttccaaataatacaggtatagctaagatagacacatgcatgcacagagagagagagagagagagagagagagatgggtagatctaaaacctagagggaggggccgcataaaccgccgtaactaaaatccgcgcggtaactagggctcgtacgtagccgcgaggatccccgcaaaagacgggatttttttttcttccgcgacatgaaatataagggctttggttcccatggaggcgaggagctcgaggcccgagagaggggcacagctggaaagggggcggacctaacgtggggcttcggatgagctgaacccctctcctcccccaaaaccgcaaccccccaacccgaaaggaagaaaaaaaagtggggaaatcggaagtaaatcgaggcgaaattggatgggtcgatttggggggaggggggaagaaatcggtcaaaaccaaaccccccgcgggagctgttcttgcggcggaggaaaagttcgttgattacctggggggtttgcgtttgctccgacagccgcgacgcaggcggggcggggcgcgatctacccggcgcgccgtcgacctctccccggagctagctgctgcttcttcttcaggcggggggagcgggaggggggcttattggagaagactagtagtagtcgtcgtcgtcggaggaggaggaggagatgcggggtggggcggtggattcgatgaagctaagacgcggttggcgcccggagagggagatcgactggtcgccgtggtcggtcggctcccggggaaggaagaggacgcaggcgcgcgggcgcgccgcggtggattccgatcgagtgggtctcggaacgcggccggcggcggcggcgcggtggtggtggcggcgagtactgcaggaggaagagaagctgcggggggaggggaatagggtaagaagggatttggagtggagaagagagagagaggggggtggaatggaagggaaaagaggaggaggaaaaagaaaggattgtatattttatttgtacgggagttggagttggagttggcgttggccagtccgccctgcccctgcccctgccctcacctcacctccgcagcgctgccctgctgcgtgtgtgggccccgcacgcctttcccttccactctttctctctctctctcctttctcttcttcttctatctccagtaataaaaatgataaaataagctccatatactactgtgtactctacctgccgctgtactctacctggtatgtgtatataggtaggtatagaggtaccgatactgcccgagcatgcgtaggtagtatactccactctaatatcacgcgtacatgcatgctaaataatattgtaccggttaatacgtaaatacgtaggagtaaaaaaaattgtacctatctgtgttttatactcgtgatctacaaagtattactatataacatacagtgctttgtaatataagtagttttaaaatgcagagagcagagatatatcaaactctgacgaagtatagatcaaacaacagagttgattgccccctctgtgtttatgtgttctctgtgtttgtttgtgttgtctttattttttttaagcctagattgattactcactatgtggtgtttaacatgttaaattaaactacagcggctttcttcctgccaaggcatgtctaatgtgatgttccaaccactatatgttgtaccaagttaaatataccacatagttattcttatctcagtcgaattttcaatcaatagatcatataactaggtagacacatgtcactagtggtacataatggctctcaccaccccatgcacagcatatgtatgtgagtgtcctaatctatataaaacgcttaaccttagttctcgacacaggtagaatggatttgacactgacctttcagttgggtttcttctatcaaactcatagtctacgatgttagacaatggggacgtgtaatgtgtgcccttgccacatgcacatgataaccatgttgtaataggcacggccggcatgctccgactctaagtgccattgacctagagaatggcctgctacataccgatgttgcctagctcaaaagtttgtttctccttaaacaaaaacaacttcattgccaataggcagttggccttagtgaggctacaagtcaacaaagccagccttcctccgttgctacccatcctatgcaggacggcacgtacgcacatgaagccatcgacgcctacgtgtatgggaggatatccacaatctaccagcattaagccgacacctctaattctaaattattgatgccaacacaggcagtcacccgttgacacccatgtgcaaccgcgataaacgactagttgtagtcacatttttaaatcccgttctaacctgactatccaactaaaccaatatttttaccaataggagcatggaggagaaaataccaatccaatgagctcattttcttcataagccatgccccatccgtgcgccacaaatatcaaatctttatccatgaaaccatcgtttgaggaagtacgaaggtcattactcaaaaggggattaaattgtaagggaaattgtttttcacttattgacctaaatctaccatgggaacttagattggagtcgagaatcgaaaatgattagtgcgaggaaaaaagggctaccaagatcatatcggggctaagatggtgaaaccaaagtagaccgaatccaatcaagataaatcaaaggattaaaatgacacaattaggtagattaaatctcaagagataactaagaaagatcataaacaatcaagatgcagggccatgggcagacagcaaaccaatagatgaatcaaattgtggaccgtttttacgggttgaaattgttcagactcatctctgattggtcaatgcaaacggagtgatggtcctacatgccattgacctctcaatgttactttggtatagaagtctcgagatgctctgctgaccaatggttggtctttagtaagtcggtaggacaagaacctcttcaagaacagtagtaacaattgtagaagaagggaagatgtcgtggttatggattttgaagtggacacagtggcagctaaggagggaggtcaacacaaccatgcttggcatttggcgatagtggtagccagggaagaggtgttgcagcgtcctatgtttgtttgtgtgtgtgtgtgtgtgtgtttgtgtttttctagcaatgtaggaatgcggccaccaatccgagtagagctaccattcctacattgttgtacatatagctgcatgatgtcgttgtgcatgtgcatactagtgaggattcgctagattcatagtctcctagatcgacacccacatgtcaatgatgctcaaacatgatagcaagcaaatcgatgatgctagtcacactattttcccttccattaagccaatagattcccctataagccgacagaacagtgcaaccaaggcaaaaggacctactatgctacctagcctgttcagacaagccattgtactgctactccggtccaaagttttataaaccattccatcaccaaatagcactcctaagcggttttgtcgataaccatgattgccattcaattactgacaaaaactagtgaaattggacgaattttgtcagcttgtttcttttgaaattgacctatataccaagttggtttctcgttatttattagctcaataatgttcgtcacattttgaacccttgtctacctagctagcccagcgaaatccaatcaacgatagatctaaggcctaccaggcgatagctgacatcctttccagtaggagcacaaggaggagaaaatttgcatccaagaagacccctttcttcctagaccacgcctacggctatcgacgagctgaggtcacctgcctaggctcgactttaacacaagctcaagcaagcctatataatcttcgagcttccaagcgggctcgcctcgacctcgactaccaagcatggctcttaattagtataagatatattttaaggatatataatatcaataaaaataaataatttgttgttaatcacattaatgaaagaggagaaaaggaataagataaatatatgatgccaacaaatactaatccatcgtgtgaatccatacaaatgcatgtaataaaaatcatatactatggagctagatcgagctcagctcgacaaagctcatgagctttggcatatacttgagttcggttcgagctgatcgcgagcctcgaacttcttcgtcagccttaaccacgccccttccgtgcgtcataaatatcaaatctttctccatgaaacaaccgattagaaggggtatatggctaataagatgattaatcaaaaggggattaaattcccacgggaaaaaattttagtcatcaacctaaatctaccgtaggaacctagattggggccaagaacctagatcgaagcaaaagacataacctaaacagatcgaatccaacaaattcagaggattaaatcgatgagaccaacaatattgaattaaagttagagagaaaacataaaagaaaaggaagaacacaaaaaaggacggaaataatcacgatgagaaa

SEQ ID NO: 58970 - DNA, 7233 bp, Oryza sativa
tggtccgcatgtcatttactcggatggtcccacgtgtcagtgtcacgaatggcaatataataaaagtgacgacatgatagtagcaaatctcaccatttttttctacgctaggaaggatgagaagatactgatgatgtgggaagaaaagctagaagcaagaggagtaatcaattgtgtgaaggtggctgtgtggacgtggattcatgtttccatcctcgggagatgtgagacatgtgccctcgtcgctacatcagcacaacagcccataccactggccctagctactgtacatagcagcaaataactggaaatgggttttggcagcgtttggttcttgtagctaggtttaattcctttgtttagataaaaaatagacactactgcaacagattaaattagtttatggtgttagcattaccctttttgatcaatgaatgtatacctctccagcaagtagtaaatgtgtcatggacacacatatatatagatagttgatatccaatgcaatatgcgaaaagcataaatggcatggtttatttgattccggcggtagtataatctttcagtgtgtgtgacacacatatatctcacatagtaaaaatggtatatatgaagaaagaaaaaatgttaactatccatatcctatacatatgcaagacatatatatatatatatagataggaaatatagcggaataactataagtctataatattatcaaagaacaaataaaaacaaaacagtctacccgcaaaataaaagtaaaaacaaaacaggaaagtagatgaattaacatcatatatatgcatcgatctttcctgccattttctctaagaatttttgttcgctaagaattaatgttgattctcagtcgatttaaaaagggaaaactacgcatgattcaaaaagagaaaaaatgataatagacacaaaataggggatcgatccatatataaggaccaaagcgcatttcttattcttactgctattaatttgtcaagcaactcttcacggagttttcggattaatccatttggcattgatcatctctctcctgagtatatatgtcactactgtttgtggtttcatgcatgaacaaaatttacaccagcagtttgattaaatgcgttttactcttagttacttgagaaacactgaggggtcttccggctagctccaaaaggtggtgagctaaatgacctgagtttaaagcctcactctttctaattatttgatattaggaccttgcctaatatttacatttttttactcaattttacctttcacaattaagcgcctttaatttgtgtaaaattttggcatgcgcatgccgtcagtcgtctgcaaatttatctccaggtcattttgtaaattattttcatcatcttgctcatgagtagtgatcacttttctattgatgaaattcccagctcgggatataatttatggagatcgatacactttatatattttgaaccccttttttcagcctgttaattaacgttcatatataggtgtactagcaggaattaatcgtatctttcgtgacgatctcagctgtcgatagtctacaacttctggatatattatacttatcgtccttatacagattacctgcagcaacgtatcttttgatcaacttcatcgcttctagaattctcaattaacctgcaggacagtgtctataatttctgacaaaaggcacacgttaatttctgagcagtgcgtacgtttttgtttctgttcctttcttctgctcgtttgcgttctttttccagttagtttcttcacatggcctcaattatataattaattagctagctagcttagttcacatttgcatcggatcgatctttggacaaatatatatttgcagtgattagcaataaggaatctcttcagttttcccccttttttcatcttcgtttagtttacggattacttcgtaaattaagtttgaactgcatgagtgtgttgatctgtaccacttcttttgtttgatctatattaggtaaattaagctgcaaccttccaagcaatactggaagtatatttgctgtctgtcacatgtctcacatcatattattgtaggccaaattaaacccgggcaattaaatacaaggaatcgcaacaacattaacttaggttacgagcatttttacgggatgtatacgtatgtctactgcatgtcatatataccttttgtggatgcatgcgtggataatatatatatctgccttcgatctgtaatacctttcatgcaagaagttaatttgaagctgcatttttgcacactctttgaaggaattgatcattatatatacatcctagcatttgtgagcataaggcacaaaataattcaattaattactgagtagagaattttcttttcaagagagagactagcaaatacaataataaaacacacagcataacgtaatctacaccatgtctaactacatatatacacctgcgataagctaattggctatgcttgcaaacgccaattaatgtgtagttaaaaacccgactaaaacacttttgtaatttggatacggtgatttgtacgtaataaacattcaaatgaacccgtaaaaaaatatgcatatgccttttactagaaaatatatgtaactaataactattatagaatttttaagcgtttcgtgctttatcttatcatgcaaaacatgcatagtataggtccttcttttgacaactgaagttctcgatcagtatttgcagtacattttgcaaaatagtgggccagctagtaggatttttttatacacagcacatacatcttgttaaaaaaaaatagtgcgtctagtgtgagtggttttacaaaatagaggacatgttcattccaatatttaaaaacaaaccatgaaataaatccgttggattacatatcatggccaccaattgtataaacataagcgttcaaaaattacttccaaaatttagatggtagtgatttgggaccatacatatgccaaaagtagattttctaaataacaagattaatttaatcagtaaaagccactaggaaatgttacgattatttactatgattttattttactttagaaaacatatatatgccctgttttggaattgagcaggtttatttatgtcaatatacaattttgcctgagacgacgtgtccttttcctctgaaccacttaccaattcaaaattcttacatttatgtacttgcacattctattatgtctagtactaaacaaaggtataatttgttaaatctaagcaatttaaggtatactaagactgcccctaatttgccataacttataaaacaaagtacttaaaattaaattccttcttgtataaaaaaagatttccttctcgaatttaaaacaacattagtacgttcatttcattcacaaggtcactttcaagaaataagggcaaccgatgggtttctccccaatctcatcagtcatgcagcagaggcagctgcagggaggggttgcagaagcatctgtgcacagagaatccaggatctgaaatgggtgagggtgagagatcgaatcagatgccaacaccacccgatccatccatccatccatccacaacagcatagagacccccactagcttttgctccactcacgcaaacctatgcagagggccagccaaaaggaaaccctaaccctaaccctaaccacaggtggcttaaccctaacccaaccctaaccggggtgcaggcaattaaataatggtgacaataaaataatgagaaaatgggtgtgtggggctaggaggagtagtagtaccagtagcttggtgggggaaagcaatcaaagcattcaaggagggggactgtgtgaagcaaaaggacaaaataatggtggtggtttgctgctgctgctgtgatgccttttcattttggtgaggcaatgtgcacaccaaatagtgcacctcagaaagcaacatctctctctctctcgtggtggagtatacactgcaatatattaattgcatgagtttaaggggggaatggatgtttaggggctgatttggtcagggtttggtgggtcatatacagggggtttgtttggattgatgcttattaatttgttttatagaaatatgaggatatctgatatactctgaaatttgactgttcatatgttcagaaataaaaaattgtatcattaaacatatctgtaataattttatgattatatcttttaaaaagtatatatagtcaaaattacaactcgaaaaccatgaaaagtcaaaacgtcaagtaaaatagaacaataacaaattatgttgaatcagccattttatcatctttctagtcaatagctgttaattagctttgtgtgtttaactcaacaaaacaaatacggagtagtatggtaacacagttaaacacttaaactacgtatataattttataaattatttcctatcattaaaaacctatctgttacgtgttagctagtgttgttttatttttttaaccccttagtttacagaaaattctctatatccaaatctctattagtaatttgttttttcttccctataattcgtgagcgcatgtgcatacacacacacacacacatatatatatatatatatatatatatatatatgcatgcaaaccttttaatttgtgtgattgtgtcccatcctctcttttcaggctgatatgcatctcccctttacccccacctaccactccttgccgcttagtttccttgtatgtgttcattgtgcgctccatccacaccaaactcactcatgtttccctctttttcccacttttgagcaacatgactatgttatgacaaagatagatcggtgctcttgctgctaataagggcccgtttgaaactctatatattgaagtagcatgcatattaccactgattaattaagtactaattattataagtttgaaaaattatttgattttagaaaaaaattatatattgaaaatatttgcacgaaacgtgttgtttatagttcgggaagcgtgctaaaggaaaatggaaaagttgtagtttggaggtgaagtttaacactcaaatgtccttgatttttatctaccattgtgcgctccaatccacccggccacaccaattttttaaaacatattttggttaatgtatagtagaagcattccaaaaaagaggtgcagacagaaaataatccaattaattagacagtacaattttcatactttcaagcagaggaggtgcaagacaaaagaagattaacaagagggtattatacttgcgagggcaattttgcacttactggcctaaactacaatgggaaggtagatcggagagaaacggaaatatttgctacgcgtgtgtgtgagagagagagagagctagatcagggcaaaatggagaaaaccaaaaatatcaatctagcaaagagaaatttaagaattaaaacaatggaataggtagattgaatcaaacataaggaagaaaaaaaaaggggagaaaatgaaagcgcaagctaaaaaaagaacataattaattacgatgatgaactcagcccgttcatggagataaatagcatgactgtcgttagatgtaccacacgccaacgcctactagagggggagagggtgtgttaggggcggggggtgttccagactatacgtctttcattcatataatctgattaatatgtatggtgaatttaggtaaaacagcgaatccaaaatataaagaaattatcacacattattcagatccaacaaagagaatagaaggattaaaacaaggatccagtaaataaaatcatacggagaataaggaaaaagaaaagggagatcacaaaaaaaaatacattaaatggtctacaatatcaaaggtaaatccacaacgcaaacaaaattatcaaacattttgtaaatgatctgaatttttcaccatttccaagcatgaggaggaatctcacggtcgaaagtttggaagtgaaaatgggccggcatagaccatgcacacattttgcactagaatagtagctattgtggaagaagataaaacgctatatatatgttttggtcgtgaaacagtacatattgtaccatagtagaaaaaatgttacagatctaaaagggaaatgctaacgacatcgtacagacaaattaagataggaaaacaagagaattcacatgatattgcataattacaatactccacatctctacaagctgtgtcctttgggacaaatagggaattctatataaagactccaagtacgtacagttttctcgaactttcttattgagtttcttttgtgacatcacgaaccaaaaaaaccatggcactaattgacaccgtatcttttacaaattcatgcactatcgaaacgtaccccagattatattatattagaaatataaattaattaaccctctgaattgtcgtttatatataggaagctaattactaagagagatctggtatgcatatatagaagaaaaaagagaaaatcccctatgtacccatgaaagttcacctaatcccttctatacctctgaattttgctcaatcccttacatacccctgaattttagtttgaatcccttccatgccctttccgctagttgacagttagttgaccgttaaattcttttgaaaaagttcattttgccctttgctatgaagaaacataataaattaatgaagtatattgttggaatataaaaatttattggatgagactattatatttatgagtatgtgatgcaccatattatttgtgacaaatttacttttacatatgatataaaaagttgatacttatttattagttattaaaagttcttttatgtagcataggtgttttcatagtaatacaacaaatttgtttatcacttcagaacacatatgctaaaaaaatcttttaatagccaataaataagtattaatgttttatgtcatatctaaaagtatatttatcgcgaatagtatggtgcataactatctcatatacataatagtctcatataacaaatttctatgctccaacaatatactctattaatttatatgcttctttataccaaagggcaaaatggactttttcataataatttaacggtcaactagtggaaagggtatggaaggaatccaaactaaaattcaggggtatgtaagggattgagcaaaattcaggggtacacaagggattaggtgaactttcaagggtacacaggggattttctcaa

SEQ ID NO: 58971 - DNA, 8142 bp, Oryza sativa
acttgtttatattttggaatcgatgcactagatggtcattttagatatattgtatacatagttagagtagcaagtatgctgtgtgtactttatctagaaaacgtaaataattcttctatatcaagacttcaacggagaacacacagctgtcgtaatatctagcgaagcaaccattgaaaaccttactaggaaagtaattaactactacccccatctctaaataagtacatttttagcatgtgaagcacaaattaatagggaatataaataaataactatgcctccaaataaaataggaaaatgctatacatactaattttttcttactaaattcttactaatagtactgatgtatcatgctataagtacatctagatcttttataactttcatctacctaaatcaaatgattgagatgattgttagtaaaaacttagtacgtgtaacagagctcaattaaataagagatggttgaaagtgctgaaagtgtagagatggttgggggtaagatgtgtagaaattttaaataagaaacgatttatgaaacatgtactagcaccttagaagtacacttattttgagaaaaaaaaactagagccatagaaacaattagggtgtgtttagttcgcgaaaagaaaatttttgggtgtcacatcggacatttgatcggatgtctaaaggtattttcggacacgaatgaaaaaactaatttcataactcgcctagaaaccgtaagacgaatttattaagcctaattatttcgtcattagcacatgcgggttactgtagcacttatggttaatcatgaactaattaggctcaaaagattcgtctcgcgatttccatgcaaactgtacaattggttttttttctttttatctatatttaatattttatgcatgtgtccaaagattcaatgcgacattcgtgggaaaaaaattttgggaagtaagggcccctttgattcgcagaataggaaaaacacaggaattgaaattgaagtagtaggtttctcaaatcctataggaatcagcaaacataggaaagacaataaaagtcctttgatagtgctatgggaaaaacaaaggaaagtttacaaagaggtcacacctcttactatttttcatatgaaatatgaagtataggaatacgatcctatgaaaagttttctttctttcctatgaatcaaagggatatgtagaaaaaaattataggaatttaaatcctatgaaaatcctttgccaatcctataaatcaaagaggccttagacaaggccttagcacaagggacggagggagtaggtacaatacctggtacgtaaagcatgttgctccccgggtggaaaaacctaggaagcaattaactaggacgtcccatccataagatcaaggaatagcttagctataggattctcacatcatcagagtttttcgtagatctaaagattgccaaggatgggagagatatctctagtcttctggatagtgcgtagtactccatactccctcggtaaaaaaaaaaaagacaaaccctgatttccgtgtgtaatatttgatcgtccgtcttatttaaaaaaattatgaaaaaaattaaaaagataagtcgcgcacaaagtattaatcatattttatcatctaacatcaataaaaatatgaattataaaaaaatttcatataagacggacagtcaaaattggacacggaaatccagggtttgtcttttttttggacggacggagtattcttttactataatatagagaaaaaatattattatatgtagcaccatcaggtaggagtattagctagctagtactacactcgatgactaaatactagctagtactccagtgtctcaagagtagatcagcacacgtcgatcagaaatccactgtactttgctaggagtagtactatacctatctcgtacaaacgggattaaattaatatagattgtatcattaaactactaattaagtaattaagaaacgtacaggtcgattaatttgatgtgtaatgacttgatcgaactaccggctatagctagctagctagtcaaggaagaaattatgatggatgcacgcactactccagtattaatatattgatgtgtattttttttgccagttcacgaaaacgacttaagtatatatatggagtaggccacagagatcaaaaagatactgggtgcggaattttttttattttatagacctttttatgttttaattttattaatagaccgttaaaaaaatattttcaaatttgaaccttttgattgtgtcagcccacctgtaatggccaaatagctctgtcacgccacaatactggccttccatgccattatggcattatgactagcgtggccaaacagccctgcctcagctggcgtggcaagaaggttcatttcttgaaattttttttgaaaatgtctattaataaaactaaaacataaaaaagtctaaaaaataaaaaaaattattgggtgcgtgacagatatatattaacccatattttaagtaattaattaagaaacgtacacatgcagaatgcatgaattactggccggtcatatatgcaagaggctcatgcagttctggcctggtgtttgtggggttcataattggtctggtccatgtccagagcgttttcagtggtgatggatggaatattggaatctagcttatgtcagtccagaaagtatatgatcaacccctccatatagcaagaaaagagatctcagtgtgatatatatgttcagaaaaaacaaggaaaagagatcagtgataatttcgcagacatctgttgatggtgcactaattaatccatctgctgctcataagtacacaccagacagatcatgtgctagatgagtgagatgtaaatttatatatgctttaatttaataataatcatgtgctagatgccttttttagcaggggctactagatgcatgtgtaattgtgtatactgttggtacgaagatggcttaattaattggtggttaggaaattgagaactatatatatacatgaatttaccaaaaaaattgaatcttattaatttggttcaacgtgacaaactagtggtaatgtatgatgaaataacttaattatatagcgaactcgtgggggtcatgccgtcatgacaaaacacaaaggggagtagaatgtatacgctcatctatgatagtaatatataagttcataagttctttaaaaaatatataagttcataattaaagtctttttttcacttctgtacagtacagttatattttcttgctgtgtaatatgcacaaatatgtgtgcaaagttgaaaacagatcgtgcagagtaccatatcagacgatgttttttcatcttgagaattatactcgatcctatttattatcagttcttttccaatcgatcgagaaggaatatccagtagttagtactattagttaatcataattaatagctaaaattaagaaaatataaccttatatattactgcatggtcacacacacgaatgctgacacgcatcccagagcatatggtatagaaagaggaaataagctgttgcagaacatatataggaatggaaattaaagttgaaaacaaatcaatactacaattaacttggagtacataaattaaaaatgatataaacaattcaagtttatatataaatgtgtgtgtgtatatatatatatatcactgatcgaggcatgggccaacttagttgggtcccattggtcattaaataaattggccgggtcacatcggccattagctagacaactggactgctctataaattgtccatatcccagtatcatcatctttcttatctcgtccctttccccatcactctcatccctgccccaacaccctactagtagtagagtattctaacaatctcaccacaacaattaaccattagtttttctttatcttacgtatatactactcctacaaagcaattaaattaataattaaacgacgaaacgatcgaagctagctacccctccgtcaaaaaaaaaagtctaatcctaacaatgaatctggacacgcatcgttgctagctatgactggattttttatcgggaaggagtagtatgcgtagctagctaagtactactccctccgtttctaattgtttgacaccgctaactttttagcatatgtttgaccattcgtcttataaaaaaattatgaaatatgtaaaaatatatgtatacataaaagtatatttaacaatgaatcaaataataggaaaagaattaataattatttaattttttaataagacgaatgattaaacatatttaaaaaagttaaaggcataaaatatttaaaaacggagggattatatagttacgcgcgcggcggcagcgactggccggccgcccgccggcggcgagaggattgtgtatgcaacaggtcagttgttgtagctagttgtgcttatttgagggcaaaagctagttatactagctaggtatgcagctgcggttattgcagctcatcacctggatcgatcgcggcctcgccggcgacatctctactccctcaaaaaaaaaaaaaactaagatgaaatacaattcaagacaatgaattaccctatcccatctttatctaggagtaggttagattttttttagacgaaagaaatatgttgtcacgatacgaggttacgatggataaacactgtcagaaggagtaatgaaaatgtagatttacaccgaagagaaaaaacatttatgcatctgattcattgctttggtctgacccaatgcctgcgacatttatgcatgcatgtgtatatatgtacagttaattagtcagtgctagctagctagacatatatgaccgagtttagttccaaaatttttcttcaaactttaaattttttcatcacatcaaaactttcctacacacgtaaacttccaacatttccatcacatcattctaattttaaccaaacttttaattttgacgtgaactaaacacaccctatatgtagaaaagccggaaaatgaaaggagaataaagaagcatggtcgtcttaggggcctaagtcggttgtgtgaccgtctagggcccaagttggtatgggacccatcaccaaccaaggtggtcacaccttacgttcaattcccacgtggtcacaccttatttcatcgtggctaagacttgtgatgttttcgtcttctcattgcatctaattagtctgaaaattgggctagtattttgttttgttcctgttaattaatttacacaatatttttaggtgtttataatatctgttagcatcatttttgattatatatgatttataacagtatatattacaaattatttaatcttgagggtgtatgttactaggtttgcctaaaaccctctaaaatatagagctggggctgtgaggaaagaagcatgtaatgaggtccgtttgtttatacgtgttggatgattttgaatttctgataattattaattgatgtatacgaatgtattaaattttgtaagttaaaatattgttttaaaatgttttttctaaaaatataatgatgaaaaaggttccaaagaaatcttacttcctccatttcataatataagactttctagcattgcctacattcatttagatgttaatgaatctagacatatgtatgtgtttacattcactagcatctatatgtatgtgagcaatgctagaaagtcttatattgtgaaacggatggagtgctatttagcagcttaatgtatcactgatcatctctaccaccaattagccacgtgtccacgcggtaataataagcaattgagttaattattacctctagctatatatagtcatcttttcgcttatacttatacttatcagccaaaatttaaatttttaaccttaattttggaactaattttgaggtttttttcatcaaagtttatttttcagcctttactgttagatagctaaaaacacgtgtataaaagttttatttacaaattacttttcgcttattccataagcgaaacgatagctagtatctgcatgcctagctcgcttgtcatgcatactggaaagtggatatacatgccaagggatatatatatatacatatgctacgtacgtaacgtacttatgtactgcgtacacgcgatgtacactagcaatggcgcatggaattaactaattttgtacgtgcaagctatagctagctagcgcgtgtaattgaagcaaagctcaaatagtctatacggctgcttgtacgcgtgcgaggaatgacgtcctgtacagcatgagagtttgagcttttttcgctcacgcctatatatatgtgtgtgaagaaaaaccgattctagagaaataaatttgaacatatataatgttgcccaaattcatccagaacttttttttgacagaagtagcttgccacgtcacgtcttttactgagttcttcttatcagtttataagataagctattttcttgtttatcttgaacatgtttcgatcctagctagactgctaacaatacatttcgtgaaagaaaaagttatatataaaagtttccttaaaatcaaataaatttgtttttaaatttataatagttaatacttaattattcggcgctaataacctctaaactaactagctcagccgaactaactgctatttcaaacgcatccttagctagataaaccataacttttttatgtggtttgctgtagtttcttagtttttttctacagcttaccatacataatttcttagggcttgtttggtttggagtaaatttttaccctacagtagtgtcaaaacattggtaaattttggcactatcaaattgggtagtattcaatttaaactattgtggataaaatttggtagcaaaccaaacatacacttgctactattgaagttaccaaaattttggtacggtaataaattgatatcaaaacaaacaagcccttagcaccttacgtgttctatgtatgtgtcatagactcggtggctgttcagattgatgacattttcaactataccattttggtaaagttactaaaaaactatttatgtttagtttgttggcaaatttaataaatacataataaatcctaccaaaattttagcaatattaccctcttaccaattgccaaaatttggtaaggtttattttggttataatttggacaggccctcaattcctagccaacctctaacatatagtatatcaacaggggcggagttaggattatatcaagatcactagagtatgaatttcttgaacaaattttaatagaaaaattagtaaattccttggtattttttctgcctgatcgtaacagttattttccacattatgcaagcttgtgacgacacgagcagcgcatgcaatgcaacgcgggggcagtgcgtcgcggcgcggggggacgggtagctaaggtttaatttgctaccgatcagggcgcggcaaactgaagccgggaagcgaccgatcgagatcatgagcgatgcgtggagccgtgtggacgcatgcatatgcagttatgcaagcagagtacagacatggcaggagtactagctagtaggatatcacacgcccggtgtgctgctgcacaaaattaatactacgtgcatgctccagttgcaagttcctatcgtggatgtatggataaaaaggtcgtaaatagtcttgctacgtaatccctctgtcctaaaaaaaagacaaaccctgggttttcgtgtccaacgtttgaccctccgtcttatttaaaaaaaattaaaaagataagacatgcataaagtattaatcatgttttatcatctaacaacaatgaaaatactaattataaaaaaaattatataagacaaacagtcaaacgttggacacggaaacctagggtttattttttgggacggagagagtactccccaaaaaaaaacttagaagatgatgttactcctagtataatgactctggacaaatggatgcccagatttgttatattatgaggggttgtccagattcattatattagccattaggaggagacacattctctcctaggtttttttttatggatggagtatctctatatataacacggctgattttattcagttattgtcaataatattttttttgaat

SEQ ID NO: 58972 - DNA, 41290 bp, Oryza sativa
gtaactacaaagaaataaaatttcgcccatatgattatgtgttttcaaactaaatagttcgagatgtattgataatcaaagttttaaaactttcacggaataatgttgactgtcagagagagtattaattgtggagctcctagttaattgaacagtaaaaaatgtttttaagactgggaatattgttagataataataatctgaaacgtcataacaatgtccaaagatgtgaaagaaggttggtgatgacagtatataacacgtcgtgtagtagcctttaatttaccctctcttctcttggcagccgggcagtaataaatatgtactagtgacgctgacctgcactccttcacgcaaatacatatatatggacagtagactagctgttgcgtaccatcaataaagatatccatatcatatctagattgggtggcgttcatcgaagatgcctcttttagcaggtaggagtagggtacagcagagactgccaccaaggcaagtacggacacagtcctgctatattaaagacagtagtatatcagaggggggaaaaatacatgcttattatactagatcatcaattaatttaccagcgtatcctctcagcggccgtgatcagtacacacggtactgtatgtataacgaatcaaatgaaatcaatcggggccgggcatcgtacaaaaccggaacaagattatacattcaaatgctacaacagcgtatgatcaagccacgtggggaaaaaaatgtgtaacaattacacaagagatattagacctcttcacactttttttttaatactccatttgattgtttctcattaagccttgttctgctttgttttggcaatgctaagaagatctccaaacagcttgtcctcaggcttcgatggttgccccatggaagatgatgatgaaggtgttgtagagtagggcgagctgttcatccccatgtaagagctgtcttgcatggagaggccatacattttctgggagaggtcattcataccagcgtagtatgttggcctcccttggctgttgctgtagtattgtgccgcttgctgctgcacaagccggtactgggacatctgggggccatacattcgtggttgcggcatggctgcaaactgcatacccggcatcatcatcggttgcgcatacatcatgactggctgcgctcctggcatcggcgaaggttgcatcccggggaattgcattcctggcatggagtgtggtggcatcgaaccgaattggttcgcaaagcctgattgcatctgggttacagcaggttggctgggttgcatggctcccggttgttggttgttgtacatttggtgggcttgtggacctcccatctggttcatctgcgggtgcaagggctgcatcccacccatctggtttgatggtgttgggagagatggcatacctccaaattggccgtttgacaccgggtgagactgcataccgccatttgacatgtcgccgcttggcgctgactgagcttcccaaggaggtgggggaagggctccactttgctcatctacaaaattcaggagacccatcagaatttcttcaaagctcaaacagaacacaagcatggacatgcgtggttctgacatccaatgatagggatgatggtgtaggaaaaaggttgagaaatgtaaatgtataaataaattgcaataccataattcactgtttgctgcgctggaggcgtcgcattgttcgcaatttgaccattccacccagaacttgtggggtatgatgttccagggttcacagctcccccattaggatagaggcccacctgctgaggctgctgctgtgcttgcagaggatgctgggttggagcattgtatggctgtgatccaggaagagtagagctagaattaacaccaaagggatccgcaggtttggcaatgttattggttgtgttgttttgagagaatatgtcaacgatagctagtgcattttgacttggagtagaatcaactactggatcagtaactgggacaagcgctagtgaattttctgttgtagatgggttgtcatcccagctaagaagatcgacgccaagatcggattttggtgctggggttgctgagccatttgacaccggaggtgctggaagcgctagttgctcaaatggtgactgcacactggcactgttacaaaggcaggtcacatgcaaacagatgttattaaagaagccaggtaaaacatgataaataatcaaaaaaaaaaagttacgaatatagatcatcactatggtctagtgatactatgaaagccaagagaaacaaacaaatcaacactaaatgcagtttggatcataaaatttggctaggttcaagaaatgcacatttatctttattttagagagagaaggttctacctacgtgctttctctcaacaactatctttttagttctacaataccttacagagctgagagccacagtttgctctgtttgctaccaaaacaccctctaccataagttacagaaaacggatattcaacaaatttgtaaaagacagcactacgatttccaataccaccaattcaagtaaaataagaacagtcggattgtagatttagtgtagaaaacaaaaactgataccacaccaggtagcagttaagggccccaatcagtagtcacagtgattaccatgaggagtcagtagtcacaggccaaggctcctcatatgcaaacagtggctaccatgtataagatgtacatatgcaaataggctggcatatggacctaccctccaacatgtcctaataattttgatatactagtactgtgcagaaagggagccatgggtgtgattgttcagtggtttgggtcactagcatttgtagatgccattgggcttccatatagccactgaccttttatgattaaacaagagaaagtagtgagaagatgagaaaaatttagccccagggtataatttgatgataaaatggattgcaggggtgttgataaaaacaaaaaaaaagtactatctccgtttcaggttataaaactttctagcattgcgcacattcatatagatgttaatgaatctaggcacacatatatgtctagattcattaacatatatgaatgtgagcaatgctagaaagtcttataatatgtaacggaggaagtacttgtcaagggtataaatgcattgactatcagacttgtaggggtgttcataaacaaaaaatatatgtacatatgtggaggtaagcagcaatggtgatgactttttggattttaatcggtgtttatgatactggctttatcaggaacataaataggaaattttatacacatgacaacatgttgtctggaagtgcatatgttcacaagcctaaacagctacactacactgggcaaattgctgccaatagcagaaactgtattgatcaattacaatgtacaaacttgtttgttctttagaccaagtataattagcagtttagaagaatagaactctgcaatggaaaaggagaagcctgaaatacccacagaaacatggtggatggtacaattgtacatcaccaaaactgaagaactatattacagtgtttaagcacttgttaataaagaataatggctaattactaataaaaaaattgtttccagcatttatgcacaaaaatcgcacgcacatgggctgatatcattcaatattacctagaaataagaaatatgcaaatgtgacaggagaagattataacctttggcttggttctttattagtctcttgggttgtaggatcctcaatatctacaagtgcctgctctttcttagagtcttggttcatagaatcctcagtgtctacaagtgcctgcagagacttaggtttcttctccactcgaactgcaatgcctgcagcaattgcatcgtgttttgcgagaacacgttgcaagtcatcattcagtgcaagcccttgtgacataagttcctcatccctgtaaatggccaaaccagaattttagtatatatgttgcaataaatagttaaatgagataatacagatgccagccaagggctacttttgccagcttttcatgagtgaatattttatatttggatccaaatgctttataagatgataagataattcttatgatcagctcttcttgagcataacattatatctcacacaggaggaaatgttatagagattaattcacaaaaatgacaaagaccatcctttttaccatcctctactcagacacatgcccataatccagggttgtcaaggaagttcagtcagtcaacttcatccatatcttagaagtaaaaactatattcaccaaatattagatttactcacgcggtagcattaactagtagtaccactctctgcttgtaagtgcgacactgatcaacaagctccacaattacctcctgccttagtccctgtgtacagagtagtcagacaaacaaaatcagtaaacctaacacaaaaggaggttgttaagtaactaagtatggaacatataagtacagatttgaacctcgaattaaaattccatttagacttctgtttattcttccacaataaatggattttaaaatataatggagtactcctttattctaagatttttaaatatgggtgtccaaacccacatacgaatgttatcaaaagcatgaaaacaatggtataccatgttcatgcttcgataccttagttaccataccaaatagatttcataacaatatagggtacacggcaaccaggcaaatggtatttcaagtaatgctgcttggaatcaatgaacatttgatagactacaggctgacgtgtcatatactcaaatgtttatagaacataagcaagtaagggcaaaaacacgctccacagcatagtaagttttatgtggttagaacaagaccatttctcaaattaaaagatcaggagttatttctcaaaataaaacaagatggattgttttctttaacaggtatttgtgacactaacatttagatgtgctttttttttgtgcagcttgagtttaaaagcaaggtaagtgttatcggtacctctctgtttccagggtctaaagcatttagcatctcggctagcacatccattataccacgagcattctgaatctctgacatgctgaaaatataagcatacattcagttttacttcaaatgacagaaaaagaatataaggttagagaaacagcaggcaaagcaaggtgaagtagatgagttattcaaaggttctcactggagacggaaaaaaaaaaaactttactccaaaggaattagtgacttggtggttgtgatgaagttcttcatctatcccccttctttcaaggattcttttgtggatgggtttacacaaacattttcaaattatttgtaatatcttctataaaggattacatcctctgcacagcacatgtgcgtataaggtgtcaattgatgtgatgtgaattctgtatgcaattcttttagggcgtatttatttgttttaagtttagaatttatagtatatttatttgagatccattgaaattcacaggtagttaggtactacgctagtattgtcatagcactttacacacaactttgctaaacagatcagcaggaggtaccgactagtgaatagtgatcttctaatagttatagttttccacatgttcatgtgataatctcaaaccagtaaagagaacatataggaaaagatattatcaaatcagaaaatgaaaagtatgaaagcacacctcaaagcaggaaaatcatttccagcagacgattcagcttcatcctgctgatcaggactacgcatatttctgcctgctggagactggccattaaacaatggtgcaggtcgatcagatctctttggaaatgcagctccagcacgctgcaatagtgaaataggaggatagctatgtcaaacagcaaggtgaattcccccttaattctaacaaatatagatagatcagtaaccaattaatcacatgatcaaacaatgcaacgacttctgaatatggaaaattcagtgtgggaaaaaacttcagagcttgataaaccaatctgggattcaaaaccataccaccaagtcatggtacgctgcatagtactgtggatatcttgcacgtggtcccccgaatgcttcttgccatgtatctatcatagttaataccttctctttgacattctgatcagactgtaataggacaagaacatatgccatcatattcaggacattaaaacaaaacagcttgagatcaaaactatggagcatatcaaacctttttcttcactatcttcaccatctcatgcaacacatctctttctgcaacatgcatgtggaatatatccccacagttcttgattgcagtttccaagagctgaaacagagctcccccaaaaaaaatcaggatattattcattttagatcctgtgcaagttgtcctaaacaagatacatctccaaaataataatgaagcataagtaaaataagttgtatcctcatcaaatctccctcccaccttcgtggactggacaaggaattaatacacacatgtttattatgaaatgatgttcctttgtgctaatgatgcttcaggttgcatggttgcaactgatcattacattaacacatgttcatgaaatattggacaataatattaatacagactggaacagtagtgcttagtgaacaaaataaacacacaaatatagctgagcaatagacatatatgcttgatgttaaaacacacagagaagagattcttcccattgcttgtaccattagcaccactcttaaaaaggatgtaaagttatgataaactcacagtcagcgcaagaatttggacttttggatttttgtgcccaatccttttcttgagtgccttaacaacatcttttgattgcctgtacatgacaaatgtttgctcatcaataattgacgaaccaaaacgaaagaaattatttacaatacaataaatattcatcttcagagtcaacctcaaccatttggtttccaatcacaataaccgaccatgaatcaaggcaaactataaaacctctagacaggaacagaatcattgcctcatcaaaaccagcagacacattaaacagcccaactgcatcaaacttttggtggcctccaccactaacttagttgtaagttgtaacaactaatgactaccgttagtagctgtatgctaagtattcaactaataaagatcatacgttgcagcagcagtacagaaatactagtttaaaagcatgcaggtgaatcatgaagcagcactcaagtagctgccttacgataaggaattaaaggtactctaatatgcaattaatgcttcacagtttatcctaaagctgtgcttgttaggttttaaggttaataaatggggtagccgtttaaacaaccaaataatcttggagacacttaactaaccccctgagttctattttctctccagctaacctcctcctcctctatctaatcactaattttgattaatgttgttagctgccaagcacaaaaattgggctaaactaatcttagtaggattaatgtaagctaacctaatttttacagcagctgacaaactgcatcccgagtcaaatgggctagttgtcatttgtttgaagaaaacagtcaagttgcagtggcgagcaaacattcatcatttctatttttcaaccttctcacaataatatctactaccttgctatattgtgggatggagggagtacgaaccatcctaggttgctatattatctgcagtttctttttttttctctctctactagtatgtgtgtcactaggaacacctcgtaagttatgaaactcacaggttactgaaaattgtttatgaaagcaatattattccatatggtagctcgtattttctcctcggttacggttggttccactagcaatttgccagtgaatccatgaataccaccacgctcttgcgatctaactgcagcgtatcatcttgtcacctcaccaaataagccaattgaacggcaaagcaagcaccaatccccagcaattctatctagccatttccaaaacttcctcctcacaatcaaagacctcatggcgaaccaggatgcgagcggagccagatccaccgccaccgcaaatcctgatctcctcctcccatctagcactagcattcattcacccaccaccccccaatcgcattctaattttcagaatagaaggatccaattcccgcgccgctgtgccccatcatcccaacgagaaaccacaccaccaccaccaccaccaccgctcgccgcggatcaagatcaggcagcccgccaccgccacgggatcaagaggagcacacgtacccggggtcgcggttgcagatgtcgcagatctccatgttcttggcccagtcgggcccgatgagcatgtcgctggtcgcccggtccaccatggagcccgccatgcttcccctcctcccaccggccgccgccgctgcccacgctccggcggcgcggaggaaggtggtgcggccaaccacccacccaccctagctccggccagccgccccccctcctggccggattcgggtcgccggcgagcgagcgagcgagcggattggcctccacctccagatgcgatgcccccccacccgccttgtctaacgatttcctcctattttcttttcttggaaatttctccccgccaaattagctctcccaaaaaaaataaaaatgaataaataaatcattttttttattttttttaggaaagttaacgagttcgtttggtaggtggcggcttgtcggatggatctgagctgtcccccacatcataactgtcacttttccctcaacgtgggcctccactaccaggcccattttggcccatactctacgtgggccgaaacactgaggcccattaaaaacgaaaacctggagcggggaggcgtcttcgtcttcctccctccgcacgcgccgccggaagcgcgaaaccctagcaatggcggcggcggcggcggagggtggcggcggcggaggtggggcggtgtacgacccgagctacgtgccggactcggtgaagacgttcgtggcgcacatgtacaggcacgtcagggacaagaacgtgtacgagatccaccagatgtacgagggcgggttccagcggctctccgaccgcctcttccgcgacgcgccgtggccggcggcggaggccgtctcgccctactgcgacggcgaccacgtcttcctcctcctctaccgggagctctggtaccgccacgcctacgcgcgggcctcctcgtcgtcgtcgtcgtccgcgccgctcaccgccggccagcgcgccgagtcgtgggcgaactactgcgacctcttcagcgtcgtcctccacggcgtcgtcaacatgcagctccccaaccagtggctctgggacatggtcgacgagttcgtctaccagttccagagcttctgccagtaccgcgccaagctcaagaacaagtccgacgacgagctccaccagctcaagcagttcgacaaggtgacacacccagctcaccaccaatgcttcttgattatgcattattactactattctttcttagctgcagcctaatctaatatgtaattcagtttctttcttatctgcggcgcataatataatcggcaatccggtttgctgaattgttcttagctgtggggtacaatctaatatgattttctgatttgttcttatccgtggtgtacaatctaatgtggtttgctgaattgctgcaggcgtggaatgtgtacggggttctcaattacctgcaagcgctggtggagaagtccatgatcgcgcagattctggagagggagaaggaagggctcgagcagttcactgccaccgacggctacgactaccagggtggcagcaatgtgctcaagatgctcggttattacagcatgattgggctgctcaggatacactgcctccttggggattaccgcactggcctcaagtgcttggcaccaatcgaccttaaccagcagggggtctacaccattgtgattgggagtcacatctctgctatctaccactatggctttgcaaatcttatgatgcgcaggtactaaagttcattgactgccttggaatcaatggatacttcaatctacagtgccatgttagacgcagagttttttgctcttctatgttcaaattgtacttaaatcacatgaaatgcgtcctaggatataaacattatttccagtaaaattagattgagtcatgttgtacagccacacctaggatataagcattcttttcagtaaaaccccattttatgaatttattttttaattcactttcttgaaattgcccaagatggttgttttagctaatgctatattcttctggtagatatgctgaagccatacgtgaattcaacaaaatcttgctgtacattctgaaatataagcagtaccatcagaagtccccgcagtatgaccagatcttgaagaaaaatgaacagatgtatgccttcttggcagtttgcctttccttatgcccgcagcacaacctcattgatgagaatgttagcacccagctgaaagaaaagtataatgacaaaatgacaaagatgcagaggtttgatgaggaaacctatgctgcgtatgatgaactgttttcatacgcatgccccaagtttattactccatcacctccagccctggatcagccacttacaaattataaccaggtaatgcttttggtgttaaataataatgtatttttctgattcatagatacgtcctatctagttgttactgcagtcaatctagaaatttgtctcctggtgtttggttcacgactgcagctactggatgttgtcactccttgagcccttttgccttctcttcatggactttattgtgtttgccaaagttctgacagctaatttactctttcccaaaaacaaattaataaaatcaaatagccctttagttacttttccttgtttcagactattgcacattcaattttagggtgaaattgttcttccctgttaaacaaagtaaattctcctgcagtaaaacattccggtggtttaaattccatttaaagctcctaaaggggtcataagaaataggcatgttatcttgtcacatggaaatgatagaatgtaggctaaatttacacgtttgttgattacacaaaatggtgtgtttctgattattgtggatgtctaattctataggatttgactttcttgtttactacattttgtttattgttttactattttgtaacaggatgcataccgccttcaattgaagttgttcctttatgaagtgaagcaacaacagttgctttcagggatcagaagctatctaaaattgtattcaacaataactattgccaaacttgcgcaatatatggaagtggatgaggcaacgcttaggtctgtatgataattaacttttcttggtaatatttcaaagggccatgaagaacttaagtcaatatttgtacaggtctatcctgatgacgtacaagcacaaaatgcatgcagttgacaataatggaaagattgtttccagcgcagactttgatttctacattaaggaggtaatgtgccataataatacccttctctgaggcccagaatatttttgtaaccatttcttgtgttgatatacaattcctcttttcagctgtcttgataccttccagctagtaaatagaactgcatagctgtaaaacttctttaacgttgcaaattctccaatttcaagttgatatttagttcttgaatatttgggtttggcttttatgtgtgatcctctaatccttttgcttactcagaggtagctgtagttaaggcactattggcatatgccattatgcatctagtttgacactataattaactgccaataatctatgtgcaaccatgcaggatgttattcatgtcatggagtccaaaccaatcaagcgccatggtgattactttttgagacagattttaaaggtatccataccaccgcttggcataaccttgctgtgaaccactactaccatttgcatttcactatttcttctgaaaataatgtgtatgttgctataccttcaaatctttactattatcctgcagtttgaggaaatgattggtgaactggagaaagtacagtttgactgagcctggtaggaatcatggaggagcggggtacatccccacttagtttagctgttgcaagaggcactcatgatagttattgtgtacttattaatatatgtgccttttgtactcctttttgacttcagagatgaaccggtaaattctttttgaaaattgtaggaacttcagagtctgaagtttgaattctcactactgtgccatcatggcgttttctgtgatgattctatacagtagttgagctattatctcttctagctgttcgatatagtccttgtgatccaattgctcgtgaaattgggtaaatggtaagaaaatattttgcgacattacttctgtttttttaacgtgacccgataaggggaaaaaaacgctaaggcatctttggagcacgggggattagttcaattcttataaaaatcatccaaacatccttcaaattccaaaggaagcataaggtcgctgcagctggctgcgttacaatgttgtctgtcttgaagatgctctgcacagatctgttccagcatacgaaccccaaaattaacgtcaaagaaccttgctcacatccacattcaggtaggggtgaaaacggtacggaaaccatctttatcgttttcgttttcatatttttttttcggaatcgaaatcggtaactccggatacgaaaacggaatcgaatattatcgaaaccgaaaatggagcgaaaacgaaccggcacaaatacggtaacgaaaatttatcggataaaaaaaccctcaaactgataaattcaattctcaagtctcaacggtcaacgattcatcatgaaacacaatcatataagtccaattgttaagtattaacaatacatcacaaaacacaatctatgtaataaattatctatgttttagagagtaacgcagttgataaatctgaatgcaggaaaaaaatattcttatgtaattttatatttgcataaaaaatattttttaaaaaaaaaataacaggaaaacaccatggtattcactattaagtgcttaaaaaaataaacctagagtatttaagttacaaaatttctagaaattctgaaaaaaaatccgaattccaagaaaatttccagaaagtttccgaccgattccgagttccgacggaaactgccctttatcattttcgattccgtttctgagaaaatatttccgaattcgtttctgtttctgaaaaatttcgaaaaaattccgactaacagattccgtttttgaaaataggtccggaatccggaaagttttcagccctacattcaggccatggcaccacattttactgggaccatgactggctggctacatgctttcagctatggcacagtccaaacctccaaagttgaagacttgaagtttagcaccataccatgctgaaatctagctattacactccacaaaagcataattatcgacctggcttttcgcaaacggtggactcgaaatttcaactactgcttatctacccgacttttctggtgaaaagcctggagaaatcttcaccttcaccatgcataaatgcggattatgaatatgtgacacattaaacaggaatgaattaaaattaaatataacagtttgaacagcccatggatcctgttgccttttggaagctatggtttagcttcaacattttatagctgaaaatgaaaatctaggtgtaggatttgagtataacaggcataaacttgaagaatttctaatagccaggtaaacttataccattatcagatattctagtactaccagaagtgtgatcatagagcggaataatgtagcttctgggctgaaattgtaaggtcgagagcaagtcacaagaagcatctttttttacggtaatgaacaagatcgttcgcataatgattgttacagcaagtctgaggtgtattcctcacatggtatatcaagctatctaaaacttttcagaagatgggacgaaggaataggtgagctcagatatcttcccagattgctgccagcatttttgtctgatgatctttcaggtgtggtacactcgaaatccaggactctaccctctgcctgaaaaatatggataaaaattacgatcaatagtgataatacaaccaaacaatgacattactgaggatgttaatttatgctcaaaagtgaccaattacagaaaaaaaaaacaactgctatccttttatttccttttctatttttcaacaaattgctaccattttggcactcacaaaccaagattttgcaagagctacaagctaagaatattaacgcaaaggcagttcactgccgcgtaccatgatttttgtttgcaatttggttgtccctggttccttcttggcatctggattccccgtgttttccttatcagagcttatgttgtcacattggccgccgcttgccagtacctcacgggcttccaccaaagcagcagcagtctgcacatttatctgcttcatcaatcctagtgcgtcgtaactatcagctgggctggtgaagtatgaaccctgggaggaacgtatggacagaagttaaccaaagaaaataacagtaaacaaagtaccaaatgcgtgacagcatgaaggattaatgaaaaactattatcaggcacaacccagtagtccaatatatttccatccacttaacttaacccagtagtccatgctttttccaaacactggatttctatatgacacaatatgaacatgagaaataaaattaaaaaaagaggtaaatgtacctgaaaatgcatatcgacgaaccaaggggacttccatgctgaaggagattctagtcctcttttgatacctggggtatcagccaatctaacaagagcaacagtttagaatttcagaacgacaaattaactgaaggaacaaggatcataaaacaatctcttcagacttcagtagtgggtttaattccctgatgtattatcctaaatgtatcatcctaaatgcattagggaattaaacccacatttcagatgaaataacgtgccaattacagtaagatggtggctaaaaggcttatgataattcatttgatacaaaaatatttttcagtttctgtctaaagatggaagctcttgaagggatattctgattgcatagacaaggatgagcatcaacttcataaatcttgtactggtttaagtatctaagtagatatcaggaaagtgaaatatgccacaccactgaactaagttcaacatgaaaaccctgcaagacccagtttaagtttaggtttagcagacttcacaacagtggcgtagctagctaggtggcactgtggtccacctacaaatttgatcaagattaaaactatagtatatgtactggttaatataataaaaattgtatagtggaccacccttttaattgacctagtacatatagatggaccacctactttaaatcctagctacgccactgcttcacaactattcagaagcatgcaggagtatgggttcaatgcattgatgcttgctaatatcaagaaaaggaggaactcatcattcactagagatcagtttccaaaaaaaactttgattttcacataatctgagaagataaccaaacaaaagaatctgatggaaaacaacaaaggaacatgtgagtggtgtgaagtcttacatgttcacatattcataatccacatttatacatggtgaagatttctccacgatgagttcagtgggctttgatttagcacacactccctccttacagactgataaagatttcacatttgtgttcagcttctgattcatggtatttttgccataatctggggaaatgggatcatcgccgctgtgttcaataagaatacctgcaggttgctgcatcaaacaacaatatagataagaacaagatcatcagcaaaactcatttgctattttgcccgggtctgcccagcccccatatttcatactactaacatggttaaaaagcacttgctacactcagtcattcagggcattaacttggtccacctcctcaaagaaataaggtactactgacaagctaaatatcatcagaaactggaagtacttactaaattgcctgacaggtcatcattagtagctacatttgttgcagaactgcgttcccctgttgtctgctcgtccatgtgttcgtcatttccagcactctgtccatcttttgtctgttcagttgtgtagcccaaattttccttgttttcatcagagaaaacaagtttcttttccagagatttagaagaagcagatcgctcaatacgcaaaactgtagttataagtgcatcatctttagtggcattgatacaacttgtttgaatgccggtggaggatgtgtctgataccccacgatccttttcagtcccatatttcttctcgattcttttatctggaataggagacaagagatctctgtgacgtttcttcagtattgatggcgtgcatatgaagcttttggcagcactcttcagcaaaacgcccgtgctttcatcatgagtaggggagccccacaatctcattggcgtgcagacattcatggttgaatgcattaactgccgaatgccaaggggactaaactcttggagatcaccagaggttacaagatcgcaactgacaaatggaacatccaggcttggaaaacgaggaggttcgtagaagagggctcccttgtcctgttcatctggtgcagtcacactctgtgtaagcgatggttctttctctagactggcttcaggttcttccgcattagtaacctgttggtccccacattcaggtatgctttccatcgttgaagaaggaacatgtctgtcattgctacaaccagggttagcaaacatttcagcatcaccagaagaactggaagattgggtaaccacttctgcctgagaaagtggcatttccttccgccctggtctattatcgaaaggtgcatcatcagtcatagcatttgaacaaataagagatggaggtactgacatctgtggactctggtcatcagcaagccccatcacacttgaagaatttgatgtctgtggcatgtagggtggtgctaaaaaatgggtatctgcttcagaggaatatacatccgattggtgatttgatcttgaaattgaatcagcttcaactgcatcaggtccagaaagaaggccctgtaaggaaatatcctgccagagttcagatttcagacagttaggactgttgaagtcagcctcagacatgaaatgtagtttttgctcagctccagaatcacttgataacatagagagaggcacctccattgctacatcatatggctccagagatctttcatgattttctatactacaaacagtctggttgtctgcaaaactaggaacagttggcatttcatctatagtcatgtccaaattcagtccttgagcaaagtcctcttgcaagtgttgatctggatccaagttagaggaagaaacatggcaatgcacagcaggcaaagcagatgcaacagcctccgcagaagtatagcatgcttggggacccatggaagattgagaatcatgtgcttcattcttgtcaaaattcgcgtttacttgcaaatcacagcccaatggcacagtagtatcatgcacttgggagcaagaaaccttggcaagtgatgattgactacaccctgatgaattttcaacctctcggacagcaaaacaaccactatcttcactgttttgttgggtcatcgctggtgaggaattacaatttgcagaatattcatttagagggagacacgaaacttgggtaagtaaacctgatgacatgtatgaattgactttcttctttactgaactgttccagtgatttttaattgaattgtccgtcctgataggggaaacagaattttaaaaattcaatgacttcaatagtctaaaagaggtttttttaaaaaaattaacaagaagaattaattgcacaaaagtactagatcattgtgcattactccctccgtcccaaaaaaagtgaatctaggactggatgtgacacattctagtacaatgaatctggacaaatgtatgttcatattcattgtattaggatatgtcacatccggtactaggtttttttatgggacggagggagtaggtcataaacagctagagaaggcaagaatgctaaacttgaatagatgtgtcaaaatggccgtaaaacaaaaattttgcatgcatcatttcatggaaaagaacatagattaatttcaagcagctcttaggtaaggaagaaacattaccttcctggtaaaaattttgtcagctcggcccatttatttccatacattcgatgagcatgtatgagggtaatttcctcttcttgtgtccatgcctccttgtttatgccagggttaagatggttgtaccacctaaatgcagattagatgatacatctgtaaggcatccaatacattgtaatgatactcaaattaaaaataatgctaccatgcatattaagaaacaaagttaggatagtttacaaaatactgcattgttaaaataaattgtacagcatatatggattgtttaaatccaccacatggtttggcagccttcattgtacaacatatatggtctatggaagaactatgtcaaaagaaaacctgcattcatctgcagaacaaaggactagaagaaagcagtagttgctagcacaaagaagctaccctgttgagacccacaaaatatattgttctatctttttttttacttggtgcaagctaaatggaataagtaattttcatggcattaccgttctcgacattgctttcctatacgtccaggcaaagcttgagcaatggttgaccatttctttggtccaagtttgtttaccatctgaacaatgatttcatcttcctgaaaaaaggagcatgccattgtgagcgtaagatgagtaaccaatacagtattatttaagagatgaaaataaatcaaatagcatgcttacttctttggaccatggccctttgactaattcagggtttagaaccttttgccacctgtgcaagcattgtacatcggttctatccggaaagcattccgctggaaaattagaatgttctctgtcaaaacttggatttttaacaatatactggaaatctcatcaacagggtaagcatgtctagggtgtgagttaatgaaacagcagaatgctttcctgtacatgagttagcataacatcgaaaataaaatataaaatatgctgattggtttatgatatcctagtgcactaaagtacaaatataaacaatggttagaaaaaggaagccttgagaacaatatggtaaaaatgcattagatgttatgtataatattgtgaaatataaatattattcctgttagaacctgacatgaattgccatacaacagtatgtaatcataaaccaaatgcgcaaaaaaaaaataaaagaaaaaatccaagggagtctaacatatgcgtgataagctataaaatgcagtgttatgtagataccaaatggattttagaaggctattttattttgtttatatattccaacataaaaaaaaacaaccataaagaattcaagaaaaagaaaagtatgtcagctaaaagatacaatacaaatacaatgataaagagtaaggactaaggaaatagccaaagaatcattgcatgattttccatatcattgcagcaatcgaaagagcatacctatttttttccagttcttcccgttgtatgtctgaacagctctggacaatatggcatcctacatttgaatatcacatatgtgcaatgttaaaccatgtaagcaagaaaatttatgtataagacacatggaaattttaaatgttgcatgagaggctgataagatgggtccaggctcacatatcagtgaggcattaaaaggcatatacaaaatagaaccaaaatgctgctggttacaatttacaaagcatagaatcagaatataattgcacacatgagtatatgacaaaaacagaatagcaggaaaccccaaggtagaagagtgaagtttatgatttgcctcagagtacatgcaatccactcgttgacctaaagttgcccatggctcccttggattttagcaattagtaaattatcatattcaacttggtttgtaggaataaagcgccaaattaagcaactcaagcctccacacaagagtcgggatttaaattgaaatgttttttcatattaaaaaattataggtctttgccattaaacacattagatgtctacagtcaatcattctcaacaatacataaaataggattttcagtcaccatttaataattcgtacaggaaaaggactctttgtcaacagaaacacaagatgacattcatgtggtatacctcttcaggggtccaatttcctttggtggaacgccgtgtcggaccggtggtcctcctaaatttgcatggacaaagaaacaaaacaaaatttagtacaatatacattacgatagtcaaaagagcttttagccttttacccattgagaggtcgtcgcctttttggttcattgctgatttctccttcttgaggagccgacggaggtccagaaggctctccatccttatctggagcctttccgttatcgcttgtcatcatgagtgaagacaatcaatcctcactttgcagtagaaacctccaagggatataaaaatcattatactgtcaagcctcagtgaggccttcagggagttgctccaagggagaagcaatcataagctgcaaaagaattggacgaatgaagatattgtcacaagatgtaacaatagaagcattcagggatgcatagaggacaggacattgactaccctcataagaacatgaattctcatttcaaaggagttggggtagaattcatgtcattttcgttttattatagagatggattgtataatattttatctaaaaaaagagttggggtgataatgtgtctacaccccctcgttgtacatctttatgaaaactaaaaaatgcatcattcaccctgatgtatatgtagatggttgattgatatgcagtcaagtggataacttgcaaatggggaaaaactcctctttgcttccgtaaactattctgcaaatctacttattagctcattctaccctccgaagtccgaactactgaagtagctaatttcacatttagggggagtaaaccttaagctttctgcaatatataaaatagttttagggtagtaaaatgttttttctccttttagatttgaggattgtattttctgcaaaatgtgaattatctcctggtttatccataatctaaaaatatggacctcctctgtctgggtttcaggtttatttggtgctaaaagcgtctgactttcgctgtggaatttaccagacaaaaaatatataacacagatcttagtgatacgaattatctgggctcgtaagtcggtttatatcgtatagcatagcacctcctccatattcaaactcaaatcagcacaacacttcaacccaatcaccaacgaagcaacatcccaaagcaacaattaatcaagcagagagatggagagatatataccagatcaccaatcgccttgctgacgggcgagcctggacgcgagacgcctctgccgtgccgccgcctcgtccgccgggagcgcgtcccttccgcggcttctgctgctgccgctgcctgcctggatctgggtggcccgaaatccttaccagacgccctcaactcaaccaccgcggcggctgctgctgcggacgccgcccggcccgagcgatgacggcgcgatttgcggaggtgggagaacggagggaggcgcctgcggggaggtcgatggaagaaggcggcggcggcgcgcataggaggaggggggcttcgccggcggcggccgcgacgcgcatcggcggcgcgcggcggaatttcggaagagaggggaagatgagaagaggagtggatggctatttggcgatttttccagggtggtttctgcaaaaaggacggggacgcgagggggcgcgggggtgtgaaatggacggcggggagatggcccgcgtgggatccgcgcgatctgggccgtccgtttccacgtcggccgcctttgtgtcccgcttcggcaatttttgaatgccaacggctggattgcggctagtcgttggttgttgttttgttaccttttttttctttcccttttgtttcgatggtttttaatttgggaatggggtaaaacaaaattcgttttgaaaggatggggaaagcatttgttttgtgtgtgatgcaactggaacagaataattgtttgcgtgtgtggtgaaaatgtagaaacaattgagatttggttttcactgtttcttacgtttgaagaaaatttgaaattattggtggcaataaatgttccatacacgttgttatcatgttatggccaacaatagtcacatttcacccatggtatttttctctttcccgtgaataaatatttcatttgcaattacttcttgtgaaagtacatataaattatttcaaattctctagctagtattgctatttattggcatacactcataggatacaaacaggaattcgtaaaataaaagtaattcatagttatatttttcatgttgcaaggctttatactaccgggttaaactcaaaaccacattttgtagctaaaaaagctaataaattcgacgtgacctaggaaagcccaaggctcgagcctgagttttaagtcattgtcgagctcggctcattttatttggctttgatttgttgtagcctaatctgaccagggtttggagatctcactataccacaatacacatatcagggttatggataccacatacctaatagtagttgactaaatcttggcaagacccaccacataccatgtcctatacggaaacaacctgcggatataggggagttccggataaggaaagacaaccagagttctacatgaaaacgacaaggactactcggattgtatccatattggttccctagttctacttggacaaggggacacctatgggtataaatacaagtccccctaggaggagagggacagaatccacacacccaacacaatggacatggaagccacaacatagaagcctacatacgccaagacacgccgccggatatcgacttcagggataagcacggctagtaccctacggtgtctccggatactgtcaggagagacgaaagcgctatctctgatctcgccgggcacggattcgaggaggaaggctatcctgttgtcgactacgagtcagatcgtcagaccgtcatgtcgacaacagttagataggctaccccaaatattgtactggtgtgattatcatgaataagagcaataccggcttcggccaacaggatgtagggttattacctgacaattcaggggcccgaacctgtataaaaatcctcgtctccatctcttttacctcagtctcgcgtataccctagtaccaacgatccctatgccatgcaaataccgtaatcgagacatcaaacgtcgacaacacatgttccataagataagcggcttcatcttttcgcttatatttatgcttatcagccaaaatttgaattttcaaccttatttttgagctgattttgggttttctcattgaagtttacttttcagccattgtttttaaatcgctaaaaatacgtatataaaaattttattcaaaaattacttttcgtttgcaaatatattatttggcttatttcatgaataagtgaaacaatagggccggaaatcttccaagttggacatatccttgtttacacagcgggatagtcattgtctcattgagcaatgagcatatgatgcctattattagcatcctctttagcgacaccagtgattgcgtcaagtttaccgtgacttcacttataaaggttaaaatcatgatgctcataattaaataatcatgtccatctataattggtgcataacctaaaagttatttccactgtataacaattgtgcttcagtgcacctggtagtcgaccacaacatcacactcgttcccttaggcgtggcctgtcgttttgatcaagcagtactaaacctaattttattcaaggttgagatatatttaagcacgtggtcttccacaggcattaccgcttttgggaatttgctggaacctaattttattaatgttgggatatattcaagcatgtggtcttccacaggcattgccacttttggggtttgctcggagcgtagtgtagctccgcctcggcgcctcctccctctcgttgtttggagtaaccattttttcgcaatagttttcccttcttttactttttggttttttttctttcttcctcctggtataggcttgtctggcagattatgttgtataaaaaaactcttttacttctaatatattgacgtgcaatctttttgcgcgttcgaaaaaaaatatattcaagcctacatgtaaaacgaaatggttcattagcacattattaattgagaattagctataaaaactttaaaatgtattgatataaatttataaagcaacttttctatagaattattttttaaaaaaaattatcgtctagtagtttagaaagtgtgtccttaaaaaacaagtgtgtagaagttgaaaaatggtagtgtcgaacacaactttaatcatccgtctagcccattataatttactacaacatatagacacatgctacttttttttagaatattttttttcaagaattatagacatgctacttagtatatattcgtgctcggacacaacttggcaatggtaattgccgcacagcctcatattttttgtttatgcctaattgcatatacttattagctaaaattgaaattttcaaccttaaatttagagttgattttaggattttgtttttcaacgtagtttattttttagcctttatttttatatcatttaaaaacatatatatatataagctttatttataaattattttttatatactgtttcgctttttttttcttcaatatgccaaacgaaaaggatgctagactcgtggaggtgggttgtccgatctgggctcatgctcatccaagtcaacaaactcaaatatataaatatgcgaacgggcacgtttaagatttgccttgtcccaggatctcactggaaaccatttacactggtgtacctctgctcctcctcctctcccataataaggccatacccataatcaatactaccagtacggcagcactactccaccactaccgcaccaccattacacccaagaaattaatcccacaactcaaggccggatttagttatcaattttttctttaaacttttaatttttccatcacatcaaaacttttctatacacaaactttcaacttttctatcatatcattctaattttaacgtgaagtaaacacacttcgaatgtacaaaactccaagcacggcaccactactactactcagcgcaccgtgtcgcagcctgcgcgcatgtgctcccccctgcaaccgcacgtctgcgccgcgccgcacgccgcgcgtccgtccaccgcgtccgtccgcgcggcgcggcctccgtcctcctccgtcgcctgctgctgcaccgacgcacgacatgcggccaccgcccggaagctacctaccgctaggagcatgtgtaggcagaacctactccgctccaaaaataaatcaatctcctacgcgatctagatgtaacacatactaatactataaatctgagcatacgtatgttcatatttatagtactggaatgtgttatatctcgtaagagattgatttattttgagacgaagggagcgacttcatctcttttaaagctagaactcaaccaaacaatattagcttcaccttaaaaaaagaaagctaaaactcaaccaaataattttagcttcacctaagaaaatagaatagcgtaaatgctatcacaaaataaactaacgaggttgagttgagtttatactattttataatttcattgcagacctagtttttaagttaaatttaggaattgaaacgctgttaaacgggctagctctagtactagcaaatcctcgtagcagtatgtaacacatgcgctgtggcagtgtgacactgacacgatcacacggcaagggccaattttgaagaaagaaaagttggaatctaaacagacccttgcgattggttagttggggaattggagatctctccggtcaggggtgatgacagagctccgatccggactcggtgttgccggcacatgcgccatggcccatggggcctcttgcctgatcaccctctccccacagctgaaggactacgaggacacattctcactgaccggcaagattcaaaacttcagagagttgttgtattattcagatggtctgaactctgaagaaaaacgtggttcacgatggttgggcaccgccgctaatgatgtgtctctgtctgatttttcccctgctgctacgacaaactctcctctgatcatgctctggtccctagcaaaccttgttaggttgggattggtggccccttggatctcaaagtagtcccaaaatctgaagataagggatcttttcaatggaaggattttcttgggaattttacagaatttaaatcctataagaaaaaaaaattcctataaatacctttgaaacaagaaatgagagtctcatcggttcccatattccctaataagccaaaatggcttatcagagaataaaaattaatttatatttaaaacatttatatatttgttcgcatcgacttaaaagccaacgctaagatatcttaaattcaacttcaaaattaagttcaaacatttaaattttgacttttgctttaccttattaggccaatcaataggctctgagatgcgtaaattcctatgaattggcctcctactacctcctaatgtcctataccgtcaggaaaataaatataagctctaacatcatgtttttattctcctttgagaagtccaatgcattctttctccatctctctaccacatgtaaattcatttttacttcccgtgaaccatccaaagacggtgaaaaatatactatttctgtattttaggatcgtatgtgattctatataatactttttctctattcctacgtattttataatcatgtttttttaaaaaaataagccctaattcagtaacttgtgtaggactagtaatgtactacctactcggtagtattttgttctgctccctattgtaaaaacaatacttcacccccgggatcattattgttattgtcctgctacccgcatctacaattaaagattgtgtggtcactttatctgcccatgagcacggatgcttactcttaaaagtgtcatgataaattgcagcaccaggaaaccttggacaagaaaaccgggtaaaattaaatgcttactacgtcaaatctaaatactacctccgtcctaaaataagtgcagccgtggatatctgtgcccaacgtttgaccgtccgtcttatttaaaaaatttgtgaaaaatttaaagatatttagtcacacatagagtactattcatgttttatcatctaatagcaataaaaatttttcaaataaggcaaacggtcaaacattgaacatgaatagtgtaaaactgtatttattttggaacggagtgagtatcagacaaccaacttactcctacccaacggtccaagagaaatcctgagaaacaggcaacatgcaacatcctctccttttgctgtaacctgtactaccggactgttccttttagattattcactggtttattaaaacaacatactgttagtatttgctccacgctaaaaaaatattttttggggtaaaatacttcttatactatattattttaaacgcttattctaagtatttttaaagcttatttcttaaatatttaatttattcttataataatcaagcagataattcatgataataatgttcccttgataataattaaacaccttaggtggtatttgtttatactgtagaagataaagttaaagaaaaaagaaaagccagtagcatataattaattgagttttattttattgtaaatttgatttaatagtttaaaacaacttgtatatactccctctgtcccataacgtagcaacttaagatgagatgagacccattcgagacatgtccagatttgtagtcaacccatcctaggttactatattatgagacagagggagtagaaagcttttcatataaaatacaccgtttaacagtttaataagcattcaaacaaaaaaacgagataggatatgtatctcagcccaaaaagaacagaataaatcaaactgggcataaggttcagatttaagggggaaaaaaagcttcagaaatgggacctgcctgagtatgacacagtggccctactgcacagacacacataccctccctgaccctgagtgtgagtgacatcatcaaccatcatcagagaagagaagaagagagggcatggtcaaagtaaacgagcccaccaccggtggcaacctgtcccctaactccctttgctcatcaaaagacagagcttgagctctctcctcatggccaccaccactagcactgtgccgtggtagtggcagcagtaggaggtcactgcactagcccacatgccgctgcagtagctagtcgtcgtagcagcagcagtatactactagtagtagccttcttggccttcttcttcttcttcttgcacagatcttgggggcgcaatcagccagttgcaggcttgcagcagacgaacctcggagagagaggcctgcgttcttgcgaaagaggagctagaggtgggtgccatttattcccgtcttcgttcttggcttttgtttttggttgtaaactgacaatttgggggttggggattgagttgataatcggagatagtcatatagatggtttctgaaaaaaagcttctgtgagttcatttgcttggccactctggtttttttgattgtttacttgggggaggtaacaacaagaagaatgcaggggacttcttgtttattggtcatcttgtttagctagttaatttgggggttttttttttggcgctctacagtaaaatttggaggattccatgtctttggggagataaaataaactgtccagtgttgatacatgattcattacactgttgtaataggcagtctgggatttttggtttaggatttgcatgtttgattttacagtatgggagtcatgtacagagttaatgagagcgaatgacctctaactacaaactactaccttccagcttccatcaccttgattcactttccccctttcccttttcacctttctataagagaaaagtgtagtgtactgcttgtgagctatcagttctttattcttgacatgatccatatgaaattcgagcactggtgaatcgagagaagaggccaggtaggtagctggtcaatgcatggatattccgtgggcagatagagaaccctcgtagtagctttctttcttgtaaccacttcttccactgcttctccttgacattcaatttctctgcattatttcttgcaaaagataaaccttggtatatgatatcctaattttctatatttccctctgtaagagtagctttcttgtgatttgcagcttcaggataaagcagacaccaattcctcaaggaaacaagttcttaaattgacacctccttcataaactattttataaagattcaaagataatgtaacctttcctccctcctcagtctgacctgtgggataatttgttcacttgaatttgtttatcatctgttgctattttctgaccatttcggtttgtcaatttgcctttcttatgttgctccagagaatagagaaaatgcatcaagacagtttcaggtcggtggtttgcagatccctttcaaagagtctttcctccaaaaccaaagagagcagctaccctgaaatagctcaatgtgctgtcccttgtgttgtcacattgcaacctacggtttgtcgaggctgccaaggccgggattggagcccatcacaaagcaacagggaggatatgtccatgatgttgcagaaagattacctgatggcatcctcgctctcgaggcgcttcgcggaggacctcctaagaggagccatggacctccaggattcgctcacgatgctcgagaagttccaaactgcgtcgcggagcatgagagtgtcaaacaagaagagaaggccagagggttgtgagagatcaccggacacaagtggattccgtggagccctgtcggaagcgtcaaacgccaagaagatggtgggtagaagcgccagcagtggattggatggggaattaacgaattctactgatgagctgaaaagagtgatcaaggatagcttttacaggaagaacatcttgtcggtatatcccaatgatgaacaggcttccatgagccagtcattacattacatgccaaacaagaattcgttatccaagcctaatgagcagaagaaggcagcaccaagatcattgccatcttgtgcaccagggcagtctgagaagtccaaatccccaagcttggtagcaaagctcatgggccttgatggattgcctacacacaatagcaataccttcaaaaaagacgagtcaatgaagacagtaagttcaccaagggcactttttgatattgagatgcctaaggtccagcaaaatgatgctcatatgagttctccttattcccgaaaaagtaatgtttctctgtatgattctactgtggttaatgagattggctcaatgaaaacaattaggagggaaaaaggcatagagcaacctcaaacccgagcagccaaggatatcaaggttgtatctcacacaagtcgaaagcaacaaataaaagagaccactgaaatgggcaggagaagtagtgacaaacaaagacctcattcgacttataggaacagagaagggaggaaggataccaagtctaaaacaggatcagcatctcggtctagtgctaatacagtgaaaaggcctgataagaaatcaatgattgcatcaagtagcagctcttcaacatgtcgcacaaggaagccggtcgcacgtaaagcacctagtaattcgagggagaaggcagtgtccagtagaagtcgcaagaactcaactattgatgacattgtggtatgcatcttctattatagcatagcctggaaatattttattcatctgaaatattaaactattttggaacattgtaccctcagatttaaaaacaacatttatcttatttttccctttagaagtttcagttaaatcattcagaccttgaattggaacagttcgttgaaataatttatttcgcttaaatcacgggatctttttttgctcctaacgtaggcatatgagctgcacagagagttcatacaagttgatggtccatccactgaacatagcgcaacacctagtgatgaaagctgccaaagtgttgttgattgggacacagagcctagcattgatggtaaggaacgctgaatttcttttcattcttctaaacatgttttcatttttatttgtcactaatacaatttgaagcctgtgaagtaagaaaatttcaaatattgaacttcaatcgaatgttgaaatttggaataaaccatttagtgaggaatttgctgcttatttgcaagtggaatgtgacagttttggaattcacatgcagcgggtgtgacagttttgtcccgccaagccagcgagggtggcgtggccaaataacgctgccacgccagtcgccagctagaccagcgtgaccaaaaaacgttgccacaccagctagaccggcgtgacagtattgttttgccacgctagtttagctggcgtagccaaaagattcagatcatgtaaataagttttgatagggtttatttttaaaattaaaaattaaaaaaaaatcattccgctttaactattgtagacattaattccacttctatttacaggtttgtatctaataacagtccaagatgattaatttcaccacttaaaaacctaaatgttctctcttgcaatgaaaataggtgtttccacactaaacagaaatcttttcatgacaggcattcgggaagatttgagtgaatcctatgaagcttcagtgactaccagctctgcggaaagaaccgattcagctaacggagatccttttcacccatcgacacacttagtatcaaaaaatgaagttgaaataaaagacgagatgagtctgcttctcctaagtgatcaaccattccttacccgggcagcagaactcattggcatcggcgaaccggggcatctgatcaaccgatataaaggtatccgcaaggcccagatgggtaaccatgagcttttcgtggacaccgcaacagagcagctggagcggaagcatcgtcagcgaaacagcttgtgttacacaggaatttggagccagaaatgcagaacagcaccatacttctcactggaggcattgctgacagatattcgcgatgcgactcgaaagctgagcatctataccgaagacgacgatggctgcactacaaaagacacactatacatgaaactggagaaggatctgagatgcacagatgcgtcgatcaacagcgtgtgggatatgggctgggaagattggattttcatggaggaaacacaatgcttcataagagatgttggggagagcattttatcagggcttatcgaagaagctgctctggacatgtgggtacattgatctgggaaaatgaagcctaggtggttcttgcgttcttggagaatttctagctttgttctccacttggctggcacttctcatgatttccagtttccagtttgtatctatctttgttacatttcacctgtgtaaaaaatgaaaaatgtgcaatgatttagagagttgcctaaagaagtgatggagttgtcttcaccaagaaacaattgtaatttgtgcacaaggtatgaaggcatgatgaatagacaaagagcaatgtttcgtttcactttttcctttcgatgaatgaacaatgccgaggaatctcaaatagcaatgagcaaggacagttcttgttttcatttcttttttttttaaaaaaaaagctagttgtatgcccgtatgttataaagggtcacgctcatataattagggacggattagacgggtgattgatgatacaatattggatctggtggttactttttacaaacgagaacacacgtacattgagaggaggaaataaaaggagaagggccccatttttaaagtagtaactagcattgagagtaggaaataaaatgaggacagttgtgtttgctaggggaggatgggaacctgcacactacgcacggaaaacgatgtagtctattagcgcgtgattaattaagtattagttatttttttaaaaaaaaaatggatcaatatgattttttaaaaaactttcgtatagaaactttttgcaaaaaacgtaccgtttagcagtttgaaaaacgtgcgcgcgaaaaacgaggagagtgttggtttggtctaaaagagcgtatttttttaattaatcattttttatcttgagattttttttatacagtgcagtgggcgaggggaagatggacaataaacaggagagaaacgtaacaatattatgaaatctgtgaatcaaaaagagtaaagcacttactgatggagatagcttccaggcaagttgggtggcctccctccgtttctgccttcttcattgtcaacaaccatcgatgcctataaaatattactgaaaaacgctattaatcgttcgagctcgatggcgatgctagctctgccactgcaagcacttgtttttttcatttcttaaccagcacttgatggtgtggttggttcgatatttaagaccttttaatccaaagtgagcaactcatcaaatcccttttacaaacaaaaagtattacacccgtcccaacaagttttagagttagacacaattattaagaagatactatctctatttttaaaatatagttatttctagcacattgacttgttccaaatgaagctatttctccacctaccatctactctcaaccaatcacaactattctctttacctactttatcttttcgaccaatcacaatcctccttcaattatctctatctattttttaaatatccgtgcctacctaaaaaagtatttatgatttgtaggtagataagattatgatttgtcgagaagtgaaaataagtagaaaaattaaatggtgaagggttatgattgggaagagaatgccgacgaagaagttgctatattttgagataaatttcgaacactaaggtggtgtttgagaggggagggacatattttaatccatctcacaaaaacataaatcactcccctagagacttatacttatataagaggtactaaacacccaaacaccacctaaaaaatgttttatcttccgatgaggaattagttagctctcgaacagtagtacgagatttgtgcaagttgtggtcctgtcgtcatcctgtggagttgtggtgagtgtttgacgaattttttttttttttggcggctcgattgcaacccgcggcccgcaacaaatccgacgccaaatcggacacggccggcgactccggcgacccaccaccacacaccaatcctcctcctcctcatcgccgcctgcgacggcgaggcggcgagcgatggattccctgggcgtgctgctggtggcgccgatgaacgcctacctggagcaggagctggaccggcggtgccgcctcttccgcctctgggagtcccccgccgaccgccgcgacgactacctccgcgcccacgcctcctccatccgcgccgtcgtcccctacgccctccagggcgtcgacgccgccatgatcgacgccctcccctccctcgagatcgtctcctccttctccgtcggcatcgaccgcgtcgacctcgacgcgtgcctccgccgcggggtccgcgtcaccaacacccccgacgtcctcaccgacgacgtcgccgacctcgccgtggggctcgccatcgccgcgctccgcaagatcccccaggccgaccgctacgtccgcgccggcaagtggaagtccaagggcgacttcacgctcaccactcgggtcggtttcttttttccgaattccttagcttccgttctactagtattatccatttacgattttgcttaatctttctccaaaaataaaaagttcttaggtttgatccgtagtttatttacagtttggtttagtcgaagcaaatatagcacaaaaactgattgtacagcacgaactgtttggttgggtactattgggtacagtggaaaatacgattgaatggaaggaaaataagtcagaaagggagagctggaagtgagaaattgttggtcctgatcagatgtggctctagtttttgtttcacatcattagatatcttccttagatagtctaatcttaatttgatcattcaaacatcgttcttttataccatgtgaactatttaactaaggaaggaagcacgggaaatggtttcagagctctggtggatgcgtttttgtgagttggaaatgcatcttatttggctgaaatttaaacttgtttcgagcaggttgttgctgattgtagttgcagtgattttctatgggtctaaagagaatcatcgtgttcagaagttactcatctgataatgctgggtgctaattttgggttgcagatggttcttactgagtggcgcactgatagcagtcatatattaggatgttagtctatttaccggagtttatccatccattttattatgcatatgctgctgttattgtgcctggagaatttttcctttcaattaaaattgcattacagtaaactttatgttcagatgcagtatctgaaggacaatatagctagaagaaagattaatctgctaacgttcaattgattatgcataaattggtgtgttcgtggaaatgtaatgcttggtattcttatttttctgcagttcagtggtaaaagagttggtattctggggcttggcaggataggcttagccgtagcaaaaagagctgaggcatttgattgcccaatcagctatcattcaagatcagagaaaccatttccaaagtacaaattttatccaaatgttgttgacctggcagccaactgtgatgtgctagtcgtagcatgctcacttaatccagagacccgtcacattgtaaaccgtaaggtcattgatgcactaggaccagagggagtgctcataaacattgctcgtggagcacatgtggatgaacctgagcttatatccgcgcttcttgagaaacgcttgggaggagcaggccttgatgtgtttgaggatgaaccctttgctccagagcagctttttgagttagataatgttgtcttagtgcctcatgtggggagtgacacagaagaaacatgctgggcaatggctgatctagttctacaaaatttagaggcacatgcattgaatcagcctttactcactccagtcatctgattgtttctgttagaagtctgggatgattgtgccaccactactacattctgtaatcccaattagttttctatcttctgtttattagttcttcattttacccatcattagggacatatgccactcttttgtaagacatcattttatcggccttatggctgtcattcaatcaaccatgacaaataagatgatcagttccagaagttgaatcttcctgtctttggatgatatattcacatattctcagtttctccttcttacaattttccattctgtcagagcctattctacccttcccagttttgtcatcaccctattatctttctcatcatcttgtaacaaatatcatctttctttgttcaacatgatatgatcttctgatgagagttttttgtttatcctttttgcagttcagtggcaagagagtcggcatcatcggtttgggcaggatcgggctcgccgtcgcgaagcgagtggaggccttcgactgcccggtgaactactaccagaggacgaagcaggatcaccccggctacacctactacccgtcggtggtggagctggcggcgagcagcgacgtgctggtggtggcgtgcccgctgaacgagcacacccggcacatcgtgaaccgggaggtgatggaggcgctggggcccaggggcgtgctgatcaacatcggccgggggccgcacgtcgacgaggcggcgatggtggcggcgctggccgacggccggctcggcggcgccgggctggacgtgttcgaggacgagccgaacgtgcccgaggcgctgctcgggatggacaacgtcgtgctggtgccgcatgtgggcagcgcgacgcacgagacgcgcacggccatggccgacctggtgctcggcaacctggaggcgcatgtcgccggcaagccgctgctgacgcaggtggtgtgagctaattgagtgactggatgattctgatttgattgattccaaagcaggtgcaattcgacaaaatgtagtatgtactgtttcaggatgtgaaaaatctgttttccctttttgtaaacacggtcggtctgggacgatccagtaataacgatttaatatttgtcattggaaatgtgaaaagtgtgttgggttgaaacggaactgcattgccactgctatttcaggtagagtaatagagtattattttttttctgaaaggaaaacggcaagagtattgccgaatatattagagggaaatagaaattcagggattacagaggagcgattacattaagaagcggtaagcaactacttagagaccaaagcctctttgcgaagtgtctagcacagatgctactttcacgaatatcttgaatgatttggtgtgatgtccttcgcgtgtctggttcttctccccctaaaatttatgcgtttctttgaagccagatatgccactgcgtcttaaccggggcttcagctcttggcttccatcttgctttcattttgcacaatgcatgtcatccattcagcaatggagcaataagattggttattttttataccctgggcagcagtgacaaggccccacgtttccttgaagaactcacactgttgaaacaaataatcagtgtcttgaaaagccccctgcataggggcaaatccagtcgcactctagcgtcggattagcatcggattagcatgttttcggccgagtaatagagtattatataggagtactagtatatactccttccatccctaaaaaaactaatctacagtggtgttcttttgtggcgtagacgaagatgaaaataaagatttagtgttttacgcaaaataaggtgatatttacgtatgattaattgagttttaattattacaaacttgaaaatatatttatctgatattttagaacaatttacatataaaaagttttcgcatgaaagacactgtttagcagtttgaaaagtgtgtcacgaagatgaaaattttcatccaattcctataggagaaacggacgggaccatatataatgaatatgaatatgaacatattcacatccatattaattgtattatctctaatattataaaaatcaaagacgtttttgccggtattttgatacgtcatgcatctatgcgtcggtttttaagttcttttagaaatacatatccgtatctgagtcagtttttaagtttgttcgcttttaaaaatacagaagtagtcatataagaaatcactttagaaaaactcacatgttaacttgagacgatcggactcctaattgcagcttatgattttctaaagaaaatgtatatatccaagcaaattctcacagtgcatttcaccttaactaaaccgtataacaacaataaaattaaaatagcatcgcataggtttttttttatattctaatgctagtttgatttttttttgacggaaggactattaccgtccgaagagattaaccgacaggtgggggccacgcgttgcatggtcaaaaggtagggtccgggagacagccacacgagttcctctcccgtgtctctctcgctcactcggcttggctagctcctgtctgttcccctcgccgccgcttccgagtggtagggtttggctgctaccggcgctggtgaagaataagaagaagaagaagaggcaaaagcgtcgtcttcttccccggcctttcttcctctctggctctccgctcgtgttcctctcgcgcggcggagatcgagggggcacaaccgcacaaatcccattcgtttcgatccgtacgtttcggccttcccaaaatccccacttccatcatcacagcggtgcgggggggggggggggggggaggaaagtgatggtttctgcccgacaactcccaaatcttctcttcctcttccttctcaatccgattgttttctgaaactaggttggttatctttcttcttttgtcccttttgatttgatcaccgtattcaactcgatgtgctttattatgtgatcaggttgcgaatgcggatcaaactttttgtatttttgttcacccatttcccactaaattttcaactaggaaaaaaatgaaaaaaaaaaacgcgccctgtttcttctgtacaaacagaattgccggggaggaaggtccggtggtggtgacacttggcgagatctgctgcatcggtggtagcagtgccacctttttctgtccgctgttgagcttgtgctacacgtggcatggtcctcccttcgctttgcagacagcattttcaacgcaaaagttcacccttttttctgcttcctttttctgtttgcgaaattcgatgtagattagatttagattagtcctatgtgtctcttgccgggttcttcttctcgggactcatgcttgcattgcacctctttgttccagcgaaaatgtgagattttgaagagatctgccattgcaaggtggtactgtacgctccatagcttttccttccggttttggatttatttattcttgttctttttctcgaaaatttccaaacacaaaccttaggctacgttctccatgtgcctttcgtcttcatggacaaaaatgtgtatgcttgcagtttcttttcttatgggttttctctcttcctctaataaatctttctaggatgaactgctcttaggatagagatgtacagttggttcttttctttttttttttcagttgagtcttgtacacgactgtttcatacattcaaacaaaagtaggtttgatcgaaactgaatatggtctacagctcatgctgaagaagatattggctttttcttcttcagataggttcaacaggttgtcatcttcagatgcttctggtaaaattgcaggttcagtttcagcaagagctaaactcgatcggattcagaccgcgaagctaagctttgcgaaggaggatgaagccggcgacgtcggagtccgacatgacgagcctcgcgacgtcgtcgccgtcgcggtcgcccaaggcggcggcggcggcgtactacgtccagatcagcccgtcgcgcgactcccacgacgacgacggcgacaagtcgccgtcgacgcaggccacgccggtgtacaacaacagcccgctcgactcgccgtcgcaccactcctcctccttcggccgccactccagggtctcctccgccagccgcttctccggcaacctccggtcggcgtccgggaggagcaggcttggtggcggcggcggccggaggcggttgggcgccaaggggtggcgcgacgtcgacgccatcatcgacgaggaggaggaaggcgcgtacgacgagtttgacgacgacgacgatggcggctatgagccatccagatgctgcgtcctcgccttccgattctcgcttcttgctctagccttcaccctcgtctgcctcatcgtctggggaatcgctcgccattacaaacctggagttcttgtcaaggtatattatcactgaattcgtatccaaatcacacaggttcataatgagtttgtgatggttttttgaacttgttaaattattactgatcttttgtctgattctagtagcattgtactaagtgtttgtttttgtgtttcttcaagaacgcaaattcataatgagtttgtgatggtttttgaacttgttaaattattactgatcttttgtctgattctagtggcattgtact

SEQ ID NO: 58973 - DNA, 7172 bp, Oryza sativa
ccgacaaagctggtgacaatgaactgctctctgcagataaatgttcacaacccttccacgatgttcggcattcatgtctcttcgacatcgattcagatcttgttctcgcaaatcgcgatcgccaacggtcaggtagcagctagcaccttcagcaccagaatttctgtactgcaatttcctcttccatattgaactacaaccacattcttaagctcaattcatcctgctgctctgcagttggagaagttctaccagccaaggtcaagccatcatgtcgcctcggcgatcgttcatggcgagaagatccctctctatggagctggagaaacattcgccttgtcgaatgctggaggtgctgtgccactgactctagacttggtggtaagagctagagggtatgtgattggtaagcttgtgagggtgacacacacaaagcgtgtgaaatgcccggtggttatcgattccggtagctccaagccgattaggtttatccagagtgcttgtagttacacctgatgcagtgccttggccttctataatctcaataagggctgtgatcatgtactccctccgtatcataatataagggattttaagtttttgcttgtaacgtttgaccactcgtcttattcaaatttttttgaaattattaattattttatttgtgacttactttattatctaaaatactttaagcataacttttcattttttatatttgcaaaaaaaatttgaataagactagtgatcaaacgttacatgtaaaaaatcaaaataccttatattgtgggacagagggagtagatatttaggtccttcatgacatgagcaaacaagaaaataagcagtagttttatcttccaattttgccatgttgatatctcttgctaacatattgtgatgtcgttttatcagtgttacatgtcattgcgctttgcgacaagtttttatacactaatttagaagttggttttaaacaatatcctctgttagtttcatagatcgatgaaatggttcagaaagaaattgaaggtggaaaaaaagaagttatctcctgaacagagtttcattctaattctacatcttcaaatttttcacagaatcattcaacaatttgagttctcttcctgtcctcagcaatgacaacctgattcattgaactagacataccatatatcatcagtgttttggaaaacaagctgtccatgatcaacatacatttgctatcttacataaacatatttcccagtcttccttccaaaatttttgagacatctgaagcgagttcttggcacagcagaaatcatccaatgtgtgttgagaaatagtaagaattgtaattgacaggttcttgccagtgtacatttttcttttttactgagcaacaacacaagatggcctcctctaactgaggaacaccatcttcagtgagctgatgctctggccatacactccacactgcatctgaagctgcttcctgcaaagccacgtggatctcaccggaagccggcacgatcgccggagcagcgacagcgacggcgacgacgacctcgccgtcttcaagctcatggaagctcttgtcacctgcatggatcgtgacgcgtcactcttggcatggccattggttctctcgaagctctgcagcttgtcgtcgccatggttgtccgggaagtagggctcctcgtcgtcgtcggcgtcgaggaggtcgccggaggaggaggaggagccgagcgcgcggttggcgttctcgacgaggccgacggccttccacgcgtcggcgacgaggcagtaggtggtctgcttggggcggacgccggcgtcctgcatcatctggagcacctcctcggccttccatggctgcttcagctcgctgtagccccagatgagggtctcgaacgtcctgaggttcgggcgcacgccggcgtcgcgcatggcggcgtagaccctcacggcgttgcccatgtcggcgacgctgcaccacccgctgatgacggtggtgaaggtgacgacgttggggcggacgccgaggcggcccatctggcgcaggagctcctccgccttctccggctgctgcgcgcgcacgtagcccttggcgaggatgctgtacacctgcgggtccggctcgatcccggcctcgatcattttgtcgaacaccttcatgcacttggccatgtgccccatggagctcagcgcgttcagctggtggctgtaggtcacgatgtccggcttgatcccgaactgctccatcagcccaagaacctgcaagaacacaagatcgcagatgaaaactcgatttcgtttagtgttcttggttattgttttgtgatgatagctcacgtcgtcgacggcggccatgtcgttggcgtcgaggaagcccttgagcagggtgttgaagacgatgacgttggggagcacgccggagtccttcatctggcggacgcagcggagcgcctcgccgaggcggccctcgcggcagtagccgccgacgatgatgccccaggtgcgctcgctggtgcggagccctgcctgctgcgccatctccacgacgagctcctcggcgcgccacgtctcgtcgttcttggcgtacgcgctggcgagggtgttgtacgtgacgacgtccgggtcggcgcccgacgcgcgcatcctcgccaccacccgccacgcctcctccagcctcccggcgtcgcaccacgccttgacgaggatgttgtacgtcgtcaggttcggcctgaccgccgcctcgccgccggcgccgccggaggccatcatgtcgaacacccgctgcgactcctcggggcggccggctatgccgtagcccttgatcagcgtgttgaacgtgctcgccgtggggcggcagccggagtggcccatcctgaggaaggtgttcgtcgcctcgcccatccgccgggcctcgacgagggcgttgatgagcgcgttgaagaagatggagtccgggcggaggccggcgtcctccacctcggcgagcagccacgggatggtgtcgaacgcccgctggctcgtcagcgccgcgagcagcgtggtgtacgtcaccagcgacgggcggtggccgtcgtcgacgaggtggcggaacgccgagtgcgcctggtgcggcctcctcgcgtcgatcatggcgcgcatctgccgcgtccgggcgatcaccgcctggcacgtgtgccccttgccgcacgtcgtgcagagcagcttctgcttctgcttctgcggcggcgacggcggctgctttgcttgcccgtttgatgggtgcagggcgccattgctgccagcttcgtgcttctcctgaacacacacaaagacagaaatcaatcgaggtgttcttcgttttctcaggtagacagtcacaaagatgaaacaaacgaggtgcaattataagataaaagaatactttgaggtgtgatccgtttagcacttctccattgattcttatcttgccattggtcttgacagtggaggtcaatgtgagctgcacaccgttctctaccatggtactatgcttctgtcagccagctccttaacctgaaccataatttcagaatttcagaactgtgctcattttcatcaagtccccaacatatgtactgcactaatgcagtcagtgggcaagaaacacatgcacacattcggagtgtatagatgaaattgatgttcctactcttgtctgtttttaaaaccaaaagaattgcatattcctgggaagctgttaagagcaaaatgtgatatttctctgatccatttccacagtgaaggacgcatttcataggggcatcctggattcctaacaatgaaaacatcatttacagaattttagtggtcatgataatcaacatcatcttcagatttcatggaacacgtgttgtattaacaaatccaatgaccaaagcagttgatggacaaactaccagaattaaagaaaaaaaaacaaaacagaaacaaaatcaactcaggatctgaaatacaaaaccggccttatcctgaagcctagaccaattcaaatgtagaaattccattattttcacatattatatcagcagaattattttatacaagcagaaaaacaagcagttgcagagcgtcggtcgacaagaaactgcctacgagagagacaagagaagctaattcaggacgaatcccggtagaacacgagcgagcgagagggcgcgttcacctgagaatcaacgagctactggcagcaacgagcgttcattggccaaggagagcgagctgcgctgcagctgcagctggtggccagcgtgtgcctccgtcccccccgcgctctacgcacgcacacgccgcgcgtggccagccgtcgctgtggctcgcaagcaaggcgggcggagcggcggagcgacgtggaggaacacgaggcgcaggcggcgtccgcttttttttttttttttttttgcccccggtggagctttttttgggtttcgaagtgggggggagcgctttatccgcggtgaggagcgaaacgggtggcgggggaagcgcggccgctttggcggttgccggggtgaactggaccggacgccgagggagcgtcgcgtcgcgtcgccggttgggtgaggctccggagcggccgcgtggcgcggtttgcagggaggcgtccgatcccgcgaggccccggacgtgggcgttggatcgggacgggacaccgtgtggtcgctctcctgacgcagcgttggatctgatcgagccaaagctaatactctccccgttttaaaatgtcggacatcgttgtttttttcaagtatgtgtttgatcattcgtcttatttaaaaaatttaaataattattttttttcatataatttgattcattcttaaacatactttcaagtacgcaatttttttaataaaacgaacgttcagacatgcgctaaaaaatcaacggtgtcaaatatttttttttgaaacggagggagcagctcttttcacttcaacgtgcaggcgggcgcggtataaaaacgacgcaaagctaacaaaaaatcacatggtagtgtagtaaccaatcttgtcattgtacttgtcaattggaattttattgtattacatgacatgcacgcgcgtacatacccaacaccacacttatacatccacaaatacaactcctaacatacttgtgaagtgctataaattttgactaccatttgttttaacttgcgggctcctttggattgatggtttttcaaagtacttatggaggattgaaaatctcaagaaagttttcatacgaggctctttgtaccaaaggaatatgaatgtcaaatttcctatggattgacttcttttcttctatctaaaataaaataatacctccattcaaatcgaaaataaacatgagtcatacctcatgttttattttggattaatttaattcatgccattacacacatgttatttcaaataagtatcattacaattcatctatttatatccatgtcacataaatttttaaaaattagaatcgttctgtcgtcatattttccatcttcttcctcatttatttgcaatcgcatggatcgaatacccttttattttcctctaagaagtataatgcaccctctttctttctctctagcacaaagaatttactctaatattcctatttttgtttctgtgaaccatccaaacacctactctgttagaacatggatcctatttctacatttttactggtactgtgcttttagatctcgcgtcccaaaagagttttgatcaacatatcagcctaccagtcatagccaaaatttaaattaataaacaaatttttagagttgattttatttttttttcatcgtagtttgtttttttatattgtcttttatgtcgctaaacacacacgcaaacgcttgagcgcgcacacactgtgcgcgtgcgtgcgcgcacgtgtgttttaaagtcagtaataagcgttagagtttatgaattatagttagagtgacataccatgtgtgtagtttcagagctttgagttagctggtagtattttctcttgaaggtttaaaattggagttaaaaagttactacgaagatcatagctttctttccaactaggtgaaaccctgcgcattgctgcgggaatttagtatgataataataataataataataaataacgtgtaaaatagctagataacatcagattaagtaaattaatgtggtttatgataatttaaatttaaatagtatgtagaatggtgattcaaacgtaaaaagtagggagatagtttggaccgtagattaatcatctaaaggctaaaaacaatttatgtgatatgacttaattagaggaaaaaaaagagaaagataatttggaccatagattaatcatttaagcactaactaagtgaggatgaactatataagtatataggatatcataaaacataataaagatatacattgaaacattatgtgaattatgttggatgataatttaacatgtttgtatttgaaaagctcttaaattataaaaactataaagatataacatgtttgcatgatgtttaaatgtgatgattgttagtggatgatgatgtgacatcttattaattagtgaataatgatgtgacatctttgcattttaagcttaaggagttagtgggagataactttatagtaagataggatatgagagtattggatcgtatacacttatagcttataattaaggcaatagtcataatttttggtcaagtatttttttctcttactataaaggggttcattattattttacgactgccaatcatatatatagtttatacttattcaaaacaaccgttaaaaacttttatatgctatcgcagatttacgagtacttataggactctttgactaaactttttaagatatgatggtgactattggattgcttgctgcatctcacattctataatttcctgataacatgtcctaatcaagttttgtgaaagctcagggtttttactactttagatatgatttccatatttttaagtgataaggaaaactacatcacccaaaattattggaggtacactaaattaattttcatatagaatcttgaaatgttcaatattccatccacatgtgcattaaaactgtattctttgacctgaactcttgcactcctatctcggaaaccccctaatatgactgacttgacgcacctaaaaa

SEQ ID NO: 58974 - DNA, 9984 bp, Oryza sativa
gagcttggaggtggaggataacctagcaaaggtgggattatagggcgtaggggttgtctaatcgattgatggtgtgtaggtgaatcgaaatagtatctcaaaaacttatgcaagttatcaactcctgtatgttgggaatggccggatttgtgctttgttctctggccggtgagcttccctgtaaaggactgggaatattttgggtggagaacggccgtgataacgatggtttggtgacataaatggtgcaattttgggctgatgttctcctgcttggagccctaggatctactttgcggaaccgtggtgtcgtcggggtggtttgagaacaatcgagtcgtctgctggtagggagacatgattttttttctgttgctaaaaatggcctggtatgtttggtttgtcttaggtaacagtgtcatactcaaatcctgtagctttagatgtattttctatttcagcatcgagatcagataggcggtgagcttgatttggtcactgcctctactacataggaagttcagtggttaatccctaaatagctgaccggttaatattttgatttcagtgaatgaaatattcttttggtaatcgttaaaccactgtttagatgggatcatgtatcaaagccaaccacggttctatcctatggtagcagggtcagaagtacttttctggttaccttttttggtaaacggaattgatgtggtggcagctaaagagttggttatgttgctatgaacaggaaaagttagttgaaacaagatatttattgctgttcatggtgcctttgttcagctaagagattgggaaatctaaggaattcggacatggattttgtttgaactatgggacaccttacaagtggtccaggggcactttcaaccttatattatttcttaccatcccttccaagaggtttcctcattctacaatttgaatatttgtcacttttcaggataaagataaagagttcaaaattgattggaagagggtgggcatcacaagctcatttggatttgcttttgttggaccagttggacattactggttagttccatccttttcatattgagcatgaacagatggtgttagggtcaattttgtttgtggattcctttcttatggtcataaattggcaagaagtttttggaggttttacccattaacaactgaaaatctgctagcagactttatctctcccagtcccaaccagcaacatggtgtagattaaggaaaagagaaaaataggtgacatggaagacataatctccatcctgcactgagcttttccatttaggttgtcatatctagagaatgatatgaatgttgctttatcgtattagtatcaatgggttccaactatgaaaaactgaagatagttaaatatcagatgctttgcttgaatatatctaggtccttttagttcttttaagtttcgatattcactgtggtgggtatcgaatggtgggttagattggatgcagtgggtgctatctttatagaactgctgtgcttttttttagatgaactgatgcatctttttctaacataatataagaaagccatcacactatagtcatccattatgagtgcgctgtgtgctaccagtggcttcttttactgaatcttgtgtcacgcaaggggcatacattatcttttggagttaagtagatattgatgcactctgcagctgcgcttcatgtttatgttcatttgtgtgcttaccaatccacttcaacatagacttgtttttcaccatgtcacaatttcttgccttttcatgcttaccattcattacgtatgtgtagttaaactgtaaaatattcttctcttgagagcatttcgtgattgatctgctccgctttgtggttagtgttctacattttaattgaccacaaggttttcaactgggaagattttggtatttgagaccacttaacagtgcatttctttctatagtacgccatactatacaaaacttcaaattaataacatgatcatatgcatccttttttgtgaaataagctaataattgaatataaataatacttgttgatggacttctactgccctgccctacatttttgtgtttgtttttgttatgaatggtgattctatggtttcctctcacttatttgttgcagtctactcatatgcaaaacctgggatattgtgaaatccatgcttccaacaaatatgcttttgcttaaaaatgagaatcctgttctgaagcaattttatacaacaggctggcatataacttgcgcttgtttctgtcacctaggtatgaatacttggatcgcttcatcctgaggagataccagcctaagaccttcaaatttgttgcgtcaaaagttgctgcggatggtctcctatttggaccagtagatcttctcttgttcttctcatatgttggtcttgcatcaggaaggagtgtagagcaggtgaaggatgatgtgaagagggacttcattcctgctctagttctagggggaaccatctggccagccgtgcaaatcgcaaatttccgcttcattcctgtgcgatatcagctcctttacgtgaacctgttctgcctcttagacagttgcttcttgtcgtggatcgatcaacaaggagatgcaccttggaagcaatggttcacatcattccagaaaatcgaaggccagaagggcaaggtttgatgtggatcaggcacggtccttttgacatggtcctggatccagtaacatcacccggcaaaacaccgggcatcccagaaaatttgtcttctgtcatttggatcaacctttgtatgctttggctgatccatgaaaaaaacactggaaaagagaaacacttgctgctatggtagcaattgttttaagcgcaattgcagtaccaagcagagctgagcatcaatatctgtgtagagatttgtttcatgtttaatgccaaggaaaatattgctcaagttgttctacttgtgtctgtatctctgaatgtttgtacaagcgattctgtaacttcatgtggttgaaatatgtgcttccaaagcagctgaacgcactgaattcaacaactaacatgcataaaaagtcgatgagatttaaagaagagtaggcaaaaatgctgtataaatcctctgccgctgacgctattcttctatagcataagcaaacaaaaccataatatcaataacaccaaccaatcattggctacaactctgcacggcagctaatctaatgtcaatttttttcttcataatcctttctaatcttcttcagtgtcaccacaacaccggccattgacatcctctggtcaggcaagtcacttgagcagagcaagccaacctcaaatattggcaaaagaaggtgattcaggtcttggatagaagactcatctagctgtagcttgtcgtccagaacatgaacaagcttcgccggaaatgcttgattgacccactgcctaatggtcacttctccaacgaacaaacgatccgtgggtcgctttccagtaaagacttcaaggagcatgattccgaagctgaacacgtcgctattgcgcgacgcctttccgagtgatccgtactctgctcaggaaattcagaaacaaaattttttaagaatgattgataatctaactaaagtaatctccatgatgatatattccggtcagtcaatgggtttatggaaattaaaatttactccctccatattttaatgcatgacgctgttaacttttttttatcaacgtttgatccgtcgtcgtattaaaaaaatgtaattatcacttattttattgtgacttgatttatcatcaaatgttctttaagcatgacacaagtatttttatatttgcataaaaattttgaataagacgaatgatcatacatttgttaaaaaagttaatgtcatcatacattaaaatacggatggagtattatattagtacctggtgccatgtacccaaatgttccaggcatgcttgccgtgatctttgacgtgtcatcacccagtagcaactttgcgatgccgaagtccgccacatgcgccgtcatttcctcatcaaataacacattgctaggcttcaggtcacagtgtaggacaacctcataatgctcatggtgaagatattccatcgccatcgacacatctagcatgatgtccaacctcttcaacaaccccaaagaacttgtgccttgagagtgcaggagcatgtctaagctgccattgggcatgtagtgaagcaccagtgctctgaactccatgttggagcaggtgttcagtacctttatcaggttccggtgccgagccatgcgaagcacacggcattcggcatcgaagcttctaatggccacttcttccaggtgcatatctagaacttttatcgcaaccaccaaaccgctgctcagttggcccttgaaaacttttccgaagctcccactccccaataagttgtcatcgctaaatttatcggtggcacgagcgagctcatggtaggtgactatcaaatgattcatgtcatcgcctggagtgtgacttgaatcctctttcttgttcttacttttccttctgatcattaggaaaatgcaaataaccatacagccaaatgctacggtgacaactggaagtagaaatcttaggaagtgtctactgtttgagtgagacttctgaagacatggtgaaaatcctagacgtggagcaccgcataatgcagcattcccgatcaaggactgtagcgtaatgtttgagaaaacaccaccatctggtatctggccttctagcctattgaaggacagattcaaggctgtcaagtatgtgaaatttgcaaggaattttggtatggtaccagagaggttgttggaggagaggtccaatgttgccaagttagcaagctcttgaaatgagtacggtattgagtctccaaatgagttgtgcgatagatttaggtaggtcagcatcctgatttgtccaaatgattctgggatacttccaagcaaagaattggacgataaatcaattgtatcaccttgttttagcctgctaagatcatttggtagtgcaccagtgaaggagttgtgagaaagatttagtcgcaccagtttgccaaggttgaagaagcttgcaggtattgttgagttcagttggttatgggacaacatgatgtgttctaattcactcaggttgccgatgctatctggtatggagccaaataatctgtttctctggagatccaatctctgtaagctgctgagcatgccaatctgagtcgggatagggcctgagatatcattgctagacacatctagccttacgagatttggcatcatggtgatggattctgggattggcccagtgagctggtttccaggaagttgtagctgttcaagactgctcaaatttgacagtgacgatgggagcccacctgttagcttattttcgctcgcggaaaatatactcaattgcgcagacaggttgccggtatgatcgggaagatccccggtgaaagaatttgaatccaaggtaatgatccaaatttgtcggcaattagaaagggaagacaagaagccaaggttcccctctagattattcagtgacagagtgagccagttgagagctgggatattgcctagtgttgctggcactgccccagtcaattgattcatctgcaaatctaggaaagataattgcgataaattcccaagagaagttgggattggacctgtcagctggttgtatgtgagacgcagagttgagagacttctcataaggcctaactctgaaggaatttcaccggtcaggttgcagaaggagaggtccagcgaggtaacaccggtgaggttgccgagaccaggagggatagagccagtgagctgatttccacccaagaaaagctcagtgaggtatggcagctgagccaaccatgccggcacgacatccacgaagctattcgacgaaatggacagggtttgcaggtatcggcatgccgcgagccctgccggaatccggccggcgaagccgttggagctgatggagaacgtgcgcagcatcggcaggtgaaagctcccgttgctcgtcgtcgggatccaccctgtcaggttgttgtgcgagagcaccaaccctcgcagcctcgacatgttgtagacggccggcggcaccgcgccggcgaggcggttgccgcgcaggttgaggtactcgagcatcggcagcgacgacggcgacgacgccacgccgtgcggtacgccgcccgtcaggctgttgttcccgaggttgacgaacgtcagcgagggcgtgccgttgaacagaagcggcggcaggtctccggtcagctggttcatgtgcagagcgatcctcgagaggcggcgcatgccgtgcagcaggtcgggcgggatctccccggagaggttgttgttgcccaggtgaaggagctcgagcatcgtgaggttggctatggcgggtgggatggcagccgatagcaggttgtcgccgaggaggagactccgtagccggcgtagcctgccgaggtcggcggggacggggccgacgaggctggtgttggtgaggtcgagggtgtagaggaatgagaggttaccgaggtgggcggtgagctcccctccgagcggcgcgtccggcagcgacaggccggtgacgcgctccggccggcggcggcggctgcaggagacgccgacccagttgcagaaggagacgttggtcgtccagctgccggcgaggacgccgagaggatcggcgagctgggccttgaaagccagcagcgccgcgaggtcggctgcggcgccgccgccgctgctgctgttgatggatggagatggagaagaagaggcacctgctgcaagggctgtcactgtcagcgagatgatcaacaactccgccgtgtgcaggactgctggtaaacagccttcattggctgtatcaaaccaacgcggtccatcaacgccaaccaatgattgcctacaactctgcacggcagctaatctaatgtcaatttcttttttcataatcctttctaatcttcttcagtgtcaccacaacatcggccattgacaatttgacatcctctaatataatgccaatttttttcataatcctttctaatcttcttcggtgtcaccaccacatcggccattgacatcctctggtcaggcgagtcacttgagcagagcaaaccaacctcaaatattggcaaaagaaggtgattcaggtcttcgatagaggactcatctagctgtagcttgtcgtccagaacatgaacaagcttcgccgaaaatgcttgattgacccactgcctaatggtcacttctccaacgaacaaacgatcgatccgtaggtcgctttccagtgaagacttcaaggagcatgattccgaagctgaacacgtcgctcttgcacgacgcctttccgagtgatccgtactttgctcaggagattcagaaacaaaatttttcgggtaattgtgtacttacccctactttgtattctaattatgattttactccttttttagggtgtatttttgcccttacttttctcaaacgaagcttcagtttacccctattctgttatcatcagttaacagtgtcaattcactcgtaaaaagacatgtatacccttgaacatttgtccaattcttttagaattttgatagcatttccacacaattcgcacggttgcagaactttagcacaaagattcatcacaaattcgtcgcaagtgatgagatggggaaaaaaataaaaggaaaatcaagcagcaaacgacatggcattgtttgtctttgtggacgagctgctcgccgtgcgtcgctattgccggcttgccgcaccatgctgctcgctgctcgcttgcccgtgcgttgtacaggagctgcctcgccgcagccttcgccgccgccttcccgtggcgctgcgccagattcgccgccttcccatacgctgcgccatcctgccgccaagcttccctgctcgctgcttgctggctcgctggctcactggccgacggagccgccgctcctctccgccgcgcgctggccgcggggccgccggccaccgcgcctccctacgcatgcacccgcggggccgccgcgcgctggcccgcaccgccgcttgtcgcgtgcgccgccgccgccgcttgcaacccagctagggttttggattggaaatcggaaatactacgtcccataatagttgtcactttgacttttttctttcgatgtttcaccattcgtcttatttaaaaaattagtgcaaatataaaaaatgataagtcatacttaaagtaatattgataataaagcaagtcaaaaaaataaataataattccataatattttgaataagacgaatgatcaaactttacaaacaaaaacttaaagcaacaagtattctagaacgggacggaggtagtagtaagggattgggggatttggctcttcattgaaccaagggtagcatagtcattcacaaattataataacattttctttttttgtttaattcgaaaattccggcccaccagacttctgtcaaacctagtagcagaaggctgtttcatttaaaaaaataggtgtaaaaatcacaaaccctaaaatacatgataaaatcacaattgaatcgtaaagcaagggcagaaacacaattaccccaaattttttatgcatgattgataatctaacaaaagtaatatccatgatgatatattccagtcagtcaatttgtttatggaaattaaaatgtattatgttagtacctggtgggcatgcttgccgtgattggtgatcttggaggtgtcatcacccagcagcagctttgcgatgccaaagtccgccacatgcaccgtcgtttcctcgtcaaatagcacattactaggcttctggtcacagtgctggacaatctcataatgctcatggtgaagatactccatcgccatcgacacatctagcatgatgtctgacctttataagagcaggtttaatagtatagccggcaaccggctataaaagatctaactcagcaaaaattatatccaatactaacaaatagttagctagtactaaattattatacacgggtttctaaaaattatttatactccttagagcacccgcaatggtaaagtaaggtgctatctataaaacatgtacatctcagcaataaatagtaaaccatctcaatagtatgtctacatgggtatctatagctctctaatatattgcctcatttttctctatagactatctccaggttagtagatagctttgctctctcttctttaatctctttcaagtagaaaaatatgctgacatggatcttttatagagagcctatagataaccattgtgggtaccttacagtacttcccacctctcacaatatctattctctgtctcatcgaggcaattgggaagcgtgcaaatggtgggaaaagcttacagttgcagcatgcatggatgacgattggtcatgctgctttttactatcgctgtagccgggtgatagattaagtgctggttactctctctcctattttcttactcttccatctaggatttatcttagatgaatagtactaccgcccgctgattatatctactatatttgctctaacaaccccaaataacttgtgccttgagagtgtaggagcttgtctaagctgccattgagcatgtactggagcaccaatgctctgaactatatgttggaacaagtgtttagtacctttatcaggttccggtgtttagtatctattttccgtttagatgtagagaccgatttaatctattaaaaagaattgcgaggaatcatggcacggctcgccgggaaaaaaaacccttctatatgacaggggtagctttttcatcccaagggagattccactggtggagaaatgctttttagtcccggttcgtaacccccttgtagtcccggttttccaaccgggactacgaatccgggactaaagatcgttatctttagtcccggttaaa

SEQ ID NO: 58975 - DNA, 9565 bp, Oryza sativa
ttactaaccggaactaaagatcatagggccctgacacggcctgacatgtaatcaaccgggactaaaaatgaactttagtcccggttgaagttaccaaccgggactaaagatgatttttagtcccggttggtaacaacaaccgggattaaagatctttctcttattaaccgggactaaaaattatttttattcctggtttttaatggaaccgggactattatggatttgggttgaccaaccaaagatggtttctctaccagtgttcggtttcacaaccttcatatgactgtgcttattacgcaatccaatcgtgacgtatgaagctaggtatactgcccatcgatcgattctaccgagatggcaacatatattcgtatatatcgatgattaatttcacaaggccatgattctttcgaatttcggacaccgcaatacacttatatatggacagctcggatcatcaacgaaaaggaagcaatgagaggaggcggcggcggcggcggcggcggctgctgcggctcatccgtggcgggtggccgtcgaaaagcttcgggctccacatataccggaggaagttcgccgcccgctcgtctttcctcatcaggaacgactacggcgtgtggtcgcaggcgcaccggcggctcatcaggatgacgcgcctcggctactggatcgtctacgacctcgacgccaaggagctgaggacgtggtacgaggagaggctcctgcgggaccgcggcatggcgcggtggccggagtacggcgccggcgacagggaggaggtccggtcgctgatcgccagggtgagggaggagtactggcgccgcatgcccgagcaccggaggcagaagttcgtggcgagactcgaggaggagcggcggctcaaagaggagagcgatcagcgacagcagctcgcggcggcggccgacgagcgccgcggggcgcagatggccgcggttgacgatggcaagctccgggcatcgtcgcggtcgtcgacgcagcctcctcctcgtcgtcgtcgtcgtcgtcgtcgttgggctccgccgccgccgccgccgccgcctcgcctgcttggtattctactgtggatacttgctgcggaaatcgtgctgctgttcgtttacaaatttatgcttccatcgtttcgcttcttctaactcttataagccaaaatttaaatttaaaaatttattttcgattttatgatttttttatcgtagtttattttactgtatttgtttttaattgatcgttataaacatgtatataaaagttttattcgtaagttattttttctaataacctgtaccgcttttgcttctaaagagcaaacggtcatatgcacctctcgttttagactgaaattgacgatttactttcctattcatcgtcgtgtgaacttgagtctaaacgaacacccatctacattggagtaagttccatttcttttccttgttgtaagccgaaattcgagaggagagaaaccgaactaccggagagtgttctagtacaaggaactttgggtgaaaatgaactttgggcgaaaattaaggagtaggccaaaacctgatcgctagcaaaaagctctgtagatccaggaaaaaataatagtggggctggacaaactatgctagtataaatcaaaacatgtatcacatataaattggctacatatctagttcaaagtacacatacattgaattaatgatatgtagagaattttgtccataccaaactaatgtccaatagataatatgtcacacccaattgcctattattcttcatgagtaataatctatacaaagaaaaaggcaaactaacgaattcaaaaaatttagagacctagggatcactgatagtgttgcttgaactattataatacgtgaaccatgttctttttgacatgctgacaatctataaatgtacagaaacaattataaatttcaatcactacctcacttaacttgaactattgaggcacaattttagactgtctattagtattagaggttagtaggctaccaaatttaacttcaatcaccggttgctgctgcaagttgtgtagttgccggccactgcgccgctgcctgcctaccttgcgccctcgccggctccaggctcggcacctcccgcccggcgtgtcagcgcaggatcgccgcctggtgccctggcccagctcgtgtctcgctacctccccggcactagaccgccgcttggcctgtctcccgtcccaccctccaggcccctagcttgtttggtgctcgcggcttgccacttgcctgcttgctacacgccgcacacccatggggccacgagccacgttgcctcgtgcctaggggtggcaatttccctattgggtccggtgacccggcgggaacccgtccctacggggtcgggaccgggggagaattctcaccagcaggtgagtggggacggggccccgcaaaattccgaggataggggtggggatcagaattaatccgcgggtgacccggaggggccccaaatatatatgagttacttttccaaaattagcccatttcaataatatagacccaataaacccatttaaaattgacatataaaagctcaatatcctagttctcctcaaccgtaatccatttccttccttcaaccaaccctcaccgccggaggctattgaaattttatcacactattattcagtgtattacaataaattttacagagtattaactccatccgggtgatgcggggccctgatcactcgccggttcccctgtgggggcaaggacgggtgatgtttttcactcgacttcctttgtggggccgagggtggggatacctgcaagagggcgggcgggggtattccagcccaacccggccccgccccgccccattgccacccctactcgtaccctcgtcagctggtgttgtcgccgggtgctggcctcctcggcaccttgcgtccttgcctgtccaccgtgcacggccgtctcccgtcgcccatcagccgcccccacacccgtgcctagctaggtccttggagatttggagaggggaggtggggagttggcagtggccaattgaggaagtagccgagtgggccggcttgacctgttggtttggggagtgcgccttgcttcattgcttggagtgtgttgggccaaaattggaagattgagctcatgggttgctcttcttagccagcccaaatcgcgaaatacttcatcttcaacctctagcctcccctccagccgatgttgacgatctgatgaaccttcagcccccacatcccatggatctatggaagaagtttttagtggggggtttatggaggtctccatggttccggggttgatagtggggtctgaagatccctctcctcccctccctccccgcgcctccacagtaaatccatccctgctctcacagcttattcccttagctttatttcactttatttttctttatataataattcttcatgcttgtaaaacttcctttaacttctgctgtactcaatggaattgagatactttaagtgccagttaatgaaatgaaactttaagcacatatgaaaacttacagccatgttgttaataggattagggtgcaaactcccgtttttggtagcactttattggtggccagagtcgtccatcaccatcactcatggactgttgtagttgtgttccacattatcgattcaatctcctcgagtgaggtctacattgataggatatcccatatcctcaaaagttaatcaaccaatacataaccagggtcctattagttgaactgcagatggtaacatcttttctcaagttaaggcatacgtggtttagcgacgacatgtagaccatacttgagatgaacagctatcccattgacctcactcatgtctactggcaacgcccatgcttggctgcccctcctcctgtgatcagttgccgccgcctcccagtcaaaatggtagagcaagctcgcgagtgctatctccatggctgacaccccgaacacgatcccggggcaccccctcctaccggcgccaaatggtagcagctcgaagtcctgtcccttgtagtcaatggtgctgttgaggaatttctccggtgagaactcgtccggttgctgcccccatgctgccgcgtctcggccgatggcccacgcgttgatcaccacccgcgtgtgcgctggtatggtgtaacccaggatctgggtgtccgccggtggctctcgtgggatgaggagcgggagtggtgggtgtagccggagcgtctccttgaaaacagccttgaggtagggcagcttgtccacgtggtccttggtgacatgactagtgttgcccacgactgcccagatctcgttctgcgctttgcgcatggcgcgtgggtggttgatcagctcggccatggtccatgccatcatcgtggtcgtagtgtctgagccccctacaaacatgtcctgctcgtgtccgtgaagcaagaagcatatcagctacggaaatttcacagtaccttaacctcaaggtatctaaattttgcactaaattttttgatacctaattaattagtacctggaggtactaaattttatactaataaatacgatacctcccgacactgttttaatatggtaaaattgccctatcagctatattaatattcagtattcacttttgtcataaatatgtgatatttagaataaaattttgttaatcttttaaaactttgatcattaataattttttattgcctagtttgaaacaagaaacatattttgcatacaattaccttaaaaatcactacaattacacctatttaatattataaaattgttccaagataacatgatgatcagagttttaaaacctttggactaaggagtgctagtattccaactagactatagctcgattcataccatgataatagccttgatttcgacggtgccgagctgaatgccagcgtccttgtccgtctcgttcacgtcgagcaacacgtccacgaaatcccggtgatcgccgccgccgtcgtcgtccatacgccggccgccttcacggcggcgacggtgatcgtcgatcaccctctcgaggatgccgtccagcgcctcaaacgtgcgctgcaccttcccgtctatccccctcaaggcgtccacccaccagaaccatggcaagagctcccccatcggctccgtcccgagcaacctcgcgaagtcgtcgaacaccttcctcagctcgcgccccctgtcgccgccgccgccgccgccgcgcgcgctctcgtcgccgaacgcgatgcgcgtcaagacggtgttggagtaagcgatgaggaggtcggacaggtcgacgacgacgtcggcggcggcggcgcggacgcggccgacgagcgcggcggcctcctcctccctgacgcggcggaacgagaggacgcggcgcgcgctgaggaggtggaccacgcagatgcggcgcgcctggcgccagtactcgccgtagggcgcgaacgcgacgtcgcggccgccgtagagcagcagctcggccatggccatcctgggccggctcgcgaactccatgtcccgcgaccgcatcacctcctcggccgcggccgccgacgacacgaccaccacgggaacgcggccgagccgcagcagcagcaccgggccgtgcgccgcggcgagggaccgcagtgcccggtgcggcagcgcgccgagcaggtggaggtggccgagcagcgggagcccccgcggcgacggcggcagcctccggcggcgccggccatcaccgccgtcgtcctcccacctcgcagcgccatttctcgtcgtgtacttcacggcgggaagcagcacgaggtacaggagcggcgcgacgatggcgaggagtacaaggacggcggggaggagtgagacggccattgttttgcgcgcgtgcgtgcaacggaaagcgtttggttacttggttgtagttgcgcgcggcagcagcatgggactattgataatgttgaggacggaaggaagggtagcaaatcaacaaccagaaactggacgggctgacggtgacggcccctcacgaaaagtatattttctggtggtgaatgggagcaagggacaagtgataatgttgaggaatttttcgtttttaaatataactcatctctcacgatgttgtacacgtactatatatactaccgccatatctctaaagtactataggtcccatactcccatccagaaaattttctctattatacccttcaagtagtgctagtggtagagccataatttttctggaccttaattgaattaataaaattttgcctttatcttctaattttttgaaggtttaaaatgaaatttcaatgaatatttaggatcggctacagctctacctgctctactcctatctccacccgggccttcaagtaccactccaatcctaactatacatcatttataaatgaatggaactattattttttccttaaattttaacctatgctaaaatatatagaatgataagtactccctccattccataatataatgcacaaccactttttttagatgttctataatataaggcatacatgcatgtaggccattaactatgatcacttcttcattaaattattacttttttaaatcctccactctcatgttctctaattctattctcactccctccatacttgtaaaggaagtcgtttaggacagcgacacggtctctaaaacacaactttgacttcttatttctataaaaatatttattaaaaagtaatatatgtaaacttttatgaaagtatttttcaaaacaaatctatacatataatttttacattttcaaaactcaacaacttgagagttattcatgatttatattcccaaggtttgacttaaacattatcttaaacgacttcctttatgagtatggagggagtatttattaggatgatccaaactacaagatgataataattattttcttggtctttgagttaggagtggttatactttatattttggaaagaagggagtattttcgaacggagagagtacatgttttaaatttgtttgtgcaaatatgcatacctcgcgggctagggagcgcgagggacgagggagtcgtcaccctcgaagacgtgagacaaatggaagagatggtggtgcgatgccatcacacgtgaccgctcgtggatcggggacgtggaaccgacgcagtcgcgcaaattggtcacgccgaatggcagacggatcgatggcgattaaatagcgtggtcacttttcgtccagctaattaactagcgtggttgctttcttccatagatttattagggagaaaacttcaaatctggcgctcgattgttctaaataaatcaaatgatccaaatgtttcagttgaccacggtaaaaattaagttacacatggtggaaaacaaataaagtcactgaatcattgaaaacttttgtgaaacataataaaggcacacgttgaaacatgttgctatcacgtatgtgtcgacgggggatacctgtaaactggatgaatagggtattgggatacgttggtacgaggatatacatgatcgacatcaagcaaacaagaagacaaggattatactggttcagacccctcataaggtaatagccctaatccaatttatataagattgatatggaaagaccatagattacaaatagagaaccgacgatcccgagattaccggcgagatcccttgtcgagatggtctcgacgagaagtcccgcaagtaggctatggtggttgtgttggcagtatgattcgatgatctaaacccctcagggggtgtgccttttataccgtgaatcaactaagtctccaagtagaactcggagactatggtccccacatgatataatataaaccttatcttctccaagtaggactctgatattcacttgcctgtgagaataatttccataatctcttgttagttttattatcatatacggaaacatatcatatactcgaaggtataccatatccgtatattccataagtcataggatatgaggtatgtcttatctgtaaccatgacagtatgacacatcgagtgttaacggattgaaatatatgttttttcattagaatttaaacatgcgatacttgttataaatatttaattataacaaatataacgatgtaatcggataagtaatttagaagaaaaatcgttttgaagatcgttaaatacatgcaggatggagtggagggagaataggggtgagttttgtgaaacacagtgaaaatacacatgtaaacatgttactatcacgtaatgaaacatctagttttatcataatatagttatacgatatcttgttgtaaagatttaattacaacgaatataatagtgtgatcagattgtagatcaggtaaataattgaggagaaaagtaattgaagagaggaggagggaaggagaagaaactagcttagtgatcaggttgaataaagtttaattttattcagtgaatggagccaccggtccaaacattcttcatttgttaggtatagattcatatagttaagctcgatcgatgaattcgatgtagatttcttaattaaatcttgatttttatacgtgtcgcatcaattttcttgttcattgcgacaaaattaaataaattgggtgccaccaggccaacacacgaccaatccgcgggaccacgtgtggctatagattgcaggccgcatcacaccggtgcctcgtccgcgacggcgcttgggtaccgcgctcagggttagaaattccagttgaaaatttcgaccatctgatatgatattattttgaccaaaatttttaatattttttaatctaaatatatataaagagaacaacttatttctatggttagggtgaaacttaaccattgtttcgcagcagcttgcgagttatatgtagtcattatcttactcaattcaggaaataacatctccaggatcaatatccgattattttgacgattgaatttcaccacatcagcgtcaatggctgaagtcgaattgaagtgaaagataccgtcagatagttactgagttgtaatttgtaaatcagttgccggcaaatgatcccacttaggcacttaccatcagaacaacttcggtgatgccgtgatggtggatgtcaatgtcagtggtgaaaatacacgacaaataacgtttccttttcctctttctctatttggtaaaatagaaaatatactaccaatgttttttttactaggggtttaatttggccattgacatagtatctaatttataaccatccaccattttatttttatctattttcttaatctttgtacctatttaaaggtagctatatttaaaacacgagagagtaattatagccactggaaataagataaaaattaggaatcgacaaatagcaaaattgtcgattttgaggcatgttgaggtgagatctaattcgatctagccccctagtgcatacaaagttcaaggccgatgatcagcggctaactcaaaaaaagtggcaccatttttttttcactttgtgatttttaattaactcgttctcatataaaaatat

SEQ ID NO: 58976 - DNA, 1551 bp, Oryza sativa
ccaatagtaattttattactatgaattagccgctaaatatgttagaaataattgttttgagttttataaaatccattcataatcataatcattgccaccttatttaattacttattataggagatgccttgattgattgtttaattatctgcccaaacccctccatatctgtactgatagtaatttaattactatgaatcagccgctgcaaaatttccgtatgcatgtacatatgttgcttttttaatctaaagtccttttatattttatatatattacaaataatagtactgagttttataaaaatctatccataatcataatatttgccaccctatttaattattatttatattcaacaaaggccaatgtcgaatccatgagaattattttaatttgtagtaaatatttaaattgctattttttttgtcaataatattctttcgatcctggatggatagcaacgaacgtttcctaaaggcacgtttttttttcttggactaaccagtcaatcggattgattccccatcttccatatcctttctgtttttatcgctccgcaggcggcggcggcggttcccggcgaccgtgggcttgtgacagaggacaccggaggggtgagccgatgacctgattctgcgtcccctgaagggcttgctccgacgacgccggactgatcagcctaccgccggtgacggtggcttcagaatccacggccagccaccattgtttcaaagaatcctgaaaacgtgagatctgcatcccccatccctacatactcatctcatctatctatttaactatcatcaagcatagcttcatcaatccgtgcatttttttttggatagattcaagttgctcatggttcttttaatttcacccatccttctgtagatgaagcggaagggcaagatgccagaaaaagtcaggagtatcaaattcactgaatcacaatccataactacctccctacattcccattttttttttataaaaataacatttaataaaaaccttcgaaattacagcgcacaattcactatcaaagcttccagaaacagtaattttaacgtccagtaaaaattttactaccgactcaattaatatattaaaaaaaccataagtaagggcaaaaatcatcgctgtgcactaattgaatcaatagtaaattgttttctaactgaaaaaatgaggttcttatcgtaagataattactaaatcgcacgtaacttttccctccgtgatgacagtgcgatcgaggatgagattctgcaagcatctatcaacaatagtacattttttgctaacgatatatttatatagtcatagtaaatgagttactaagtcaaaccttcagaggttacaggtgtgacacacgcgttactcggctcgttattgcggaagcaaaccaaataatcctcagtaactccattactgctagaccaaacatcataattaagtaactactttactcacacaaactaaaaaatattactcggttggttagtgcagaagcaaaccaaataatcttcagtaagggctgcaggaatt

SEQ ID NO: 58977 - DNA, 2362 bp, Oryza sativa
acaaacgagaccacacgcacagtgagaggaggacataaaagcagaagggccccattttaaaagcagtaacaagcattgagagtaggcaataaaataaggccagttgtgttcgctaggggaggatgagaacctgcacagtacgcacggagaacgatgtagtgtatcagcgcgtgattaattaagtattagctattttttagaaaaacaatggatcaatatgatggtttaacaaacattcgtatagaaactttttgcaaaaaacgaaccgtttagcagtttgaatcacgcgcgcgcgaaaaaacagcctctcaattttttttcatgtttcccaaatagtaatgtaaaattttgataggagtacttatttgtcaagaaagtactacccctgttttgttttgaacttctttaaatttgggcaagtttataaaaaaaaattagcaacatctacaacaccaaattagttcccgttaaattaacatttaatattttttataatatatttgttttatgctgaaaatattgatatgttttcctataaacttggttaaacttaaaaaaattatctacgagaaaaaaaatcaaagcagactaatctatacttctactacttaaaaagaaaaaaaagtttcagtctatgtaaagataacaaaaaacacatgcagaaaaaaaaatcctctgagaaaaaactattagaaaaaatcggtgtttataaaatatccggataaaaaaaaccaccagttataacaaaaccgtcttattcaacgcgagaaaaaaaaccaccgcttataacaaaaccgtctgactcaacgacaacaaaaaaaaccatgtttataaacaaatttgcaacaaaaatactccaaaaaactgtcagaaaaaaatcattgtttatataaactatgaataaaaaaccatccgactgtacacaaaaaatcattgtttatataaactatgaataaaaaaccatccgactgtacacaataaaaaaccactgtttataaaatttctgtgcagaaaaaaaaacgctcaaaaaactgtcagaaaagatcgttgtttataaaaaaatacggataaaaaaatttcctactcaaagcaagaaaaaaaaacgccgtttctaaaagaatagtttgagaaaactgtccaactcaacgcggaaaaaaccaccatttataaaagaactgtccaactcaatgcgagaaaaaaccacggtttatgaaagaaaatctgtttcgaaccgtgcaatgcgaaaaaaaaactttcctacttcgaagaaaacatctgattcgaggaaaaaaattgtaacatttatatcgtcaggtctacgacgtcggtttggtttttacaaagcattggttaaatgttctgatgttctgatctaaaataagtcttgcttgagccttttctttctccgaacgagatcaaattaatggatgcttgggtaggatagaatccatagattgtttccatctcttacacgacttttgctccctcatctattgtcctgtattggaggttatgcccatctatagataattattagactactttgttaaatatagctactattctttataacgtatcatatgaaaataataaaaaaatatatgtttttaatttttatttagagaagggtgcacggtggctctattttgtttagagttgaccatagaggccgtgtcgatttgattgatcctattattattggttgaaagaattagattgaaagagtatttcagattatatgcattttactagataaataatccaattcttttgggtaaagcagccattgataaggttaccaccgtcgagattggaccattacattgaagatgttcccgtttttcttatgatatgtcttagctataacaaccgatataaatattatcattgatatggttatgtatgaaaagcgtattttataatcgaattttttttcatctgttccaacgcacggatatttttttttagtatagtagcatatatgcccgattcatacgtaccagtataatggccttgatttcgatcgtgccgagctgaacaccagcgtccatgtccgtctcgttgacgtcgagcaacacgtccacgaaatcccggtgatcgccgccgccgccgtcgtccatctgcctaccgacctcacggcggcggcgacggtggtcgtcgatcaccttctcgaggatgccgtccagcgcctcaaatgtgcgctgcaccttcacctccattccgttcaaagcgtccacccacccgagccatggcaggagctcccccatcggctcttgcccgagtagctccacgaagtcgtcgaacagcttcctcagcacgcgccccctgtcgaagtcgccgtacaagccacgcgcgctctcgt

SEQ ID NO: 58978 - DNA, 3583 bp, Oryza sativa
attcgcaatgcgatcatgcaacagcagcagtgggagcaatttcaacgggaacataaagattaaacgcatctgaatcatatatatatccatgatggttttcgcgacgaatctgtgggcacggctcctggcatggttgacatatacgatatgggaaactgttaacagctcgaatagacgtccacctatttattacatgtccagtacgatatactattttctcatcattcgcaatgcgatcatgcaacagcagccgtgggagcaatttcaacgggaacgtaaagattaaacgcatctgaatcatatatatatatatatatatatatatatatatatatatatatatatatatatatatatccatgatggttttcatctgtgggcacagctcctggaatggttgacatcaattcgtccatatcaggaattggattttcatttttagaaaggatatcctcttttttttatactacttaaatagtcatagaaaagcttataataatttgataacatatattagcatgaaatatatcactccatgaacatataaaactaaattgaacttctctacaagttacaaaacaaaaaacaaattaaactgaaaatagttaatgcatatacatagttatatttattattattaagtaacgtgaacggagaagttgaattggtatttacatgtttgtaaagtgatatattttatattaatctattttttttaaaaaatttttatatgactatttagatgacttataaatctgcatatagatcatgcttaaattcatatagaaaatttagtttttattttacaaaggaagtaacatggcagctagtgcatccgtgcgagcctccagtttgcagtttatctatctgctctattattactgcataccaagaggagtttatattcttttttggtgtcgctgcatatgcctaccgcacatgatggttgcccaccgaagcacgtacgggttccctcgtgcaccgggtgtgccaagaggagtttatattcgctcttaacactgtgcagaactcttgacacgtacgtttccggtgcatgtacgttttgtacttcatttctggacgatactgcaaattgaatagtgatgatagcctgtatgttgaactcttcttccctcccgtctctctcaaatggataagataagagggatatcgatgtatatatgttcatattcatcttcttatttatttatttatacatcctatagttcaaaaaagttgtttcactcatttttcattctttcattcatcactcaagcgtcaagggtccagatcatctcggtaaaatccaaacggcggagatcgatcccacctcccacctctctcaatcaccgcacgccccctctccctcaatcgcggaatcgccgctctctctctcgctctccaactcgcacctgcgccaccgccaggattccgctcccgcacgcgctgacgccggaaagagctccgccatcagtgctcccctctctatcagccgccgcgccgtcatctgcatcgccgatctgccaccgatccccgccgccggctcgccctacacgatccccatcacccgtcctctgccaggattcacgtcgtcgccgatcaccgtcctggtccaccgatccccgccgcacgaagtcctcccgacgccaggtcgccaccgacgccttccgcggtgatccgatctgccaccgatccccgccgcacgaatcccttcccgtcgccaggtggccgccgacgccttcagcggtgatctgctcctcactgcagacgtcgccaggaatatcttcatcaccctcatgccatgcggcccttcatcgcatcgcctccgccaaggcatatgggaggtatgggcgtctgatcattaagaataactgatgagatttgaaccatttttgagaattgctgtggcaggagttttttgcagttactatacgactcaaacaaaaatgcatgtttgctgccatatttacattgttcatttacacatgtacacctgggatacgcttttcagaagttttttttttcaaattcatatgctcacttgctgttattctcttctagatagacttgttagaatttttgttagaatttatctcgtggtttacttcctccgtttcacaatgtaagactttctagcattgtccacatttatttacatgttaatgaatctagacatatatatgtattcagatttattaatatctatatgtatgtgggtaatgttagaaagtcttacattgtaaaacggagggagctgaatggaaacatcaaacccgtacagataacccattggtaaaaggcatatgcagcggcccattgaggttttgtcacaaactgtacttccaaaaaaacaaaaaaactttggctcattcgttctttaccgcagttcatgtatttgattccattgaactttcaagaacaagtcccaaatgttgcatgagaggccgcacgtctactgtgacagctcttttgatctcatacatacttatctttcatctcatgtcctttcaagcttctgaataaacttataagatctgttcagtgaagtttatgtttctatttgttccgtttgggtatgatttattcatcctaaatgttagatcatttacttttaagcaatattacacaagcagctgcaaacgatggccattctgttaatcttgtgattttaattgttcctttttgttgatttttcagctgcactaactatattttctttagtatgtgttatggcacccacacaggcttttgtttctagagaagagtatcaatgataatttcttctgacatggcaggtaaatctccaattcaagggggctctgcgcctttcctcaacaagaaaaggtgaattttactactgcaactataggttgaatgcaactatcttgagtcgaaagttttcaaatatgagttgaaagttttttaaatctgagttacaagtttttcaatctcgagttgaaagttttcaatcttgagttgaaagtttttaaatctgagttggaagtttttaaaatttatcttacaaatttgaattttgagttaaaaatttccaaaatttgagttaaaagttttcaaattttaaccttaaaatttaaattttaactcgaaagttttcaaatctaacttaaaaattttcaattaaaaaaatcttttcttaatacattcattatccttaactaaccgaattagttacgttaactcattgaaaaaagaatccgaaaaaaaagaatctgcgtggcgtgcgcgttgccggcacgtacgcgccggctaccttttcactttggcaacgcgccggctaccttttcacttttgggtaaaggtgcacgtgtgtatatgggccttgtgttcgcattttcacttttgggtaaaggtgcacgtgtgtatatgggccttgtgttcgcattttcatttttgggtaaaggtgcacgtgtgtatatgggccttgtgttcgcatataattatatgggactacctatacatttgtcgacaaatttttctctaaaaatttgatagatgtaattatagtacaatcgtagtgtaattacactggtacttgtttgtgagtacactgtaactggaatgt

SEQ ID NO: 58979 - DNA, 2944 bp, Oryza sativa
tgtaattacactacgattatactgtaattacatctgtcaaatttttggggaaaaatttatcaacaaatatatagcaaaatcgtaattatatttgtaaaagaatgaaaaaaatgtttttatttgaggccgtagttgagataacctattattgtgagtcctcggctactgcctttgcattttcggagttcggacttcagagccgatggtaattgggctcagtatgttgggtcttcagttcttcacgcggactcttctgggccatttttgcaaattaaaacaaagattataagtctagtattagacgaatgattttactgttcttaataagtataccatgattctattgaaaatgtagtatctctcaatatttcagactagaaagataccaaattcacataatttttttatacttcgcaaacggtaaaatttcttataacagagactgcatcaatttcctacaaaagacagacataggtatgtatgcatatactacttatcttaaatccattattaattgattattctatagacggcaatttaactgcacaaaatactatacacacacgtaggtatatcttcagcggaacataagaaactcgtttctaggccttgctgcaagggagcggataaagtgggtatgacataatggagactattcttagtatggtgacaattttttttacaattgtgggtggatgcttactattcttactatctcataatataagggattagtatatcgtttttttacaaaattgaaagaagtagcaaaggacagctactcgtgatataaaagatgataatgaggagaataaactagtataaaagctagtacgtgaaaaataaatagtataaaagttaatataggtggaaattaaaatgctgtctttaggatcacaaaatcctgagacgacgaaggaagtaataggctttgtgtttaagtgtttttttccattcaagcttgaattttgtgaaagggtgctactttattaattagcactgttgatcttaattaaactagaactacttcacgcatgtcttgtatatgcagagattggaataaatctattcctttacttataaaacaaaaacattcactgtgcaaactcatatacatacatacatacatacatacataagcagcatcaacgcagtcacacaaatgaaagtttgaaacacatagaaaacataataaatttataatgagatatagtatacagagaaattaattaagatgctccaggagaccacggcttggcaactagattcagatccgccttgagacgcacggacaatccgaacagctcgtccatgtccaatctcgtcgtcgccatgatcccgctggccgccggcggtggcaactcccagtcgaagtggtacagcaggttggcgagcgccagctcgacgctcagcgcggcgaacccggcgccggggcagcctctcctcccggcgccgaacggcacaaacctggagtccttccccagctgctgcgcgtactccacgccgccaccgccgccgccatcgagccaccgctccggcacgaactcctccgcggaatcaccccacgccgccgcgtcgcggccgatggcccacacgttgatgatcacccgcgtgcgcgccgggatgcggtagcccagcagctccgtgtcctccaccgtctcgcgggggaggagaagcggccccggcgcgtgcagccggagcatctccttgatcacggccctgaggaagggcagctcgccgaggtggtcctcggtgacttggccgccgccggtggcggcggcggcggcggatgcactcgatgtgcccacgaccgcgcgaatctcatcctgcagcttgcgcatcacgcgtggatggttgatgagctccgccatgacccattccgtggtggtgaagctggagtctgtgccggcggccatcatgtcctgctcgatgaacctctcattcatgcatgtcacacgtggtactttctctgtttcatatataagtcgttcctcttttttcctaatcaaactttgttgagtttgaccaaattaattaaaaaatatactagtatttttaacataaaataaacatattatcaaactatatttaataaaactaatttcatattttagatattgttaattttttctataaacttaatcaaacttaactaagtgtgacttaaaaaggttcaaaagacttatattatgaaacagagggagtaggcatgtttagctgtgcatgtatatatcatattgcttggaatttttcatgaaaaattaagtgttgtgtagtagtgacagagaaaattgagatggcatatattcagcacagatcactaattttgaaaaaaagcaaatccaatggcatgacttggtgttagatatagctctctatgaataaaaatctagaaaatgaggtgtataaatatctagaaagcgacgtttgcttagagctttgggtggatgagaagaaattaacatgagatttgtgatctcggtcttcttcccggcccagcagtggtgtccttttacacttctccaacaacgacatgatgccgaccaggagttttggggtaagggtgaaaagaggttttcttcacgcttagcagactacaagtatgtgacgatgacactagcctagtggagaaggggtttttctcccagcgtatgggcgaagacacgatggaccggtggtgggcagccgaaaggactatggtgtgcacatatgactcttttgtagtgggtcacatgcatatgcaattatgcatatggacccgctcaatgtaagacctacaaagttagagggcaatattttagaggatctttttttctatgttcacaacaacggttggatcatgaacctatgggcaagagggctaggctggtggacaaagtcaggcgttagcggtgagagcgtgggatctagagtggttgaaaagtagagcggccatggcatctgc

SEQ ID NO: 58980 - DNA, 8120 bp, Oryza sativa
gcgaacgccatgtcgcggcggtagaagagccgctccgacatgcgcacctggggccggctcgcgaacgccaggtcccgggtcctcatcacctcctcagccgcggccgccgacgacgccacgacggcgggcacgcggccgagccgcagcagcatcaccgggccgtgcgcctcggccatcgaccggagcttccggtgcggcaaggtgccaagaagcgggaggtgcccgagtagcgggacacccggcggcgacggtggcagcggcagccgccggccgccatcgccgcagggcggaggaggcctcttcttggtcgacgagacgatcagccatgagaagacgagcaggagcacggcaaggaggaggggtgagtgcaacagagcagcaagcgacgagagctccatgtctgaacgagtgtactcggctcgatccgcttgtgtccaatgacagtgatttaacatcgccgaataatttgtgttgatggaaaagccaaaatgctggttgacgtgattaaaacgaagacaaaaatgtagctctcgcgtatagttgttattgtagaaaataagcgtaaaaggacatgtctagtggttgcagtgatctgagtagtatcctaaggttttgagtttaaattttcatatgagcgaactttatattaggttatttgagggctaagtttctaatttataaaggttgcatatatccggttagatgtagaggccgtgtaaaaaaaataccctttctctaaaataaataaaataaaataaaaaaagtagaaactaagcacaatccttccagagaaattggaaaagtcacgacagtaaattgaagtctacaattctatatacacagacggcccgtttggttggagggagttttcaggagggattgggagtttaaaaggataaggatattaactgctttgtttggttgggatacatgggaattttggtgggatgggggtgaggaattgagggaggaactccctccttttcaatacctgggtagggggtggtaattgggaaggaattcctcctttactttacctaaataaatctcagccatccgttttcattaatgacctaatttccaactaaactccctatcaatttccaccacctctaccaaaaaagatactgggattaaaaatcaaatttctatcttaatctcaccatcaattcccttgtataaactcccaatccccttccctcgcgttgtcaaacaagccgtctagaacctctacaaagtccatatggaatcaccatcatgttctcaaaaaaaaaaagaaatcaccatctttggaccatgcattatatggctggaaataagtctattttggtcactcgtctatttaactccctaatcattggaccaggtcgtgccgggtcggcccatcatgccgaggcaaaggcccaagcacggcctaaagatcgggtcgtgccgtgcttgggtcgggccaaaaccccgtgccatgggtcggccttcaacatccacaaacactgaaagtcagtgtccgagtcggtatatgcatggtagaggcccttccggccatatccgttccctggtgcttcatgtttgatcacgaaagtggaaataaggatgttgtcgtatcatacggggtctgttgtctctgagttctacttggagactaaggtgatctgcggtataaatacatatcatcgaatcttagtgcaagacacccaccacagcaggagcaatccagaggactacttgaaagccaacttgcagataggtctcatcaagtagttctcgacagggatctcattggtagtctcgggatttttgttgttctctattgtagtctgtagttttcttcataatcccatataaactagattagggttattaccttgcgagagacctgaaccaatataatctctgtctcttatgtgcttgatgtcgtatcgtgtagatcctcgtatcaacataccccaatatcctcagaatacggtccgcgagtatccccgtcgacaatagctgaggaggctcgtgacgcggtcgcgccggtcgccgttgagccgcaggggtgaagtgtggtcgagcgggacgagaactggcgggtcaaggacggatcaggaaacgaggtagcggagcttgtccttgaagatgacgagaaggggatgatccggggtggtgggcgcggaagcagaggaggaaaccgtagtcggagacaaggcggcgccaccgcttgtagacgaggaaggcacgagagatagaggacgagtgcgaggggaggcataagaggatctcttggatgaggtcattgtcatccggcggagagccaacctctatatttttctttatctctcttctccatataagattatattagccttggggtagtcccaaccctccacctcaactagtttacataacattaatatactatcacataatcaaaaagctaggtggcaagaggatttactgatgagagaggaaaaaatattaagaaaccatttttcatgaaaaaaattagttttatacaggaataaagaatgaaataagagaatacatggacgaatgcagagagaaaagaggtgattaattggatgataatttattatgaagaaactatctatcgggtatacagtttttatgcatgcttagtgtctatatgacagataaatatggattaaaaccattagataatttctaggttgggactgccccactattatcattgctctaagttcatgtgcactctatctacgtactaagccattaaatgctttactgatattatgaattcatgttataccgagaacataatatatattgtgcttaactaaaatataaaaagtatacactaatgtcaaagcaaatctaacggtgaagcacgtgtaggtgcacatgcacttaccccttaaatatagatgaccctcgctacacaaattatatgttgcaataggcacagatggtagctagcctgcctagcagctttcatactgaacacatcaaacatcggaagaccatggctttgcgactagattcagcgtcgtcttcattcgcatggacagcccaaacagctcacccatgtccagcctcgccgccgtcgccgccgccgctccgtcggcatgtggcggtagctcccagtcgaagtggtacagcaggttggtgagcgccagctcgatgctcggcgcggcgaacccggcgccggggcaccccctcctcccggcgccgaacggcacgaacctgaagtcctgccccagctgcgccgcgtactccacctcctcgccgccgccgtcgagccaccgctccggcacgaactcctccgcgcggtcgccccacgccgccgcgtcgcggccgatagcccacacgttgatgatcacccgcgtccgcgccgggacgcggtagcccagcagctccgtgtcctccaccgtctcgcggggcacgagcagcggcaccggcgcgtgcagccggagcgtctccttgaccacggccctgaggagccggagctcgccgaggtggtcctcggtgacttcggcgccgccggaggcgccggggacgccgacggccgcgcggatctcgcactgcagcttgcgcatgacgggagggtggttgatgagctccgccatggcccattccaaggtcgtgaaggtggtgtctgtggcggccgctatcatgtcctgctttttcattgttcatatgcgtcattcattaataattgaaatgtatcttaaactgtttcaggttacaagactttttgactttgatcaaaatcaaactattttaaatttaactaagtttatagaaaaaaataataatatttttaactcaaaacaaatttattatgaaaatatatttaattattgatttaaagaaactaatttgatattataaatattattatatttgtcattaaacttagtcaaatttgatgtagtttgattttttctaaagttaaaacgtcttatacctgaaacggatggagtaatactgcagtagttgtattgaaaagtgatatgaaaaattgaaaacacggtttaatattggcaattaatatgcatcacgtatcactatgactttgaacatgatactttgaaccagagccaagatagatactggtgtggtgtggatttattgtcatggaaactaggattatactccgtattatttggactttgatgaagtggaatatttagaagatactccatgattttgcaaaattatatgagacggtttcgatcgcaataatcaacgtgtcgtgtcacaacgaaaggactcaccaggataatggccttgatggcgacagtgtcgaacagcagcacttctccggcgccggcgccctcctccacctcgctcacgtccagcagcacgtccacgaagtcccggtgatcaacgttctcatcgccgtcgccgtcgccgtcgccgccgtccggctggctgaggcggcggcgctcgcggtggtccgcgatgacacgctccagcaagccgtcgagctccgccgatatgcgcgccgccttggcgtcgaggcccatcagcttgtccacccacgccagccacggcacgaactcccccaccgtcgccgtcccgagaagcgcctcgaagttggcgaacagctccctcagcttctcgccgccctcgtcgccgtcgaggccatacgcgccgtcgccgaacgcggcgcgcgagatgacgccgttggcgtaggacatgagcaggtcgctcaggttcacggtctcgccgccaccgcgaacgccgcagcggcgccggacgcggtcgaggagcgcggcgacctcctgctccctgacgccgcggaaggaggcgatgcggcgcgggctgaggaggtggagcacgctgacgcggcgcgcctggcgccagaactcgccgtatggcgcgaacaccatgtcacgcccatagatgagccgctccgccatgcgcaccctggcgcggctcgcgaacgccgcgtcgcgggccctcatggcctcctgcgccgaggccgccgacgacgccacgacggtgggcacgcggccgaaccagagcagcatcaccggcccgtgcgcctcggccatcgaccggagcttccggtgcggcaaggagccaagaagcggtaggtgccccagaaacgggacgccccgcggcgacggaggaagcggcagccgccagccgccgccatcgcctggcttcttcgccgacgagaagctcagcaaggtgaacacgggaaggagcaggagcgcggcgaggaggaagagaggtgagtgcaacacggcagcaagcgacgacgagagctccatttctgaacgagtgtactctaactcacctcgatccgttcgtggggaatgggaacaaatctacactgaaagggaaattgtttgtgatgtacaatgtttgtattttttttttctttgaaacgagatttatttcaaaaaaaaaactaaattcagacaataaagacgaaaatgtagctctcgttggggaagcatcggtgatgtgctgacggaattatgggtgtatgacttcacctactgtagtttaaatcctggtggctgtaaatattacgcacatgtaggtgagcttaaatattggtgcccacgactattacgcacatacaggtgaactttcaacaagactttaataatttcagtagtatgtcgttggtttctgtttttagagcatgtgttaggggacgcgtaggttttcaacaggactttaatgaaatcaataatataccgttggtttgagcatgtgttaggggacgcattcacatgtgtgagtgagatgttacgtgtgtgctcacgtttgccatgtaatcaaaagaaaaattgtagctctcgttggtcctggatatggttgaaagctcaggacaaatgcacgatctttccagagaaaaaagggcaatttcacaaccgtattttctattttttgtggccaaaaaacagaacctccaaagtccaaacgagcaatgaattcgatggatcaaaatgtagtacagagcacggacatgaactgtacatcaagcaagacataatggaaggattgtattagcaagtagcaagccatatagatacagatctggcacgctctaccatcaaaatgggcagagaacagaaccagattgataggttgttctgtcaatttacaagctttcacagaacatgttttggtctctccagatatgcactgaagcaatcaaacagaaaagatatgtgcactgcagcaatcaaacagaagggtagaaagactaaaaaggtatcccaactctagcatctagcagatacaaaggtaggagtaaaaacagttacaaatgaatcttctccaattatgttggagcactaaaaaaacaatatgtagcattggacatagatagaggctttcaaactaaagatatcacacagtggaagaggtgaggatgatgatctacaccgatccggtagaatcaactggcgatatcgctggtgccatatcttctagcattcacagcctgacgagcgctgttgccttccagcacctccaacatcaattgtatcaggaagatatctacaaaattatagcaaagtgtcattgaacggcatggtttgcactttgtagttcatctctgcgttagtacttctaaatgctccccttatcaggaaaaagaattgagtttttttaaaattgatgtttctactgggaggctgcaagatacaaattttacctcgatttccattagcaacgcttttcaaactgctaaacagtatatttcatgcgaaatctttttatatagaagttgctctgaatatcaaataaatccaatttttcaagtttaaaataattaaaacttaattaatcatgtgctaatggctttctcgttttacgtgtgcgtacttaaatcttcatcttcatcagattcaaacagggcaataattaacttacatctcctcttccggttcattcttgatagcattccttgctatacactcaaaagcagcctccacgttgaagccttctttagcagatgtctcaaaataagggatgtttcccttagaagcacaccaagctttagctttcttctcagaaacctgggaagaacaactaggttaagaaaagcacaatgcaaatcaggaaatcagaggctaaaggcacttctatgaggacaaatactcacagtccggctattaccaccatcaacatcaattttgtttccaagtacaacaaaagggaaattctctggatctgatgggctagcctgcattgagaataatgattcaactttcaataaacagattgcagtacatttggaattttgggtaatcgataagtaagctacttacttgaattaggaattcctcacgccagctgttgagcctttcaaatgacttggtaacattgacatcatatacaagaacacaccagtcagctccccggtaaaatgccaccccaagactttgaaatggttcttgtcccgctgtgtcccaaatttaagttccaggtaaacacaagtattagcgtaaatgtagacagaattactgtttgacaaatgacaaggtattactttgattgccatacattctagtatttctatgatttataacacttaaaccagcagatattggtaataattatcaggtattgagctataacagcaaacgttggagttactttgctgatttacgagttagatacaaatcgaaaaccacagtctttgttccaataaatgtgggaaagtgaatataatttttggcactgatggactactatcaaagagcattatgggtgtggatattttctccaacttgctgtaaagtgagggtatcattagttccacatagtcaagatgattctctactgcagttgattttgtcttagaaaagcatttgccaattaataatgtaatataatatttactactccctctgtcccaacatatcttcaagcgtttgaaatttgtctcaaaatataaggacttccatagtactacttctcccaccaactaacgctcatttaattttcacccaattttaccccaaaccaccttcccactccccaatcacccaacatttaatgaggagcatcatagtcttttcccttcatcattaatctctctcaagaaaaaatctagaagtccttatattttgggatagagggaatagaacagaatagtactcgcttttcacgaagggaacaacacattg

SEQ ID NO: 58981 - DNA, 1577 bp, Oryza sativa
cgtaacataatcctcattgtagcttatgaaaggagctatgcaatatggcttccaaactgcgtaaatagagtggaataaaaacaattttctagtaaccgctctatcccttctgtcatatttgtgttttacatcttttgtgatctcattaacgtctccaataagcaattacatgatggttgcacaggtatctcacatctcacactaaaataaaacaagagtaccaagcaaaataattacatgaaacctaaactctaactgtcacaagcaaaatattttttcttttgagcaaaacgattttactgttcccccaatattatctgaatccattgttgtctagtagaccaaacctacagtactagtagacggtcaagctaaatcaggtctgcacgatttggcaaaaaagcaattccgaccacaatcagtcaacggtgcatgtgcatcacgccctaatccccaattcccctacttatctgcaaagatctaagcaccccaataatccccccaaaacaaactatcaccgcgcaccaaaatccagctgcgatgaagctgcgaagtgattctgggaaagcagattagaccgaacctgcaatgtgaagagccggtcgtcgatctgcacctccttggtcaggaaatccgcgccgatcgtcgctttgtactgattgctgaacttcttgttcacgtacctgaacaacaaaaacaaaatcacccaaatcattcaacatcgcgaagtcccccttcaaacaacgcctaaaaaaaccctcaaatttgacgaatcggacaacgcaagattgcgcccccttgatcttactggttcatcagagacgtcttcccgaccctgccaacgagaaaaaaaaaagagacgcatcagcgatcagagaaacagaataaatttcgcccagaaagaatatcccccagtagaaattgaacgaaaaggtgggggattttttttgctttttcgcacccgctgtcaccgaggatgatgaccttgaggagcattcgcctgcgcgacgccatgggcgcggatctggaggcggcggacggatcgggcggagcacgaggagggagaagaggaggaggaggagaaggcgagaagcaaagagatgatctttgcgcttctctttgctttgggattggcgtctcttgtgtgctcaagaaaaaaaaaggcgtttttttttggagggatcttttgttcgtttgttgcttggatggtctggctaatttatttatgagatttatttcgtctaaagtgcgttttgaagtagtagatgattagtcacacgtggaatataaaggtaattaaaatatgattaattgagtattaatttagatagttgaaaagtaaattaatttgttttttaaaataataaaatttttccacaaaatacatcgttcagcagtttgaaaaacatgcctatagaaattgggaaaatggtcaaaaccgaaacgtagtgtatacttgtggatgctctatcaccctctaaattttgtggtggttggacaatggagtctgtgtatgtattttggtttctgtaataccctttcgcttacttcttggagaatggagatattgtttgtgg

SEQ ID NO: 58982 - DNA, 2274 bp, Oryza sativa
cggtatttgacgcgcatcccccattgatacggatcgattcgggacgaactcggtgggctgcgtttgctggctgctctctagattgccactgccaaatgccatcttcctgaatttcttcaggtcttcattgtaatggcccgtgtcgtactcgttgctgttgtatgatcccaagaatcggctatggccaggacgaacaccttcgttcagatcatccaatgacacatcgccttccaaggcccgaacaacctgttgttcattgcatcaatcaaacggtagttaggacttcagagactagataaaaatgatatgctgccttcctgtaattacacagatgaatcaattttgtcattggaagtgaaactagtgtagctgatagtccactgtaagtaatatattttgcactgaaatttcttgtcttgtatgaatctgtgctgatgaaaactgatgaaagaaaagaacaggaaccttgaagtacaagaaggtacctggctcatccgtgggcgtcggcgtgcagaatggcgtacacaagcagctgcacaagcaatcatcctcgccatctcgttaccattgtactcctgtcctagccgtggatccactaaagcatcataattgccatcatctgatgctcgcatcattaaaggccttgcctgcaggtaggaggaacaaaatcaattgattgtacacaagattttcaaagaacataacacatgttcaggaataggcatgaggaactcgttatctagactgtagaatttcacaggatgatgaacggtacaagaaactaaagtatagaaagatgtacacgaaggccaaaagtaaacataaaggacaaagtacttcactgaatctggatactagattcgcggaaagtaatgtatagaatgtagttacttaaattttcaaatatggacctcaagatatgattgggttgtattcataaaattaattacaacggatcatcatgtaaaatcaacgataagtatatatactgaaagaaattgcataacctctgaaagtattgcttttctttttacgaaacctctgaaagtattgtggacaataaagttaattagtttcgagaaataacttacccaatcaaccaagctgtcatccatctgtgattggttcgatctcacaggacggcggccagttattagctcaagaagcattactccgaaagaaaagacatctgatttctcagttagctggccagaagacgcatactctggtgcaaggtacctaagggcaggaaaagtattacaagggaactgattttgatacggctgatgctgtaatgcactagcttaaaaaatgattctttattatagattttgattaatcctttttttcgaaaatatgaactgatgcttgctacacaagtagatagaacatacccaaatgtgcccattactctggttgaaacatgagtgttattatcagaagtcaattttgcaagtccgaaatctgccacctgtaaaagagttttacatagcaaattacacattaaactatttggtagtatgcgtatcaactctataactgtaattatgattggatatatgccaactactatttctctgaatttacttatcaggtagacagaaaagtttagcctatatcaaaattgtgtacgccttcaggcagattaccagttgaccatagtacatcagaacagtcaaaaccaccttgccaatgaatggaaggcactgtttgctcacaaaatgtgctttaagtctaatcaaaagttcgcaatgtaaatattgatttgtaaaatctttgatgactgtaattaccaatcagtatgcacttctaaaacagaaaggaaacaaaacacaaaatgtatagcgcacctttgcctcaaatctcgcgtcaagaagaatatttgctgactttatgtcacggtgaatgatcttaggatggcctgtaaagtgtgtgagagaaaatcagtatataataggcatgtatacctataagaagtggaaaatggaaccaaaagaaaaacgagtgatatgggtgttcgctcacaatcttcatgaagatatgccaatcccttcgcagcacccaaagcaatgcgtaatcttgtaggccattccatggttggtcggcctctccctgaaagaggtgaaaatagccattaacaaatgctcaagagcagacaaaccaaatgtgtatacaacatggatttcatgacagattgacagctgtttcaaggcaagtttctggattttacataaaagggcatttgaagaacctagagagcattttctctttttt

SEQ ID NO: 58983 - DNA, 918 bp, Oryza sativa
  unsure (1)..(918): unsure at all n locations
tgtggtgccaaaatcagaagaagacaaaaaaaaatgaagaatgaacagaaagatttgagtatgggaaggcgggtttaccatcctcaaggtgacaatgatcgaagaaaatgctagagaatcaaatggtatgtcatccaaggcaaaaagtgcacattctagcgattcaggtccaggtgagaagttgggggtcttcaatcttgctcggaaaataatgtaactctactgcatgtcatcataacaaacaagatcaacttagtagagtattgagctatcatggagactctgacaatgctaatttcactcacttggccaatcagtggaatatccaactgagcaaaaggtgaaagtatctctacatctgcacaagcttcctccaatgtttcccgggaggctccttccgctgcagactctccaacctccaaataaccagcaggaagagtcctgttgatgcaaccttgattaggattatggaccaaacaacaagcaccaaaattgactgggaatgactgcctatgctttacaaatgactgggaagagacaaaagcaatctcaacattgttgcattagaaaaataggaaaaaggaacaccgttttacatactagaatcatatcagtcaccagtcgatgtgctaaacataaaaaagaagtgtatttaaactggattggcaagagtgaaacaaaaactaacactataatgtaaagaactgtacagttttaaactgaattggatacagcgtgcatgtactaaattgattttgattattatattcatactcaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 58984 - DNA, 986 bp, Oryza sativa
tagcacccaagttgtccgagttcgcgacaaagacatactccttgccctgagaagaatgggaaaataggtaagcacacgagtatcaatatgcaataaagaactcacatatttttagtcatagtattgcattcattttttatgattgttagccccaaaaggtgatgtcatagtttggttactatttctttggaaaacatgtttttattcctctaattttctcaagcaacaagattaatgcagtttcaccaaacgtgaaatggcaaagaagctgtccgtgtgatgaataagcataagcacacatcacacagctcagtgtctgtatctttggagtgtggtgcatgactatgtgcgcatgtttacaaccaatttgaatcaagtagtgatgctaacaacaatgccaacatgaaaggtcaaagcactttagctaacctgtgccaacaaggtatcaagttttccactgttattcaaggaggggaacacatcaccatggcctgggggatacctgcacattcaaaaactggttattcagatttagggaggtttgatctgctactataagtggttatagtcaaatgtataaaccaaagccattttggaataatctgagaatactaaccagccatccttgccagtcttccccttgcttggaagtggcaagaagtcttcagtaacaatgcgaggatattggctctgcatgaaacacgattatgttaattaacaatcaccatggtgcaaaaatgcgacaaatcagaaacatagcacagaagcagctctatacctggttgaaagtgtgaatttcaatgttggagttggagtacttctcaacaatcttcagaaaaaataaaaagccgttagcatgcaagttggcccaaatactaaaatcctagtacatctaaaaaaaattgaagagaaataacaaccttctgtgtgtcatcatgagtgttgaatgagttcattataagcaaagggacattgcatccatactt

SEQ ID NO: 58985 - DNA, 838 bp, Oryza sativa
ttctgtattttcattgtgtttgtggctactgatctttcgccattaagaattaatttcgattttacgatgctttccaggtttgcattgcaagcaagtactgtaccccggttgagctgctttgaagttcagacatggcatcctcgcctcgcttgctcagctgtcaatttgcacttaaattattgcataatggttgcacaaagcacatgttatcagtctgtcggtgcatctgatctgaaagctatgtttagtcgcaagaggaaaaaatactaatctgacagcacaagatgaaccaagaagttggcggagtttaggcgttgattattgttcacaatctcatgtggagaatcatgtctgattgatgcaaacaatcaactaaagtgaaagattattcagacaagtgtactcacctatagacattatcgtggcaattccattcccaatattccaagcatttgagcacaatgccctcttcttccttgatcccagctgatgacaagaacaagattgctgcccttctctcctgtgatacttggttgaatttgttcttgttccgggtgagagatgggccatgtggcccatgtcattgctaaacatgaccggcaaactcatggaacccatattggtgcagttcatctttgctatattctttgatacgaaatctcgcactgtctcgtgcggttcatttcaaagaaaaaaattgttgtgggtgtccttttcatttccttttaagtatcaatattggcatttcttgtcacaaatgccattcttttgtcaatgttgacaagactgggaaatgcaatctttagcatgcttatacacaaacacagaggcaagagca

SEQ ID NO: 58986 - DNA, 1198 bp, Oryza sativa
aagtgatatccccaagtgtctcaattagaaaataatgctttagtagatgaatttacagaaaaggaaattaaagatgcaatttttaaaatggaacatattaaatctgtaggtctttatggatttcctgctgagttttatcaagtgttctagaatgttatcaaatctgatttggtagatttatttaaggattttcatagtgaaagtctaaatctttattcactcaactttggtactattattttactgtctaagtgcaaagaggctattaagaatcaacaatataggcctatttgtttactcaatgtcagttttaaaatttttactaaagttgctacaaatagaatttctggagtagcttagaaagttattagtcctacacaaacaacatttatatatgggagaaacattatggaagggttgctatcctccatgaaacaattcatgaattacataaaaaaatgaatggtgtaatttttaagattgattttgagaagcctatgatatgatagagtttaatcttgtcattaattagaatatatgcatggttctattttgtttacatgtagtataggtcactgcatatttagtttggctccagctcattggcgagatgccgacgtgccgtgcgatgcggtggtgcgagaatggagcaaacaacgttcatgaagaccaagctcaactgcatgtggagtgctgcgagaagtagccgaattgcaagcaagacaaggtcagtattagccgagtgaatcggtcctagctgtacatgagatttagttgttgctagtgattagccgcatatgctgcgattagtggtaatcatgtattgggatttcttggcaaataagtaggattagttagttacttagtgcatgggcatcccacgtctgtgtgcatggcgtgagttgtggctgagtgggtttggccattgtaatctctttgcatgtactgagtctatataaacaaggaaacgatgtgagctaggggacacatcaaccaaaagcctgtgtgttttgttcagttcttgtgtgtttgtgtccaccgagtaaatacaagtgtttatgttagtgctagtgattagtacttaaacattcagagaggagagattcccaacaattggtatcagagccaatttatgcccaagatcctgcgcttcaacaagatgtccatcgtcgagcactccgcgtcgcgatcgatgagg

SEQ ID NO: 58987 - DNA, 997 bp, Oryza sativa
gagaatggagcaaacaacgttcatgaagaccaagctcaactgcatgtggagtgctgcgagaagtagccgaattgcaagcaagacaaggtcagtattagccgagtgaatcggtcctagctgtacatgagatttagttgttgctagtgattagccgcatatgctgcgattagtggtaatcatgtattgggatttcttggcaaataagtaggattagttagttacttagtgcatgggcatcccacgtctgtgtgcatggcgtgagttgtggctgagtgggtttggccattgtaatctctttgcatgtactgagtctatataaacaaggaaacgatgtgagctaggggacacatcaaccaaaagcctgtgtgttttgttcagttcttgtgtgtttgtgtccaccgagtaaatacaagtgtttatgttagtgctagtgattagtacttaaacattcagagaggagagattcccaacatgataaagtgtagtggtctgttgttcaacaaactttgagaatggggggtttttcgcaaaaatggtgtgattggattgcttctttcattcaatggagacatgttggtattaaagtaaatgatcaagtgagggtaaattttcaaacttgtaagggtttaaggcaaggggacctgttatctccagttcttttaatatagttgttgatgtgttagccatattaattaagagaacaaaagttgatggtcagatttatggagttgtcacacatttggtggatgatggtttatctattttacaatatgctaatgatactattatttttcttaagcatgatttagagaaagcgaagaatatgaaattgttattaactgcttttgaaaaattatctagcctaaagataaattttcacaagagtgaattcttttgctttggccaggcaaacaaatgttatgagcaatattcaaatatttttggatgacaaataggagactttcctgttaaatatcttggtatccctatgcattat

SEQ ID NO: 58988 - DNA, 7108 bp, Oryza sativa
tgtttatgcgtggaatgcatgaaaagttagggctcttctctcttcttttcccccatatccatcagtgatagccataaagtattccttgcttccatggaccatagctactttacaaagtacattagaaggttttctcagttctctaatgggtcacacatggttcacttttctaggtgctcttgataagacaaatttaacatccaattcttggttcatgtcgcgatgatgtgaaatcctacaacatgattgtacaggggttaggtgcgtcatcgtttcatgatgcagagtataaaaatctaggtcagttgcatgttgatgctaccttaaagcttagacatccttcagtgtggccctgtgtagtgtcgtggctttacactttattctccccgtcaacctccaactttactcactagtgaaaaccataactgaacatgaggactgatcccatgtttattgtaaattagatcaaagtgcacatagtgatacatattgtatgtccactcttaaatttacattagtcgtgttcgaagactctgcattagttgaactgttgacatttatattaagtaaacatagagttcaaccaaaaccattggtgactgaaacatagtccgatttcaaacaagtggaatcttgaaatagcaattcagcaactaccttaataaaaactgctcaaaagttatggggttgttcagattgatgctattttcaaccataccattttttggtaaagttaccaaaaaaaatgtctacgtttagtttgttgctaaatttggtaaatacataagaaaattttggcaatattgtcatcttgccattgccaaaatttggtaaggtttattttggttacaatctaaacaagccctatgattgatggtctaagagaaatcaatagcagcataaattcaagttgcaatttttatactgttccctgccgaacttgaagttgaatcctcaagaattttactctaaatttgtttagtactgataatgaacattcaatccaaattgaaaatatgcacatgtaaattagcaaacaacaagcgtagaatgtagaagcatataatccattaactttgtaagattacagctgtatattatcagtaaacagaaaattaaagaagcaccttacttcggttcactagtgcgctgaaataatttttcatccacattgttgaacttgaaatctccccatgattccaatgtagaaaagtccaacctgtgcaaaaggaaataaagtaatttagatcatttattcattttcatcattttagttacaggactcctatgcgctatgtcggattttcaagaagaatgtggtgttgggtgaatttgacaagaaaggggagtgcagttcatcacaggctaaacgaaatgaaaaagttacagatgtcggggatgctggacaatcctcgggagcaaatgagaatgataaagacaattcatggatgcaattcatagcagaggatctatggtgcaccaacaaactaaagtgaactagaaaactgagagaaaacagcttgttaacttcatctaaccagatatttcggtattagttatactgcgtgtatcttctgtatatgtttgataaggacacttctcactttgcataggaggaccactttaagtttggatgctggttcttaaattaggtttatacttttgttcctttagtactgtataatatatctaaaattgtgctactttgtacttcaatcttcaattaacatgtacctatcatctaatgaaatgatacaaaaggagaaatccaattttatatatccaccatgtattctatggatatatgtgcaatgtgaccaatatggattaagcaatcaccatatatcactaataaaagaaagttaaggatggttcagttttgaaaaatcaattgattttgatattccggctaacaaaattttacggtattattaatggcaaattccatcaatgtaataatgtttatgtttcaaggttcttaagttgcacaaattagtataagaatgtggcaaccatgctcacatctaacagctgctaggacctattcagcctaagcctgatacaatttccatgtagttttctagtttttttttttttgacgcgatacagttttctagttgcaggctgtaagtatctgtttgggcgatcttttattctcagagtttaatttagatcaccttttacccaaaaatcttttcactttggactaactaatattgcgactaccccaactctattctcgagccagagactgcaataagtatgggtaactaaacccagatatataagcctaacctttcggactccagcccagtactacagtgttttaatcatatatgtttgaagatgcccacttagcatttctgatgttttttttttcgcgaatgcagcatttctgatgttgcattcaaccaaagaaaatcagctgcttcaagtttttatcccaactaatttaaagttgcagtaatttcctcaaaattagtgtgtgctttcagggattagagtccaatcagtagagcatacatcaattccagtcacgaattaaagggtaatcatatcaagctttagaaaaagacccaaatctagcgtgagaaagtcacaaagcaaggcaaagcagatcaataccggagggaccagccgcacgaattccggcccaagggtgaggactcggactcgagcagcccaaggattgcagctcgtcgcggccacgcccaatgcctcctcctcctccaggcgccgcagcacgatcacacgcttctctcccgtagtctcatcccagaggcgaatacctgaggcaaccacgaatgttcatcagaagcggtgcatttggtggatgcgcagcggcggcggcaatgggggaagaagcccatgcctcccaggtgctcgacgaaatggcgaggtggggataggtttcgggcgcgtacctgtgcgagcgggctgcgccaccggcgccggccggacgatgagcgggatcgtcgccgacgcggctgctctcccttccctccgctcccatggcgagagatccgtgctttcgacttgtctccttccccttcatctgcgctctgtggcgacgagtcggtgggttggaatttggaaaccgactcgctgacccgcggtctcttcctcttcccctttgaataattttgaaaataatgggtcctctttcgaaattaaattttaaaccaccttcaaataatctgaaactgagtttaggtgttccaaaattcaaactccaaaacccaagcgggaaatcataaatttagcgctcgggatggttccaaatttccgatcgcgcgcactgaatttggaccccgcgtcaaccacattgcaagatacctcatcacctcaggagattcctacatgaatatgggcatttccgcggttccgccccccaaatcgcagcgggaaatcacaaattcagtgctcgcgatggccgatggttcgaatcaggtagccaatactgaaaatcggaccgtgaaaatccaaatagggagcaaatcagaaactgctcgtgctcttgaaatttcaaaatcgctcaaaacaaattgggcaatacaggtcaaccagtgtcaccaactagaacaatgcaggttgcaaaacgttcacatagcacggcaagagattgcaactgaatttagagggtaaatcactgcagatttcctattccattcgaacgaacgaaccagtagttcatacatccctaattaatgaaggaacaggagacgagatgaaacaacagctacaggagaagaggctaggctactacgacgaactgaagaacatggcactaatcgaatccctatccaatcgcgtggcctcgcatcgcctcgcctagccgccgaatccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatcagcccggagatgcgcttcacgccgcccctcctcgccagcctccggatcgccggcttcgtgatcccctggatgttgtcgcgcagcaccttcctgtgcctcttcgcgccgcccttcccgagccccttgccgcccttgcctctcccagacatcgccgccgccgccgctcgccgccggtcgcgaggaagaaactttgacttggtgaggagtggttggcggcggtggtgatgaggtggggaggaggaggcgtgtgggggcggggctttatagaggcgtgggtttaggggaagcgatggggggcacgatccgcgtgctgctggttttccgccgttggatgggagatggacggcggggagtgggggaggtgggggttgcgcggatcggtgacgtggcgtggtggtgagcgggaggtgtgtttcttttgtgaggatgtggcgggggtgcgggaattcgagcggggagtgggctcgtgttgggtggatggcaggtgggccccgggtttttgggtggcgggtctgcgcgcggtctagaaatttcggatgggttctatctatgacaagtgggcccatagttgggtgccatgaggttagtaaaatacgtttctgtagtttgaaggcgtaaaaggctttgagccaaaattatttgtgagatgaattaagctggccatgttaggtactcctatttaactatgtaagtcaaccaaattaaatttctgaagacttgcaaaagcttcacaatgcatttgtgactgtaaacaatcgtgttctcttctctgacaaaaggttacaggtaataagacacgtataaaattgtaaaaggacggcacgaaagaataatttgcatatgccaaatgagcgtagctctactcatcatgtttcttttcctgaaaccatcccacccgacatctacgctaggggcctgttcactttcatgcccgacatctacactatgtcaaaattttagtatgatttcttatatagttgtcaaaaattagctacaaaataaatgtagcaacttttttggcaactttaccaaaatttgataaggtttaaaatagcatcaaaatgaacaggccctaggtgtatcattgtcactcctacttataatcggtgttttaaataacgagataagatatttagtagttgaccttcccaaacaactatagcgggttaaatgaagttatagcggctaaattatacatgggagcaaatggttaggacccttctcaaacgactatagtcggagatagcggtaattatatttttgtatggtatttcatgtatggaaaatgcagggattaaatagcacaaattataaagtacgttgattttttaaaaaataaaaattataaatgcgaggctagtccagttggtacgtgctgatgcactaagatacagactttgcatatgtagtttaaatattctaacttgattaagatatggattttaacttggttttcgttagcatgactttcgaaatgctaacgttgtattccgtgtaaaaactttctacatataaattgctttaaaatatcaaatgaacatatttttaagttaaaaaaaataaaacttaactaaccctgtgctaatggttttctcgtttgtgtggcatcacttaatatctattttcatcagatttaaacagggttaaccaagcatgacgaaccgatgaggtcaacaaaatataatgtttaagagcctgggaagcatatctacgataacccataagaaaaaaaaaacgtgaccttattcctaggcaaaggatggttcacatcaggtggtctagtgcaaaccgcttccttttacaaggaatagaatgttggagaattaggctatgtttgaaatgatgtgataataacttgtgattaactgaattttaattattacaaaattaaaaaaaaatggattaatctgatattttagaataattttcatatagaaaatttttgcacgaaacacaccgtttagcagtttaaaatacgtgccatgaaaaactaaaacttttatctcgaacagggccttaatgcacatgcttcctatggagtactcccttcgtcccacacagggacggacttaggcctcaggccacgtggcccaggaaagaaacattatcaggcccaacaaattctcaaacttgggccaaaatgccatgtgctagcccgggtctcgtgagaaatctggatatgtccctggtccaaaaaaacgaatcttgataagtttctgtctagatttgttttactatgatatatcacactcagttataggtttgttttctgtgagacggagggagtaagttctaaatgtggtatcttttttttaaaaaaaaaacaaaaccatgtatgtatttaatagaaagctattataactccgatgtagacttcacagtgtttgatttgtttgtacccttaaataattatcatataatcattcatctatttgaaacggtaattatacccttgaacttgattaaaagttcatgtagcacccaaaactttaaaaacatccatccaacctcccaaattttattccattcatattcatataatccactatggtggttttgcaaagtgtttttttttctaaattacatatatattttttaggagtttaactacatgatatacacattggtatcccattttgcaaagtagtcctttttgtctaaattgcatatccatttttcctacctccatcccatattatagctacttatatcatttagattttgtcagatgatatagctacttttctatccaaaccaatcacaagcctccctcattttaatatcaccatgttacttaatttcttcaaaatagcattcataagtcactataaaaatgagacaaagggagtacatcagttctgttaacatgcatacaaacatgtgtataagtgaatcaaacatcgccctcacgccaatttcactacaaaattcctacgacactctttggcatgcaacgtgtagccttcaaagaaatatccatcggtatcactcgacatcgtccattgttttttctatccaaagagaatttattcgaagtgttggtaagatagctacctacttcattcaaccatcatggatccaacatacaaggtgaccaagataatatcacttttt

SEQ ID NO: 58989 - DNA, 1005 bp, Oryza sativa
gacaagctcgaccagatcaggtgcgagttcatcacactccacttccactggatctacccgcgcgatcgtttcgtccccattttttttgtgctgattttttctgtgtgtgtgttttttttgctgttgtttttgttgcagcgagaacgagaagtccgggttcatcagcctcgtttcgcgctacctcaggtgagatcccgtagtgtttgcttcgattgatttgctgcttccgcggtgggttttgatggtgatggtggtggtggtttttgcagcggcgaggcggagcagatcgagtggagtaagatccagaccccgaccgacgaggtggtggttccctacgacacgctctcggctgctcccgaaggtactagcgtctcgttgtgaattgggtgatctgagatgctcgtgtggtggttttttccgaaccgatccgaggttcagtgactgtgtgtgaacactggatcatgtggtgatgtgtggatgtggtgcagatctcaacgagacgaagaagctgctcgacaaactcgtcgtgctcaagctcaatggaggcctcgggacgaccatgggctgcactggtcccaagtgagcacaattccatcccatcctgtttagaacttccagttggattgattagatcgtatatggccgtcatgctattcatagccagtataaactaagtcttacaaagcaaactagattttctcctgcttgtggcgtttacaatgatactatagtatggttgcctgctttgagtgatgttgatattgtactttgttaatttggtaactataaggcttgctcacgcatatgcaccaatttgccaaaaccatttcaaagttgttcagtgtgtttgatcagatcgtgggaaagtgtgaattatgtgttggttttaatgccacttgcccctttttaaattctacatgttattatattatatgtatgctcttctgtctatgtctcttagtggagttctcaatgttaacgatatggaaggactcaatattgtaa

SEQ ID NO: 58990 - DNA, 6092 bp, Oryza sativa
cctgcagcccttgcatctaagcttggggtaggcagccactcataaatagtagcttttcatctccctcaacacaaaaaccaagtgtgcgaacctaatttctatgttgtaatttcgcaataagagtaacttcgttcctgaattccttcgttccttgttgagaattcctgcttaaccttttaatagcacttactgaccccctagcattccctttaaattgtgagaaaagaaattagatttgagcatatgacatacaaaataaattattgaataacctagaacatataaaaggaagctactaccgaatgatttaccttgtagacttttccaaaacctccctgaccaattttgtatgcttccgaaaagttgttagttgctagagcaatatcctcaaatgttacaaatgggaattcaagatcttggacaggatttccttccccaacctcttcagctgcactcatgccaaacaaaatttgctttctgtgcttttctcgatttcttttcttgcatgctgaacaagatcaatcttaattatagtcatcagcttttaagaataacatatgtttacaagagaaaaaaacactaaatatacctttcatttttaaccatgcaaaagaaatgcatagaattaccagaatactacttgctaacactggaagcacaatcttgactgcattgctcttcgtccttccacctgtgcaaagttttagtgtttaagtagttttttcaaaaaaaaaataaatattattggaggtggaatagaaatataatatttttctgttgatttgtataggactttcaaaaagtacttaagactaaactttaaccattcatttattatcgtataataatatattttagatagctataagacctactccatccgtccccaaaaaaactcaacttatggagattgaattttgtcaaaaaaaaaaaccaacttctgccattctacctactctcagcacgtaaaacgagaaagttttatctcttaaataccctttacctacctatcaatattactacttttttcaataacgaggggcattttggtcatctttactcttcactaaatttgcattgggattctaggattgctctttctgtgagacggagggattaccttgttagtctaaaacatgaatggattaccttgttagtctaaaacatgaatttcttggtagactcatcatagaggaatttttataccaactgatcaaaatctatagagaatttgacttttagacatcaaagtactcctacgtcctatgaacaacaacggatgtagtaattgattttagaaaaaatgtactaaaaattaacggtgtgtttacccgcatgaagctgaaggcctgcaagcctgaggtagagcgtatcgctgcccagcccttgtgcaccaacttttgccatgtcaatcagctcccctgaccacaccaagcacctcgtcgtgtcgcccctggacctgctgttgctcaggttggcgtacgcgtacgccacgcacgagcagttgctgctgcactccgcggcgcacgcctccagcgtcctgttcgggacgtgcacgaacttgtcggggcactgcatcccctgcacggccaagaagccgtcgccgcaccgcaccgcctccttccgccggcaaccccgcgagaaccggccgctgctccactccgccgcgctcgccggctcgaagccgtcgaggcacctgcacgccgggagaggcgcctccgccgccgtgctgtcgcagtacccgttcgggccgcagaagtcgtaggggtcgcacccggccggccactcctggagcaccacccacgccgacgatccgctgctccacctctgaagctggtacttgccggcgtaggtcagcacgaacctggtgtgcggggcgtcgtcagcgacgctgaacgtgatgtatatctcctcgtcggtgtcgatgatcgcgacgtagacaatggcgctggtgttcgtctggtactggctatccaccatgtagcctgtccacggcccgtcccgcatcaacggccgcgtcccgttccacatgatcacctggaggaacgtgtccgtgtcgccgccgtacgagaagctccccggcgacgggtcgccggggcccctccacgacaccagccggtcggaggcgcgcgtcctgtacatcatccgcagcttcatcccgggcaggaacgagtcggtcggtgctcgaagctctgccaaaagatggtgccgttcggtgaccggacgacgaggttgccggtgttcatcagcaccgcggtcgtgttgccgttgccggcggcgccaccggtgatgttggtcgtccagcggacgcggccgtcagcgtcggacacgacgaggttggaggattcggtcagggacagcgttgtgccatttgtgaccggagtttctcggtcggcgacccacaccaccgtgcgccgggggatgtcgttgtaccatataccgaggtagagcttggccggggtggagttggagggggagaagaagcccatggcgaaggcgccgccgtcggagacgacggtggcatcagaggttagcggcttaccggggacaagccggtcgtcggctgaacacggcggcggcaggaggacgacgacgacgctcatgatgatgacgtagatgaaagcatctgatcgatccatggaaaccaagccctttcttccttttcgtgagccaatgtgctagctcgtaatcgcgtagttgttgttgagcatgtgtttgactataaatatgtggaaattcaaatgtactagtctgtgcgtagctaaccggcgtatagttttcgtatcacgggtagattttctcgtgcaatttcagcggaccagctagaaatgtcgagatgtatttttttttaaaccccgcggggtgtatttgtattaagtagggagaaaaactgtaaaatagctcgaggctaggagattacgaaaggaaaataaatagaaaagcgagagggggaggggtgggctgctaggggaaaggggttgggggtatatgtcacgacttacatattgttgattgtacttccacgggtgtccgggagcagggattgaatgttccttgctccacttgtgcgccatagccaaacttcatcaatcgaccggttaatgattactacttgtgacggtgctgtcgagatgtattttgatgtgcaactcttgcttatgttttcataaatacaaactgtattttgtaaattatattgattctatctccataaatacgatttttacgacaaagattggaaatgatgatactccttcattgtaaagtcggagctgctgcgtcactattgcgggcttgacaacgacgatgatcgtttgcatgaagtcgaagctgctatgccattgtcagctctcaatgtcctatcattttcttacttttctacttcatccgttcctaaatatttgatgtcgttgacttttttaaacatatttgaccattcgtcttattcaaaatttttttttgtacatattattcaaaaacttgagtagtagtaatatatttaacaatgaatcaaatgataggaaaataattaataaatacttaaattttttaaataagacgaacggtcaaacatgtttaaacaagttaaaaatatcaaatatttagggatggagggagtatcatgttaagtggtgtcattctctcgaaatgaccgttggtccaaaatgtggactattctgcacgcaggcgtggacaatttcaaaccaacttgcgttcttatcatgcttcaaccaacggtacagcaaaaaatatatttctaaaagaccaaaaaagtagtttgaatttcactttgctgcaggaggggcgcagtattagcgtgtgctttggcatagtttggcttagaagctagccgaagctaattttagaaattagaccttaataaactgagccctcctttggaacacaataattttgcaggggtcttattggagttagttttaattagcttccagaaaatttatccaattacctgtatttcaaacgacgcataagagtcttgctgttgtctgagaccgaagattgcggttgttaaatggcactatcattcctagtggcagaaaaaaacccgagcagtccatgcactgcaactctgcaagtttattttccacagacagaccgaattcggctcttcttttctctgaaggggatttgcctaaaatctgaagctgcggacgttgtaactttcgcccgcgatctctatcctccatgtgtagcaagttttcaagatgtttcttcgagagtcacgtcggaagaaacaatacaggcatgcagaagaagtcttggatcctagccatacgttttagggcccctttgaatcaaagaatttatgtaggaattttataggattcaaaacctataggaaattttcttatttggccctttaattcaaaggattaaagttttccaaatcctatgaaattcctatgaaatggcacattgcatgtggattttggagaaaatttagcaagagctccaacctcttggaaaatttcctttgagtctatctctctcatccgattcctgcgtttttcctgcgctccaatcaaacgaccattcatgtgtttttcctgtattttgcaatcctctgttttacacttcaattcctgtcagaatcctgtgtttttcctattcctccgttttttctaccctacgattcaaaggggcctttaatctgagggttcgtgatggcctgggggccagggttcggagattaaaactccgaccccagtaaggttgtattttgttcacactgaagtttggaagtttggttgaaattggaacgatctgactgaaaagttgtatgtgtatgaaaggtttgatgtgatggaaagttagaagtttagaaaaaaactttggaactaaacagggcctaacttctaaaacagccatctcaaatcgcatccaagaagaaggcacatcatgcgaagaaccaggataatccaacaaaaaagagatatgcatcagtcatcacattagaactgcgaactatggtagatttcagttgctaggtgttgacagaaaacacgaggcttgggagatctgcttaactctagtgcaggtccaaagctcgccttcgaatgtatgagcgtgccagttgatttgatcctgcaatcaacaagaaacaaagacaaagaatctgtagttaaatccataaatgatagccgatcggctagatgccgatgacatatcatttatctttgagacgatgtcatatgtgaatcgatcggcaatcgttaataagaaagaaagacctagatctgctcaatcggctgtaggtatcaacgatatataatcttcatgctagtatatacttaaatcgagtgattgggatagatcggtcgtaatgccgagacagtataaatcactacgatcgaaatatatactaataagaggattatatatgtttatagcatagccgatcatgtagacctggcacgtatcggctaatactccgatactactctgtattaagatactaaagcaaatcaaatataccaaacagtagcctaatatactttagatgcgacaagatcttaatgcaaatggcagatttaacgtatcaaataagcgtataggatagaagtagttaaatcagataagatcggctgaaactccgacactactctactcggcaactagaaagcaggctagagattacaattctaagcacgacttaatagatcaaactcaactgatgcagcattaagtatgaaaagaaggacaatatctagacaatcaagccgctagatgtttcatagagtggtagatatcttgtataatctaagccaacgtcgctatttaacctaatcggctgccttctactaacagatattggccgattatagattagataatgatattgtcgaagattatacaagatatatgatagctcgacgaattacataaacaagattagagtgtcataaagatggaagcactaatcccgaaaacacaagtcgccatgacaagttttacctcttgttgaagatcgaaaccgatgcagctcaacccgaaagcgagaactcgtcgaaataaaactaaagcaaaaggatggcgatgcgccgaaattgtattgaacgtctgttgttttt

SEQ ID NO: 58991 - DNA, 1561 bp, Oryza sativa
tctcggatcctagccgtacgttttaatccgagggttcgtgatggcctggggggttcagagattaaaactccgaccccatccaagaagaaggcgcatcatgcgaagaaccaggataatccaacccaaaaagagatacgcatcagtcatcacattagaactacgaactatggtagttttcagttgctaggtcgccaacattgcaggtgttcacgtagcggatggaagcttttttggggtttcggtgttttctactccgacccctaacaaatcgtggattaaaacgtgattcctgtagagactaggactactattttgtagcccataaagcggcccaactatatgagcccgttactccaaggggccagggaatcggcctcatcaggtgatccatcatctcagtcgccggaggccttttcgaccacgcctgcgacacggccatcagatcttcaaatattttttgtgcgttggctgaacaactgtagactgtactggtagccttgcttcttagcacagaataacgggggtggattctaaactctcgaggggacaccgtctcgttatttgtatgtcatcgaaatggttatgtacaaatttgctatctaacaatcggtaccatagagatggaactaagtgtttcagttagatagcactagtaagcagttggagcagaattttcaatatcaggcgtttcgattggggaggtagccagaagcgatttctccgagcttccatggttgcacttgcagctgagcatgcccgcaaagaagatgatgaccgaagtcgcccaacacaccatcttcaacaatttggacatcccatccatagtcataggaaacggagtactcccttcgccccaaaaaagacttaacctagtattggatgggacatttttctagattcattgtactagaaaacatcaaatccaatactaggttgattttttgtgggacggagggagtaggtggcagcgttcctccgcgcggtcattttcgttcccaccttgtaaaagcctctcacgagtcgcgtaccacgttcctgaccctgttccttgcttccatcgacccgggaactttgcaactttgtgactttattattcccagggacaaagaagctggagagcatgacacctacagtgacgagggacctttttatcagaggcattttggacctctcgtaaccctcccaaatgcgagccttgatcacctcttgtgtaatcgaccgtccggaatctcctctggatatcatctatgaacctaagctgcatatcaacgggtacgctgtattccgtgtgttcccggatgaggtgctgcttgacgtacttgggtgagccccgtaagaagcgatccaatctatccaggatgaatcccttcttcatatcctgcagaggtgcagcttcttggcagcacgcttatcggccgcagcatcgatccgcaacctgtgagattcctcccaagcccggatcttgacccgcttctcgtgatcgcctaccccgaaattctgttccacacgttcgttaagaatctcctggacttcgtcaacgatctcgtatctaactctaaag

SEQ ID NO: 58992 - DNA, 1092 bp, Oryza sativa
aaatgacttataatatgtaacgggagcagggtttaatctgttggtttgaccgatcgtatcggggttgggcgatataccgaaatttcggtccaaaattttgagcaaaaatttaaacaaatactaccgaaattcatgaaaaattaaaagaattaaaagtttcgactgaaataatatcatatctgaggatccgaaatgactgaattttagaaatttcagtccgaaactttcaaccctgaacgggagtatatatctgaccagaaaatgaagtggttaccaagttttctacgttagcaagaacactgtgtgaactgtcaattcttcaagccggacgaagccaaaaatcctataaatgagatcagatctgcagttctgcatcgccgtgcgaggaatgatttggcagtcatctgtaatttgcagacagaaatggagctttccatcgatcaaaatttaatctgacggtgcgtttggtttccttgcacacggcacccatttgcctataaattgcgtgctcccctcctcgtgttgctcataacgcagatcagccaagaacgagttcatcttcttcttcgtgttgttgtagcatttgattcgagatatggcggcgactgacatgtctcccaaggccggcaagccgctcgtcgagaatgacgctggctcatacctggcgtggtccggcaaggaccagccggccgtcgccggcgagaagctcgggtgcggcctactcgtcctgaagcccctcggcttcgcgctgccgcactacgccgactccggcaagttcggctacgttcttggcggcagcgcggtggtcggggttcttccggcaggggtggacgccagggagagggtggtgcggctcgaggccggcgacgtgatcgccatgcgcgccggggaggtcacgtggtggtacaacgacacggacggtgaggatgtcaccatcgtgttcatgggcgacaccgccggcgccgtcagcccaggcgacatctcgtacttcgtcctcgccggcccgatgggcgtcctgggaggcctcgacgccggcctcctcgccaaggcgttggggctgacgtcgccggagcaggcggccaccgccttccg

SEQ ID NO: 58993 - DNA, 13831 bp, Oryza sativa
  unsure (1)..(13831): unsure at all n locations
ccgcggacgacgccggcggcatggagctggtgtcgctgatcaaaagccccaggtaacaagacgagcagcggcaggcaatcgtgacgtcatacgtgagcgcatgagttttcacttgggatttcgttgtgtcatgcaggccggcgacggagcacttcaccgggaagggatcggtgatcggcggcctgacggcggagatcgtgcaggcggcgctcaacgtgtcgccggaatttgtggaacagctcaggaccaagtactgaacgccggatttgatgaatccggtactgtacgtccatgtgtcctctcgtctctatacgtttcctgttttcagcacgcgacgaagttaattaggcagtggctactgctccggtgttcagtcttgacacgtgaatagtctctaaacgaaataattaatcgaaaccatactgtaattagctgaagctgaaactacttgtatgcaatattattataaagtacattacgcagcgtggtgtaatggtccattgtactatctatacgcaactaaaacaatgtgtctatagagtgtctggacaatgaatagggtgtagaaaagaggatcggaaaatcaacagttcttccccctctgccataccaccttgaagacaacgattcatcttcttgcgtactgcacactatcaaaaagaatctgaaaggaggtccagtgttagatcgggctaaaccaagtcctctaaagtcgttagttgtcctcgtctcttggaaagccatggtacgagcgtaatgcaagaatcttcgggcgtatcggagctgtatgcgcccagccgcaactatcatcataaagataaaaggaataagctgcaacaggcaaaggcggggacgagtcccttgcagagtttatatttttagagacagaggttaaatatgtttgaacaactttttctgctctatcaatatatatacgcggcaaagtttgtgccctcttttcaaaaaaaaaagaaagaaaacaatgtgccgattaccctatagtcaaagaaaacaatgtgccgattaccctatagtcaaagaaaacaatgtgccgattaccctatagtctccgttgtattgtaagattggcagtctttgtttaagataaaattggcgctctttgtttaaatgttactcccttatttctaagatataaggacttttcgagtagaatacaagtattaagaagaaaggtaaaaattaaatggcaaatggttgtaatcagttaaaatgatgtggtagatagagaaattaaataggaaacgattgtggatgattaacggtgaaaatatagctagtatactttattttaagacaaattttaaatgttaatactagctagtatattttaggatggataagcaaacattatttactttctttacgccaaatatatttgaccgaaacccaagcgtgggatctggatcagctgcaattatagtattgactgcaacttaatcagttgtagatactgcattggatcaaatctaaacgatatatagattagcttggtactgtagcaaaagtgtttgtagcataaaatgttgttcgagttttgtagcgatgaatctgtgctactgatcatcgaaatgagcgactgaaaatacatgcaatcatatatactccctctgtcctaaaaaaaaagtaaactctagatttcgtgtccaactttgactgtccgtcttatatgattttttttataatttgtatttttattgctgttagatgataaaacatgattaatattttatgtgtgacttgtctttttaattttttataatttttttaaataagacggacggtcaaatgttcgacacggaaaccagggtttgtatttttttttgagacgagggagtatggtgcagccgtacgtagctatgactgcacaagccggatctccaatccacaagcctgtgcacgttgatgtccccgcacgcaacaagcaccgtacatcgatcatccccggagtggctaacggtcgaagtacgcggacgtgtcacgcgtgcgtggtggggcctgatcggcgaagatgtcgtcggtcgttcgcctgctcgatcgatcgatcggtcgcgttcttgcagatagctagctctgatatgatttgcttgtacgtcttccctgtggttaggcaagggttactactttgcttcagttcagcttctgtagccacgcgaatcacgatcgtcttaaaataagttttaccgtaccccatccaacaggtctgtattgtagctaaagtgaatgttcaaattctaaaaataagttttttaaatggtttaatttcaaattaaaaattttaaaagttcaaaataataggaaaaaaactctgcacacggacacgggaaataacggccacgacgactatagccttgtttagttggaaacaatttttaggtttaattgtcacatcagatatacagacacgtatttttaagtattaaatgtagtctaataataaaataaattatagattccgctaggaaactacgagatgaatttattaagcctaattaatccgtcattaacaaatgtttactatagcaacacattatcaaattatggtgcaattagcgatatatctcgcaattcacacgtaaactgtgtaattggttttttctttatctacatttaatattttatacatgtgtcaacattcgatgtaataggtaaaaagtttttgttttgcgaactagacaaggcctatctataaattgcgagctcccctcctcgcgctggtcataataacgcggatcagctaagagcgatttcttcttcttcttcttcttcttcttcttcttcttcttcttgcttgttgttgtagcatttgattttagatatggcggcacttcccaaggccggcaagccgctcgtcgagaatgacgccggctcatacctcgcgtggtccggcaagaaccagccggccctcgccggcgagaagctcggctgcggcctgctcgtcctgaagcccctcggcttcgcgctgccgcactacgccgactccggcaagttcggctacgttcttggcggcagcgcggtggtcggggttcttccggtggggttggacgccagggagagggtggtgcggctcgaggccggcgacgtgatcgccatgcgcgccggggaggtcacgtggtggtacaacgacgcggacggtgaggatgtcaccatcgtgttcatgggcgacaccgcccgcgccgccagccccggcgacatctcgtacttcgtcctcgccggcccgatgggcgtccttggaggcctcgacgccggcctcctcgccacggcgtcggggctgacgtcgccggagcaggcggccaccgccttccgcagccagcccgccgtgctgctcaccaggctgagccgcaagctgcaagacgtccgcccacgcgagcacgacaggcacgggatcgtcgtgaacgccgcgcgcatgccggcggacagcagcaccggcggtgccgccgccgggacgaagattgtcaccgcggcgcacctgccggtgctggggcagctcgggttcagcgtcgggctcacgcctctcgacgcgggcgccgcggtgcgcgggccctgggtgctccgcgacgccgcggcgcaggcggtgtacgtcgcccgtggaagcgggcgcgtccaggtcgccggcgccggcggcgcgtcgacgctgctcgacgcggaggccgcggcgggcagcctgctcgtcgtgccgcggtacgcggtggcgctcgtgggcgtggacgccggcggcatggagctggtgtcgctgatcaaaagccccaggtaagtagacgatcatggagcatgtgcatgcattctgtgtcggcgtcgtacgtgagcggatgggtttttcacttggactttgttgtgtcatgcaggccggcgatgaagcagttcaccgggaagggatcggtgatcggcggcctgacgccggagatcgtgcaggcggcgctcaacgtgtcgccggagttggtcgagcagctcaggatgaccaagtgagcgaagccaactccggatttgatctctccggcgatggggtgtggtgatgcccacagtagaacactgcgcgtgtctttgtctttcagtcttcaccttgcgagaagtcatggcaggattaagtgttgatcagtctcagcatgcgaataatgtcaccaagtacaataataatcggaactagcagtgcaataattaaagctgaaaatggatggatcgatgaaattttacttttaaatttcacgacgtgttttatatgtttggtctattgtactacccaacagaaaattgtgttcacatacatatctactcccttcatcataaaataaatcaatatgttaacatgagcacgctcatagcgtgatcacttttgtgagtttggccaggggacaagtcacgttcgagtcttaatttgtaacaaaaacacgcgggattgggagcttgggtttatactggttcgaactattcgaaattataacaccctactcttgttgtgttgttgatttttctctcggtgagaaaggatcttacatgtttacacaaactcaacgtagttcctattattctcttctggattctctaaaaatttcgcaacaggtagcacaccaaacccctctctccatggttatgacacgtcaaaaagtttacactctttactgaaggacaataatgcacttgtgttggaaggcatcataaaagagtgataattggttattggacacccacaacattattttattatatccaaaatatacggaaagagaaataacggtgcacgtgcaagtatgaatcttcctatctccattggttaatgatcacttttaatccacgtctttgaatccacatcgcggttaatccatagccattcaccggtcgggttgaaagcagttagcccgtaagcaatcttgtctttagtgaatatttcactctatatttcttccggatataacgaattaatattgtgggtgtctagcagacaacaacaaattactgcttctatatgatgcctttaaacagaaacacgttcttacagtatcttcgagcaaaaggtataaactttggatactgtctattactaataatagctatatattttaggacagagactttctattacgttacgtcgccatctcgcgctgcacattcctcacttaattactctacacaagaaagcatcggcatcgagaattcgagatcatcgatcatatatggggcatttacaaatttgctactgtttcttttagttttgcaaggatgccacttgaatgacagttatagtggcatttttgtaattttttagtggtatttttgcaataccgattcaaagcagtggtaaatttacaattgacccatcatttatatatatatatatatatatatatatatatatatatatatatatatatatatatatatatatatatgggcgtggcctccggcccggtcggtgcgtagttcatgcatcatgtataacggtcgatccggacaaaagcacataaagtatcacgtcgcgatcggtcgatcgatatatcctgacgccgacgtgtgtttgtggtggggcttgcatcatcggcgaagatgttaggcaagggctacgtacgtacgtactgctttgcttcagtgcttcttcacttcttcagtctcaaggtatttataaattctactcccgggagtctatatgggatgcttttaagcaacgatatatcccttttggaaccggatataacaagttaaaacaaaattgaattggaacttagtaaacggacacgaagttttgaaggattctcgactgggttctgaagacaaatttccagtttaagaagctaatgtgaaaggccatatctcggatggagatctccagcgatcgctgccgttgaggcggtgctacatacgtacgtactccgtgcactacgtgcatggtgggaaacaacaattaattaagctactacgtactgtagcaactgttgaaatctccagctctctctggtggccgagtaccgtcaggtttagcgtttgataagcgaccagcgttactcggctcgctccgcctaccaggcttttttcctcggacaacaatcctttgcttacggtgattttctaggcgggctaaaagctctactaaatgcatgctcctcctttagcttgaatttcagtagtgttgttggacggccgatctcttgcataagtgttaaattgacagccacttggtctgttcgttcggtgtcccgaaactcgagacggcgaatcatatcgtcctcgatcgtgtctttgctcgctagatctagcatcggattctgtctccgcctgacctgtcgaacctctctcctgcccttggctcctctcttcaagcctggtggccacctttcaaagcttgtatngcaccacacctttacaaggggtttgattacttagtccttctcgtttcctggcaactatgaaaaggacaaaactccaaaattttcgatttctctctttgtaggtctcggtagttctgagctccatcctgcaaaaagaccgcctgaggtctgctgcaggtgtcatgtcttttgaagactcgttgggtgagtagtggggcttagccttcaccttccccttactagcgtccagcttagatcaatcatttttctcttcatcgttcagttttttcctttttcctgtcccaatgttgcgcgttcgaaaaaaaaaaagcaaccgttgaaagttcaaacaagctccaatattcttagaatgcgaaaatggagtggttacaagtagtctacgtacgttagcaagacacactgtgtgaactgtcaaatttcaagcaggataaagccaaaaatattttaaaaatttatcagatctgcatttccgtatggcgagatctgtgtgtagccagaaatggagatttccaccatcaaaattcaattttcacggtgcatttgatcgatcgtgcacacggcacctacgtacggcgacgaagaccgccacccacttgctgatttgcctacaaattgcgagctctcctcctacggttgctcgcgcaacgcggactcttcttcttcttcttgcttgttgttgtagcatttgatttgagatatggcggcgcctgacatgtctcccaaggccggcaagccgctcgtccagaatgacgccggctcatacctcgcgtggtccggcaaggaccagccgaccctcgccggcgagaagctcggctgcggcctgctcgtcctcaagcccctcggcttcgcgctgccacactacgccgactccggcaagttcggctatgttcttggcggcagcgcggtggtcggggttcttccggtgggggtggacgccagggagagggtggtgcggctcgaggccgccgacgtgatcgccatgcgcgccggggaggtcacgtggtggtacaacgacgcggacggtggtggtggcgaggatgtaacccatcctgttcgtgggcgacaccgccggcgccgtcagccccggcgacttctcgtacttcatcctcgccggcccgatgagcgtcctgggaggcctcgatgccggcctcctcgccacggcgtcggggctgacgtcgccggagcaggcggccaccgccttccgcagccagcccgccgcgctgctcaccaggctgagccgcaagctgcacggcgtccgcccacgcgagcacgacaggcacgggatcgtcgtgaacgcggcgcgcgtgccaccggacagcaccggcggaaagacggtcaccgcggcgcacctgccggcgctggcgcagctcgggttaagcgtcgggctcgcgcttcttgacgcgggcgccgcggtgcgcgggccctgggtgctccgcgacgccgcggcgcaggcggtgtacgtcgccagggggagcgggcgcgtgcaggtagccagcgccggcggcgcgtcgacgctgctcgatgcggaggtcgcggcgggcagcctgctcgtcgtgccacggtacgcggttgcgctcgtggccgcggacgacgccggcggcatggagctggtgtcgctgatcaaaagctctaggtaagagaagtaatttgtacacctagatgtcctgactcatgacatctaaatgccggtttaatagttatttaaaaatttcataaaataataagatagattatggtaatataagatactacgaaaacattcaacaatgatgggatatcacctcgagagataaaaacatgtatttttctcattcagaaatataaaagtttaaatttaatctacacacgaagaaacagaataacatattttatttgttttgtataggtactccctccgttttttaatagatgacgccgttgattttttctcacatgtttgaccattcgtcttattcaaaaatttttatgcaaatgtataagatataaatcacacttaaagtactatgagtgataaaacaactcatagcaaaataaattataattacgtaaattttttaaataagacgaatggttaaacatatgagaaaaagttaacacgtcatatattaaaaaacggaggtattactatttagcgtctgatttttctattgtttaagacgatcatacatcatgtgcatgcatgcattcgtgtggggtgccgtacgtgagcggatgggtttttcacttggactttgttgtgtcatgcagaccggcgatggagcacttcaccgggaaggggtcggtgatcggcggcctgacgccggagatagtgcaggcggcgctcaacgtgtcgccagagttggtggagcagctcaggaccaagtgaacgccggatctgatctgtccggtgattgtgtgtggctgtcgtctcgtgtctgcgtgtcttgtctccggtgttcgatcagtccggacacttgaataatctgaaccaaataataacaatcaaaactgtactgtagtctgtaataataagctgaagctgaaattacatttcacaacgtggtgtttatatatgtggttgtggtccattgtactattcttggtgtaaacaatgtactatatatatttgatgaaaaacaatgtgttgacattgaatatttgcatcagactatggccgtgtttagattcaaacttttttttaacttccaacttttctgtcacatcaaatgtttggacatatgcatgaagcattaaatgtgaacggaaaaaatcaattacacaatttacatgtaaatcgcgagacgaatattttgagcctaattatgctatgatttgacaatgtggtgctaccgtaaatatttgctaatgatggattaattatgcttaatatatttgtctcacagtttacatgcgaaatctgtaatttgttttgttaattaattcttattatcttactactatcgatggtgtgcagtaaaaatggaagtacaaccctatgatcatggtcaattggattttttttttacttcagcgaccttcaaagttttgtccaattagagggcagtagtagaaattgaaaagtgttgttgagaccaagaaaatgcgaaggacgatcggactgacgtcaattcgtatacgtcaattccacgatcgatcgacttcggaagtctagttcacaccaaaattaaaagtttggttgaaattggaacgatatgacagaaaaattgaaagtttgcatgtgtagaaaaattttaatataatggaaaagttgaaagtttgaagagttattttggaactaaacatggtgctatctctcctccaaagtccaaacgtttccattcatatgtaccgtacatacgggaaaaaagattaacacagctttgtctgttatactcctaccttccaaaagtctaagccctatttctttttcatcaagaccaaggtgtaattaattcatttatcatgtgacaaaaccaatgagcatacaaccaataagtactaaaatgacttgttgggttcttatcaagaatctaatagacttttaaaaaaaccaaaaaatgaaatatgacttaaacttttggaaggagggagctgagtatgtaaaatactccatcgatagtaaaatataataacttttagatttcagaatttttccaaaaatataataagttctctccctaacattttttttcaaacaatcacaactgaaaccattcaatttatttacatacttctacttctcaatcaataataacttctctcgttaaattctatcaacttcttcaataatcgttccaaccttaaattccttttatattctgagacgtgggtggtacgtgtactgtacgcacattatatatctacacgtgcatatatacacgcagcggtagaagtacaaacgggtcgctttgggcctctttgtcccatggatgatcgatcgagctgagtatccccccgatgcggacgcgcacggtgggcctcgatcggcgagatgtcgcccggccgatctgatcgaggcgtcgtagttgcatgaaggaattccttgcatgaatataattttctcgcacaagtgtcgccgatacattgtaaatccaatcaaaaatataaagtggtcaaatcaagatagtagaattagagattgggaacaacaatctagggaaggcggaagcttgatattaggattagagaaatagaaaacaggggaggcagaactagaggaggaagaaagtcatggcagaaccagtttaatttctgttctttatgtacaatcctacgtgttcgcggaaaataatttgtgttcttcgtgccgatatagcctggacgctaataggccgggcggcttctctatcaggagcagagatgcacgtggacatggagagcaatccgcacggcccatatcaaccaccggaaacgaacgttgcggcccatagaacaccagtgctcaccaaacgcatcgcatggcccacttatttccgaccaccgacggccgcgagcggcccattatcctcgtcggtcgccggcacgccgcaacgtcagcccaccacggcaacggccacggtggtgcacgtctcctgttcgtttctgcacgtaaattttgcgtggactacgtggtttttcccatagagtgtagtgcgagtctgccgcgtttatccgttacgttttcattttttaatacgccccgttctactactagacgcaattaataccaacaagggcctgacaggtgcacgcacacgtgccgcatcaaccagacagccactttaccactaactacgcaatcagtgcggcctggcccatctccagccacccacccaccggcctaaaccacggcggcccatttcaacataaccacacaaacttatggagcatatagcgtacagttgactagtggtccgcctgggttccggtcccacaagtcagcgaaacaaagtgattcaaatcgaatagtagtagtaccactgtaccagcttataataaaagttagtattacaattaaggaggcaattatattttctaattgcggtgtgattaggttaattagcaccgggatctctctcgtttctcgcggcggtggcggaacggtcacttctcttcttcacccgacgcaacaatcccatcgctggtggcgatttcgcgaatccacctcgtttaaaaaggcaaagtctagcctagctttcctccctcttgctcgccggctgcggagaaggggttcgagtgagatagaatccggaggaggaggaggaggagattgcggcggccggacggcggcggatcggttgattgattgattggttggttggttggttgggttgatcgatggcgttcttggggaacggctactgctcgtcggggtcggagggggaggacgaggacgaggggatggaggggtaccggaagggagggtaccacgccgccaggcccggcgaccgcttcgccggcgggaggttcgtcgcgcagcggaagctcggctgggggaacttctccaccgtctggctcgcgtacgacaccctcctcaacgtacgcctctcttgccgcccccgattcctctcttgctttccgtttcttgtcttgtttttccccctctctctttgcctgttctttactcgatgctcggttggtttggttcggttgcttttggatattggaaacttcggttgaggtcgttggaagcttgctttttatctgaaactgtgcgccctgtctcctatctcctgttcatcaactgatttgtgtttggtttcccttcttcttttggtacagatttctgaaatgctctgcagccatttgtttgcttctgatgaaaaaaaaaagggagaaattttcctacatgtttatattgtttctaccgcacgtctactattccgattcgtgcaaaaaaaaagttttttttctccatcacaaatatagcagttgtatggtgcaaccaatatatcatgagttgtcaatttgagtattgcaagtccgaattttgcagagatttgtcgcgctcaagatccagaaaagcgcgagggattacgcacaggcggcactccacgagattgagttgctgtcggcgatagccaaaggtgacccgacaaattccaagaatgttgtgcaattgctggaccatttcaagcatgctggtccaaacggacatcacgtttgcctggtcaccgagttcctcggtgatagcttgctaaggttgatacggtacaaccggaataagggcattggtctgagcggagtcaaggaaatctgccgatcagtgttggtcggtcttgattacttgcacagagagctcggcatcatccacacggatttgaagccggagaatgttcttcttgtatcgacaataaacccatcgaaggacccagtgcgctctgggttcacaccgattcttgagagaactgtgagcaaccagtacagcggatcagtaattagtttcagtgagaagatgcttaagatgcgggcaagacgcgctgtcgccaagatttcactgaggagggagtctcttggtggagttgcagcagagatggagaaggagagaagcctggatggtattagcttgaagtgcaagattgttgattttgggaatgcctgctggggtagtcagcagcttgctggtgaaattcagacaaggcagtacagagctcctgaggtgatcattggtgctgggtactcatattctgctgatatgtggtcatttgcttgcatggcctttgagcttgcaaccggtgaagtgctgtttgctcccaagacttgccagggctgtagtgaagatgaggtaagaaactgttatttatgttgtttaatttcaacttctcaagaataccatcctatgtcttagtattcctgctagttctgatgataatccaggcatacaaatatgcatcaatatgtcacatagtcccttgcaacatacgacatattaaccaaataataaaatgcttttaaaagcatctgctagggccttggcctcttgggccacttcatcaaacaaatgtgcaagcagttatcatgaaagatgcacccaacctgacaagcaccaacctagctactgaatctttagaaaaatgaaaaatgaatttattgggtccacactcttactcagtagtattcaaattaacttaaccaacttctgatctgcagaagttgatggtgaaggatatcatgtgatgttgctatttgagcagtttttatcatcttgcaaagtcactttcgtttcaatatcaatttccgattaaaagtactgaacctattaaattttttcgcataaaaggtgccagccaggatactaggactgttgtgcagtgtaaactgcgtcgtaatatgtactgggacaaattgatctgtgttgttattgtattgaagaaaaaaggaaattgtcctctgttctgattctgttaaattcatacttatgaagaaaaatatctaactgagaaattcctcttgccagatataatgcactggtacatataaagtaccaaccggtgatccttgtcctattaaaaataact

SEQ ID NO: 58994 - DNA, 2311 bp, Oryza sativa
tttcttttatgaaatgcttgaccatcatcatgtatctggatgtagtagcagaatttccattagtgtgttttgggtgtggagctagtgaaatgctaattaacgtcagcatgtgcgctggcctgaattctgtcggctgtgcctcgtgttgatgtaaagataaatatttgctaatgtgatctgggccatctggcagtggctaccaaaccttttatcttttggttgagaaagaaagagcagttccagtgcagctgtgcattgattctttttgctcaatggattctgtgctgtaaagttgcttactggttcagagccagcgtgctccgttgcagtttgcttgctactgcagtttttatctgtgattcgagctgtaacctgtcccgtacacgttttctgaaaaagagaggcatttgtgttgtttggtgaggaaatgggattatatgataagaagttaagaaccttttaaactggtgtatctgcaacagttttgtgccaactgctgaatcgctaagcaagcgagatgtaatgttgtgcaaatataaaaaacgaaaagttatgctaaagtactttggataataaagtaagtcacaaacaaaataaacaataattccaatttttttgaataaaacgaatggttaaacagtgcaatcaaatatatcaaaatcccttatattagaggacggagggagtatatttgaaattatatttgtcaaatgtgacaagtccaggtgaccaggtggaattttacaccaatgatcttaaattctggttacatctcaatcaactgaaaaatgtaggatattaagattgcacaaatgaaaaatactagtaatttttgaactaacacgtcataaaaaaagagggggggggggagtatgaaactgttgaaaaagtaagttcatgatattaaaaattcacaataacccataatcatatcataacaagggttcatttggtgaaactcttactctgagattcttgttgcatgaagctcgaaccatagcagacactttagagattctggatgatacagagtgatgttgttgctccgctcctaaaaattacactgggagcggcattcccactacttttcagctccgatccactatcacagtaggagctataccaaacaaacccaaagtaggcaagtaccagtaatgatacatttttagcctttgtaaatatccaaaggaataagtttactttgggttcctctatttgtcgcccagtctgattttcgtcctttgatcgcaaaaccgggtataataggtcccccaacttacgaaaccgtttaaataaggtcccttggtagtatttgacccggttttgactaaggtggcgactacgtggctactttgactcggtctttatctgacgtggcattgacgtggcgcttatatggcaattcgatccgaaaaataataaaaactatgagacccacatgtcagtttcacacacacaataattttaaaaaatggtggggcccacgtggaccccacctgtcatcctcagtaccctctctctatacccctctctctctcctcttctccgccgccttcttctgcgtcgcgtcgccgctatccgtgtcgccgcgccgaccacccagacaccctccgcgcgcagggacggcatcgccgagtgcctctacaccgcgctcgtcatcctccagccgccgctccacaagccgcctgccgcctctcaagtctcagctccgttgccgcccctgtgcgccttccgccggcgctcaccattctcagggagagagggggggatagagagaaggggatagcgagcactgcgccggagaagaaggtggcggcgggccgcggcggcgctcggggcagacccaacaaggaagtcctcctcctcctcgtcgctggactgcacgaaagcgaggcgacgaggccgaagatggcgagcatctcggcgagcagcgccttgggcctccccatggcggcctgcacgaatgccaccgccgcggtgctgttcgacgacgcggcgtccctccaccccatcgcggcgtccgccgccgccgagacagcatccccggcggcggcgaaggtggccgccacggccctctcgacggctgctctgatggcgcagaggaggaggcagctgaggtagcccgggagctggaccagcatgagcaggagcacgacggccatggcggcgcccttgaacacccccgcggacgagcaggtgatcaccgtgctcagccctgtgatgaacagcttcgccatggccattgccatcgatcgcctcttgtctctgtcgttcttttgcctgaacacgacgtgttcttgagatttcttga

SEQ ID NO: 58995 - DNA, 5033 bp, Oryza sativa
ggagcgacgcacgcatgctcgccggtagacaagggagctcgcctagccgtccgccgcccttctagctcgctggcgggagaggagggagctcggcatggctctagcgcggcgtaggcggcgggaggacgacaagcgcggtgtagaggcgctcggagatgccgtcctggcgcgcgtggaggtcggcggcggcgacacagatggtctggtggtcggcggaggtcccggcgcgcgcgttggtcggcggcggcgacacggatggcggcgtcgatggcgtcttccagggcgctgccgcgctgctcgccttcacgcggaccggcggcgctccggtcggggggcagcgccgaccacgcccaccgctgccgccggagctcgcctgctccactgctcacccgcgccgtcctctgcccgggaagaagagagagaagggagagggaagaagagaggagtgaggctgacatttggggcccatatggcaccaccattttaaaattatttctttttgcagctgacatgtggggccacacttttttttattttgctgagatatagttgccacgtgagcgccacgtcaagctacgtgggacggagacctagtcaaacaagccacgtatgcgccacgtcagctaaaaccgccttcaaaaccaccgaaggaccttgtttgcccggtttccgtaagttgggggacgggtcatgcccgattttacggtcaaggggacgaaaatcggactgggcgacaaatagagggacccaaagtgaacttattccatatccaaatccaaaacttcacttatttgtgtggcccaataggaccgattttgctcggaggatagtatggctttgggtgggccggattcagcccaattaatggctcattcgccgggaagaaaagctgggcttccttttcctgagaagaagaaaaaatgcagaggaaaatttctccttagcgacgacgaggcggcgggcggccactctccagtgtcatttgcccgcctcacctgcactctctccatctctctcctccggcgaaggcgcggcgcggcggcgttctccccccgcctcgcctcctcctcctcgcgcgcgcggccgcggcgagccaggctcggaggcggcggcgttgacgggacgggctcctctcctctcctccccgaccacaccctaccttcgcccccgcgctgcctcctcgcgcgcacggccgggagacaagccaggggcgacgcggccggcctcgctccgctcggctccatctcggttccagtcgaattggaggtatccattctccctctctcagtctctctcctgctgcctcgcgccacctcatgagccggcgtccgcctctgatgctgcggattctgaaatttttggtttacactggtgtccaattcttcaatctcaagttggggtttaatacccgaccacccaaacctagaccgaagggtagatgcaggatcgtactagagattgttgagttgctgcagaatttaacttctggataggtaggtagtttgtgcagtttggaagaggggatggacatttttgggcatgggttacgttagttgtttgtcctagggggaaactgatcgtttgttgggttcgtggtggctactccatcaatgtaagtggaaggatactgtggcttcttacttctattatgttcatggtgcctgctcatttgatctgacatcatgttcacttcttcaagcaacctatctaagtgtacatttgaagtttctggaagaaacttctgatcttgtctactgtttttcttggataagtttcgctgccaacagttgctgattgtactattcccccagaatgcttaaatgcagacaataaaacggttgccaaaaagtgtccatagctcgttgcgctcaagcattgttctatttgacctatcaagggttgttgaggagctggtatataatagcattgacgcaaatgcgagcaaggtattactttcacatacaaaaaggcaaactattatgcatgcagtatcttcagtgacataagttttctttttgattcatttcagattgacatctcagtgaatgccagagcatgttatgttaaagtggaagatgatggtatgcctttatagctttgtaccttatgttttaaatttcttactgctggtatttgcttttagaatagtgtttcctgttgcaactattgcaggctgtggtattactcgtgacgaactggttcttgtaggagaaaaatatggtaagttaaaacttctactattatttatacattttcgtttactccctatactcaaaactgctgtttttgtcatattaaacaatgagggtgcattgttgcaagctccttcacttgttgaagcaggccttatggatgcttatctgatttctctaatgtcagaatagaattattatcttacagaaaagaaaaggtgaatacatgatttgcttagaattagatagtaataatggaaacagtatcattctgtgatatttgacatcgattattgatattgaaagcagatgtgtttattactattttttatcatcagatgtttttattgttattcgtatagattgatggttggtaaatgaaatcactgtgttgtttttgctgctgatgtcacccagtgatgctttatgcaaatcatcattaggtgcataaggatttcaagacaatatatctttgatttctcacttatgggtcatgagaagttagttgcattaatacctgttggcaggtgtgaatttactattttgtttattatgcttattcaccgtttctttgcaaccaaatatattttgatgtgctgtcctcagggtaaaaaagaattaattgtcagtgggtaggattatagaaacccctttatttaaacttttgtatcttgttagattcattcttttttaagacgtgttaaatgtatatccaccaccttaattacagtaaccattcactcttgttttcaatgcgctaataatgtataactcttttattccataacagcaacatccaagtttcataatgtcatggttgatggggaacctagttccagaagttttggattaaatggcgaagcactcgcatcactatctgatatctctgttgttgaagtcaggacaaaagctcgcgggcgaccaaattcatattgcaagataataaaggtagtttacacacttaaccttttaaaagctcagcataatcttgatacatacatccatagcgtatctgaattcttctggcaaatatacagggatccaaatgctcacacctgggaatagatgagcagagggaagttgttggaaccacaggtacatttttactctacatttaaagatcaagaaaataaaattttactctagtcgtgtattcatgtgtggtatatttacattttttgccatgttatataagctacgtatcgtaatgtttttcatttttgtgtagttattgttcgcgagcttttttacaatcaacctgtacgcaggaaacaaatgcaatctaggtaaatcatgttatctttttcatctgtacatgtttcttacaattcacaattttgttggaaagaagatttgattgtctttctcaacattatgtttttgtagttacaaaagagaactacatcttgtgaagaagtctgttctgcgagttgcactcattcatccacaagtttcactcagactttttgatattgagaggtagtctattgtgctacactagccatttttattttaccaataccgcgtgagaaagtgtatctattgacatatcttttttatgtatgtagtgaagatgagttgctatacacgattccttcatcctcccccttgcctcttgtatcaaacattttggggaaaaatgtctccagctgtcttcatgagatagctacctctgacaagcattttgctctttcagggcacatctccagaccaacagatgtgttctgtaataaggtaacatttatcatataagttgtgggttgttgaacaaaagtttggcaacatgtattcagcaaagtgtgtttttcctctgtaggatttccagtacttgtgtatcctacaatccagttcttcactgtctatttccatagtttcacataccatttttctgaaagcttgagttgggagatatccttgactttccaaagatatcaactcaagattcgtcagtaaaagcccaatccacaatatgctcaataacctggcatctagttttcaatcttctgcaaggaatgaggaaattgatgttcggagtaagaagaggcagaagaatgaagtctaccctgcatatctgctaaacttgtgctgtcctagatcaagctatgatctacattttgagccttcacagactattgtggaattcaaggtgatccattacacatttatgctttttaattccccttctttttctggtaaagcttcatatgtaaacaactgaccggataaaagtggtttgggcttttttttttttttgggggggggggcatgttgatttgtaccttcatttctatttattttaaaagcaaattttctttcttatagcttgacattcatttcccattcttttttatggtttttctactctttaggattggcaaactgtcatgtatttctttgaacgaactatcacagactattggaagaagcatgcacctcaactgccagaaggttagaaaaatatttacttccgtaatgatgtcttccctgaacaattttgaagtctagaagctgttgattgaatgattttcttattgttatccttttctattgtagtgaaagctattggcaatgatacctgtgtgcctttggaaagagatggtcagtgatttagtgtacacgattctcttcctcttttgattcgtctgccttgtgagctttgtgcacgtgttgtttttgcagtgaaatcaagtcaggaactgttaaggcgtcatggtgtgcagaagaaagaagatgtcgctgaattgtaccaaacagctctgcagaagaatacagtacgagacatgaattttgatacagctgccccagcaggtcctaaaggcaattacctttctttggatatgg

SEQ ID NO: 58996 - DNA, 933 bp, Oryza sativa
aagttccatgatatgcaagcagtttgcgaaagtgattacatggataggtccttcatcaaggatacatgtggccttcatttctttcatccattctcgttggctgatacacctcgcagtcacagtcgtgcaaggattgacttggaattgcatggaaggtcaaatgaaagcattaacagttggaactgtgaaaatattggcactgattttggatttacttcagacaggtttaatattgattcatcaatgatttttgaaggaagcaaacatctcaataactttggcaatggaactcaatctcctagttacttcaatcatgaatattgttctgtcggtcagtttgcttccaaacaggatcggatacccttgaaatcaaaacatgatgcaagaatgtcatatgatatttctcctgagaaaagttctactggttgtcatttgaatgtttctttttcccaagtggcaaaaagcagcaagcttactgaagatcagtatggatgcagtcagaggcccaggctttccagaggtagatataggagtcgttctgcaccaccattttacagaggcaaaagaaaattccctagattaaacgaaccactaaccaaattgactacagaaggtggtaaatataccactgttaatgactcaggaggtacgtcttctcagagccatggcaaatctttatactgctctgtcatgagcaataagtttgtatcttttatactggatgcagatatcacacctgttcaggagtatacatcacatatgaacgcaacccaacctattcctgagacctttagcaatgacttttctgacctaaatttcaggtatgcttcttttgcatgttgccatactactgagaatgtcttactctttttttattttttcataaacctcttactatgtacttatttttgccattttcttagcttgaaggga

SEQ ID NO: 58997 - DNA, 1100 bp, Oryza sativa
aattcctgcagccccttgagcgcataaaatgtttgaaatatatgcaggataccggaaacttgttggattttttctttctttaagcaggaagaattcattttttatgttcacatactatatgaagtagtcagtgtgtatatggtgacaaaggtacttctcggacagattttagtaacttactccttgttcttactattttacagcatgcagctgatgaaaggatacgtttggaggaactccgtcgaaaggttgtttaacttaaattgaccaggaatgttcataacattgtttcccctctttcatattcactttgtttggatttacaggttttatcagatgatggcagagggattacttacttggactctgaggaggacttagtacgtcactttatactttatagcagttggcatctgctgcactgtgttaatagcttaatataatatatctaagagaattattttgagattaagataagttttctttgaacactaggatgtgttgtttgatcttctatcatctatttatttgccaggttctccctgagactggatttcaattgttccaaaagtatatgcaacagatccaaagttggggctggatcatcaacagtactaattcctgtgaatcattcaaaaagtaggtgcctgacaatcatgtgaatgaaaaactttcttttgtgtacttagccttcggtgctattttatcgaggtcttcttgcacatcttctagttatgttcatttgaatctacttctgtaattaagacaatctgagccttctagtgctgtttaggttgcacaattttagtttgtgtttatcataccttcagcttcttatagtataagaatagtcagttcagaaggtcacatgaatttcttcaattaacatttggtgataacatgttatgatgcttttggatggctcagtccatcattctctacccattgtgaaggagcaaaaagctgtttatcccctctgtatacactagaatataataattgacacataccatttactttatattttaaaggaacatgaacgttctgaggagacaatcgcgccgtcttactcttgctgctgtgagtaaccttttctgcga

SEQ ID NO: 58998 - DNA, 1564 bp, Oryza sativa
ggagtgctctgtgattatcgaagaactgaaagcaacatctttatgtttccaggtaccatcgaaatgctacaatttccagatcttattcttactgttatctaagccattggtttactgatgaaagctccattaataaaccattagtagtgtctaatcaaggtttttctttgtttttttttcctggcagtgtgctcatggacgtccgaccaccgtgccgattgtgaacgtcgcatctctccgcggcgagttggcgaggctcggagcggtgaacggaaggcaagaagagacctggcatggtctctcgcaccatggacccagccttgaacgtgctcgaacgcgcctcagagaactgagaaagctacgtggtggcctgtagctgtacaacagtacaagatgtaggatcatatagagggtaaatagtccaaaagaaaaggagaagtgttgcatagtgcttcaataggaagcggcttgtagtttgcagagatagatatgccattggttcacgaagaagaggtaaaatggccatgagccgtgttgtacacttgtaaaccattgtgatttgtgaaggccattctcaccctgtaaatatatgacaatatttttcgcagttttcagagcaaaagccaagtccggctctctttttttttttttacaaagcaaaaggtaataagcttagcagcttgggctcctttgaaacacatgaattttaaatgaactaacttgatttctacaaaatttatcttacaaagtccgccttaacaaggtttttgcctttctttccagatgatgaccaaagtagaagagacagtggtagcccaactcctcaatcctcaatctaaagttgggccttgcttatgtgggccagcctatgatcccaagccaattcagcccatgatgagaggacggcctctctcgtgaaccgtgcaatgtactcctacggtacagcgttggcgcgcggctgcggctttcggagttccatttccccccccaaatcctcccgcccaaatctcggtcagtctctctctctctctccaattccccatctctctctcctccacctcgccgccgatgggcgccgccacggcggacgaagacttcgccaccccgccgccgccggcgcgggcgcccggcggcagggtgtaccaggtgggcggcgtgccggtggagttcccgtacaagccgtacgggacgcagctcgccttcatgggccgcgtcatcgccacgctggaccgcgcgcggcggcagggccgctcccacgcgctcctcgagtcgcccaccggcaccggcaagtcgctctccctcctctgctccgcgctcgcctggcagcgccactacccgctgcgtgccccgcccgccgccgcccccgacccgttcctccacggcggcggcttcgtccccgacgacacccagaagcaggcgacgcccggtacgcccccccgcgcctctcctctccgctcgtgtcgcttttttgcggcggttcttggagccgcagatctgcaaccattcttgctcatttcgctctgcccgttcttgatgtttaggcgtcccggagaaggcgaccagg

SEQ ID NO: 58999 - DNA, 1362 bp, Oryza sativa
aaatgaattactaaacaaacaagataaataaataagagtaccttgtaaactttgccaaaacctccctccccaatcttatatgcttctgaaaagttgtgagttgctagagcaatgtcctcaaattttacaaataggaattcaaaatcctggacaaggtttcttttcccaacatcatcggatgtactcatgacatccaaaattagctctctgtgcttctgcctatttcttctcttgcctgctcacaaatgaatatagatatcaatcattttatgagtaccacattggcttctaagaaacaaaaatacgttgattatacctttgatttttaaccatgcaaaggaaatgcatagaacagtcaaaatacaagctaaaactggcagcacaatcttgactgcgtcgctcttcgccgttccacctgtgcaacagtgccagtatggtgcaaagttttatgatccaaataacaaattgtaaatactactacctccattgtcaaatatacagagccacacattgaaatcctaaattgttaataaatttaaaattattagcatttgaaatgtggaaatgatgttaatataattgttatgttaaaaaactttatatattttcatttttaatatttttataaacatgtaattaaaaaataacaacttttttattgaaaactatgttagaacgtcaagtaaaaaagacggacatagaaatagtgatgcatagaaatataaaatatgctatatttgtttttaaattgataatgctgttgactttttatataatttttgaacattgcttttttttaagaaaaaatatacacttcatccgtcgcttaaatataagcatttatgtctatacactagctacatagccaaaaaaaacatctatatttttttaatggaggaatgatcatttattttgttgtgacttgtttatcatcaactatatttcaatgatgacttattattttttaatatttacactagatttttctaaaaaaaattgaaaatttacccaacgccatgtgtaaaaatcaaaatcagcagcatatgattcgttaaaaaacatgaggagcaaacagtgtgtgtcattttttacccgtatcaaggcctgcaatcctgaggtagagcgtgtcgctgtggccgctcccgaggccaactttggccgtgtcgatcaggtcccctgaccacaccaagcacctcgtcgtgtcgcccctggacctgctgctgctcaggttggcgtacgcgtacgccaggcacgagcagttgccgctgcactccgcggcgcacgcctcgagcgtcgccacgttcgccacgtgcacgaacttgtccggcggcttcatcccggccacggccaagaagccgtcgc

SEQ ID NO: 59000 - DNA, 2110 bp, Oryza sativa
gtagagcttggccggggtggagttggagggggagaagaagcccatggcgaaggcgccgccgtcggagacgacggtggcatcagaggttagcggcttaccggggacaagccggtcgtcggatgaacacggcggcggcaggaggaggaggacgacgacgctgatgatgacgtaggtgaaagcatctgatggatccatgaaaattggtctctttcttgctatttgtgagccaatgttgctcagaaatcttctcaagacatctgcttgctttagaaattgacggggaaatcaaaatatacaagcacgtaaaactaatcggtgtgcattcacgctatttatactcattgcttcaattaattgaaaatactcagtgtttgactcttttcagtcttcaaggtacagctttgacaacacaattatttattcgaatacggttaaaaattctaaagccgattattggctattggtcaccgaagagtatttttgacgacattcagcattgacgcatcagcttagctttgacaacataaggattatctattcaacatgctgtggcggttattggtcatctcaagccgattcgcgttgtgaaaccggttagaaactcgagaagtaaaaaaaatcaacatttcggcaaatttatcaagttttaccggctttcgtggcggtaattgtgataaccgacaaaaccgcctagcaaacggtgttcgcctggcaagtatgtatttgagaccttgatgtgtcctctcattttttccatctaactggctgttttggtccaaaacttcgacaaatttgccgtggattgcttcaaatcaaaccaacttgcgtccttatcctgaaagcttcaataaagacagctaaaaaaaagaccaaaaatacttcgccgctgctactttacgatattaataacacacagggtcagaaaccagtatttgactacagaggggatgcagtatctgtgtgcttggcataaaatttgaagctaattttgattattcttagcaattattggaaataaaacatgggcaagctagggcaacgaagttgacggagaagcctttgaaaattaaattctaaaattcggctggtgggtttcaacaacaatttcttcggaatcagtaattaataaaatcttagtgggctatcagagagagtggttatgctagcagccaagcaaatagctctattccattatccatttatcctactggtagttgcgttgtatcatatcttaactagtgaaaatactttctcatgatgaaaaaagaaagagccacgtcataccataaatattggtcataggattggctataaaaaaagagaataaatctcagccggggttgcaaggaagttactagatcccaagaccacttacgaacctgccgatctgtcacaccaatggcccattttcatttttaaccctataattatttctctttagatgtatctatactaatataaaaagaagttgtcctcctccaatgctacaggtcaaatcatccaaattgatctgaaccgtccatccgcgcgcaagttttctccaccgcacgatttcaccgccgaggattccacgcgcgaagacatcgttcctcctccacccgcggccgcgaagaccgcgcttcttctcctcgctcgctcctcctcctccccgcgtcctcgccggagctcctccccgctgccgccacttcgccgcatcctcgccggagccgacctcagccccttccgccgccaccgacaccggcgtgcactccaccgatggccggcaccgaggttggccctcttccccatttgccacttcatcatcatcagcatatcgccagtattggccccattgttgaaagcctagagtacgagtaagtccctaaatcctgttctttccttaatcttctccatacgtgtggaaattttgatctctatgtctgatgatcttcgttcttgagcattggtggttgcatttggtagatgaaaacacgatctgaaaacgagtaagttcccttccacctccaccgctgccaccgtcggagccgatgtcttccccagccaccgccgaagctgtggtcttccccatccggcgccgccgaactccaccgaccccgcatgccaccctgct

SEQ ID NO: 59001 - DNA, 4445 bp, Oryza sativa
caaaagtgataaaggaagtgtatacatcactatccacacattcaaccctcgaagcctgaaactttagctccaatcccgaatacttcttgaaaaataatagaaccaaggatctcattgatgtatgaggcaatatgagtcgcaattagtggtatcgacgcgttggcacctagttacacgataagccctcaaagcaagttcttgaaatagtgtgcaaggtgacatgagtctcttcggctcttgaatcatgcagaacattcatatgtttgtctattaaccatttcacacagccaaatatcaccatcaatatcattcatgctatcccctcaaagtaggatgtagcaattttcactcacatccattttcctcttgattcctcttctcttagggcgacactaatttccatttccatcgaataatgacaaaataaaatgaaacagataacattatttccaaacaaaattctttttctcttttttttctcctccctctctttggcactctctatataagctttcatgctggttatgacatgtctcctatttctatttgattgcatgcatccttaaggctcttctccactatctcatctagttgtttagcggtatttgctctccgtcatgctaatgtttcagctttaagactcttagaaaaagttgtatttgcattattttctgcttgcaagacttgctcagtattcacttgttgcttaatgttagcaaatagcaaccctcttccttgcttccgtagcttagcatatgtgtttgaagttcttacccctcgatcaatcaaagagccatatttgctacagctagcactattactcacacatgaatactagcagctaggtcatgtgtgtatgctccgtaatatatattatctatgtcttataggagtaagtaataattattatttttttaatgatattacatttatatgagtaaataatacttacatgcatatgcattaaacagtgaatcacaactcacttgaataatatatatagtgcactacgatcactggattaataacaagtgttgatatctaatttacccataaaaatatttatatgacttatatcattcaatattattaatccttatagcattatagattaagtttagcaaaaatatctttcgtattaaatactatatatacacttgtttaatatctttcgtattaaaagtatttatatgacttatattgtttaatgcataaattaggtatcaacacttgttattaacccagtttctagtcctttttgaaattgagtttttacatttctttagagaggtatttaagggtattgtttttcttatagagaaatcgattttttaagggaggagaggatacaaaaatttgttttttcgaaagctgtaataaaaaagtataacaaaaatcaaaagttattttctgagtatgaccaaaaattgcttaatttcagcgcaaatggttatgggttcaggggttgatgcggagtggatactatgtgcttcgacaggaatcctcgagcctctgaagtttgaaccatgaacgtaatccattaataaaactaggaaagaagccgcgcatatgcacgggtatcttgttcattgtctgtaaaaagagtgctaaaagaaatgatatgtcatattgtaagtactatagattatcttataataaaaagagagaagaaatatctacgtagcaaaatagaccatatactgtaatacactaacaataagaatgtctcttggattcaactaaaaatcactttatcccaactatacataatcttgtctattatcaccactacttattatcatcatcttcaaagctaggtcaatggaactgcacttataccacctaaataagcctaatacatcattaatacactaaaaaggtcatccacgctacatatctaagtgttcatatctcacttatttccaagtcatcctcgctacatatctaagtgtttgtgtcttatttcttttcacatcatacccgccatagacctaagtgttcatctctcacttatttctaaatctatttatgactgagaatactacttctaccatataataagataacaccgttagaattagacatgaatacccctctagtgggtgaagccgaccgtagccaccaagtctttcttctctattgccttgaaacatggttcttgcattaggttatattttaaaacatgtaacttagctttgtttttatcctatatttctagaaaatatataataattagtagcaagtataaacatcatgaacatattttgcttctaattttaattctacagttttaacaacttataggtacaacttttgaatttataaaggtgagatggagtattcataaaacacatatttctttccctctaatataccaccttcatcaacttgttagcgtatattactatgatgcggtgtttcttactcagtatcccacaaaaataaatctaaaaacacaccaaaaggatattttaaaggtacaatgttgatacaactttttaagtatttgattaattgcttaaaaaaatctcacgttctaaataatctctaagtagtatacaaatgctaaaaaaagttttataggctaaattagcaagtgtgccaatagacacgctgattttctagtgtgttctataacacaatacattggcccagtttagttcacgaaaagaaaatttttgggtgtcacatcagatgtttcaccggacgccgaagggggtttttggacacgaataaaaaaactaatttcataactagctggaaaccgcgagatgaatcctttgaacctagttgttgttagcatatgtgggttattgtagcacttatggctaatcatggactaattaggcttaaaagattcgtctcgcgatttacatgcaaactgtgcacgtgtgggttactgtagcacttatgactattcatggactaattaggctaaaaaaattcgtctcgcaatttacatgcatgtgttcaaaatgtgatgtttttgagaatttttttttaaaaactaagggggtgtttggaataaaaaatttagtccctctctccaaaaaataagggggtgtttgggaactagggactaaatttattccctctcacaaaagcataagtcattatggtagggacttatgtttttgtaagagggattaaagtttagccccactttagtccctccaaccaaacaccacctaagtctctaccctaagactaaagtttagtccctctctcccaaacacctcctaaaccaggcctaagagcaggtacagtagtaggctataagccagctgtaaacatattttaagaaaataaatgaggagagagaagagcaacgggctacaaatttatagccagctgtagcacggactccaagacaccgtgtgtgtatgacaggtgggaccatgtattaatagtgtagtatgtaactattgtatgaatgagctattagattgactatagatgaattgaagctagtagttggctacgctattaaacttgctctaatcctcatcatagtaaaaagtttgggataaacagagagtagcgcccccaccaatgacacgtgggccccgcggagaacacccaccaacatccgtgaaacttccgagaaataccaaaaatacccctccaagaagcacagggggaaagcacaccgcccgaactccgcctccgccccgcggccggacaaaaaatccggaaccccacccgtagaggcaatgacatgtgggccccacgtgaacccagaccgcctctctcaggacacagcaaccgcgggctagcgtacgcgccgcgtacaagagggaggcggtagccgcgtcgcgcgccgcgcggccaatgggaggcgagctcccggatcggtgacgtggcgagaaaatgttttcagatcccgcgcaaactcgcccaccgcccccgcctttaaaggcggcgcccttctccttcccctttcctctccaaatccaatccacccgcatcgcatcccacccacgaacgcttcgccgcttgataaaccaaattccccaccgccgcttcgttctcgccgatccggaggtaaatccatggctggctgcctcgaaatgctgctcgaatctccgcgtgttgggttgtttgtgttggttcgggagtgtgtgttgggttttgggttgttgtgttggttctgatcggttttgttcttactcggtagggctcgagatgaaggcgaggtcgaggtccagcaatggcgactccaggtgagttttgttggtggttttgtgcttgtgctcgcgggtggtttcggttcgttttggttgggttgggttttgatttggggttttttgtggtgtttcgtgaaggctctcggtgaggaagaccaaggcggagaaggacccgaacaagccgaagaggccaccgagcgcgttcttcgtgttcatgtgagtcttagatccgtgggtttttgtgttagtggttctccg

SEQ ID NO: 59002 - DNA, 2219 bp, Oryza sativa
agattggcaaggctggtggtgacaagtggaagtccatgactgatgctgtgagtgtctcacttccccttatttgaactgttccatgtgcatttgcgctaattggtcgcgaattgaggagttgctcggtttctctgatgccgtgtctcgttctagatccgtttactcttgtgatgccagtgttgtccatgtctctgtattgctcgtatggatctaattgttgctgaggattaattttagcctgcttacttgtatcactgttgctggttcaacttcaaatatgtgggggaaaatgcacttaaatttgtttgctcatgggtaaattcagattaggggttatgtcgtagttgctgtgccttgtaaggtcggtcatacatgttcaccaagttgaaattgctcctcgttccaatcctacaaatagatctgtaaattactgccctaccttacttggttaatgttaagtcagaatgttcaccgcgaagtcaaattctagtaaaattttgtggccatatgtactcaaccgcgatgtttaggcttgtatttggaacagtggtttcatcatttgtgctgatttgttgtctctgtcgtttgttgtgaatgctctgttagtgtttcagtccaccttgtgctttgtttagctcttacatttgaggtgttgaaacgatgcaggacaaggctcctttcgtgaccaaggctgagaagctcaaggctgagtacaccaagaagattgacgcctacaacaacaagcaggtaatccccctctccacaactctgcacctgcaactgtcatgacacattgaaactgatctgttgtgcgtttctcgttgcaggcaggaggcccggctacctcaggcgactctgacaagtccaagtccgaggtgaacgacgaggacgagggcagcgtaagacctccctccaatccgcaacaccgtgtctccattaactcataaatcttcttgtgtgacctcactgactgttttgtgtttgtgtatgtgcagggtgacgagtgatcgatggagggctgcaggtagtagggaaagttctcgagtcggcctaaccaaagtggacgttgctggttgctgctccttgctagtgttcggatgttgctgcctttagcttttagtcttagaggtctcctcctgtagcttagctctcatgtggtgtcctcgctctcttcggcacttgaccaccatcttgtcgtctgttttgtctcactgtctgtaatctaagtgagtactcgtatctgttgctgttttaaatctcagatctcagtagatggtgccatctgtgttagttgctgaagaggaaaaggaaaaaaatataacaagtctcttgcatcctgtttaatgatgcatccggatctgtcagttcgtttacttgctttgcattgtgatgcctcgcttctgaaatgtttctccatgcgcttttgctgtgagcctgtgtgcagttctctgcattggtttgggtaaggttcagtactacaagttgctgaatgtttgtggtgcatctagtaacctgtgtggtacagtaactgccactgctcgatcttgtgatgtacagtaataacttgatggatagtagttatgtcttgtttagccgcgattgttggaactgtctgagaagtggctggcaagttgcattctgttttgggtatctcatatctgcatgcttgtgatgatcttctggttggttcgttggatgtgaagctcccggcatgtggtggtattgtacacgttctgtcaggattggagccgaacagcagcttggtggttggaaaggttcttttctcagttttgttgttactcccattagggcatccacaatgttgatttttaaccggtaagaagtattaaatgctctcttcctatccggtaggaagcattgtaagagtggcaaagagttaaaacccagccatacatctactcactgatgtactgtagtgatgattcgaatgcatggaaattgcggagagtggaatatatcttgtgatttctactgtagtaacttgccacgcaatgtccacaacttctgattcttccagtgtcaggtgaggattttgttggatccggacctgctttcaagagatattattttttgacagttttggttagtatttatgacactcgaagtgcgtgagctgcttccgtagcatagtggtagtgcgttcgcttcgtaagcgaaaggtcgcgagttcgatcctcgccgggagctcgatccctttc

SEQ ID NO: 59003 - DNA, 4947 bp, Oryza sativa
aaagttaatttaagcacaccgccacactgatgcatgattatatctgtacctatatatctagctttctgagaaattatgatgtagattcatgtgcaatcttttggcaatcaattggtccatttggtttgagcaaatcaagcataaggttaattctttaacacactagtgtcataatggtgttctattagttaggaaagagagataagttaataagagagaattaaagaagacggccagccgggtaggaaggggaggatgcgagtatgatgatggattcagcgtggaataaagtggaaagcaggcgacaccgacatgcatggccttgagagggaagaggctggagatcgagaagaagctcttggctttgctttgtctctgcgctttaatgtctcatgatcaatgcactgccctattcagatcagtgtctgctcatctcagtattaaagggaggattagttgtaactcaccaaagaacgcagcattactagtgctccttagacctggcctggctttgtgtttttcacaggccagtaagctagactacagatttgtctcatgcatttggagtagatcataaagcaaagggatacatgtcacataactagtagtagtaatacactattacatcacttggaagttagtacttctactgcagaacagatgcaaaaaagttaaattttactccctcccagaaattttctttgtcaagggcgaaagaaagggatcaaattctcaaagccctagctactatacccaacctagcttattatagctgaccaattagcagttttccaagcaattaatctagtagtagctgtctagctaggatcgttgccctatatcacagtatgatcatgaccgtgactgatcattgatcatgatgagtgaaatagtcatcaaagagatataagtcaatttagcaaatatatttacatggtagatcgatctatatacacatgtagtagctaaaaactaagatgatagaatatagatagatagatagatatataccttgatgggcatggtgtcctcgcagtccttgtcgtcgaggcggtactcgtgcatgacccagtcggtgcggacgccctgcggcgcgcggccgcggtagtagaccagcgtcttcttcatcccgatggcgcgccccccgtgctggtgcaccacccgccgtctttccccgtcgacttccagtaccccgccctcgtcgccctgttcgtcctgaacccgttcggatacttccgatcccgaggcccgaagaaataccactccggatccctactcggcaagaacgatttctctgcaaataattccatccatatcatcatcatcatcatcatcatcgacatctcatgtcatcgatcatattaatcagcatgtgttcaattgttcatcatcaggattgattatatatatatatatatatatatatatatatatatatatatatatgcaggcatgcatgatcacttaccagcgagctcccatggctcgcacttgtagaggtcgacttcagggatgatgtcgagctcgatcttgagaccgtggatcttcctcttgaggtagtagttcaccaactcctcgtccgtcgggtggaaccggaaccccggagggagccccaccggcgccatcaacgtcgatgtcggtggccgccgatatgacgacggcggcctctccggctgctggccggcctcctcctcctcctccggcgccggcagctttgcccaaagacaccttgcttcttctgcgctgctgctgaggcctttcccagctgctgctgccaccacccttataagtaggtttttcaaggcagctaatgctggggtaggaggcacagtagtagggacaccggtcgacatagtcatccctcccacaagattttggtcgatcggatggccacctttggctcctcttttgcagattccctgatcaccctcacaagaagcttgaaccttttccatctctctctctcactcactactagtctactactactctagctagcttctctctctctccaaccccttgtttgatcaaaatatgtgtctacgactacctctgatcgactatagtgaaccaatgggggttaaatatactggcctccctggctatgtatagatactatgtaatctagatcttatcttgggtttatgagctatcaatggctctatctctaagagttaaaagcacttctaccaatgtgctatgcttgcgcggtttttgcggatatatggaggttgtacgagatatctataaagtgtaacgcatatatcccatggatatcaaaatttagatatcatttatgatcaccattattttgtatcttgatatagatgtacatatagcttgaagattttataccgattaaatattagtgtcacattttttgtacgtatgttgtagaaactgtggatggtttgacgcttaaaataggacattggagtgtttcattgcccaatatacgaagcataacacatgcatatatgttgattttcaaatttggatatgatttatgctctagtattaactgaaacacatttattttttatatactagaaaaatgcccgtgcgttgcaacgggtgaaggctattttaatcttattgttgttcactgaaattcaccgtgagaatacacttagctatatatttttctagaagatcatatcaagttagcatgcgagtctttttaaagagatttcttatatgactccttttgtattttcaaaagcaaacaaacttaaaacccgactcaaatacggatatgtatttccaaaagcaaacgaacttaaaaaccgactcatatacagatgacgtaccaaagtatcggtaaaaacaccttcactatttataatagcagagatatacaactatgattgtgtgcagaaaatgtaaaaggtaagtagtgatgaatttgataaggattgagcaattcatttttttttcttttggagagttgaagatgaatcataccaattatcaataagaaaacttttagtgtcaataaaataaaattcttctgatctaagtttgactattaatttctatatggtagtattttttgaaaaaaaactgaaaatctaaacatatgatttttcatatatctggctagcttaaataatcaaaagttttaaatatgtctttttatgggaatgttgacttaatatgcaagtacaaagttagccaggatagttagttgataaagaagcgggggcttgcaaagaatatagtaagttggtaaaattatgtacgttcatcagggctgcttagcttggtgggctgctcgtgtgacatggtgtctggcccaggtggcccagttggatgtttgcatacacctgcatgactgcatctggagatggattgaaccaagagagcgccacaccaacgcaccctgcgagtcgagtccgttggagactaaccacatgagactaaccgcgtgacattgaaaagaaaatcggatagggagaagaaagcgacgtacgaaactattaggcaaaaacatcttaaacttttataataggtaaagatatagtgaaataaataaaccatatttttcaaaaaatatcaatctttgttaattttttgacaaaaaaaaatcttggttaattatgctacattgtttaactcattggtatttcacaatcaccaccaagcatgcatatatagtatcgtaatgataccagaaggttgcatagaagtatttgatattggactgctagcttcttccatgtttgctaagcgtttgtaaaatttatgcactgcatgacaaaaagcaaaagagaaactaaagaaagaaaggaaatagtaaagaacagtggggaaaaaaatatctttagatgtgtcttgagggagaagaggatacagaagagctttgctgtcatagtccttgctttggtgtgcgccatgcatatatgcatcagcttttccttttactccataagttttcttcacctttcaatcgaccgtgccatgtacaaatgccagtgatgatcgatcagagaaaggagattatgcccacagaaaacgaaaatgcacaggtttgatctatttagaaagaacgaatcaaccgtgtcttcaatcaacgaagcacatcctggacgagatggtgagctgtgtgaggtagatcgacttagcaactagtgtagttacaaatttcctgtgtacaaatctccagtggaacacccattacttgaggtcatattagacttgacaaaaaaaattcagctacaccgcgtactttttctacatattagtctttttcacaaaatattttacaaatagaaccttcataaaacttattttaaaaaatagaccataattcggcaccaagattattaacgcggaagttaaatgtctcggcactgaaactgaatggagcaagaggtgggtgcttgctgctgaccctcttccacttacgaacaactttcctctctctgacgcctccctacccaatcataatccaattgatttgctattaaaaaaaataacaaatcaacatataaggattcatttcctgcattttatttttattgttagtaggacgaggtgtggttcctcccttctctcccacactatacgttgatttggtgtcaaataaaagcgaaaaaactcgataaagtcacatcttctagtttatttatccctcccattttttttaaaaaaaaacttttaaaacttagaatctaggatgagggtgtgggaggtcgagtgttaaacgttagtgccatcgagactacaaggtgttgagatgtctaacgttggcaccaaagacatactctcatcatatcataaaaaacagatatagaataggatgtgacacatcctaatactatgaatctaggcactattcgttcagattcgtagtacaatggtatgccgcattatgttttaggttttcttataggatagagggagtacctaacaaattaaagtacaaacgcagacaagtgctaacac

SEQ ID NO: 59004 - DNA, 8841 bp, Oryza sativa
atattgtttagtgattgcagtgacctgagtagcacctcaagctcccgagtttaaatataagaattggatttgtatcattaaactagcacataaatataagaggggtaatatagtcaattttaaaaaaattaacggtcaactcatgttcaattaacaaaatgggcataaaggagatcaaaatgaaaactcaagggtatataaaggatgaggcaaaattaaggggtacataagggattggacgaattctcaagcgtatatagaggattttctcattatttgaagtcaaaacagtacaactcatttggcattaagctcaacagcgatcattttgtttaggcttataacctcttataagcaaaaagtctaatcagaaataaacaattattttttgttttgctttttgaaatccgtaagctcattttacaatgttaaaggtcctctttattacacttataaaccagcctataagtcgatacgtctaaccataaacaaacaaacaagaagtttattcatttagctttttccaatccataagccactcttaaattattaagccgtggagaagccttttggtttatgtgaggtagatgtatgactctatccttaatcttagaactttaaattcatcggcttgttaattatataagcaaaaggctaacttaaaagtctaagccagtaaacctaagcataaacaaagatgccctaagcaaaatctaggtcgcgaggtacttttttttttcttgtttgaagtggatgtagaacttcaccattaaatttaattctttaaaaccaccaacttataaaacacaaaagaaaatatcggcttaacagtctaaaccaataagcctaagcctagataaagaggatcttaagcactatggttgtttttcaaggtttcttttgaaggtatcttcataatatatcttgcaagattgtggacgagtgatactcgtggaccggaagaatagggtattggggtacgttggaacagggatctgtgtagtacgacatcaaaatagacaaaagacaaggattatactggttcatgccccatatcaggtaatagccctaatatagtttatatgggaataatgacgatgagaacagattacaaagagagtaaccgaacaggcgatgccgatgagatcgtagtcgagggattcgatgaaatctcccggcgagttggctccgtagactttggcttcataaactctggtgggtgtgttggcgatgagatgcgatgccctttgcctctccctaggggtcccttttatatcgtgggataccttgaccctcaagtaagacttggagatatgtaaaccgacacgatatactagagattttaccctttccaagtaggacttctgcaattccttaacttcgtggagatattccttaacttgaggcgaattcctaacggcatatatggaaaccaaccgtatacgtatacgtgaaggtatatcttatcggtatattccatatgtcgtaggatagaggatatgctttatctgtaaccctgacaaagatattttcaaaaacttatttttaagaggaaactttatacggataaaatttctagacaaaatagttttgtaagactattttacctaagatatttttatgaattttgatgcacacacttgatttttttggccaaaaattaggattttttttagaaaaaaaggaattgctaaaaaatatcacaagttttctggataaaacaatttcaagtgtaactatagaataaatttgagtataactacatgtaattctgtcagggttaaggataaggtataccctctacccttggatgaacgctatacggcaatacggtatatcggcgcatatacggacgttctctgaacacgctaaggaaatccatcacgaagtctaccaatgcaaaggttcctacccgtataggactgggtcgttactatatcgtgcagggtttgatgtctccgagtcctacttggagaccacctgacctgcgatataaaagggaccccccgaggggacctaaggcatcgaatctcaaagcttacacaacgaccacagcctacgaagtcggagactacaagggccaagtcgccgggtgatctagtcgaatcaacttgactacgatctcgtcggtatcgccgagttctactattccctttgtaatcccatatcaactggattagggctattacctgctaaggggcctgaaccagtataatctttgtcttttgtttccttgatgtcgtattacgtagatcctcgtaccagcgtaccccaataccctctatatccggtctacaggtacccaccgtcgacagtggcgcgccaggtagggggacttggtgctcaaggttctattactatgacatcgagcttcgtcgacaacagcgtcaacaccggccccatccaaggaatccctgcttcgacaatgctgctgtggactcaagtcggcaaaatcgtcttcccggtttacaccacggtgccaatctcgggctggtccatcaatgaccggaaacgagaacgccgtggttgtaaacccagacgatcccatgtcgaagaattctcccgccgtggcggagaacggaacatcgacgtcatacgagcccgagaaggttcctagcgcggccaagccttgtccttccgacaagtactacgagccgacgaggacagcttccgaggtaaccaagtcctgttctcctatccacaagtccaggaagcacaacttgcaagcttgttgggtttttctcaacgtacaagctgaaatccgtgcttgcaaagaacgtggaatccagcgtacttctccaactcgtgatatctattgtcctattcacaagacgaagaatcacgacttctcaagctgcaagatctttctccgtgccatgaagacgacgcttccgaaggtccaacagtgaggaacctctctcaagggtacagacaaggaacaaggagcgacgttgacctcggatcgattcgttggagtaattgacatcgatccccgcgaaccattagtcctacacttgctcgaagactatggctcgtcatcttccagtacaccacgcgacgtgtttaccatcggtgggactagcatgtctgcacaggctaacgcagaggcggagaatcagacggccatgccagctcaacatctcggcactgtcaacgcaatattgagacaagctccctatgaccccgtgcttaacgatgatctcgcacgatggacggaacgactacgggaatcggtagccaatctcagtaacgcgttcgaggaagctgctaccagagcacaaccggagtgactgacagctggcggtgccgacggtgaaccaccggagcagcgaacattgcctgcacgagctacccgtccacctcgcggcaccggcgatctccacgatcatctgaacggccgccgagaagcacgacgcacgcgagacaacgagaatcgttcccgacatcgcgtgtcttcacgacgttgcgagaacaaggagcgaggaggtcgcttgaacgaggaccaacatcaccgtgatcgtcataaccaccgcgatcgcgataaccgcgagcagcggacaccggatgatgatggtcgggggcgttagcatgaaggtgatgataatggtgaccggcgccagaacaacaacggtggacggcgatagaattctcgagaacctgaatgtcgccctcggaatcgcacgctggagccgactaagccatcgtcgtcgtcgtcatcatcatcttcatcttcgtcatccgatagacgtccacggaggacacacgatcgccgacaacccactgcccccagcgctgggtgtagagctttcaaccgttctctacgtgatgtccgatggcccgagagattccgacccggagcaatagagaagtacgatggaagtactgaccctgaagaattcctctaggtctactccatggtactgtacactactggggcatacgacaacgcgttagcaaactatttgccaacagcgttgaaaggttctgcacgttcgtggttgatgcacctcccaccttactcgatctcttcatgggcagatttgtggcaacaattcatcacgaacttctagggaacttacaagcgccacgcgatcgaagacgatttacacgcgttaacacagaatcagggtgaatctttgagggactatgttcagcgctttaatgagtgcagaaatacgatccccgatatcaccgatgcttctctgatccgcgctttcaaaaccggcgtcagagatcgctatactacccaggagttggcaacaaggcgaatcactactactcgaaggttgttcgaggttgtcgatcgatgtgcccatggagacgatgcgctgagacgcaaaaacgacaaacccaaggcgggaggagagaagaagccagccaaagacacacccgaaccaagcaagaagaaaagcggcaagagtgggaagaggaaagctcaagcagtagtcctcgcatctgaatacgagcgcccgcccaaacacccagacccacaaggcaatgatacaaagagaatatggtgccccatacacaagtcggacagacattctctaaaggagtgcctcatcttcaaaaaatcgttggaaaggcagctggctttggagaagggcaagcgagtacgtgtagtcgagaaggcaactgaggcaaccactcaggactcggactccgcgtacccagattccgatcttcacgtctcacacatcttcagaggttccacaatgtactcttcaaagtgagaatacaaaaaagtggagcgtgaggtttgttcgacatggcaggggactgcatccaagatgaagtggtctgaacagaagatcgagttctcagatgaagaccaccccaaggctgctgttataccaggacgatatccgatcgtggtcgaacccactatttggaatgtcaaggtggcgcgagtcctcgtcgatggcggcaactccatcaatcttctcttcgctagcactttggacgcaatgggaattccacgaggcgagttgacacctaccgatcaacccttccatggaatcacccctcaatcttcatccaagccattgggcaagatcacgcttccgatgactttcagccaagcgagcaacttccgaacggaacagataacatttgatgttgctgagttcgacacagcatacaatgccatcatcggaaaaacggcactcgcgaagttcatggccgcatctcactacgcgtaccaggtactcaagatgcccgggccgaagggaacaatcactattcaaggaaacgcaaagctggcggtccaatgcgacaagcggagcctcgacatagtcgagcacactcccagcccacccgccacagacggccacccaagaaagtgatcaaaacgattaagacgccgaaaccagacggtgcaatcaaaatcgttccactctccagtgccaaccccgacaagacagtcaagatcggggcatcaatgaacgagaaataggaactcgcgcacatcaccttcctccgcaacaatgcagacgtattcgcttggcagccgtccgacatgccgggggtccccagggagatgattgagcacaaactcatcgtgcgacctgatgccaaaccagtaaagcaaaaactgcggagatttgcaccagatcgaaaacaggccatacgagaagagctcgataaacttcttaaggctggtttcatctgagaggtactccatccagagtggctaaccaacctagtcatggtgcggaaggccaacgggaagtggaggatgtgcgtcgacttcacggacctcaacaatgcatgccccaaggatcacttccctctacctcgaatagaccaactagtggactcagcagcaggttgcaagctgtcaagcttccttgacgcttgctccggctaccaccaaatcagcatggcaaaaaaggacgaggagaagacagcattcatcacgccgttcggtgtattctgctacgttaaaatgccgtttggactcataaccgcaggaaataccttccagcgtacggtccaaggggcacttagcgatcagctgggtaacaacgttgaggcctatgtcgatgacatcgttgtcaagaccaagacagacgactcattgattgacgatctacgggaaaccttcgacaatctcatacgatatcgcctcatgctcaaccctgagaagtgcacgttcggggtaccgtcgggcaaactgctcgggttcctcgtctctggcagaggaatagaagcaaatcccgagaagatcaaggcaatcgagaacatgaagtcgctcacaagactcaaggaagtatagaggctaaccggatgcatagcggccttaagtaggttcgtcgctaggatgggagaacgaggacagcctttcttcgcactgctaaaaaagcaagacaaatttgtatggacacaggaaaccggagaggctttcatcgcactcaagcgctacttgtcaaatccccctgtacttgttgctccccaacctaatgaagagttattcctctatatcgccgccacgccctactcagtgagtactgtcattgttgttgaaagagaaaaggtgcaaagaccagtctattacgtcagcgaagctctacacgacgtaaagacaaggtacccacagatccaaaaattgctctacgcagtaatcatgacgtcaagaaagctacgccactatttccaagcccacaggatcacagttgtctccgccttccctcttggcaaagtcgtgagaaacaaagatgttgtcggtcgcattgcgaaatgggtagtcgagctaagccagttcgacgtccactttgtaccacgaacagccatcaagtcccatgttctcgccgatttcgtagccgattggactatgcctgaaaacaggttagacagccagaccgacaacgaaacatgaacaatggcgttcgatggtgcgctcaacagccaaggagcaagtgaggggttcatcttgacatcaccttcgggagatcagttcaagcatgcaattcacctcaacttcagggcgactaacaacacagccgagtacgaaggactactcgctagaatgatagctgcagctgcacttggagtcaagtgactgatcgtgaaaggggattccgaactagtcgcaaaccaggtgcacaaagattacaaatgctctagccctgagctgtccaagtatctcgtagaagtcaggaagctggaaaaaagatttgatgagatcgaggtccgacacgtatatcgcaaggacaacatcgaaccggacgatctagcacggcgtgcgtccagacgagagccacttgaacccggcacttttctggacatcctgacaaaaccatcagtgaaagaggcaaacgacgaagatagcccagtcacccccgacatcagctcgggggctacagaggtagagcgcgctgttgccgacatcgagaccacggatgactggcagaccccactcattaaattcataagcagcgacgagttgcccaaggacgacggagaagccgagaaaataacccgtcaagcaaaatctactatatgatcggccacgatctatataaaaggcgccaaagggggtacttctaaaatgcgtctcgtccgacgacggcaaacacctcatcctcgacatccacgaaggagtctgtgggtcacatgccgccggttgcacattggtcggaaaagccttccgacaaggatttttttggccaaccgccctcaaagacgcttgcgacatggtacaacggtgtgaagcttgtcaatctcatagcaaacacacaaagctaccagcgcaagcactacaaaccatccctctcacttagccgttctcatgctgggcgctcgacatattcggtccattcctacgaggacagggcggctacaaattcctgttcatggcgatcgacaaatttaccaaatggatcgaggcaacacccacgggggaaatcaaggctgacaacgctatcaaattcattaaggggatattttgccgatatggattgcctcaccgcatcataacggataacggctcccagttcatcagcgccgatttccaagattgctgcgtcggactgggagtcaagatatgtttcgtctcggtttctcaccctcagagtaacggataggtcgagagggcaaacggtatagtactacaagggatcaagacctgtgtctacgataggctcatgtcacatgacaagaagtgggtcgaggaactcccctcggtactatgggccgtacgcaccacaccgacaacgtccaacaatgagacacccttcttcctcgtgtacggctcggaggccatgctccctaccgagttacgacatcaaagtacacgagtacagaagtactccgacgaggatcaggagcaacagcgaaacaacgacgtgaacctactcgaggaacatcgagaacgggttgccgtcagagcagctagctaccaactggcccttcatcgatatcacgagaagcgtatccgagtacgcatactttcgagcggtgactacgtcctccgacgagttcagagccaagctgggcgaaacaaactctcgcccaaatgggaaggaccgtacacgatcacacaagtcttgcggccaggcgcatttaaaattgcagacggcgatggtcgcgagttagcaaattcttggaacattgaccaattacataaattctatgtataagtcaatagtgtccacacttgtaagacatcttacaacttcaataaagtctgttttaaggcacagatttcaatcacagtgccccttcccgatgatcccttacccagacgacacctagcgttgaaacccatcctcatgtccctttatgccgttttgataaggcctccgaggaacctaagggaacttcggctggggacgtccagag

SEQ ID NO: 59005 - DNA, 21234 bp, Oryza sativa
cggctgggggctaggatcagtgcttattcaactaaggcaagtcgaaggtccaagagccttatcttccgagaggagctctccgacgacaaggctgggggctaggaagagtgtataactcaagtgactgatcgaagtcgcgaagtgagaagacacttgagcacaccgcatccagagtaagaaagcttagttagatagatttcccttctatttcacaagcatttcttacagattgcaaataattccaaaatatattacatttttcttaagatgtttgtcacagatatacaagcactaccaggaaggccaacgccagtccattgaccgaaagattttctccgctagcggagccatcgactttgctaggttgtctatctccgcaggactcctccgagaacgggaaaacccttcgtgaaggaactcgaggtgcaactgtggatgatgatctcgtatacacgccagcacgtgccctccggcgtatcggctcgatcaacgacactcctcctgtttcagggcctcgtcgatacgcccgccgatgccttcaagctgagcacaagccccgttcagccacgagatgtagccagccgctgactcctcgggatccccgcgaggtacttggagctctctacagacaattctatgacatcttcactctcacattcactaattctattggatgcatgcattatatttattaagataacccaaactacaagataataataattatttcttggtctttggatcaagggtggttgtgccttatattttggaatggatggagtatatgattatactccgatgtaaatatagtttttcttgtttttgttgtaatagattgtgttaatgttgcatatggtgtagtctgtaaagtttctataagcattttctgatatttcactattattatttggaaatggtacacatgttttataatgttttgtttagttttttatgtttcaatgctttttgaaacatcttgatgtttcatgcgtaatatactaatgcttcaataaaattatatatttgcaaatatattttatgtttcaattttctagctagttggaactcaatgtttcatatagtggtttttggtgttgcggttagtattatttttgaatgttgtatatctctaaaacatttcacgaagtgaattgaaacatttgaccaaatgatgaaacaatttttaatattattttttattaaaatataattgtgcaagatcttattgtaattatttaattgtaatgaatacaatgatataatcggaatatagattaggtaagtggtttagcataaaaagtggcttgaaacttactactaaaaaattagttttattaaaaaggagatagatgaacaacttttgggggcatgtagtgaagccaagtacagcagcacacctaggggaaggtggggccgatacaagcagcaatccagtactaaatagatcaaggagccgcgtagtagtgataaggtacccgatttttggagaaaaatagggcgtccgatccgtattctcctcgacaaaatggtgatggggcaaggagcggcgtcttcaaatgatgctcaaatcttagtttttttaggactctcagaaaagaaattccacaagtttttcctagaaaacttttaaatgtaactaaagtataataattgtagtttaactatttataactacatctttttatgtaacttatatacaagtattaaagatcttctgtcctataaaaaaaccaaatctaaagatgattctggacataatttaattatactatagaatttgtcaacggtgggtacccgtagaccggatatagagggtattggggtacgctggtacgaggatctacgtaatacgatatcaaggaaacaaaagacaaagattatactggttcagtccccttagcaggtaattgccctaatctagttaatatgggattatatggaaagaaccacagattacaaagggaatagtagaactcggcggtaccgacgagatcgtagtcaagttgattcgactagatcactcggcgacttggcccctgtagtcttcgacttcgtaggctgtggtcattgtgtaagctctgagattggatgccttaggtcccctcggggggtccttttatatcgcaggtcaggcggtctccaagtaggacttggagacatcggaccctgcacgatatagtaatgacccagtcctatacgggtaggaaccttcccattggtagacttcgtgatggatttccttagcgtgttcagagaacgtccttatatgcgccgatataccatattgccgtatagcgtacatccaagggtagagggtataccttatccgtaaccctgacagtgagcccccgacttcttcttaaatgaactcgtgtaaccaatcgcaacttctgatgtcaaagttgttgtcgttctcgactggtcgatctcggtgtgaggaccgtagagacaaagagtgatcgacaaccccatgcgaagtccaacggttatgagtgaatttaaattgaagtccaagaaaccgcttcgcgcaatggacccagaaatttccggcggccatttctctcctttccttggaattcgcaccgtcggtagtgcgcctatttaagggagttttgggaatccattttggggtccggctgttgtgagaactttcttgcctccaaatgctcttcgtcttctccgtttccacacaaaccctaagttcgtctgcctcagcttcttctccggcgatctccaacggcgatggacctcgacaagtccacctccagcaacgcgtccttgaagaaactgcagaaggagggcactctccccggtcacgggaccatggagagggaaccgggaggtactgaacctgaacccgtcctaggccgcatggttgcgattgaggactacattctctgtggttttcttcctccgccttccgagtttttccttctcgtcttgaacttctacggtctttctctgcttcatctgaactccaactccatagccttcctcagcattttttctcatctctgtgaggcctacattggggtagagccgtttcttgaccttttccgcttttactacaagttgcgctggatggaacccaaaaaggtatccgggtgtgtcggtttctgacttcgggatggactgaagtcgcgatacattcctttccagtgcccctcgtctcgtagcaaatggcgggggaggtggttctatcttcagatagaagattcggatccaatcttcattgttcatgaggagcaaccagacaagattccatcttagaccgccaaacccgccttgaccccatccctccaatctttcatcgatattattgatgacctccgagtacgagggttgtcggggtatgaagtcgctgccgactttgttggtagacggacccagtcgctccagactcgagcccatccagcctttgactactctgggccggaggacgcgacccgagtttctactcggggtatttttcttgtattttgggtttctctccttttaagtgcattcctcctgacttgtcgaaacttggttctcgatctgcaggtctgagcagcgcaaccgtggagcaccgtgttgcccaggtgatgattagcggtcccacgatggcagcaacgtccccacccctctttgcgagagggaggcggctgagcgtgaagccgcgatcaatgtgagtgtagtcgatggtcctttacccttcaattccttgatcgtatcgtgacttcatgttgtgcaggctctccccctgactgacatcatcgggccactcgtggaccaccagacggcggcctcgttgaaggagggcgttgcccaggaggcgtccgacgcagccgttgccgctgctgctgccacaaccagtggcggcaaggttccgaagaaggggaggaagttttcctccgtgcttggcaaccgccggaagacgcccgctccatcggtaagcttcctaggttattgatttacatagtcggagaatgtcgccctcatgtcgtactcggtttacttaggcctcggatgcgtctcgcccgcctctgcgacggcagaggctggtgacgctcggcaagaagtaagtggacgaaatttgaggctcttgacttgatcggattttatcgtcttgttgcgatgaccgacatggtcgtctttcgtagggcgcaggcgaaggcggcgcaagatgggtctggagcaaactccagcgcgtctcctgcagtggcctcgaccgaggtcgtggtcatgcctaggagccgcgaggtgacacccaacggcgcagccagcgacctcgcggctggtcggggtccgccagctgccgtcctcacttgggaggagctccaggtcgagatggggtgcatcctcgaggctggtgctcgcggcattagtcgcgagatcgcggaggcgagggcggcggcggcgtcgtcggcgaatgagcgcgccgactagctgacgtgtgatctggcggaggttcgcgaggacctccagaagatgagggagctagtggccggcaacaagcgacaacggcaggggctcgagcaccgtatgtcggacgtcaagaacaacctgtcaaaaatccgtggctcactgcaggtcacctacactggtctgcaccagctcgtcggggagtgcggtgtcacgaccaccatatcggcgaatcccgacgagttctcgctaatgacctcgcttgcggaactggcgacagtgatggaggcgatcccctccaagcacgcgggcaggatcagagaggagacatccaacgggatctataccggggcgtgccacgtccttgcatgtgtgaggctggcgcaccctgaactcgatctccataagatcttagatcagggggcggctagcgacgcgcgcaaggatgtgatggaagaagtcggcgatctaggggagtccgtcctcccgctttttgaagagtagggccgccgcttgtctgtacctcttaaccaatcacgctttgtaaaacttttcgttggttccgactgcttttgtgtgtgcaatcgtcaccttagttttctttggcgttttgattccgggtactttgtttgttgtttgtagagatgccgatgtcgaggatgtccagtagcgcgggcagcctgaattgcctatagtcgttccggcacttgagcttgagccgtatgtgccgctggacagcgtagaccaggatcttcccggggagatggacgtggcgacgactcctttaggttggttcttgtcgtttccatttcctttgcctcttctgtctcgattagcttgacttagatatttgcatgtcaagcagacctcgaaagtgcgcttgctgatcgcgaccatcgcatccagtactggaagacgaagttcgatgtcgccgaacttgagaggactatattggaagtgaagagggaccgggccgtggaggcgctccgaggtcgcgaggtatggttcaactcgtacctcaggagctgctgtgtgaccatggccgttgtctgcagagagctccgaacaacaaaaacaagaaaaactatatttacatcgaagtataatcatatactccatccattccaaaatataaggcacaaccacctttgatccaaagaccaagaaataattattatcatcttgtagtttgggttatcttaataaatataatgcatgcatccaatagaattagtgaatgtgagagtgaagatgtcatagttaattgcatgtatgactttatattatgaaacatctaaaaaaagtggttgtgccttatattatggaatggagggagtaagatcttgttgtgaagaattaattacaataaacacaatagtcattgtgtaatcgaattgtagatcggatatatagtataggagaaaaagtctaaaaatttgcgaaatcttttatgcatgcatgtattgtggtagtcaaaggagacaggtgcaacatggtactaatgtgcatgcagagctgctaacttacagtgctatgtatgcatggagagagaaatagggaggtaccgctgaggttatcaatatcgggatcctaggtaatatcgttttgctcaatgtagtattgtatcgtagtatcgagatactatgagattttttcttttaagtttaattaatatttgtattaattacatatagccattctatataaaaaatatagtaataatatatgccatgcaaatagagatatttatcaagagaaaccacatattcaactgatttttatgtaaacttgagcataattagatggtttaaaaataatgtaaatagtagctaagattatttacattatttacaatcttaaggattgttgaatcgatacaatagctaagattttgtaagatcgtgtggtaataaataatagaatcgagatattatgaaagttaagatattagatggtgtcagtatcgctttgactagtagaattgtagtatggatacggatcgggagacaacctcgatttttcatatagaataatttaatcgggtacctgggggaggattgtagtcggagaaaggccatttctgacatcctctcatcatttgggcccccctcgcatttcgggcaacaaaacggccttcctgacctcgatcagtttgggcccccatctcagccagccagacagcccatgagtacattctagagacacggcggaaggacgacgacgtcagtttcttacccatctactatggcctatttaaccctgcgcccaatccaccctcatctcggtctcctcttcctagtactagctgcgcccccccccccccccaaccccctcgggcgcccgcttcgctccggcgactccacccggccgcgccgccgggatccgcccccccgcaggccgcccctcgtcgtcgtcctcgctggttccccgccggccccggcgccttttccttctgatccagccagccgcgtcgcgcgcggcgccggggggcatcgaattcgaatccgcgccctcgccgtcgtcgtcgccgccgccgccgccggacaatccggcgcctgccccctccgtgctccccccggccagaggtgagacccccccctctcctaatccgggttgtggcggctccgcgggttgctttcgcctcacgcgggtgtcccagattcgcgtcgctgtacctgtcgaaaccctagatgggttggtggggggagcctgctgctttgcattcggagcggggatttccagtggaggggtctgttgcagcgggaattttggtcgattgttgcgttgttcggtgtatatttggttccgatcggggtgcttaattggttcgaggttgaacgcgccgtggagaattctcgacgagttcttgaactgaccaagttgttggctttgattcagggattgcgggactgatacggccgggatcttgctggaaatggggggttacgagtacgcgaccaatgtaagatctgttcttttgcacgatatatcctgttcagttccattttggatgcgattcttataaacagtaggaatcaaactttgctgaatactacgtttataatcatgagtatagtacctaaatcctttgaaagaacaataggaacttgagtcatttcaatgtgaaagcgcttctatttcccatgctgatgacgatcgatcatcttgaagggttatcatcggggaatggaggatgactatgaagacgagtactacagtgaagatccatatgatgaggaaggggagggtgctggtcaagagtatgccgaggaggatgacgagccgccggagggacagcaagagttccttcaaattagagaacgattaaaggagcagattaggcgaaaggcgcaggctgctagtgctagcgctgctggccgctcatcttcctcacatgatagaaaacctcaatccacgtaagtgttaagtatgtctcttctacattttgattgttatgcaattttgtctctaggatcaataaacctctgttaaactttctcaagcatcatatttgattttctccaggaacttgaataatgctgaaatttttagttgattgaaaaaaggtagtcaatgtatggctcctttatctacgtcccatcacaatctttagcatgttaagtttagttcatcaaaacttgctgagtatttttcatttgttggttacattgtttattactattgctttggagcctgagagttatcagttaatacattccccggtacatcctttttgaaatgttgtatttgaaattggattgtttcatcatagttgttttttaatgcgaacgtgtcgaatcaattttcgtttggattcctgcaggaaacaaaccgtagatgcatttgggtgggggtgttatttttaaatactacaccacacttgtatacattatgctattgctctactctgcatactttgtattttctgatatgtgaggtcaaatatcttttatgttttctccaagacctttgttatagttatgttatttgtgtagttttggatccttctttgggccatccaagccggtgatttcccagcgggtaattgaagaaagaaaatcactgaaagaactacagaacacagcgtcaatgtccagggatcgaaggccttctgcagtatgtagccctacatctgaccctaattatctttgattcaacttttgtaataattgtgtttaactatgtgtagaaggagataccatcatcatctaaagtgcaatctaaaacaaatggacatcaccacaaacagaagattgtaaatgaggtacaatgaacttctctttcattggatcatttttatgtttgctatgttaaaacttgagttgtgtcataaaatagcagctggaatttgcaggcaaaaagaaaggctgaggcacttaaggataatcgagactattcatttctactgtcagatgatgctgacatttcaccttctccaatggagaaacctgtggctaggtcctccttgagtcagaagtctggtgagtgaattgcgatttcactgaacttgttctttaatttttagtgaagtaatgctaatagttggttcgttgacatcgaagatcgcgagtcgacacattcagctgtgaagagcagagcaccgacaggccaaactgctagattgtctaatggatatggattgaagaacacattgtccagtcagaggcatactgaaggtagggtagattccaacagaaaggtggctggtgcaaacagagaaagggttgtcttgcctgacaatggaagaatgcatagtgtggttagaaatggatccacccaggctactacaagcaaagctgcaagtcaaaagcttcctagcaaggctcctattgccaacaggcctcctataaagagtgtaagtgatcaatctcttagggcaaatcattcagcttcaaagcaacttttgtcacagaatgggagaccacaatcctcacagagtcagaggatgcagtcgacctcgcatggtcagaggccacatcaacctgtgcaaagtcagtggccgctgcagtcattgcagggccgaaggccacagcagtcaccacaaaatacaaggccacaactgatgtcgaagagtcagagaccgcagcaatcattacagagacagagaccacagctatcctcacaaaatgagagattggaatcctcggagaggcaaaggccaccttcacaaagctacaggccacagtcgtcgcaagggcagaggcctagttcagtacaaggccgccagtactccgagcaaagaagaatccaggcaaatgatagagtaaagtcggcagaaaggcagataaggcctccctcgaaacccatggtaatacttctgcgaagcaaatttgtcagcttttcctttgttgtcatgtttcacatgcatttgggcaattatttaggatcatatgtttctctgaagcttatttcttcgctatcatgttcctgtagccatcacgacaaataccttccaacggaatgcgtgatgcccatgcaaagaaaaagcaaccgatgaaacgaagatttaatgatcttagcgaagatgaggaagatccgttggcaatgatcaggagcatgtttaggtatgtcagtttatgaatttcttgtatgtggtcctttctgcacaagctgggctagtcttatatactttgttggctagtgttttagttgttattgagtgtctacaaagagttggaatgatactctgaacagggaccttgcactagttatgctaagcattgttttctgatttcaagatctgctgaaaagatagatcaggcttgccattatgcatttcagtttggtgatttcttgaaatcaagtccatttgctttaaattttatggcatgcgaatgagctaattttggactatgcttccatactattttttgttttgaaggacactatatgaaaactttggttgtcctgtgcaggtatgatcctagtaaatatgcaggcagagatgacgatgatagcgacatggaagcagattttgctactatagaaatggaagagcaaagaaggtatgtactcccttattgctttctaacacaataccttcttttcatttagaacattataatctgttaaactatggtaagtgaagaaaaatagggatcattaaggattatcttatattctgcctcagtgaggaacataatggaaaaagaatgcttattttcgctataatattgtactatcacatgctaatttatgcatgattttgcgctgcatatgcacttgatcaagatgcatttgacatcatgattgagtatcatttccagaaacttgaactgcaggactgctgtacattcaaattcacttgtcatatggatattttgcttttaatctcttaacttattagctttttttttgttacctcttagcgcgagaattgcaaaggaggaggatgacgagcaacttcgcctgattgaggaggaagaaagacgtgagcaggagaggaagaggcgaaagatggcgcgtggccgatagtagcagctaagttgtacaaatgcttgagttacagcttgagcaaggcttgaactgcaattccacggtcgtacgggccatggtgcttgcagatgatagcacgctttacccccatttatttgccgtgcgatttctcaagagatctatcaagaaaaaaacggcagggatcaagcaaaacggcaggagaacgatgctccaacgtaatgtgaagtggtgtagcttgtgctgaaactgttagctgtgccaactacagatctttttgatgctgacgctgatcgtgcagaaacttctcccgtgagggtgtggtgatgccaacgtccctacaccttgtcactttgttgggttgtacatgatattcttcctcatgtagctgattcgttctgttggtcgagtactaaagatgccagaaatcaactggcgcctgtccgtgtttggattcgatttggatataccggtgttctaataaacaatgttttagacaattattactggactggttgaatgaattattgaagcgattatcggttagccggaattatcgccaccgttttctgcatataaatgataaacgtctgattttatggtttgtccctaacgaggaaatgccattgtataagcaattttgttaccgtagtattttggccctgcgaggaggaccacgcaagaacggccgacgcagtagagtgcaacggtctcccagagtatgaaaccacggttctgccattttgtccgtggatagcgctgcatcagattcactagaaaggactttgcccaaatttttttcctctttgggcccttacatcttcaagcgcgcacctctctctaccagatgtttacggagtttgctggccaaaacaaaacaaaatcgattgtaccatagcatcttagagaacttgcactagcctataatgagggcgcaatttaagggcgaggtcaaactctaaataacccctccatgttgttattttccactaaattctcatttcataagggtattaatttctgtattatagtggatagcatgaaagaaatagctaactatactcgttccagtttcaattttggagtttttgatgtacgaatagtcgctaggatactgccagcgcaagaatgttgtaacaattcgatatttacatgttaatttagctattcaccgattgcatcactgcaacaacatgcccttgttgagtaagcacatgctgcgatttcttcacattccctaagttaaagtctaacttctttcatgtatgttagtacttctcatcctttatatttgaactttaagcttcttccttttctttctgaaattcttattcttgctgtttttatacctgtaggcgtggaatcatgcatatgctgctctacccgcggtaagggcctacttagaaacacagttttagagcttaaaccaatataaaatacaggcacataaacatttttcagttgggcccataaaagcgcacctggataggcccctaaacagttttaggtgagtcacctctctttgcactgccgctgccattgtcacttatctacgttgcttcctcctaggtgccgccatcaaggagcattcgatctgtaccagagatgtctgaggggatcggaagatcacttgatctgcagtatggcctaggggaggactcatacaccaacgtgttgttagcattgagtcgctactgtggcgatgcagatgcatgagagcaagtactgtaatggtaatgtttgatgcgttgcctctaagaatatcacatctgattgggtgatgagatggaggctctgatgcgaaagttaacaaccacataaactccaaaaaaggtacgagaggaatagaggcattggtatttatatatttgaggtgaattactgtatacgttgcttcttaatttattggtggatgatatggataaaattaaaggcagtagttacctctattatagaacttgctctgatcgatgcatctactcccgtttgattctttcgctgtcatcgatgcatccatctcttgtcaattctttcgtaattatgtttcggtgttgtttttttatttttgatttcagaaatatgcggatcatgttcagaacttcaggtactctgcaatgccccgtaggttttaactgtattttacttcgatgtaaacatggacatttgtactcaaattggaagcggaaaaacagagtaggaaaaatataagattttaataggaatgtaagtgcaaaatagaagattgcaaaacacatgaatagtcgtttgattagaccgcataaaaatactgcaatcgaatgagagagatagatactcaaaggaattttccatgatgttgaagcacttgctaagtttcttctaaaatctacatgcaatgagttattttataggattttcataggatttggacagctccaatcctttgtgtcaaatagccaaataggatttgaatcctttaaaattccatcgtaaatcatttgattcaaagtagtcctaatagtctttaaagtgttctatttccggtttggtgaaatactattgactgaaacactccgcctgttgttgatgttgaatttactggaaaaagagaaagatggaacatattttttttattgaattcatgtacatacagaaattattccacataacaaaattactaagtttacaaccaatgttttccatgtacacactgttcacaggcaggttcagacaagtacactctgatcaaactgttttgcattttatgacaaacacttggcacaccattgaaagtagaaaagtagtagtaaaggtgatactagtaccacacttgctcttttcagatttgttcttcctgcttctgcagaggtttgcgagccaagacgaagaaaaggggtgtaaatatcccttccctgggaacaaaaaaatcaccattcaatcagcaatgttttgtttcaagttggacatgaattcaaactttattgcttcaaatttgctcgaggatggcagggctgatcgacttacttcccgcccttcacgagggaatcgaccgatgtcgcaaggaatctgcagattctcaggcttccttccggggcaagatggaggaactcaagccacttcaactgtggatttttcgcaggtaaaaagaagtcaattgtactgtacagtctctcccaagaacatgctaaaaattcagttgcttcagtctgggtgatgaactgcttactaaccagtgtttgaccgaggaagcggccgatacgggtgaactggaagtgtgtgagcgagagctggctgggatcaagaggctggtaccatggcaacggcgattcctctgccatatccttcgccaatataaccttcataaacacaagatcatagagttaagaaagctttaatctgatgatctggtcataaataaatgatttgccaatttgcaggtttgaagaattcagaagctttaatttgctgggctctgaaattaagatgcaattaagttcatttgcacctcaaagcctgcatctttcagagcctggatgcactgcctggtggttctgatgtccggcaagccattgccgagctagagctcccccttgatgctcaggtgcctcgcgttgtcaggatcatacttgtcagtcaggcaccactcgtccatcgcgaacaactttcccggtttcaacactcggaagatctcactgtagacaccgacctgaacgaactcacacaccgagaacgattttcattttaccaaatctgctggagatatgataaattaaagggaaatttttttttctttgatctctgtgagctactatgcatacagcgtcaggggcgtggcacgtcgcgtcgagggcgtaggctgcgtcgaaggtacaatcagggattggcatgttcatgaagtcaccctgcatggcaatttgttttttttgttgctgaaatgatcctagaatattgaaatggtggttggagggtacgtgtctaccttcacatagttgcaagtttcactcaaaccgacagaaaagttgagttcctgaaattgaagatcaaatttcaactgtttatttcgccatggtggcagtttcattttttttttccacttgaaggagtatattatgactcccgacaaaaaagttaaaaaaaaaagaaaacaaagaaacaagaactcattacctggccccttgatatctggtagtcattgttgttcaatccagtcaccgatgctgagctaaatttgggtagcattgaattattgttttactaaagtcaatttacacatgagcataaatttgtgtggtgattatagaatcttcattacctgaatctggcaattttctcaagggccctccaattccacaccccacgtctaggacctgcagtatatacagagaaggaatgcatgattcaactgtgtcatcagtagcaataatcacattgccatgtcccatcgcatgcaaggttgttaattaacagaacattgaccttcatccccttcttgaggccgagttgcagggccagaaaatgctcccggcgcttaaggctttcgcgtaaagtttctccatgccatctgaaaaaaagattcaagcaaacaaaacttattacaacttgaaatccatctgtgcataaattctcaagcattttattcttgcgtgtgtacagaatatttggatcagatataaacatctctctctatcttatggtcacacaggatggtggagagaaaatagaggcccacaaaacgcataaactatattgaccagcacttgcttgattgttggataacatcagggttcaccgaaatgctcacgtttcgcccgaaaatttcggttttttgcaatttctttttttgaatttggtcaaattttattcaaattctgtcaaaaattcaaaaaattccgtagaaaatttttctgaaatttccaaaatttcagaaatttcggttctatcgcccacctgtggtagaagtgtcagtttcaaaatttgaaaccctggataacattgacataactcaagttgctataagtatggacaacaatttattggccacaagtaaggcaatgtctggctagacaataggtatatggtatacaagccaatggaggaacaaagtgtggcttatcacaattgaaacaaacaaataaaaactaacctaataaactataacatgtctaacatttgacgtgatactgtgtgtctgtgtggcacttaaccaaataacctctcaagtgcattgggtgcagaagagcgatagagcctagcttgtttcttgtgctagtgctccacgacagatgaatttccgactctcttctgatcgctccttttgtttctctcccttccatataggattgtgctaatgtggaccaatttgtatagcctgctgatcagtgatcactcaaccttactatacttgctgtgcaagatctctcttacgctgtcacaatcttcacctgttgctatgtttggtatgggcctaccaccaataacatctatctatcttctattatatactaaaaatctattaagtattctataaatgctccaaagccatcacgtggcacttctacaagcgctcctaggccgccatgtgacattctacaatcccaccatcgattttcatttaaaatggtggactcattattttaaaccgtcggattagatctatttgaaaagtttatgctttctatatccgagcaatttaccaaaaatacttatttacatgaaaatagttacgtaggatggaaatacttacatacgtgtacgtatgaaagtaattactccatccatctcataatgtaagactttctagcattactcatatttatatagatgttaatgaatctagacacacatatatgtatagatttattaacatctatatgaatatggacaatactagaaagacttaccttatgaaacggaggaagtacatacatatatgaatctttaggtactgtttattaaaaaagaaacaaagaacatacgtgtgtacgataaaaaacctatagagacaaaaaaaacattgataaactgttcacttggatggaaatatacaaaggaacatgcgtacatatgtacggtgaacgcacgataaaaaaaaatgctataaagccttaaaggaaaatatatgtacgatgttataaccatcggaaaaaaaatagacggtctttttaaaataagatcttctatactataaaaaataaaatttattactctataaatatagtcacatggtgcttccataagcgctcttaggtcatcacgtggcactgtgtaatctcatgtagcactatatttaaatttatggatccgttattttatacctttacattagcttgcttcatcttaacactggtggagaaaccatctttggtcggtcgaccaaattccacaatagtcccggatgcaataaaaaccgggactaaagatcatttttagtcccagttaaaaaatttttgatctttagtctcaattggtactaaagatcatttttagtcccggttcaaagaagttggtgggtggagtcaagctccaattatctttagtcccagttggtataaacaaccgggactaaagatctatttttagtcccggttgtttatacaaaccgggacaaaaaatgaactgccgagccgcgcgcatgccgctaccctctcctcggtacccggtacccctccccttttttctctccttcattttaagactccctctccttttccattgtttaattcctcggtataccagcctcctctccttcatctccccttcctcccccttcccctctcctccgattcccctccccgcctcctccgattcttctcctctctgctgcgggccgggcggcggcgacggaggtagccggccgcacagcaggcgcccgtgcggtggatgggtggcggcggccgtgcggcagccggtcgggcggcggagcgaggtggccgcgcgacaggcggccgtgcggcggacgggaggcggcggccatccgggagccggtcgggcggtgacggccgtgcggcggtggcggagcgaggcggccgtgcggcggccggtgaggccgcgcccctcggcggcgggcaggcggccggcggggccgctggtggcggccggtgggccgcgcacagcagcggcgggcaggcggccggcggcagcggcagcccgtattgttttttttaattatttgtgatttcactgatgtacttttggatgaataattttgtgattcattgcatatttgtatggatctgcgatgtatttgatttgtttgtaatttttataggatttgtgatgtatttaatttgtgtgtataagtaactttgatttgtgatgtagatttgagatgttactttgagttttggattgggggtttgatttgggagaaaatgaaaaagaaaaaaaaagaaaaaggggaccatctcactgccccaaccctctctttagtctcggttggtgttactaaccgaaactaaatatcgatgtttagtcccgggtatttgaaccgggactaaagatagattggtagtcccggtttgaaaaccgggactataggggggttgcgaaccgggactaaaaagcacttctccactagtgtaatatcgtctattatatactagtagtccattaaacatcctacaatcgtactcaggacaccacgtagcactcctacaaatgctcctacgtcgccgcatgacattttaataaattagaaaaatcacaaaaattttgagaataaacaaaacatttggccgtcgattttctgtaatatacggtggacccattgttttctactattaaattatttgtccaagtaaaaaaggaataccacctatttcttttctctcctattttcctctattagaaaggtggaaatatttttttaccaattatattttgtcattatatttatttcaccaaaaagaaaatgacaaaaaaaggcccgcatatctcatccccgccagtccagtacgtacgtgcgtgcatacctccacacctatttcctttctctactattttcttcttttagatagatggaaaaaatattttatgataacaaattttaaacaactgtattatctaaatcatatagctaattttttattggtacactccaatagattatttactattatatattttaagattgaagatccaagtttgggacatatattattaaaatcatatagctaatattattatagaaattcattaatttgggacatatatattctacgaactagctatggttcactcatccataaatttttaagaaaaaatcaaatagatttttaaatcttctgattaataacatgcacttaaattataaaaatttaagtagtttaattagaaaatacaatacccaaagtatttctagtagccgtaagataaattgtatttataggatccattcgatctatcttgaaaaacaataatctcctcgtatcctcttgccttaaatatacctctggccctccctctctgactctcccatcctctcctctccagctcaattatcccatcttctattttgttttaactaacataatataaaaacagtcatagctattgttttattttataactaaataaataaatcaagatcacattagctatattttactatacaaaattaaaaatgcatcatttgaaggtagacactatcgtttgcatgccaattaaataacaacgaaaaaattaattaaaaatatgtaacatgttgaactaaatcattgtacataacaaaaatcaataaccgccctctagaacgctcatgactcattgtgtatcatatcctaaaattctaaaaaaaaatccaattaaattgttgtatccattatttttaaccattataagatatataaattttgtgaataatgttactatcactttatcggatgaagaaatgaccaaaataaaagttatagatattgatgagttgtagaactttaatgttgatgacttcttcagttaaaatcatttagtatttgaaaatattgtttgctcttgtcataatttgaaattcaaattcaaattattgaaacagagtcatataccaaaataaccaaaacaaaagttgtagataatgatgatttatacaactttgttgttgatgactttttcagttgaaatcatttagtatttaaaaatgttgtttgaagttgttataatttgaaattcaaattcaaattattgaaacagagtcatatagcaaaatgacccaaacaaaagttgtaaatattgatgatttatatagctttgttgttgatgactttttcagttgaaatcttttaatatttgaaaatgctgtttgaagttgttataatttgaaattcaaattcaaattattgaaaccgagtcatatagcaaaatgaccaaaacaaaagttgtagatattgatgatttatataactttgttgttgatgactttttcagttgaagtcatttagtatttggaaatgttgtttgaacttgtcataatttgaaattcaaattcaaattattgaaacagagtcatatagcaaaatgataaaaacaaaaattgtagatattgatgatttatataattttgttgttgataactttttcagttgaaatcgtttattatttgaaaatattgtttgcatttgtcataatttgaaaattaaattttatataggtcaattaaactcatatggagaaataaccaaaataaaatcggtagacctcaataagttatacaactttgtttttgacaactttttcacataagtttatttagtaagacaaaattcgatttgaaggtttaatatttttgaaataattgaaaatagggaggcagaatggacttctcggcgagagatgagcaaaagggctggcccgtaataggccttttgctcctcactcaccgagaagtctattttacctcccttctttcaattaattcaaaatattaaaccttcgaatcaaattttatcttactaaatgaacttatgtgaaaaacttgtctaaaacaaagttgtacaacttattgagatctacctatttgattttggttatttctccatctgagtttgattgtactatataaaatttgaatttcaaattatgacaaattcaaataacatttttaaatactaaatgatttcaactgaaaaagtcatcaaaaacaaagttgtataacttatcaatatctacaacttttgttttagtcatttttctatatgactttgtttgacagtttaaatttgaatttcaaattatgacaacttcaaacagcattttcaaacactaaatgatttcaactgaaaaagtcatcaatattaaagttatataactcatcaaggtatataacttttatttgggtcatttcttcatccagcaaagcgacttgtaacattgttcacaaaatgtacatatctctctaatagtatatac

SEQ ID NO: 59006 - DNA, 8197 bp, Oryza sativa
  unsure (1)..(8197): unsure at all n locations
ctttgccggatgaagaaatgacccaaataaaagttataaactattagagagatatgtacattttgtgaacaatgttacaagtcgctttgccggataaagaaatgacccaaataaaagttatataccttgatgagttatacaactttgatattgatgactttttcagttgaaatcatttagtatttaaaaatgttgtttgaagttgtcataatttgaaattcaaatttaaactattcaaacaaagtcatatagaaaaaatgaccaatactaaagttgtagatcttgatgagttatacaactttgttattgatgactttttcatttgaaatcatatattgcttcaaaatattatttgaatttcttatattttaaaattcaaatttttcatagttcaatcaaactcgtatggagaaatgtttaaaagaaaattggtagatctcaacgagttctacaaaaatttttcatatgagttcatttaataccataaatttttgattcgaagttttaatattttaaaattaattgtttttcccttctcttcccttcaaattttttcatctccccttctcactcactctctctttctatcatctcccctcactctctctttctctcctctcttgctctccactcctcctcgggcggcggtggcaggagctggcggcgtcaaggggggctctcggccgcctcgggctctggcctggagctggcggtggctggggcggctctgcctggagctaacggcggcgggggcgacgacctcggcgaagagtgggcggtggcgggcctcgtctcactcggatccggaggcggcaggccttgtcctgctcggatccggcgacggcgggcctcgtcccgcccggatccggtagcggcctcgggggaagagtgggcggcgacctcgttgaccttgggggaagagtgggtggcggcgccatcgccatctcctcctcaccgccgacgacgaggaggtggccagatgcagccccttcgtcgccgcctcgccgccctattcatccccccaccccccggggcgggtaccggcgcctcggctcctccgcctccgtgtccacgacaacggatgtgatttgggtggaggttgggacgacgaagggggataggagcttattccatgtcgattcggccgtgcttgagaccgggtcggtgcggcgcttcctcgcggtggctgggcagcgggcccgcggcggtgcggtggcggtcgccatggacgcgctgctgttcgagcacctgctgtggctgcaggcggtgggtacatgagctcaagcttgccatgaaggtctggatccagtgatgttgcattgccatgggctattgctgtgatgaattctccgttgtttagtagttctttgtctctgtaattcatatttggttctttttgctttgtgttctcttcagccggtgcaattcttctccagctccagtgggctggcgccccttctgcatctcgatgtggatgggttcagtggcctcttaccctaatcccccacctcgtgctcttttctctcgctcttcatggcgtggcaaaccagcgcccagcggtgccgccgtgctgcgcgtgtggtggcctgacgatggctcaaagcagaacatagcgccagatttggtcaagccctccagattttccctttacatggtgataaaactagctataatggttgtatttttttggtcgaactgcaaacatttcagtgttggtatcgttgcatgaattttgtttacgaatgttctatggttcacatgtgcagctgcccattgccattcttccttctctgacattatctatgaagtatgtattttttttccttgaagatttatatatcctgattgaccaatagaacgcctttttttttgcaaaacccataaatgataaaagggtttcatacttgccagatattttgaagaatatcttagctgatcaatttacctttctgctacctaatgccgaaataattagtttagtagagatgttttagggaagccaattaattcggttaatggctttgtggtgatcatttgaccctttgtgcttcgttatagatatgatcaggtgccctctgtaatgccattagtgtgccgcacaatgtgccaaaaatatgtttgccttttatctgtttacatgttcttgataagaactttttctcactgacaaccttgaaacaccacaagaaacacattggttcctatcaagtttagtctgctctagatgctttcacgttctactcatataagttctagttttacaatgtctaaaacaaacggtaaggcgccgagccatcgtcattagctaattaaaaagcagattactagatttgaatgtacattacagttgtgtttctatgtacaagaaggataaatattgctaatatctatgttcttttccagtttaccttctactctagatggtagtttgaaattatatgtagaatatgtttttagagagaaataagtgcaatctaattgtaaatgtgaatattgaatctgataattatttttgtcatatctgtataaaaatgattggttgctaccacagaaggtgctcaggcttgtgaagactgtaagtgcatgcttggctatcaatcagccttgagcttgtgctttctcagtcctaagcagttgcattgccatctcattttataacaatctttgtatatgtgagaattgccatttagcttaagtatattaagggtgtcactgctaattagttgcacaatagagctttgctgcacaaacagactgataatagagctttgctgcacaaattagttagctgggatgttcttatctacctgcaagtttcaagaaaaaaattgaaaatatactgtttatagatttgttttgctaaaatataccggatggagaatgatttgcacaaatatagtatcggtatcgcggcttggaagagcgataccgaggttcgcgacaacaaaatacgataccgccacgctatcgcactatcaactcgcgagggtgcatttgagctggcggtgtcgcttgtggaaacaacgagactgtcatgatatcgctctttcgtagagcgagagcgccacgtgaaggaattgatccgttgtcacgccggtatcacggtgtgcaagcgtgagagcgaaatcggtcttgtaatcccaacacgcgagaccgagcatgtcgcgggacccacattggcgaaacgactgggcgcgagtgggccgttggtctcgcacgcgcaaagtgcgagaccgatattggtatcgctgtcccaatgcgcgagaccgacggcggtatcgctctggcaaagcgagagagcgctttgctatcgctcaatcaaaaatcaataccggctataccagcgaatacgtgcatagccttagtgaatacggccgctgaatcgtgtccatgcaggccacaagtgaacatgccgtatatacgaatatgcatacacatatatatagccgtcaaatagatcatctagcttcttgttggctcatgcatgtatacgtatatacattagccaagcatgcatgtatatatggctgaacacacatatagatggacatatgccagtacgtgcatgcatggctcatgcattcaattagcaggtgggacacgctctcacgctgtcaaagcgcgagactgcttggggccccgccggtctgggttcgcgtcagacggccgcgaaatcgctctacgagcgtttttggaatgcgagaccgatgcattagcgctcccgcggtttcaattaacgataacgctggcaccttcactaatacattatgtgatatcgcgctctcgcttaaccaaagtgcgacggcggtatatttccgcaaatctttccctaatcagtatattcttacaatttcagtaaaaaaattgtatattttcaaaaaattttccaagtttcaagttgtacggtaggaaatcttactcctgttgtactcaacattgtcccttatattggctattccttgaaattccttcttttcatctattattatgctcctattatttgctttcctcaaagtaatctaccatgttagtgtatatttgtcccttaactgcatagccctaaatgaacagaggggcgcagcgaagcgcgccaaaagtcctagttcattttacacttggaattcctgccctaggaatcctgtgcattgtctgtttggaattccttttgcctgtaagatattaatggctgctaggagtacaaggattaggtctttctctaacttaagtgataagaaatcaaactcgtatggtttgatctttgatgattaattttcttttttataggtgcaaaaattagtggaaacttggtttgtttctgcttatcttcatttcagttcgttaacaacaggtaaccaacttcccatgctaccataaagcttcagtttaagacattgagtgttgccctctttgttgaaatcccattataaccaagttatgtatttgactatgttgcactcaccatattccttcaaacatattgtatctgctcacaaaaatattgtgcttgcaatgattgaagtactaagatcgcatacctataatctatacttaaaagatgcacaaccaatagtttaacttgacatattgacgttcacagtcctgtccattccaaaattttttgctgaataaacatcatgttggataaattatttggtttactttcctgattatgagaaaattactacgtgaacagtttagattgtttacctatcagttgtgttcttttagtatggataaatcattactttggttttggctggtacctttttgcttttccctcacatttagaaaaagaaaattaggagggaggactaatattgttgagtagtttagtgacttaatattgttgactcccggtattgacaataaaattgtatttttgcagcacatctcaagaagctatgtataagttgtagcaaaaaattccatttgcacatcaacaagaaagccttgctgtaattcaatcctctacttgctatgggtggaggatgagaagcatggagtgactccattgaatgtttgaaagatttgttttggttttctgttttcagatttcgttattaggttgaatctgagatgaactattgtttgaattctgttgtattctgattgtatctgttattagttgaatctgagatagtatctgttattatgtttgaatctgagatggtatgagaaattggattgaatttggtgggctcaaatttaatgggactgtttagtaggctttgatctgataattggttaacaaaatgggccaattttaaaataggcctattttaaaatggactagttctaaaaaaaatgatgggccgctgttaaataattaatgggccatcaaaacagttggttgccacgtcatcacacgtgtcaaccacgtcatcacacacgtgtcaacaaccacgtcacctgccatgttggccaccacgtggcaaccatatgtgacgtttaattttgtcacaaaggttgggcctgggctggactacacgagcccaaaagcatttcatgacggttaaaaaacgtcatagattgtgctgatccatgacgatttcggagaaaacatcggcagatttaatctgtgacgctcaatagatgacgataagtagaatcgtcacagacaaatttctgtgacgaattttaagtgatccatgacgaattttttcgtcacagattaaatagattcttgtagttgttgttgtggatggtttgagataatggatgatgattttgttgtcgtgaatgatttgggattgtggatgatttgggatgtcgggagatgatccgtgtatgagttcagccggaaaacaagtgcaaatagctaaaaacaataatctacaagcaaataaaataaaatgtctctactcccggttggtaacaccaaccgggagtagagatgcatcattactcccgggtatttaaaccgggactaaagatcatcatcatcatcatctctagtcccagattccttctcccggtttgcaatccgggattacagggggttgcgaaccgggagaaaagaggcattctccagtagtgagcatctcctatctctttaacgcaatcttgtgtataccctaatatcatcttgaatattttataaataattacattcagttttcaaatgaacagtcggaaactgctggactgggtgaaggattggcctaaaaaagttatgttatagttgaatttcactgtgagctgtccgttacattcgaccgtctgtatgttgcttgagacggttggtagccataactgtcacgcccaaaaattctcgaatagaattccatgcagaacgtgcattaaaacccctgtccaggactggccagggtacgcaaacgacaaagttgacataaacatccacgtcttacaaagttaacatcataaatgcagcggaaaattaaagataactagagctaagccttgacttggattgcagcaggaacaccacttcacaggcatcctcgacgacacggatgaagcctactcctcgaagaaaccaccatcggacgcatactcgaactgtaagggttgggagcggcggttgcggggtgtgtgggaggtggcgcgggagcatgggcgacgtatgcgcaggtgcgcgcggagagggcgggagcggcggtttcgggcgcggcggcgctggccggaggtgggagatgggcccgacaggtgggccccgccccacctgtcggtgacccggagaggggagggggtggcgcggcggctggctgggcctcggcctcgggccagcccagctggcgtgcgggaagaggagggggagtgggtcggcgggggaaaggagggaactttaatggatccgaccgttttttgctcaatataaactaattacgaacctgcacctcacaggcggcaatttttgaggtggacttaaagatgctggtttaagaactataccttagtggttcctaaaatgaaagaaaaggtatgctcaatgcatcggctcgaattaccatccatccatcccacatccatccacagcacaaattgaagaaactaaatcacatttttttggtacaaatgaagaattccatcactccaattacacgaattatttatatgcataaaaggtaaagaacaagatgaacagatcagaaaaaagatataaagtccatctgcacctcgcttggtgggtgggtggtggggggcaccgaatccggctacccccgagcaccaatgggaagggacagagaggaggaggggccacgctggatccgaccgcttgccgagcaccggatttggccgttcccatgtgctggtggggaggggcggagccggatctggccacccccgagctccaatggatgatatgaaggggcgagaggaaggttaaggggcggagccggatctggccacgccgccatcgccgtcatcttgcagcatggagggttaaggggaggaggaggaagaggaggtgcggcggtagttacagagagaggggtgagagaatgaggggcttgagagggagaatgaggaggggggagggcacgggagcaagagaggcagagaaaaggataaggatgactgggttggttccgctcctcacctaaaagttgtgattttttttaaagaaaattggtcacttttatcccgaccctactaacaactgctcccatgggacaacattctcagttggttttaatagggaacaacacttttctctgcaaggagttataggtgtcggttcatgaaggtatcggttttaatttaccgtatggtgtcctgcagttgtgcgtttctggttggaaaaggtaagtgttggtttttcttaattactgatgggtgaatagccaatatggtccctgaagtttcgcttcgggctcagtttagtccttgatgtttcaaatcgtccaaacaagtcctccaaattaatcatttgggttaatatagtccttggactcaaaaaagtgccacgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59007 - DNA, 7706 bp, Oryza sativa
  unsure (1)..(7706): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctaagttccttgtttttttcagtctctttttgtttggatgacaaacagctatacaattcttgtgtgagtttgtttgtttagtttggatgtcaacaactatccgattaatgtgtttacagttatgggagtataaccatttcttgcattctggcaggagaaattccagaactatctttccgttgaaggtcaaaggcttaggcagcaggacggagtggcgatgggcaagaactaatgaaagccatggtatttatctctctgtaccagaccaaattttcttctcctagagctatccctccaatggctttccctctaagctatctccaataaatcttgatgctcatggctgaagcttggaatgagctttagctctagtttttggctgctgcgcagcatttgtgtaaaacgattgacgatttcgctttaacctctgatagcccttgttttatcatagcttttaacttcgttttgatcaacttgtgtgacatgtcgatgtccaacttgtgttttgggtgctctgaatgaataaggtggtttcatttgatgggacatgtaaatatgttaaagggggtgtttagatcaggggtttaaagttttggcgtgtcatatcgagtattatatagggtgtcacatgaggtgttcggacactaataaaaaactaattgcagaatccgtcagtaaaccgcgagacgaatttattaagcctaattaatttgtcattagcaaatgtttactgtagcaccacattgtcaaatcatgaagcaattaggcttaaaagattcgtcttgcaaattagtcgcaatctatgcaattagttatttttttagcttatatttaattttttatacatgtgttcaaacgttcgatgtgacatggtgaaaaattttatagtgggatctaaacaaggccgaagttctagtcggcacctcctatgtgcattgtgctataatgggaagtcgtccaacaagcgccgtccgggtaaattgaaacgtttttcacgggcagcttacatcatctgctgcctagtgtatttatagtttacacggggcagctctttaaagccccccaccccaccccacccacccccctcccccacaccaccgtggtaaccataaagaaagcgtttcatattttatccacctaggaaattaatggtgagggcttgtgaaaattgtttttttctatgctacccctcttctctcgacgagacatcgagtaaactcgagtcccttgcatacttctcctacagtctgtttggttggaggaagtttctaggagggattgggagtttaaagggatgaggctattaactgttttgtttggttgggggacatgggaattttggtgggatggggatggggaattgaggaatgaactccctccttttcaatacctaggtaggggcaggtaattgggagggaattcctcctttacttcgcctaaacaaatctcagccatccattttcattaatgatataatctccaactaaattccctatcaatttccaccacctctaccaaacaagagactgggatgaaaaatcaaattcacatcttaatctcaccatcaattccctcatgtaaactcccaatcccctttcctcaagttgccaaacaagccgctagagcaagatgacggcatccccttcatgctatcacagatgaggtgcatgctggatcttctttcgtagatcctgccacagacaagctccacgccaccctcttccaccatttaattgtgcacactttgacaataatttctggtttgaaagttttgtaactaggtttaaaagtattttttttaaaaaaaaatgagtttgtaacggtcagatttgagttgaaagtttaatgttgtgaatagaaagtttgaaaatttgatttgaaatgttaggttttgaaacaaagtattaacagctgtcaatgaaagttctatattttgaatataaacttttgattgaatgtagaagtttcagggtgctatttgtaagtttccagagtttgagttgaaattgtgcgtgtagaaaaagaaaaatgttggttgaaacttctaagatttctttcgaattgctacacgcaaggcgttagaaaaaagggttaattagatccatactattaaaaatttactgattttgaaatatactattactatttgtgttttgtaacgatgccactgcaacgtattttacatgtattagacaaaaatgcccttatcttctacctctctctctcttccccatcttctacccctctctctctcctccactgcgctgctgcggcggccgcatcgctgctgcagctgccaccgccgcgccgccgctgctgcagcctgcagctgccgccgccgagccgtcgctgctgcgctcgccgcacagctgccgcgtcgctgctgcagctgccaccgccgtgccgtcgctgctatagcctgcagctgccgctgccgcgccgtcgctgctgcgctcgtcgccgagccgccgcgccgccgctgctgcgctcgccgccgagccgccgcacgccgctgctgttgctgccgccgtctcaccgctcactccgccgccatccccgccacatgctgctcgctcgtgctgccgccgcgcgcgctctttctgctgctcgcgccgccgccgcgtcgctactgcagctggcgccgctgttgcttctgccgccgccgagccgccgtcgctgctaccgccgccgccgagccgcgccgccactcacctccgtgcgcacatcgccgctgctgcgctcgccgccgctgccgccgacgcgccactgagaagaaagagaggaggaaggtgaaagagagaggaggaaggagaaaggggaagaaggaagaaggaaaggtggtagtttgatccaatttttcttggaaatgcatagaagagtcaagtagtggtatcttttgaatatatatgaaattatattggtatatttctaaatatatgaatactaatgatatattttaaaactggtaaatttttaatggcatgtatttaattaaccctagaaaaaaaggtttgcgttggggattctgaacaatttgaacctgaaacatcatagatggatgtgtgggtaccctggtatggccattcaccctgggccgttgtatttgcttaacaataatgacacattgtgtcacatcatcgaaaaacacctcggtttttttaaggatgggatatagattattttaaaagttgaggaaccaactttaattggtttcacatctaaaggaccaaaactaaaccaaaaccataattaagaaatcaaaatgaaccttttccttatatcaaatataggtatatacttcctctcaaaaattacaggcatataccacccatggaatcattcactctaagcatcacggtttttcttttattactgaataatgaagcccatgccacagtgatataagtaagaaaatcatagcatcgtaatgccttatttaattctcataaaaatttaggtttttatcagatgattagagccgaggtcatgggataaagccgtttgcaattacaatgcattgatataaatgatacaagaatattaattcgtgtatatgcgctagcagtcgaactcacacgtgtggttttgaccgcgtcacaactatagggtgagggttagtgtttcaggggtaggtgggggaggaaggccatgatgatgggaagtgagggatcgggtttagagggatagcattagaggcggtggaccgacagtgggcagtgcacaaagatggacaatgagctagtgttggtggctgggcaaagcggggtgaagaggaggatgaggccgggcagacagggctcgctggcacgttggcgtctttcggtgccagcgaggccagccaactacacatgaccaagataggggatgagtataaaaagaattgacatagtttccggatgatctcgtcagagtaagctcgcagaacgagaaggaggggcctcattggggagaggtcttcgccaaagaaaagccgctcgactacattctgttcttctttagaggagttcacgttcaccggagaaagggggactcacaagatcttatcctatcttactataaaattataacccactaaattctaaagctcaacatgcaaagatgctacatcatcatccactaacaattattacatttaaacatcatgcaagcatgttatattatatataattttataatttattaaattttagagttttaagatataagcatgttaaatcatcatcccatataattcatataatatttcaatatatctcttcatcattttttataatatcatatatacctatatgattcatcctcacttagttagtgttatttttctcttctcccattaaatcatatcacatcaattggttttagtcttagatgattaatctatggtccaaagtatctctctttcttctttcataaaaccatatcatcttacttttacatttgaatcatcattctatatactatttaaatttaaattattataaaccatattaacttattaacttatataagtttatgtagtttagctatcttacacattatttttatttgttataattatattgaacacctgcagtaacgtgcaaggttttagctagttttattaatccctattaggtgacattctaatcctattcaatccactttaaaccgaacaaaacaagacctaaagagcaaggatcgagctcgccgaaggggctgtgttgccgttcgtacggtgtagaggaagagaacgaatacgatacggtgaggggaagatgggataaggcatccgaggagggacccagtggggctcacccgccgcgccacgtgcagtttacacgtctcttcgcttcacccacgcgtcttcttcttcttctccttcctcttccgcatcgcctcttcctcccccccctccctcccccctctcgcgcggaagaacggaacggaacggaacaccagccgctgctccggcaagcgctcgccgccggcgaggcaaaggtatgcgccacacgctctctgtacctaccaccactcgttgtcgttttcctcctctcgcggggggtgttttctttgcttgcccgcgcccaccggtggatggcttaatttagcttttccgctctgcgcgcgaggaggatctacctgctagctagacggattccttaccccccgtgtgattgatcgatgaggggctttacgctgatgcggtgaatcgaaccggcaccgctctccgtcatgggctttggaggctggaaatccaaccaccgatggatgcgttgggggagaaaaggaaattggggaatttggtactaggagagcttccttgctgtagagaggaagctagctagcttagacttgttgagaaattagtggagagtgagttcgtgagtggttttattgcgcattgcaagggaaatggaaagagggtgtctgatgaagcatgcgttagaggtgcacaaagtagagattcacatcgttgctgaagagtataggctactagtttgatgtatgctccgcgttgctaggagacatctcgcgaagcaaaatttggagaaatgagcgcactgaaactaggaggttgatttttttttttaacaatagtgtagtcaaagtgatgttggatggttgatgtttaaatgctgaacaaatgaatatgtgtacatccattcaaattaagctcgccattgtaagactaaaacacgacaaaatgacagagaaagtggatgacaacaatttaggaaggaaaaaggttaagcactgcattacgttacatatggaaatatttacttgttaattttcattagtttgcaaacaatctgtagatcctaacacatgtattatatatgcgatcaaattacaggctttaaattgatgccgctgtgactaaataagttttattcagttgtacatctctgatatccattcttcaatgagataagcactccttttgataattttcttttttctataatctctaatggttataaaagaaatccgttagaaacaacacatcattactaatagttcctaaccttcttgacaaagtcagatgattttcctttagaaccatctgacgtcacataatcgcaaatggtttccatatacacctgtttacggtagtaatgccagttatgttttgacttgctcatgtgtgctgccgtgctgcacctagtgaacctataggcactgtatttttgtggcaagaaggatttttttttcatgaatgttatgcaagtcttttttttttggtcaacttgcttcacttaagcagttgactaattcctcattagccttaatgttttcgcttggatgtggtaacaattttaatcaacttcgtagatggagaacactcaatttagccgtccaaaggcggtaccctataatgactcctgggagatacccaattctgactatattctcttgtatctcaatgacaaacaaactgggaagatcacttgcatggtatgtgggaaagaaggacactacacttgtgagtgccccatgaagaataaagaaaaatatgtcatatgtactctttgtggcaaggttggccactgtcacttatggtgctgccatcagaatgagagtgagaggcgtgcttgccgtcgttgtggagaaaaaggacactatgataattggcatcacctaggttgctccagctgtgagaagcatcatccactcgggagatgtcctatgggaaaaattacatgttttctttgtgaaggcaatggacatgtccctgttcaatgtcatttgagtccaatgctcactgcaataactcagaatcaacgagagagtttccgagctactctgagacaagcattgagagaaacaagcaacacagcagtcacaccaattacattgaccagagaattagagccatataatgataagaatggaggccaacctaaaggggacaatgaaatggtgcccagggtcttaggcttcaatcaaggagaggaaggccattctgctttgaggaaccctaacagatgccatgtaccatcctctgacaaggctaacgttgctgcagataaggcaccaaaccaatctttaggagtaacctgcttcaactgtgggggcaaaggtcactattcaaataaatgtcctcaaaagcaaaagcaacatggagtcagatcaaccaatgctgcagctatgaaagataagacaccgaacctaacaggagtgacctgcttcgactgtggtgacagaggtcacttttcttatacatgtcctcaaaatctactagaagtcatgttgactgcagaactagagccacatgatgatacctatgaacgccaacctaaagcggataatggaacagtaccaactgtcctaagcctgaattgtggtgaggcaagccattgtggtaggaataatcccatgaaaagtctggaatcatcctctgataagatcaattctacagctatgacata

SEQ ID NO: 59008 - DNA, 1452 bp, Oryza sativa
gatgccgggggacgaaatctgtactcgttgcgcctattttggtcccaactaaaagaggatcccttgccatccctttctcggttgttaaatctaacagagctacatttcaccagagcctacaacggagagaagctggtcttccttactagatggtttcccaagctgaaggttctacgtttaagagacttgcctaatctaaagaggatggatattcagcaaggtgccatggtgagccttgaaagattaagactaataaacctaagcagcatggaagaggtccctctaggcattgagtttctcatgcccctcaaatatctaagcttcgaggagatcactgttgacttcttactgtcattgcgccaatctagaattggtggtatgcgatggtggcacactttacgagaggagaatgatatggaagctggtgtaagaacgtaggctacttgattccgtggcaattagctactgttatgtaatataaattcaattcaatatcataaactacaacactagctagctatatgccaggttatgcatgtcacaacatttttgtccataagccttctcttactggctaggtgtggtagatagtctgaccgcgtgcagggagatgcatcttctcaattacaagattagagtttaagactcttttcatttaatgggttggttttggttgagggtcgtcctaattctgagttaaatgtgtattgaacttggtttgttgtcggtatgcatcataggtatgaagaggccggagtttagattgtaagccttccattatccaacatgttttgatgggtgctatagtggtcattggtaagtgagcaaaacaatttggttaagagagctgaaataacacatatataagtagtacatgagtccttttcgaatgattcaaaagcactcaagtttctaatgtaccggaaaaattgcaaagaaaaagatacaaatataaaaccaagcagcactactgtgtgaataaaaaccactgctacggtgaaattttaaccatcgattagggaatttgcatcgagcaaacaaaacagcttctacgtattaatatcccaagtcctaggtgggataacttcaaaaacatcaagtgggagttgctttggtctgtggcccccctagtcactccaggagggaccggttcgggcagcgaaaccctagccgccacctccgcctctcctccctactcccttgctcctcactgccaccctgagcatgccgacggcggctagcgcgaccactaggacgtaagctgcggagccagtttccgagcacacgctcgcttgcagcgacggtgacacggcgggcactcgcggtgatggagatggcaccgacacggtggcgctacgaagtaggtgctcatggcgatggtgtccctctcatgctatggctccaaggtggtggatggccagggtcggcggcccgagcttcagggaggggtca

SEQ ID NO: 59009 - DNA, 1975 bp, Oryza sativa
aaacggtggcgaaaagctagacgtgattttgcctggtttgatgacagcgacgccctatggtgcagatcccctccttgtaggcgccattgtggggttttatccctactcctaccacaccacactccgggtgaaaaccttgatttggattttcggacaagcggcgacggcgtttcacatcatgtcctctatggtgctgccactttggagagccttcctggtgcattaatggttgttttcttgctcctactcggctcaaggccttctgcctccacatcaatggtttaggtgttttcatgaggccttcgctgccttggttccagtttcttgcttgcggtgcaaggtagagtcagagttgtgttgttgggggtgcaataaaactaggcaacgaagacacattgtgtgccagccgtatttatgtgatggattttaatggctttggctgatgtccgtgtgggaagtggaagctacttgatcgctctataatgggcttagcattgatgacacttttgctgtggagtcggagctgctgtgttgcaagaggtgacaagctcggcaacgataacataaattctacgtggtcgaagcattcttgttactttgcggcaagctcggcaacgataccctatgtttaggctttgccattgttggttgtttggttggatggtgtgtgcagtgttcggtgtgttgcgcttgttcagccggcctcgtgtttggtgagacttgtgtagttgagttgttttttcttttcatttaacccgttgggtttttatccccgcttattgaaatataattggagcccttcggctggtttcgtttcaataaacaaacatattattatccataaaaaaggtgagtgatcgaagaaaaaaatttgctgtagttcagtggcaaatcaggacgaaaaatagaagaatggctcatgttgaagctatggcataagataagggtagtagagatgattttgctagccagtattggactattggctaccaaattttaatctcataatagatacgtaaaaaatgagtagcaatttgtaggcttgttagcatcttaatttgtaggctgtgttcttttggaggagttgggaaccccctcgcacagaaaatggagcgatagattaacacatgattaattaagtattagctataaaaaacttcaaaaagggattaataagactttttaaaacaatttttctatataatcttttttgtaaaacgcatacagtttagcagtttgaaagtgtgcatgcggaaaatgagggagatgagtcgggaactcatggaaaagaacataatggttgtaatgtaacacacgagtgccggtcagccacagcaagtcagtgatacggttgtaattgtgagtacatgtctacatattaaacattcagaactaattatgactgcaattcacacatccacgagttggctatagatggccaaaaggcctgaggcccgacggcccggcccatggcacggcattttggcccggcccaagcacggcatggcccgacggaggtcgggcccatgccggcccggcccgaccaccgggccatgccggcccggcccgaccaccgggccatgcctgggcccctccaccggcacgttggcccggcccggcatgatgggttggcagttaggcccgataaaaaaaaatatgggagtaaaaatagacatattatatgccatggacgaaagagtagggatctaaaatagacttttttttatctatacatatgtcagccaaagaggagggacggcaaatagacttattttagctatacatatgtcagcccaaagaggaaggatggaaaatagacttattttacctatacatatgaaatagcccaaagaggagggacgaaaaatagacttattttaaaaaaggcccgatgggccacccatgccttcggaccggcacggcacggcccgacagctggtgggccgtgcctggacgggaggtgcagcccatcggc

SEQ ID NO: 59010 - DNA, 11784 bp, Oryza sativa
  unsure (1)..(11784): unsure at all n locations
acgcgatgaaatcttggcggtcttggccatggacgacgacccgccaccgtcgaagatgccggtgatgaccgggtgactaggtgacccggcgagcagcgccatcaccatggatagccctgcggccgtcggtcccgtcctcctcggttgccgccaccgtctggcacgatcatcccaggctatttctcgatggctgggtactccagaggacaccgtcttggggtcacaggtaggcgctcgttgctgcccaactgcagggagccccggctcgccacgctccgaccatgcctccacatcgccaccgcagcgttcgatttcggccgcaccgccctcgacaggaataagttcacctactgtcgtgagccttccttctttagttatcataggtgtgaacactagagagggggaagaagaggccagcatccagcagcctcgcacgtgagcgtcgtcgtcgccgtcgggtgcggcggcggcagagcctctcgaggtggcggagctcggctgggcttgccggccgtctctccctcttctgccgccggcgacctcacgagaagagagcaggagagaagaggagaagaaagaaaagaaaaaagagacgtgggtcccatattattttttctcacttacatgtgggctcccatatactttttttttaactaggatgccacgtcagtgaaactagatatctatactactatgggacctaaattgcacggttttatatagtttaggggtaaagatttctgatattgaggataagggatgtcaaaaaaataagggatggcaggtgaacttattccggtagaaattagtcctgcatcagaatttctcataatggcgacatagattatggatggattattcatgttttatacacttctaaaaatacactttcttctataactttacattttagtaccaattaaatattttttttctaagctatttattagccttataatattacagaacttttacgctacaatatacgagtagtatgctgccattataaatgatctaactttataggccgatttgatcttccaattaattactccctccgttttgactttctttctagttaaattttgtaaagttcaatcaagtttatagaaaaaattaaaaacatctaaaatatgaaattagttttattaaatctaatgttgaatatagtttgataatatatatttgtttttttaaataatactatatttttctaaaaatttggtctagaaacaaaaagtcaaacgacttataaacggagagagtagattacagtataaaatttcgtaaaatttaaaaaggtagatttgtctttctacgtggtggttcgggtcccctttggctggccatggtaatcatgttctaccttactctgcgcgatgattcattgttcatgggaggagagatgggtgaccaggcttttctaaagtagggggattagcagtgtttagtgtgccttcgattcgggtcaggctatattggaggtttggatagcaggtggggctggaggtaaggaatgaagaagctttatcagttgaattggttcctcatttaaataacgatttatctttctttttttcggtgagtcatgtcaaatcataggctacaccaattttgatagtagctaaactacctcaaatggtcatctcactactatgaaaaccatttttcgtggtggccattttgaatttttgctggcggattttgcagccgtcaaaaagcaaaggccagtgaagatcaagatcttcgctagcggttattgaccgcaagaaaaaatggagcagccgccacaaagcaaaggccagtgaagatcaagatcttcgttagcggtcatcttaagccagccgccagtaaaaatccagtttcgctggcgttggcttaagacggccgtcagcgaaaatggatttttgctggcggctatgttaaatcggcctccagtgaaagtctattttgggcccaaaaagaaatacccatgcagctgcccattgattcattaattttaaaattcaaatccatatctagattcgccgctcatttccaaattcaaacatgaaatacaaaatcatcatcagcacagatcaaacagatcaaacatcatttacacagatcaaaacatgtgcatcatctggaataacatgcaaaaaaaaaagaaaaaaaaaatcaaatctagcagcacggtcggaggagggagccgcgggagcacggtcgacggcgtcgaggtcggagaggagggagacgagcagcatggtcgacggcaccgaggtcggtgctgccctccccgtggtccggcggcggcggatctggcctccccgcggcccggtagtggcggatctggcctccccacggccgggcggcggcggttccggcctccccgaggcccggcggcggtggatccggcctccccgtgcacccgagctcctctcgcggccacgcccgagagccgccgcccactcccgggtgccaccgcccacgcccgagctcgccgccgccttcgccgcgcactccgtggagggagagggagttggaagaggaagagaaggatgtttccttcaaccttgaaatcttgaatgcagcgtttggtaaagaacatcatcttttaggtgattgttcttaaataggcccggttgaacttaggaagatgtgaaaacaggagtttctgtctttctaatgacaaatttgtttgtgatatttagtacgtacgatgccctttatgcactatgaatgtaatgatctacatggaataatattatcgtgcttgtcacagctacttaattagaagcctatacaacaaagcaaaggaaattgcagatgcagatgatgaaaagagtaaaacctcagacgcttcattggtggataaatacaattcctccaaacgatcagtatctctcgtgcaaaagcataaagagagcaaaaaggaaaaaaagaaaagaagcagaagcaacgagagaaagaagaaagggaagggaaccatcaaccacccatggaagccttgtgaccgcgagaaggacctgactgctgggcggcaaaatgtcaatttagatcctgagaacatggcacaaggattgtcatcccgtttttcctctggagctgttcagaggaacttcaaggatgaccatgttggctaatcacagatgaagcatgcatgaccatgttggtcactagtatcctggtattatgagattgtcctgtttcttcatgatattgttggtttgaaaaagaaaataaagtggggtaagattgtcatgtttttccatgatattgttggctcccagttagtacttggtactcctactatcctaaatccagaaatagatttggtgcatgtttctttgaaggatctgttgaattgtcttgtggcatgtagttagttaatttttgattaaggtgcatatgctactatggtactaataagaattaattatgtctgattcatgtggatagtctctaagttattaaataaaattgtagaggaattacttacaatcaaaagttagattagatggggctggtcatgggctgaagatttgacgaaatgttccttctgtgattatgaacatgtatgcagttagctgattattaatgaacagttagctgaatttttagaagtgtatttacaggtgcctgtcaggcttttgacacaaataattatactaactttgacatattgttttggtgtgcagttttctgatatgtgatgtccacgggccttttgtttgctgcaacaatgatgcaaggaaatgtattatgatgtatgtcggaaagtgttgttactagatagaactattaaggcaatgaagctcaagttatgtcttgttcaatttgatactggtaactgggagagatatttgtgtgtcctaaatctcaatgtgtattggctcttaatgttggttgcctttttttttttgcaatattgtaacaattacgacatggattttgcagcaggtcttcagtatttctttaattttctacaattttcgtaattttctaggcattttcggaaaacctcatggcggccggccgacgtggagtgagaacttcactaccactggcgcggggacctttactactttacgacgatgggtgaccgcccgtagggggtttattgcacaaggcccctgcagaggaaaagcttgatcccagcgaatagaagatggaattgctttgctcttttctttctttgatgcttggaaggaaggcctataaccaatcaatagtaaacatcccgctaacttggtcagggagcatttagacggtgcagttagtattgaccactaccgccaagtccataattcaaaaattgatgaattcannnnnnnnnnnnnnnnnnnnnnnnnnnnnnnnnnnnnnnnnnnnnnnnnnngaagaccccaccgtggtatgcgccaataagaccaccaaaggctcaatatgggggatttccgttggatgtgatctccttatatatcttttttctgtattttcctgaaaaattatattttgtttgtgccgtatttcgaattatgtgcataatattttgaaatttctggagtgagactattaaattgatatgatatctcaccactcactattatttaccacaccaataatatacttagatcccatgggttaaggggattatatcccacggtgaaggggattgacgtggggattgggtggtgggaggggatccacccaatccctgcctagtggtattttccctggggaaaaacaaccccaactaccgaacaagcccttagtcgtagctgttttgttagcatcgtatttggatggaagcgggagttatcctcgtgccaagaaaaacgagagagcaccctcatcatcactgaacggctaattaatcctccactggcttgcacactagcatatttaatttattgtattgcaatttgcaacagggtgttttgtttcttctcaaagttggtaaagacctacttcctggtcgccgtctttttcttaaattaactttgtgactttgtaaagaagacctgtctgcagattccaagataccggtcgaagagtaggtcttccatatgatttatatcatgtccatgtacgccctgctcattggctaattaattaagttccagggcaaaggaagactttgccaacttgcataactatagaacgactcgcagatcgatctacctcccaagagtcactattaatatatatatatatatatatcaagaaccgagaaatatatatgattactccatatatatagtgtgtactctttgctaggtaggagtagatcgatcgagccagtcgcccagtgctgctcctgcagcgatggcggaggcagccgggacgagggcttcacagcagcaggaggaagcagctgggattgagaacggaggaggcaaggaccagctgccagaagatacaagtaagttaaacataacagtcctctggcttgcaatctactttaggttgatggacggcttcgggaagctggcacttgcctgggccaccgttgtgctgctaggtggattctccaccctgataaagcccaaggacttttggttcgtcaccatcatcgtggtcatgcaaataacaaggtgcgtatcaatacgacatccctatatatataaagtagaagttaactaaactgctaattagtttccgtttccaccatcaattgatacataggaaaagtgctggcttgttcttgggcactcgatcacaagagaaaaattgggcgtcccatggctacaggcagtgcccctctttcactgtgaatagcctgcacacgccagcccctctctctctcctatgcatgcatgcatgtgtgtgtatcgctctaacgagtttcaaatattttcccttaaattagttattatctcacatatgatccaattacacccatatttattaaattactagaaaaaatatccatgcgttgcaacgggaaaataccttaaatcacttagatccgtactttcctttctcaaaacttcggcaaactcaatttgaaaatttgaaagcgaattcaactttcccttttgaatactttcttcttttactagtctccccttgtttaaaattcgtttaaattctcgtatatcaaaattcactaaagatacaaaagtccatataatcacacgttgtgaccgatgatggatgaaaaacggaagcccattaagatttttctacaaagtaggtggtgaagatattccaggagaaaaacaagataaaaagaggagaaaagagaggagattgaaaggagagggagataatcaagattatcggcacaaaagaaaagaagaaaaagaaaacgaaaaaaaggaagagaaaaaaacaagctgattaggggaggggtgtgcgtggcgcccaagtgtaggagcgcgagatggacggtgggatggtgttgggttggttgggttagactgggagagagagggattgggatgggatggtggtgtttaatagttattctagactcacgtgcgtggaattggatatgggtgacatataactagcttaaaaccaacttaaacacggatgaagcaccaaagtttcggctgaaacatcttcaatttttatatagtagagactagaaaattaaaggtgtccgtgcgttgcaacgggaaaaactaatgttatgataataattatagttattttatagtttcatgggaattaggatatggcatattcatggacataaataatgaattaaatctatacctaattctatatcatgacaaagaaataattacatttttgttgactccatttagctagaaataatttaatatgaagaatgaaaacatatttcaaatttaagtaatttttaatggctaaaaatagtgcttgaactaagtttgttaacggaaaaatagtttaaatcggttgaaaataaataaaacacaattagtctcataattagaaggatgttgtgaccggcctgttaagtgcactgggcccatgtgacaggtcatggcacaagtcgacataggtgcgctgagagtcgttggattcgatagaacggttaggaacttaggatcactcgtgatttagataaacattgcctgttaaaaccctaaccttaaattcattcctcctctctcccaccgcgagcgatggcgcactcccccatcatgagcgatggcacggtgccctcccttagcatgtgtggcggcggcgggggcggcgcccttcccctccatgagcaacagcagcgtcgccctccttaatatgggtggcggtggcagctccctcccccaccacgagtgacggcgtcctcccacggcttcaacatgcggatccagcggcgacgacgaagtcgacgacttgttgcgggcggatccaacgtcggcagtgtcggcgcaaatccggcgacgaggcggcttccaacgggcggatccgacggcggcttcccgagagcagatccggcagtgacaaaggatttcatatttatctttgaatttttttatccaccttacccaatgtgttactcgcgcgtgtgagaacggaggacatcattcgattggacttacagacaaaaaattgatgtgacaaatggatagcccatattgatcagtaacatacctaaggccctgtttagatcccacactaaaatttttcaccttgtcatattgttgatgcgaaaaacacacactggcctgcgagatctgcttaactccagtgcaggtccaaaggttgacgagatgcgggagtgccagtcagtttgactctgcaactgacaagatatgcaaatagtagatcaataagccgatcggctgacaagccgatggagcaattccagccgatgccgataccagctgatagcgatagggttttgaacaatcggctatatgtccaatgtagataatgatataaaggcgatcggctgatgatgataaataataataatataatccagtataaaccaatcggccaacattatgatataatagaacaagtactgatccgaaggttaaagcatacatcggctggaggtctgatgtcataaaatccacaagattagatagatcaattaaacctttgttgtcatcggctaaatcgaacttatatgtatatgcaatccttataagccgatgcaacatctagataacttatcggctagcactccgataaaatattagcatgaaccgatcggcttaacaagacctatattatcaacaacaatctagtaggttgaacctaaccgatgcagcacgagattgtatatagtaatctaatactcgatgagccaatagatctgtctaatgtgatagatataacaaatctatttagaacaacattgtgattgtagagatatatcggctaagatagaagatcggacctaaccgagacagtcccaactaaaccgatgtgtctctaaacacaatgtaattagagatataattgagatatcaggtaggcaaatatatcaaccaaaccagagcgatccaagagattgaagcgatgcagccttgaacaacaccaatgtagccgatagattcaccagggctggtagaacgtaggacttacctcttcgccggagatcgaaagccgatgcagccccgcgtcagctgccaaattccgtcggatgataagtaaaaacctcaagaaagaggatggcgatgcgccgagagtagttgtattgatcgtgtgattgattacaatgaccctgggtgtacatatttatactcatggggagatactagtccttataggacaagaaagaaactttcctaaagataaaaggaaaacataaagtccttagaggacactaaacacactttcctaaagataaaaggaaactaacaaactattcctaattaatagataacttgccatgttgcatcctccttgaactcggttacttctcgataaacttcctttaatagattaatttccttaaccgaatatagcaggaattcggctattgacgacttggtaattctcatcggccgattccaggactctgaaaccgatattgactttaggccgatgataacttcgggcttaccaaatttgatcgttagcacatgccccccagttttggagtatgaaaactcatgcttcaaaattatcttatttcttgtcttgataactacaaaactgatcttcctttgcttattgtaatcagctttcatgagcctatactgtttgcattagatgagccaggttgtcaaactcatggcaaaagaatctctctctgataggtgttgacaatccttggaatgcgagatctgctagttgctcatcatttaggctcaaaccataacatcggctgcggacattacgaaatctctgaatatattccatagccgattctccttcttgctgctcaaccgatattaagtatgaaagcttcaactcattgattccagcaaagaagtagtcattaaattgcttctcaagatcggcccaccctctgatagaatttgatgatagcgatgaaaaccatgtgaaagccgattcagtcaaagacaacggaaaaaatctaactttcagagcttcctcagccgatgcttccccacattgcgctaagaatcaactgatgtgttccattgtagatatatcatcttgccctgaaaattgggagaagtctagaaccttgtattggtgtggcaatagaaccctatcaaatcacttatgatatgacagtcgatatacagaaatatgttccttaggtttaattccaaactgctcttctatcatctttgcaattctatcggcccaatcattgttatattggcattcttcaccatgcccatattgatgaagttcgtctggccgatattgatatagcccatcatgttgatactgatatgctggcccccaagccgatactgttgttgttcatcaatctgccccccgagctggcttttctggataattaaatcgtcaactgataccttgatcaaattttgtaacgtatccgccaaaactccagattgattaaacaatgcgcgatgaactgcttcatcaactgtatcttgaagtatttcaactatcggctcaggagattgttccttcttggtattgacttcctcttcagacatgttgggtgcgaaattcgggtcccatcgggcatgccaaaaatgtgttgatgcaaaaaacacacactggccttggagatttgcttagctctagtgcaggtccaaaggttgacgagatacgggcgtgccagtcagtttgaccctgcaacagacaagatatgcaaatagtagataaaaggaaaacataaagtccttataggacactaaacacattttcctaaagataaaaggaaactaacaaactatttctaattaatagataacttgtcgtgctgcatcctccttgaactcggtcacttctggataagcttcctttaatatattaatttccttaaccgaatatagcaggaattcggctattggcgacttggtaattctcatcggccgattccaggactctgaagccgatactgactttaggccgatgataacttcgggcataccaaatttcgtcgttaacacacatcgaacgtttggacacatgcatggagtattaaatataaacgaaaaaaaataactaattacatagattgcatgtaaattgcgagatgaatcttttaagcctaattacgcttgatttgataatatggtgttacagtaaacatctgctaatgacggattaattaggcttaataagttcgtctcgcggtttacaggtggattctgttatttgtttcgttattagactgcatttctctactattataaaaattaaagatgtttttgctgtattttggtacgtcacccgtgtttgagtcggtttttaagttcgttcgcttttagaaatatagatccgcgtttggcttggattttaagcttattttcttttggaaatacaaaaggagtcgtagaaggaatatctttaaaaaaacatgcatgctaacttgaggtaaaatacggacttctaattgtaccttatgattttctaaaaagaatatcaaagcggattaccacagtgaattttaccctacttaaactgtataacaacaataaaactaaaatagcatttaccgttacaacgcacgggcatttttctagtaatacttgaaatgtgcgtatgtatatatgatatgacacgccaaaactttacacccctaatctaaccacagcctaaatcaaaccagcccaaaacttccgttttctttttttttatttcttttagtttttcttatggccagatcgctccacgcctcctgaaactaatatttgaatgtttagttcatgctaaaattgaaagtttgaaagtttggttgaaattaaaatgatgtgacgaaaaagttgaaagtttgtgtgtgtaaaaaaattttgatgtgatagaaaaattgaaagtttgaagaaaaaatttggaactaaacaagccctaggctgaattggagtgctcgatccagcgatctaacggggtaggaaaactgatgcacgctcaatacacagatgatttgacacggcgatgaaaaaaagaaaacataaacaattaattagtgcgcaggttacttctaatcggatacatatgcgacgtacgaaaattttcgacaaaaacataaacttttataatagtagatataataattagaaaaaatacccgtgcgttgcaacaggtgaaggctattttaattttattattgttatatggtttagttaaggtgaaaatcatgagctacaattaggagtatgatcatctcaagttaacatgtcagtttttattaaaaaatatttcttatacaatttcttctgtattttcgaaagcgaacgaatttaaaacccgactcaaatc

SEQ ID NO: 59011 - DNA, 16854 bp, Oryza sativa
tcctgcggccctgtcgaggccttgatccttttcactcaaatgaattttacaataataatcattaggtgggacccacatgtccgaaatcctttctccacccctcccttgccaaccaacagtccaccacgccacatgcatcctctaggattgaagacaccgaggtcgtgagaaagagcgcgggtgtggtagcggctgaggacgatggtggcgacgacaccaccgttaggagagggatggatgcacgtccgtcgtcgacaaagatgcagtcagtgtgagcagaggaggaacatggtgacaacgtccaaggtccatggcgatcacagcggcgaggagctagtgctgctgggtccccaccccacggcgacggagctgcagctgctacaacaacccatcctgccaactggtggaacaggcttaccccacgccgcctactcgagctcagctgcggtttgggctgggtctgtgtcacgcccagaaatttagtccaaattttcagattattttgtatataaatccctatcaaagaatcaaaccagggtacacaatatgatgaattaatatacaaatctaaacataaatattgcgtaaatattttcagaagaaacacttggtcctcacaccgaaaagaaagcagaatcagcggaaaaaggcgatcctcagctccactccacaggcaaaacttaatcggggtatgagccttggtactctaacttcgtcttcggctcaaaagcactacacttctaacctcttatgcctaggtgaatccggaattcgcaaaggtcatcgcaaggcccatccaaactccatcatgctcacccttgcctcgtacgtcacaaaggaaaaagctgcactacaagttcagcatttgcccattctttcttgtcataagcactgtaagtcttaattgccatggtgtgatcataaaaaagatgcacccacaacccaccattaagtcatattttaaatggatagttacgaccaataaaacatggccatgtagttcgagctcgcagctcatcaagatactagaagtagataatgtgattatcccattaggatactagaagtagataatgtgattatcccattaggtaaggtagtggtaattaagcatggctaagcatatcataattctagcaagatcaatataagtgaaacaagctagacaaattatttcccaagtctaacaaaggatggatcacaagtaaacatggcacaagcgagcagataggtaatcccatagtcccatgtaattagcaaagcgtgcaatttatttgcaaacggtaaaaacatttataaagtaggctcaatatgctcaaggggaaggtgtgacttgccttgcttcttcgattgatcttaggaacatttttcctcgcggtcacgatattctgaaaactagcagaatctacacgatggcacacaaaatgaacaaaaaccctaataaaaaccaaataaatagtacatgaaaagtataaacatgtagaactcaattttgtatagaactcaattttatataaattatgcaagttgaatggctcaatttggagttcatatgaattagttatgaattttagaagtttttaaccatttaaatcaatttatggaattaaaccaaattattgcgcaattactaattattttaacaaagaaaaacaaggatgctggtgtcatcaatgggccggcgccaacatgtaggccccacacgtcagcaggccaaggggtgtgggggggggggggtcatattgcaacggtcggctgggctatggaccgggtccacggggtgcatgggcgaccgatggcccaaatggcccaaggctgaacaggcggccaagatcagctaggcggcggcagcgaacaaggacgcaggcgcgccggccagcccgagaaggcggtgaccaccgccggcgatggtgagagacacggggagcggcggctggcacaggaagtggcactgcacgcgaaaggcgccggcgagggcgaaaaaagggaaacaaggagagagggggagggtgatctcatcggcaaacatcggcgggcggtgcaggagaggacggcaacgacgatgaccttgcgagcgaaggggcggacaagcggcggcgacaactaaggatggacaataaatcgattagagagagaaggaggatgttgctagctggaggacgggaaatggtgggactcaccggcgtgcgagggaaattgggtttcggtggcggggaacgtcaaccgagtggcggccgtggggctcgtcgtccttgcaaagctggaggaggaagcaacggggcatgggattgccccaatctacggcaattgccggccagaggtggcgaaagggtggtggtctggtggagctcgggttagtgatggaggtggcagctcggtggcggattggagtggagtggcggccaggacgtggcgcggcgctgcgatgcggcaacgtgaacagcacggtgcgatggtggctaggcggtggcagcgtgcgcccggagtggggaacaacggcggtgttccagtggtggaggggaaaaacacgtagtggaggctaaggtggagctcgatgcggtgaagctgctggtggtgggggcgtggcgcagcagtggcgctagcagcagtgatttgtggccgaaatacgacggcgatggtggagcttgtaggtctcagcgagggagtggtttcgggcatcggcaagctcgcaagagaggggtaaacggatgagtggagtaggggggttgatttttctaggcttgggaggctggctcgagcctcgaggtcgggaagagcgggaacaaccagcggagtgaggctccggcgacttgtgcgaaatgtggccttagtgggcatttaactatttgccacttttagatttggcaattaactatttgcacccctatctcaatgacatgtgggtccaaatgtgtcaatgacatgtgggtccattaggaaatagttaattgccacatctaaaagtggtaaatagttaaatatctcacacagggggccacggggatgtgggggaaatgaggcgggaacgtggagacagttcgacgctgtttagatgcgagctcgtgaccgggggggcgccggatttggcaggatgtgagcggcggtgtggtccggccggtcaaccaaccggaggttgaaggagagcccaacaggtgggccccacctactagcggctcgggagataggagggtggcagtgtagacttcgcaaaggggaggtgcaagcgggcggagcagcgagctaggtcagggagagagaagaggggaggatggcctggcccgggagagggaggagaaagcaggtcgtgcggggagcttgggcctaatgtccctggtggttgtggcatcgacatttgtggtcatggcacgggacgcccgcagcagcggagtggtaggcgctaggtgccaagatgtaccgacagccgccttattgcagacgcctaccagtgagctcctgccagggcaagtcaacgccgtgtgtaggttagagcaacggtgccatcttcttccttcaccaccaaagaggcaccgccatgccttgctctttgaaccgagaagagagattagggagacactacagccgaatgctgatgagatcgggaagagggagcctaaggggacagaaagggatagaggcagtacatggcgcggcgatgtatcttgaatcgcccccacgaggtcagcgcaccagcttcaccaacaccgcccaggcttctacaaatttattgatccacagacatcacctgcaaatcaacaaattcacatacaaatcaacaaaatagacatccgtgcagcccgccgtgcagcccaccgcaccgcccgccgccgtgtaggccgctgccgccgtgcacctcgaatccgccggcttgctcgcttcctttaaaggagaggataagagagaggaaagagagaggataagaaaagggaggaagaggaagttaaaatgaggagataagggagggggagtttgcttgaggataatggcgaggtattatatacgacgcatcgatttttaagtcccggttgctcttatcatatgagtctaaaaatagtagggggacacacactttttgaacctggactaaaaataatctttagtcccgggtctaaagatcataaagtggtggtgggcttttcaaccggggttaaagatgatctttagtcccggttcctattcaaaccgggattaatgtggtttttgcaccacccagtaaagatcatttcttcagtagtgatataattaatgcatgtgatataattaatgcatttaatttaattaggtaaactatgacaggcttctaggaaatagctgttgttggttaatgtaaggaaaaaaaagtacgaattacccctaaactattgcgacagtatgaattgccccctcagaccacaaaaccagacatattaaacctcaaactattgaaaccggacgatttaccccctgactcaacccgaagcggttttggtcctacgtggcatacacgtggcaccgacgtggaaatccaatcagcaaaaaataataaaaaataatatatatagggcccacatgtcatattgaccccttcttctttgtcacttctcctctgtgatgttggcgttgggcatggctgggcaagcggcagtgggcacagatgggtggctccggttggcggcaggcacggatggggagggggaataggttggcggcgagctgcgacaggcgcgaatggggggactctccaggcggcggcgggagcagcgggaagggggtgcggctgggagtaagctccagatgacgacgaggcggcggggaggaagcttcggtcgagcggagcgcgatgacgggcatgactggaatgacggtggtgaaggtcgcctcatcggtattcgcatcacacctcggggggacgtgcgccaaggctctgtcgaggtggggactctcatggtcgtggacgtgcgcgatctgtcgctgctgctccttgccacgccctctaccgctcccgccgcgcctgccgccgcttggcgctggcatgctcccacaaatccgccactgccgccgcttcccgtgcctgccctggagggcgacgacaccgccgtcacttcccccgctcgccctagagagcgcagccgcacgtgaccccgctcgacctggagggtgccgtcatcgccgccgcttcccccacccgcccttgacgtcgccgctttccccacccgccctggacgccgctttccagcccgccctggagagcaccaccgccacgtcgctttctatctgccctggaggagatgaagagaggggaaagtggaagaaatacataagcatgacatgtgggaccacctaattttgctgattggatttccacgacggggccatgtgtatgccacgtaggactaaaactgctccggattgaggggggggggtaattcgtctggtttcaatagtttgagattccggggggggggggggcaattcatactatcgcaatatttcaggggggtattcgtactttttccttaatgtagtaatgtgaaacaaccttaagcaagtagcgtaaaagaaaatctatttttcatttgatacatggttttaagaagagtaaatactagacacatttcagattgctacaataatatatagtctatgattttatcaaaaatctgccactttattagtctgacaattcttggagccatctgtcattcatagatgcaatacttaggctggtgtaagttaggtctacatgtcatatacatagaggatcgtaaagtagtagttttgtgataattaaaatctttttctatagctggagtttttgtgaaatacctatctaaagttgttgcaaattaaagcgttatgtttgacaaaataatggtagttttgggaaatttaggacctgttcagattgtagccaaaataaaccttattaagttttggcaatgtcaaaattttggcaagatagcaatattgccaaaattttggcaggatttcttatgtattgatcaaatttggcagcaaactaaatatagacatttttttagtaactttaccaaaaaaaaatgtatggttgaaaatgacatcaaagtgaacagaaccttatactatcttaagaaatatgtgctgatcattttgaaaatggtagggtttttggcggttcccagaaacccgaggatcaactctttattcgggtaccactctcgatgctgcaccgtgacgaacttacgcatgttggactcggaagttggcggaagaacacaataaagaacggagaggccagcaaaggctcgtcaagcgtacgacagaatcaacgcaatgtcctagttcgcatgttttgcccaaagcgccatgtcaagatgaccatattccagacaaccctgacatggatggaggcagctgcactcgtcgcttgcatcttcatatcgttccggcgtttactcaagcaagactacgtcgatccaaaagacaaagttaaggatgaccacaagaacattagaggttccctgaatgtcttctatgggctggcccttgcccatagcatgtcctactacatcttgattgttgcgttccagtttttagtggctccattggtaaggttggtccattctagttacaagcttcatgactggggcatggatgcagtttctgagtatacagccaaaaagctttgggcattcattaggtataatgttagggaagctctcgagatgaatttgatcacctttggaaaggagctggcacgatccgattcaattgatgaccagttgaaaggagttaggattcttgattacatcataagatgggagaagcagcacttatctagagcaggtgttcttgacatctacaagattgagaagtacaaagggagggtgcttacaagtattcgagcttccactgagacactagagagagtggtgaatatgctggggctgaatttgaagagcctagaagaggaagaaactagaggtcatgcagcatccatagtgcttgaacttgctccatacctcctattcgagaatttgcctgcaatgccacagcttatagcctcactactaacgacaggccgagagaggatcaatgaaggcccccatgacataaatagtgtggagctcacttgttatggtgtgaaaattcttgaaaggcttgtagagaatccagataaccgcagatctgtggctgatgccaatgtcgttttgtcgaaaattgtagaactgctaaacttcagagatgattgtaaggtacctgttccagatgaaactgagaatagaagccaagaagagatagttgaggcctcactaaatgtcctgcacaagctagttagcactactggtgagactggcgaagctctacgaagcaccatttccaagaattctgagatcatgagcaacatcagaaaaatcctgtatcagcatgataacaagaacagtagtttatctgttcatgctgtaaaaatcctttcttgcttagcgatgcatgagactgctagagaagtgattggaagttcttgccagatcgtcaggaagcttgtttcgtcggttcttccaaggcctatggatattgttcaagatggcaacaatggatccacagttgctgactcagccgcacaggcattagttctgctaagtactgggagtgaatacaacagggcaaccatccttgataaaattaatctggaagagcttgtcggcatgctctttgatgcttccatggagcaaaggattatgatagcacatctgcttaaacatttgcggacgtattcaggcccaggttatggaaaccaactgaagaaagtaattgacggttctctgccaaaggtaaattctgtcatatagttgagtttttgcctaaaattggaattcgatactaaattttctgcatcaccataccactgaagaatagctgaaatatgtgtcaatgaatacaatttttctgaaggtaaaataaagtgttcgcgtgctataagtttcggtagtaaactatctattctttgtcttccgttacatgttccaattctatttctgttaaaaagctaaatcttatgttttccatgacaatctgtattgcatatttagttagaaacttagaagaaaagtaatatatgttatcaattaatgccatttcagttattggaagaaatcaaagttgcagttcagaagctcgataatcctgaattccctgatggacaaccttctcatgtaacaaacctctctttctaagacatcattgattccatgtagcttccctcatttaaaacgtacactcacttttcttgagtaaactcacttaaaattggtgctgtgtacaactaggacctgaaagaactgaaagctgaagaaggcaaactactagacagctttattggcctcagctcacagatttgccactccttgcaagccattgattttgataaggctctacagagtgccaaccttacaatggatacgtatgctcaagatggtactgagcgtgtgcaaatctcctaccaccgatttcccggggataagaagagtaacactcagtcagatgaaatggctgataaaaaataacgaagattacgttggggtgttcaagaggtatgaaatggacaaggcgctgaaggaagtggcagagacagcaactgagctcgagagcttcgagctattctgcagtggttctggtgttggcaagcatgatgagcccatctcttctgctgtcagatctactttggcgctgcttgcaggagattcagcataatgataacattgattactgcgtttgaaggtatcaaggatcaaggtatatgctgtttgctgctacgtctcgacttccttactcgtagcaggaccaatttgccgtatgtcaatttaattatctacactagaaagatagcctcctgaaataaaattaatgaaattttattatgaatatttatgtgcaggtggctttttattaaaatatttttattatattccaaactaaaattaaacttattttgtgttatttgaatgctgattttttttaattaccattgcaacatataaattctaaaataaaattacttgagatcatgcggttttgaattgatgagaaaatattgtgtcgaaacaatggaggtggttccgtttttgtcaaaatttcactttgttcggttataatcaaaacagcagttgatttttggtaaaataatcatgagcatcaaaaaccaatacccctattatagctagtcatttagattgatccaaaatcatgttatctttcttttcccatcataaaatgtttccaaaaaacttttcaaataagaaacttcttttgtcaaattagcacaaattttacaatcaatcataacacgtttgtttttgcgatatctagagcaagaaagcacttcatcagattttacaattatttttttatgtagtcactattattccttgcataccatttgaccttgctttgttagatatcatgatatttttgagaatccatataaaatttagtatttgaagaagctattgacctaaccaaacatatcgaattgtagtaaggatcactctgaaattttgttaatcttaattggttttttatgaattttctataaatttttaaataataaataaaatctcttcagaggtggtggcttatgaaaaccacctggaaaacgaagtgagatcacatatcagtgagaatccacatttgtacgggtcaactttatcattgagaatccacatttgtgcaggtttacttgtcaactcttttgacactatggagatgaaagatttaaaatatactaatttggacaatagattttaagtttaagatattattttttatagtagatttaacctatattttactttgtacaaaagatttaacatagagaacatggtgatatatcagaaagcaaaagtttctccccaatttaaactacttagaaccctcttgtcatactctggggctaataacatgtttgtggagtatatagctgtcgacgagtgatacttgtataccggatgattagggtattgggatatgttggaacgaggatctacgtaatacgacatcaagcagacaaaagacaaggattatactggttcgggccccttatcaggtaatagccctactctaatttatatgagattgatgatggaaaaccaaagattacaatggaagtagacagaatcggcgacccccggcgacttggttccgcgttttccggctttgtaaactatggtgtgtgttagcgatgagattcgatgccttgcacccttccctgggggtcccttttataccatggatcatcttgatccccaagtaagactcgaagacattggatcttatacgatataacaaaaactctatcccctccgagtaggactttgaaaatcactcgactcgtgtagatattttccatgatttttaacagattccactaacatacatagaaataatccacgtacgtgaaggtataccgtatctgcatattccataagtcgtcgggtaggaggtatgccctatcaggaacctgacaatagcatcttcttaacatagatatgatttagttatttgaacttaacatagatatatgtagtatgagcaaactgtgaagtcggagtagagctcagagtttctaggtgaacattaattcattgtggctgctgcttacggttgtagaagtatatataagagcaatgggaaaacttgagaagactttgcttgcttgtcataataacaaagacaaacgactagcagacctcccaacaaggcggtcttaattcatttgctccaccatattatattactacggccctagattaaaactcttcaatataatactagtatttcgcatgataatatatagatgtggcacggatcgttatgtcgctacaaaaaagcttcgaatctgcacgcatgtggcttcgtatctccagttctccaccccctgcatggtaacagtctagtgatattaaagggcaagaacagttgaacctactaacatatatatactcgctctggcactgaaaaaaccaacttctgggacgtgtttgaacaagtactttttatcccagattcattattgaaagttgatttttgggacaaagaatgaataagtgatcagaataacgacataagatgaaaagaagtggagaagaaattaagttaaggaacgatgaaaattaattatagaattaatatttgcactaactatatatttaagttaaggttgtatttttccttgacggtaaaatgtatttttctgatggtttcacgctcatatatatacactagtacaatagctatttttctgtgcggtcgaatcggtttttgcgtgcggttgcttcacccgtctagaattaagggtctgcgaaaatcgtgatttttttttgcgggtgacgcatacgcacgggaaaataaaaaatcgaaacaaaaaaaaagaaaatcaaaaccaaaaccataaccctaatccaccgccgccgctgccctagccgaggtccgtcgccgtcgcccgcgcggtcgccggcgacggatccagacgctggaagaccgctgccgtcaccgccgccgtcgtcgcccgctcccgacgttggatccgtcgcccactcctatcaccgacgccggatccgccacccccatgcctcctcactgctgccgatgccaccctcccctccggccgttgtccccgtggtcgccggctgaagacgcccctcccctccgccggatctccaaggggagggaggggagggggaggagagccaaagggagagggaggagaggggccacgcgccgccgctgtctccgctggatccgccgcccccatgactccccaccgccgacaacgccaacctcccctccgggcgtcgtccccgtggttgccagccgaagacacccctcctctctaccggatctatcaaatcattattttatatcaaaattttcaaaacacgttgtttaatataaatgttacgcaataatattctctaccagtaaattccaatttatgatctatattaactaattttttacattaattactgaacccactattttatactatttttaataaaaatattttgatatcggttttcgcttaaactgatggacctattaactagacctattaaggacctattaacacgcatgccatatctatcttttataaaagtaaaatgaaacatctcaagacctcatacatgtgcatgtttgccttctgcacatatgacgaagcatcgtatctgaggcagctaaggtgatttgtcaaggtgatccgataaacactatacataccaattaaatttatataattttgctcttatttcaaacaaatattgtttcgaggaaaacaatcaacatgcgaaaaagaaaaaaagggaaaacttcaacaaattgctgatattttgcactacccaaccaagcaattctgccaatgatttgtgtcctaacaaaaattctttaaaactttggaaaagaatatgaaaattttgaacttctacgaagggaaaaacaatccaaccattaatctatgattaatttggttgtcaataaatcatgcatgttcatgagacgattcgatcaaaataactttgagtccttgtgttgacagaaaacacgagacctaggaaatctgcttaactccagtgcaggtccaaaactcgcattcggatgtgtgagcgtgccagttgatttgatcctgcaatcaacaagaaacaaaaacaaagaaaccgaggttaaattcataaatgatagccgatcggctaattgccaatgacatatcatttatccttgagccgatgtcatatgtgaatcgatcggcagtcataaatatgtaacaaggaactaaatctactcgatcggctgtagatattagcaatatataacccttatatcgatatatactcaaatcaagtgattgggatagatcggtcgtcatgccaagacagtacaaatcacttagattgaaatatatattaacaacaagattatatatgctcatagcatagccgatcagacagatctagtatgtatcagctaatactccgatactactctatattaagatattaaagcaagtagaatacaccaaacaggagcctaatgtacttaaatgcaacaagatcttaatataaagggcagatttaacatatcaattgagcgtataaaatagaagtagttaaatcagataagatcggctaaaactccgatactaccctaatcggcaaccagaaggcaggctagggattgaaattctaagcacgacttaatagatcaaactcaactgatgcagcattaagtatgaaaagaagaacaatatctagacaatcaagccgctggatattttatagggtggtagatatcttatataatctaagccaacgtcgctatttaacctaatcggccgccttctactaacagatgttagccgattataggttagataatgatattgtcagagattatatagaatatatggtaactcgatgaattacataaacaagattagagtatcataaagatggaagcactaatcccgagaacacaagtcgtcataacaagttttacctcttgttgaagatcgaaaccgatgcagctcaacccgaaagaaagaactcgtcgaaataaaactaaagcaaaagggtggcgatgcgccgaaattgtattgaacgtatgtgttaataattacatagggctcgaggtctatttatacccgagaattataagatatgtccatattggacacgactcttatctctaacaaactctaagataccataagtctttgcggcagacttttgcccacatttatctctaataaaatatcctaattaatagatacaattgccttcccaggactctatccatgcgtggcaatcatcttgaagcacatcaacttgaacccgatgtcgtacacaagtcgtattgtcggaatcggctgtatcacttaacccagtctgactcggatttagccgatcccagtcgtagccgacccggactccagccgattcttactctgtttccgcaacaatccttatcttcgattccgcttcgatcctatcttcatctccgatgctgatattaccaaatttggtcattaacaccttgctatcgcaatttttacttgtagcaatattgtatggtatgtgttcaaatggtatacatgatatttactcactcagtccaaaagtaaattcaaatgccatatgaccttgatctatcttctaagtcaatgaatggtttttagatatacccgacctatagtttgcccttataaaatatagtttctaaagaaattataatattacgttacgatagtatagatgtccgcgcatcgtgtgggccaccttcctagttattatatactaaaaatccattaaacttcctataaacattcctaagtcgccacatgtcttcctacaaatgctcttaattcgacacgtggcacttttaaataaggtggacccaccaatttcttttatttaacaaaggacccactattttccttcattgcatttactttaataataaaagaaaaggcccatggggcctgtacacatgtacgtgtgctgcaaactgcacatacgcatgcctataaccggccggtgcatctcctcttttttatttccatgccctattagattgaacatattttgtagtaaaaatttttttgaacaactataacatcttacatcatatatatagctaattttttatccatgtacactattagatcatttataacaaatattgataattcacgtcccaaattagctggatttaacaagtaatagaattactctgtttttggccatgctattggccacttcaacacacatttttacatttttaatggaaaaacacatagaggtttaggccatgtgattaacaacattgagtttacactagacaatataaaacacataaaactaattaataacattaaaataataagaagttaattagaaaatacatattcccccgtcccaaaatataagaaatttttgttggatgcatggacatagatttagattcgtagtactatgatatcccattcaaccaaaatcatttatattttgtgccactacaaatatgtcattttagaaaaataccactactattcacgatattgcggatggcgtcaaggatggcggtggcggcggcacccaagacctcccatcgaagatgcgatcgaggacagagacggcggcggcggctcccgagcgctcccacgcggacccctgtcccaaaatataagaaatttttgttggattcatggacatggatttagattcgtagtactatgatatcccattcaaccaaaattacttatattttgtgctactacaaatatgtcattttagaaaaatgccactactattcatgatattgcggatggtgtcaaggatggcggcggcggcggcggcacccgagacctcccattgcggatgcgatcgaggacagagacggcgacagtggctcccgagcgctcccacgcggatggcgtcaaggacagcggcggctgcggctgcaggttccgagccctcccgtcgcggatggggtcaaggatagtgacggcggcaggggctcccgagccctccagtgtggatggcgttgaggacggctactcccgaacctcttgccacagacggcagcggcggcgacagctcccaaccctcccgccgcggatagggccgacaatagcggtgacggactgacggcagtggctcccgaggccttcacggaggtggtcgatgacggcggcagctacggtggtggtcgacgacattggtggagagagaggaaggggagagagaagagaggggagggaggtgaagatgaaactgacagctaggtcccacgtgcggttggggctaacggagatttttgacggaaaacgtgatggagtgatatgattctaattttctcaaattccagtggcacgtagccaatatcgtgaatagtaatgatatttttctaaaatggcatatttgtagtggcatagattcaattaacccttaaaaaatatcacttcatactgcatgcacgcaaccggccctcctcaccttctcttccctttcctttaatctttttttatagtagttgagataatatttgttatttatcataataaattctaaacaactataaattcaaaattacacatacaatttttacatacataaaatgtaatagttgagataggcttaaagtggtgctgacatattttaaattataataaataaataaatgtttgggtcatatattgacccttttcatcggtatatgacaaacaaatggcgacatatattattttatcatatatcacttttacaaacatgcataactaaattcactctactattgaaaacgaagtttagtccatcatattatttaccattaaattaatattttactatctgttttgaatatatttcaacttataaaataaaattatattttaggtcgcatttttattcttttcatgtaatccaaacatacatgaaaattatataacaaatgacaatataaagtatatttattagttgacaaatatttacgactaaataggatgacaaaaaccaaaaatgctattgacaaacgcccaatttcaacaaatgtcatcaacaattttatttataaatggaaaaagtacgaattacttcctcccgaactatcgcggtcgtctgaattaccctcccccaaaccacaaaaccaggcattcttcaccctcaactatacaaaccggacaaattaccccccttgacccaatccgcggtggttttggtccacgtggcgtacacatggcagtccagtcagcactctatttataaaaaaattgtgggacccacctgtcatctcctcatcctctcatcttctctttctcaaacgggaggacgcgcggtggcgtgcggggga

SEQ ID NO: 59012 - DNA, 2577 bp, Oryza sativa
  unsure (1)..(2577): unsure at all n locations
gtttgagacagaggaagagtgacagagagaaaatagaggatgagaggatgaggagatgataggtgggtcccacaattttttttataaatagagtgctgactggactgccacgcgtacgctacgtggaccaaaaccaccgtggattgggtcgaggggggtaatttgtccggtttgtatagttgagggtgaagaatgtccggttttgtggttcggggagaggggcgtgatttgtactttttcctaaatggaaaaattttatttatataattgctctcttatttcaattttaaattcatttttccaagaacatagtaagaatatgacaaaaggaggtagcaaaagtaaatataaatttgtcataattggataaaattttcctcttaccatatatcttaatagaaagtttcttccattaaaatatcctaaattccataaagatatctatagtacacaagaaaagctatttcttaaagtttagaaactccaaaagtaagatatactaaatattaaaaacacatatagtacaaatgatagttacatgtgaatcaactccattttccacgacacgatattttctcataaactcaagattttacgaattcaaataattagaatttatatgttgatagggtagttagaagaaaatcatgactaacatttaaagcaatcctaaacaaactatggacaaaagaatataataaaaaatcaccaacatgttaatattactcataaaaattcaagcaacaataataaacaaggtgtcaggctgtcagcaacgtactgcgcatgtgcgcgggttacctttctagtttatataatattttaataagacaaataatcaaatataatgctaaaagtcaataacgttatttattaaaagtgaaaacagagggagaacatagataataccaggattatatctagacttctgaaaatacacatccctccattggacgactatactccacaatgtccgcgcaaacttattaaaggattcagtgtttttaccctccttcaggagtattaataaatggagcgtagtcctatttttaactgtcgaccatgttacgttagggaagaccacgcctgccctttagaaagtcagttttagtagcatttatatcatgtccatgtacgccctgctcattggctaattaattaagttccagggcaaaggaagactttgccaacttgcataactatagaacgactcgcagatcgatctacctcccaagagtcactattattattactaattttttttataaagctgacggcgtccatctccatatatacctaaactaacatatgttacaggttgtattcgatctactacgtaccacaccttattttctactatgctcgtccgaccagtataaaatgggggtgatgccaccccagtgttgatgcaacgagaagacagatctaagaaataaattaccaacactcccgatcaatgtctcacaaacccgatcaaaaatgtgcgacgcaccaagattgcgacgccatggcagtgccaccaaaaaatgatgcagaggcatttgatcagcctgatccaaatgatgagaggctgccggaagagaagctcaacaccatggccgtacgcattgcgttcttctacagggtgatgaacggttgtggtgcactggctttcgcatgggccacggtggtgttgctaggtggatacgctaccctcatcaaacagaaggatttctggttcgtgaccatcatcgtcttcatggaagcaacctggtatgtctacatgtgtatatatatatatatatatatatatatatatgcagattaattataaggtcaattttaatttcaagcaatactcgctattccgcaaagttcatagaagggcttccctgtcggttcgtaacaaacagtctctctgctggttttcccactggcaggctgcatggcacggatcaggatcgtctgccttcacggggtaactgcacgagcgtgcagtcagcacacatccaccgtccgagccatccaacggctatcgcgtgacgtgtacccttaaacaaccagcccaggaaagcccacgctcacaagtgatagactgatagcggacacacctctggactccgataacatatgcgttcgttgtcgttatcgccggccgtcgtcgttcacggcggggactgacctgaagctcttcactgggatgcgccgccaccagagccaccgggagctgtagcttcctcgctgtccccttgagcgtcgtgcacgtactccactggtccatcttcttgctaggattggatatgcagcaattggaagcaattcaacatgcttgctgcctgtggaacttggaaaatatggatgcaccaagaccaagtagtagcataacacgattacagttacaatgagcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59013 - DNA, 8409 bp, Oryza sativa
  unsure (1)..(8409): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagccctgaatcccttttatgcatatctggatctggatcctgcagaacaaacatataggatgagtaatatctgatataaacataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataacttgataggtacttttgtactcagattatgtcgcaagcaatcaagataaatattatgaaaattgtttaaaaaatacgatataacatctatagcccccgactcactagtcaacggcgaaccagttgaggtagtgaggcaaaggaaaaggcaaaatatcatataaagaataaaataaatgatgacttagctttgtaatattccctcggtgacagcaaaagtagccgatgtgggaacgaagcagtccatcaatggtgacaaaaacaccagtcggcgccagtggaaccaagccagtggtgtagatgatgaagcccattaacagcggcggagtccgccaaccgtataggcaaaaacaccagtcagtggcggcagaggcaggccagcggtgaagacgtggacgcccatgaacggtggtgtgaccaaccaatcgtataggcgaggacaccagtcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagacgtagacgcccaacagcggcggcataataggccagccgtgtaggcgcaggcaccactcggcggcgacggaggcaggccggcggtgaagacgtggacgcccatgaacggtggtgtgaccaaccaaccatataggcgaggacaccagtcggcagcgacagaggcaggccggcggtgaagtcgtagacgcccaacagcgacggcataataggccagccgtgtaggcggaggcaccactcggcggcgacggaggcaggccggcggtgaagtcgtagacgcccaacagcggcggcataataggccagccgtgtaggcggaggcaccactcggcggtgacggaggcaggccggcggtgaagtcgtagacgcccaacagcggcggcataataggccagccgtgtaggcggaggcaccactcagcggtgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagttttcccctgactgatttggatcaagtcagagaagaggagcttgaagaagtggtcgacggaaaggaagtgaaaactcccaaagcgaaaacgaagtcggcgactcatgaaattgataggaagctcgacgcagcccctacctggcgcgccaactgtcgaaacatggattcggcaataataaaacggggtagcgcacgagacctaaaagtggatggatgcagagacaaaggatttagacaggttcaggccctctcaatgagaggtaataccctactcctgtttggggatttgaatccgccgggtgtgtattgatctgacgatcaggttgtgtcatatatgccccctagagggcctcctgcccaccttatataggacggggggcaggattacaagatagaaaccttaaccaatacggtatcggtttcctaaatcaggactttaggccgttccgtaatatacaaggaaacgtaacacccaagtcatgatctgttacatattacatagatataagttatcccctataactagtcggataaccatgccgtgtgggtatggggtacccataatctccacacagaccgaacaatgtaagcagtgtgttaaatggatgtcatgcagatcgacatggtaaccatgcatctttatatttgagaataaactaagtttgtgttctgcaacttaatagtacgatgcaagcactgaagcaagccagcaacggatttttcgttcaattacaaaaaagaaataacatatgagaagtttactgtaggatgaatttgtgttatcagtggtacggatcagtggtatatactgtattaggaagtgaaactttaccaagaacaaaacacccagttgcatagcatttgtgtatctgtaaacataacattacagaagttattaacgaagctccataccatatactattaattaaatatgcagaagggaacatgaaaaaacaacggaaccttaccacaattgcttagttcttggatcatttagagcggtcatatctacgacttgaactcttgaagtggcaactggcaaagggtcaagtaccagtcttaaggactgatgaatcatcaaattttccccatactattattaaaagctccatgaacaaaataaaaggtgacacaagtgcacccttcaaacatctgatatgcacggtatacacaaattacagataaaaaaaattgaatcgccgttttgcaaaatgctcagatgagcatatgggcagcttcctacttctacaaaagcttaatctgaacttacccaaaagagtgaaagagatatatctgttaaataaacaacataaacctttctaaaacaagtaacaccgtgttaagcatattataatttaactataactgtactccgcacaatgttaggaaaatgcactccaattataaaaccgttacaccatttcaccaaatttactttgttctgaagaaaatttatgcagcatcaattccatttaagttatctgtaaattttgaggtgaacttaatgcaaaccctgtgataagttttctcacaccaccatcgtacaatacaacacagactaattgtcttgagctgttacagatcaactacctgtatcgagaccagatcaattacctatatatatttttgaagaaaacctcatagagaaccaggagtgcctgttttcatttaagaagaagagatttggcccagcttttgatggaaaactgggcccaaaatcctaacataagcacggtttaaagaggaaaaccggacaaaacccacatgaaaaacaaactaacaaacttgcgacagcacaactgaaggacaagacataggtcatatttgccgagctcagaagaggagctctgacttcctatcaacataccacagataactagcgcagggtcttcaagacgaagcctccaaggaggaagatagcgtcgcaatgccaaacaacgtccgcccgaacattggaataaggttttcacccgaataaaaggggagagcaaagtaatgacaccttcaagaaggataactgcgcccacaagcgtcgacatcgttggctctagcccaagatcgagcagggtcttcgccctagctctctctccctgccaactacaacaacccatgctgccacagcgctgtcaagacgaaagcaaaagaaggttatcattgccgagcttgccacccttgacaagcagctccgactcccccccccccacacacacacaccaccaatgcaaacctccgctgggaagccacccttcccccccacctggtggaagtctcacaagttcccaagccttattttttgcaagggcattaagcttttctttcattgcatctttccaccttggattttgctttgcacgcttccaatccttcagaatgggcacaatatgtaatgatacaatgaatgttttgtatgttggtgaaatataggaatatgatatatcgtttgcaatgtcacgcatagaactaagatgctcaaaaccaagacatacaggaggtctactagcattggatctaatctctctacactatgcaataggtaattctactagttcaagacttggagaagtgttaccaattatctcaagaggagccaaggagaccgaggagagagggtctgagaggattctgggactgagcactctaggtttggtaactcttcaacctgatctttcactaacattttgcttttctcccaccgactatcaaaaccgcctcctttgataaactagtacatccttttgtttcaccatttcggctcactccataggacatggaattgtctcaacaactacttctccatcctccttatgaagatccatttctttaacttcgtcttgtgtagcttcaacagtttgccctacctctttactcacatctatactaatataaaaaggaggagctgcccctctccaatcctaccggccaaatcaccggatgaatcccaaccatccatctgcatccgcattgccctaatccctaatccctaccatccacccgtgatttcaccctcttcaccgcgaccgcgatttcatcctatccatctaccgcaatgttcgcctgcgctctcgccaccgcacgaagactccggcctccgctctatttgctcctcctcgctccgcacatcctccctcctcgcgtgtccccgccgccaccgcactccaccgctgcccccaccggagcctaggtcttccgccgccgccgcgctccaccgttgcgcccgccggagctgaggtcgtccccagccgctgccgctgccatgtgcaatcatccccgcatttcgagggaaaatccgccgatgataccgcgaggtagtggtggccgatgggtatgggtgccgccggcgctgcccgcaaccgatgcgtcaccctcctcactattgtcgtgccacacagatcgaggactaaagcaccaccatggccgccaccgcgcgctcgatcgatcatgccagcaacccaaaaactgacgctgtcgctcgccacaccaccgacgccgtcgcctgccgtttgctccgcggctcttcccattccttggaggtcgcacgcctatggcaccatcggtcaccgccgcacatactctttgccgccccttcctctccctccatcacccgcagcgagaaaacctccatccgcagcatgtaccgctgtttgcaggtcttcaacggtaccaatgattatcctacccgacgcccagtagactacccactggaagagcagcaaactgatgaacatcgtctagaagaccaggtgatttttctccctgctactgaaactgaaatgataaagtgttcttccctctaatttggaacataacttccgctgctactgttgctgatactactaatataagtgccgccgaatcatgaagaagtgtgtcattgacagggagatatacatgtccataagcattggacaaaatggagacaagattcaaaggaatcacgagagcaggcaatgaaggaatgaggaatctaactctaagaaatagacagtttcaacatctgtaattggtaaccccttccgagtgttttttaaattaaaatatgtatgcccagcagtaatatgctgaaatgatatttgggtggtgcaggaaatgaaactgtgcaatccataatgtgtcttgtattcaacaatgcacatccagcattagtaccatgcctctacaaaacatataatttgatctgatcggaaaactcaaatatatttaaaaaaccgatataatgtttcagctcttaagaatggtgttactaaaaatgcaactatgtcaaatgtgtttgctccatcagtaattctgtatataattgttgttcctaagttttactgacttaggaggccgctgggattttctcctctgtgaatggctaacctctgtatatagctatgtaactgtgtaatgttactgctagaggggctttctacttggtgtcctatttgtcagcataatgttgctgacgttgtaatatttccccttcttgcttaatcatggtggtagactcacggatttattcttctgttccctttcttcatgcaccgctcactaattttgccttgaagctttgatgtgctaggagtcgctatattttctttgtacactctaaatcaggtaaacctaacctttttctcactgtcaaaatatgattttcaggtaaacctaacctttaccttaatacaagtgttctttgtttttattttgagggattaagtgaatcttggtgaaaaaaaaatgaaggatctggattttttttgaagggtcatttgatgatctatgttgttccacgggtgattttacttcatgcttgattgttaactatccctgccatatctaattatctatgtctatgtagatgtgatctcattttttttatgcatgagcattaacgaggtttactctctatgtagattaagaagtattattgtctgaaaatatttggtagttgcctgaaatgtttagcttggttatgttaataggatgtacatatgtacttctgttatctggaaattgcttattgcgattatgtcatgccgtgcaccatgccaaagatgttcctttttttgctgcataagcttatgtcctaatttaggttctgaaattgtagctagaagtttgaagaaatagtattttgtacaaatatagctgatgagcaagttaaaaggctacagaacactgttaatatatcaactgaagcaacatgctgtgctaatgggcttactcattttatgtagataggctattctcttaagcaggtttgactatttggctttgctcttttttatatgctttcttcctttaatagtttaatatacctcctatgtcctaacaattcagtttcagctgtaagttagtccccttaggcgtatgttcagcaacagtatttgtacataatcgtttgttgataacaataattcttgaagtgttgatttatgatttccttgaagtgtaaagcaagtcagtaacacacgaagaaaatgtgtataacaatttaatattgataacactacattatgtttgactatgagcgtagtaggctgcagaaggattttattttgacaatgttgaactcaatagtcgttggttctaggtacattaaagactgatggaggaatattgatgcagtgcaaatttgatcaaaagttgccatatgtttatctggcaaaaatgatttgctgtcaaagacaggtgatgtaaaggctattagcttcctaaacataagggggaattatgccttttcatgtgccctgagtgcttgattatttaccatgcaaatcattgggtgaatagctaatatggtccctgaagtttcgctttaagctcagtttaatccttgaggtttcaaatcgtccaacaagtcctccaaatttatcatttgggttaatatagttcttgaacccataaagaataccacgtgagcatgccaagtcatcctcgcatgctgtattataaataaaatgacaattttacccttatataccatataaaaaagaaagacaagatgccaacaacacaattataggccaacccagcccaacattgttgcgaagggtggccgacaataatttatacgatcagtgcttggctacagcaatcataagggacaattctaaaacgatcatacatgtgtgaaacatttgttttcttttatatatggtatataaaggtagaatggtcatttcattcatatcggtgcatacgaggatgacttggcatgctcacatggcactttttgtgggtccaaggactatattaacccaaataattaatttagaggatttgtttggacgatttgaaacctcaaggactaaactgagcccgaagcgaaatttcagggaccatattagctattcaccccaaatcattagtcgaccatgggatatttgtttcgttataaatccatt

SEQ ID NO: 59014 - DNA, 7009 bp, Oryza sativa
tttttaatggaataactacttatcaggtcagtaaatttcgaggcatacctttgttctaattaatgaggaatacatccaatgtgcataatgttaagtaacgacgtcatgtagggaaatatgggtattttagtttactaaaatctgaaaaagcatacctttaatttgtggtgctttatgcagagacaaattaaggtgctataacctcttgctctgcatcttactccaccgccaggtctgctaccctattgttccagggacatatttgcttgacacttaacagtatatatagatgcatgttaaattattttaccttcaacatagattggacatgtgcacgctactcatatgtttgtattagatgatttgccaggccgaaacgtataatactagctgaccatgtgtttattaaaatgcttcagatatatcattaatttattttccatcatttagcttcttctttcagtaaatgtgatcataccaagagatatcgagatcgtttaagctgaaaatcccttattaaaaaatgatcattggtttcatcatatttattttatttcaatgatatgtttgcttatgtttcattcatggattggaatttgattttcaaaactaattgttttcaagctgaagcctttaatcaatcaagacgatctggatgaatgatcccgcttcagtttggagatatatgaaataattgcagatttataattatacattcttattacttctaaaacttagtattctttgtaaatggagatgacaacaatgttgtatttttctgaattctttgttatggttctacttggtgaatttctatattttctttaattttcattttgtatggaaataaaaatgaggcgtcttctccatttcaattatttattcatgtaacatggatttcgtctgcattgtttactctgaatctctgattgaacgctctaaggtgttgtctattttttattttcaacatgaatgaagttgcaatgaagcttacagttttctttgttttatctttgaaacaaaaaatggaccttattggacacaattttcactgccaaatattaggttaaagcaagatgtaatgcatacatattgattgttcacctatatatattaagttgaagcatgatataatacagagaacgtgcattgcacgtgcatgattactagtcatcaataaagcatggattgatccaaccaccactacctctccattcttgtcaccagcattttcttcatgtgtgtcacatctctctatctccccctctcgactatcaacctccatggtagtcaagaatttcttaagaaattggtcaagatatttacttttataatagggctcaaactctcgaaatgtcgcatccatactcacaaacaatctcctcccaatgggatcccaacatttataccccttctgacttgaagcgtagtcaacaaacacacattttgttgcatgaggatccaacttgccaccaaaaggtcgatgatctcgcacaaagcatacacaaccaaacacttttggagggaccttgaactctcgcttacccaataaaagttcggtaggtgacttcataccaagtatcctagatggcatgcgattgataagatatgcaactgttattacagcctcactccataaatactttggcacattcatttggaatattagagatcttgcaacttctagcaaatgtcgattcttcctctcaactacaccattttgaggaggggttacagggcaagtgaataatccctttatctgagacatatgacacaaattcattattgatatattctgttccattattaggccaaataatcctaacttttgcatcaaattgagtagtcactaatttatggaagtcctagaagcatcgaaagacctcactcttgtgcttaagcatataaatccaagtcatacgagtatgacaatcaataaaggtgacaaaccacttgaaactactcacaaaagtaactgggcatggtccccaaatatcagaatgtattaatatgaatggttcacagttatgaaggctaattccaacatatgtaaagtgagtatgtttgctaagctcacaagcatcacacaccagtctatgcttatccactctaataaataggtctggatacaacttactcaaaatcttaaaagatggatatcctaactgacaatgaagcaaaatgatctcctaccactgcagttagtcccagctcctcatgattgatgtaccacaacccatcacgcctgtaacgccccgattttcgttcaggattaaaaatcatttaataatgcatttcctagaaattaaataaaaatttaagcaatttatttgagtgaattaatgggagaattaaaattttcccttaaaaatcattggccgggaatattttgcaatattctttgtgccctaaaatactctctgaaatttcccgtgaattttcggagctcaagaaataatttaaatagcacaaagttcatttaaccaattagaataaaaagaaaagaaaataatcttccccttccttcctttcgggctcggcccaaattcctcccctcctccttcctaggccgggcttcccttcctcggcccgctcggctctctctcttcctcaagtctacatttcctccctagcccgttttcccctccccctctctccgacaggtgggccccacatgtcatctcctacctccagctccatccccaaccgccgccatggccgccaaatcctcccacgtcaccgcctctcccgcgcgactccctctcccgcgcgtgcgtggacgcggtcgtcgcccacgtccgcgccgtttccccccactctccccgcaaaatccggccacgtcgccgcctcccgcctctctctctcctcccacatcgccggccggtttctacctctctcgggctcgatcccgcctcccctcccctataaaaacattccccgcacctccctctccatttccccctctcccgagccctcccgtgcacgaaaaccaccccgccaccgttgcacctcccgccgccgctcgccgacgaccctccagccggtcgccacagccgctcccaccaccgtcgttccgcgcgaccgccaccagcggcttcgccgcgtcgtgccacaccccggcgtccgctccatttcccctccccgcctccgaagcaccatcgccacgcgcaccacctccttccaccgaagccgccgactccagccgccgcttggcgccgctcctagccaccccaagtcgcgctgtcgccgccgctcgcttcgcagcgccgaggagcacctcggccgccgcttttcacggccgggatcccgccggaacacggttcccctcgcgccggtgagcatccgccgcccattctcccctccgaccagcgattcatgccgctgggagccctctctccccctcctaacctctcccccatcctccccaggtccttccagccgccgtctgccggttcccgctcgcggaacgccgccgggccgccgttccgccttcatcccgaggagcgccgacgccgagctcccccccccccccgcctttccccgcccctcatcgccgcgtccttggtgagctcctcctctccctccttgcctccctctctctgtctcccgtgcgcgctgtcgcgccggtggccgccgccggcgaccaccaggccgtgcgccgctgccattaggtcggccggccggcttgccgccgccccgctcgcctgggccgcccggatccccttgccgcgcctcaccgccgctttctcgcatgcaccggccgtcgccgcaggaggccgcgccgccgcgagccgtcgctcggccgggctggcctgagccgtgcccgtgctcaaccgcgccacccagtggtcccggtccacggtggaccgattcccttgacccgctgacgtgtggggcccgcctgtcggcgccggcctctttgatgacgtcagcgcttaagctttttcctttgagaaaataaataataattgcgcaataaatcgagtttaattctagaaattcatttaaatggctcaaaacttctaaaattcatacctaattcattcgaactccgaattgagccattcaacttgcaaaattcatctaaaattgagctctacatgtttgttttgtttttatgtactattttcttggtttttattagagtttttcctcgttttgcatgccagcgtgtagaatccgtcatttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaaccatgggtaataaatcgcctagcttgtgttactttgatgacctagctagaactatatgcttagccatgcttaattaccactagctcagtcgatgggataattgcagtattagacattctagtatcttgttgagctgcgtgctcgagacatctggccatgcttcatggtcgtaattatccaactaaaatgcgactgaatggtgggctgtgggtgcatggtttttctagtcgcacccatggcaattaaggaccggttcgcgggatgccctggaagaacttatcgtacttaccacaagccagcgtgggcaacggctggacttatagtgtagctttcctctagctgacgcatccaggcaagggtgggcgtgatagagcggggcaggccctgcgacggcctctgtcgcttccggattcacctaggcacgagaggggactgcccgtcgcccgctagggacgggggtgaaacctgaggtgtggtgtgcttggctagagggggttatgtgaagggtcctgtcacggcctctttccggtatgtcatggtggcatgtcggcgcacggtaacgtgtcgtggggctgtgtcttgtgggtacagttgtacacctctgatcagagtaaaactattcgaatagccgtgcccgcggttatgggcggtcgaccagattcaccgtgattagtctcatacttaataaatcgacccaatacactgtagttcaggtgggttgattgggcctgttcaacgtggtgtagcgttgatcagtggagatttaatgttactctaattactcaacagttttactgtttcgctcaataaaatgttttacaaccgcctttatgcaaatagccacaaaccatccttgtatccccttgcacgtctgcatcgttggtgtggcttgctgagtacggtggttgtactcagccttgctattattcccccttttcagaagtgtagtgcttctgagctgaagacgaagttagaggaccaaggctcagaccctagttgagttttgcctgtggagtggagctgaagccctgctaggatcgcctttttccgctgctgctgctttcgtttcggtgcgaggactaagtgcctcttttgtaagtattttacgctttatttacgtttggaactgtatattacttgtcgttttgtgtaccctggctggtcctggacagggatttaatacacaaaatagtctggaaatttgggctatatttctgggcgtgacaaagtggtatcagagccaacttgactgtaggttgagccaaacggtcaaaccctaaggacaaactttctgaaaaccctatttgcaaaatgtctcctctcgcccttcggcatttccttgtgaaatggtttttaaaattctcctccctgtccctctaattcttttagctgtcaaacctgaaggacaagccatcagctttgtgcatgtttggaagtcaagtcaagctaagcctcaagcttcgtgcaaagagcgagaagatctgtccagagtcatcgttccgcgatgatcaataggagttttcccggagatgacctaaacccaatctttcccagaagagtagtttcgttagcttctagatcgtgtgttgtttgcttgtgtgtaggggtatggcttgcatcattggtagggatgcaaccatactaggttgtttgcttaagcaacttaaaccataaaaatctactcacaacagatcactaggtaagtggtttagtacctcatctctagtaaccccacccatttccccctctctctggtgcctgcagcagatggtcagcatgagggacaatttcatcgaatcaggaccctgtcagtttcatggggcaactcagtgcaattctaatagtattccacatcagcctcttgaagatcagcctcaaccccaagtcatggctaatcaaactcaaacagtggaagagttgttacaacagatgcgacgtcggtaccaaatataccagatgcaacggcaatgtcaggagtcgcgtcaatgtcaccaaccgcaggtgcaagtccagatgccagcccagaacccgaatcagagtcagagtcaggagttcccaatattggcaccgaagacccctgtcaaaatgctgtccagatccccgaagataacgacagccaagtcatcgtcagaccaaaggaaagtaagtgctacctgttatgactgtggtgagcaaggtcattatgtaaggaactgtccatggaaggtgttcgccaggtcgcctcactctagtcccaatcctccttccagtccccttctcctggaaaagacatgagttctcatcaaatgcaacaatgcacttgaattggtcaatagccgagctaaccgagagaaggttaactggaatggaaggaacatgcagaacaaaagataaatttattgatgtgcactcaaccgaccctataccatgaatagatttggatgtaccatcagcaatttggatagttttggagtggacataaggggtgtatgatgtgaaagtattatggaatcatgtggtatgctttgatgttcctgagtctatgatccaatctataggatgtctatatgtagatgcaagtgcttgtgcctgagtacctttgcctgcttgggtatggctagcgaagttaccga

SEQ ID NO: 59015 - DNA, 5024 bp, Oryza sativa
tcaaagctaatatctaacagagaatggggattattcctatcaaatgactttttcttgaattgaactccagcttgatggtattgcactgcccgacggccacgaatacgtggatggtgatcctgaaagcagttaagcaaaggatctggtgacatatcgtgattgctatcggcaagcttacgtccaattttcaaatacctatagcatatattagcgaaagaatgaaaatatcttcctctctccaggtattgtgaaccctcaaccagctttttactaggcttgaggtacatctggaacaaatgcagcatatgatggaaatctttaggccgatgtgcttcctggattgctcttggatggtattgtatgaagttctccaacgattgagctactttgtctgtgagaaatgaaataggcctctcatttccagcaaaaagttcatatatcctcctaacaataaagaaaggaatttggttctctagtagcatcaggtcttgttcaatacagctgtcaaaccaggttccaatttgccaattattacattgagaagattcaagttcctcagtgtgatcaaagtcagttccttgactagtaacttcccgacttgaaccagcaaggacaagttctctctgtgtgcagatagagttatccctgctgcattgctcaccaaaattaccttgacttgtagtgcttttgtgtattgttctttccattataatgtccgaactgtcagcactacatatatttgcacccaaagtggatggaagtattccctctaaacctctgaaatggtgaacaaaaaggcaagaatcaaggagtagcatctgcagaaatttgtcatgttgcatgtcaatgtcttcatagcatgcccgtgcttcctcctctaaatctttgaccaaatttaggtagtcctccaactttatttcacgattcagtttaagaaaaagatcaaggcaattccatttttccttctcaaaggctagcaagtacgacaatccatggtggtatggaccaattgataacataattggctcataagccccatgatccatcttccgaatgtgttctggaactctggagattttgcatgatttactcaccctcacatgtgaacattctatagataggtaatagttcaatttttaagacttcaccatttcatctatgtcaagataacttgtaccagcattgctgcttccaccttgaagcgttcttatttatctgttcaagaacattacacactaaatatcatcaatgtagctatgaaattcattcttaacaataagcacaacaaataattcaaatatggtatatatagagcggccttagtgaccattgaacttggcccaagtccctgtaattgtttaaaaataatataatagttaacaaaagaataagtctgttgcaagtagtacctcaatgcatttctaataattgaattgcacacaacttaaagcatgagccaggagacgactgaaaaacgcagtatggttagttagtactacgtgcttgcaaaccaatttttagatttgaacagcgtcgttcacttttgggttaggcagaaagagcatttcctacagaaaagtataaaagtaaattaccgtaacaatgagtgtacaacttccaaccctctcaataggtgttcccagaagaagtttgaatcaatgtatctcatatcatatttctagtatggcaaatacttcaaaagatacaagattgaccacacgtatttggaggattaagacaaaatattcaaaagttatatagttttagtgttttcgcttttttttttgctcagttaatagatgagacagtttctaatgcaagttgggtaccctgttatttggtatttctattttctttttctaaacttttcagtaacagaaaattttaatagtatggcaattccctttttttttccaaaattgtaatggtgttaagacgcttagatccattaatatcatatcgaccctacattgttttttgtagaatgagtgaaacaaagaaggtccaactgtccattctacattaatagccttgtagcgaaatcttcatactggatacagtttcagggttgcatccccagccccttagtccgatttggagagtaaaggctaatgctaatgctaatgcttcaccacagtaatgctcatgcttcaagcaaagatatttgcggaagataaaatattgcacaaaggatggccagccaattcaatctgtagtgtggttggacgaatgcgccaagacagtagttttttccaaaaaaatactaggaacattgtttgttcctgagagagaattaggacaagcccaatacaacatattgatcaattagcggggcaaagagaagccaagaggttggtactaactaagactttgttgaaaatttgggggagagagagaattttcgaacactaacaatgcactatgatgcaagtggtactcaaaataaaggagttcatagatcagagggaaatggtagtctcaccaaccaatcgagaaccagcctgacagattcaccaaagagtactacaatccctactcttgtggatcaattgaccagtaatttagagagccagagaaagaaactgaaattgaacgcttgtccgtcgtatatcaaacaaaaaatatacgatgtgtgaggatttgttgagaggagtggctctgaaagacggaattgaagggagaaaaccagaacaaaaaaaagggggaaagttgatctttacctccccgattggagaattagggcggcggagagcggcctgagatacttcagcgacgccctattgccctaatggtggcctccgatcagcccaaggccgttttctcaggggagggtctagtcgagattgctctgcaccgtagcccgatttagagaaaagaaatcggtcctcatctgtatctcttctctactgttataaaaattaaagatatttttgacagtatttaatacgtcatttgtatttgagtcagtttttaaacgttcattcttgaaactacaaatcgtgtttaagtcagattttaagttcgttggcttttagaaatacaaaaggagtcgtataagaaatctttttagaaaaaaattacatgctaacttgagatgaaagttagactcctaattataactcatgattttctaaaaaaaatatgaagcaaatttccacattgtatttcaccctaactaaatcatatctgttactacttaaaaaatttatgatgaatgagaccctagatgatttttattagttatggctccgaagattacgggaggcgattcttaggcaattctagggtttcgccattgaatctcatctgatcatctccgttctggtctctgcgattttacgtggagattaaggtaattgaggagtttctgttgtgattcgctggatttataccgccacgttgtaatcgggggcggattggctgtgatctatttttagtccggactcttccttccgaggtcgtgcctttgtcctcgggttgctggtctgctgaaaccctagccaaggttggggtactggtttcttctgcctgtcgattcgtctcctcttcacgtgctcttcctcttgttgacggtgagggtgatcaaggggaacccggtgagggatctacccacccgaagccgttgacgggtggatctgcatgatctgcgaacgagcgatggacgctggcaaagatgtgcaagttagggggctgatagatggaagaacgggggttggcgagaacgatgagatcggattgctggccggcgagctgggtgcaactattgaccaaactttgaaaggtttgggggctggttctgcaagtcaggcttccgggcttaacaaggcgattgtgctttttggcgaaaatctggattctgtggatgaggcggaggaggatcttttttatgttgatctgggagagttagaacaggaataggaggttaagtggctggcactggcgaggttctattcagggcaacggtacaatgtgaagggtttgtttgaggagatgagtacggcatggggtttacatgagacaagaagaacccgagacttaggagaaaacaaattcttgattgagttcggctgtgaagctgatttgaagagggttattaatgggggcccttggaagcacaagggggatgcattgatagtagttccctatgatggtattgtgagaccgttagaggttgtcattgactctattcccctctgggtcaggttcttcgatctctcggaggtaatgatgaccacaggtttttgggcgagaaactgggtgcggtgattgaagtgcaaggggcgatgtttaactttttgcgagtcaaagtgcagttttcacttgctaatgctctaaaaacctgcattaagatgagaatcaaaggaagaggtattatatcgtgcccaataaagtatgaaaacgtatcgttcttctgcttctcatgcaggcgcattggccatgctgaaagggagtgtccagaggaaggaatgtctgataatcctgtgagatatcggaaggagctgcgtgcttcaccgttgaggaatcgtgtgcagtagatgggttcttcatcagcaccaagagtagtcagagggctaaattttgttggacctcagaaggataaagtcctttctgagtccagttcatctaggaattcgcaggtaagtcgtgctcgaggtggtacgcccgcaaacttgggggttcggaaggatgacgaagctgttactgagttagtaaaggatgatatgtgtggagcagatgagattttgggcaaaagtgtgcagcagatgcaggtggaagatattggtcccagtctgaatttggttgctcgtgggccttgcagtagagagagagtttctatgagttctgactatggtctatcggatgataaagctgatgaggtagattcggcaaaagctggaggagcgcagacataggtcagaaggaagtccccagactggttaataaaaaagatgcagggactgccttctcgtgaggttgaaaaatcgagtagcgccagggtctttatcaggagaagggacattggg

SEQ ID NO: 59016 - DNA, 18280 bp, Oryza sativa
ttcctgcagccctatagcgctgttttgggatgagactataaccgttgatctcttgtcgatgagtaacatgtatattgatgtgctaatcagaaatccgggagatggttttttatggagatgtacctttgtttacggtgagccgaagaccacggataggcatcttatgtgggagctgatccgtccataaaaccagtctcaaatgccctgtggttgatgatgggcgatttcaatgaaactctttggtctttcgagcagttctcggcgagaaggagaccagaaaaacagatgatggattttagagaggtactatctcattgtgatctgcatgacataggcttcttgggtcgcccttggacatatgataatggacagagaggggataggaatgtgaaagtgaggttggaccgggctgtcgcctccccaagctggtcgaatcacttctcagaagcaaaattgttgcaccttgtgtctcccaggtctgatcattgccctatcctgttgtgtctaacaaagcgatcgtctaccccgacgaatgtcttccgttatgagatcatgtgggagagggaggagtctctcagtgaagttataaaactcgcctagcagcaggatttgttggcagcagatctaggtgaagtggctgtgaagctgaggaaggttatgtcctccctacgtgagtggagcataaaggttttcgattcggtctcaaaggaactgaaagatcttcgtcagaaggttgaagctctcttgctggatccttcagctgatcattccgacgaaatcagtacgatttatagacggatggacgagctcctatatcgagaagagatgatgtggctccaacgatcaaggatttcttggctgaaggagggtgaccgcaatactaaatattttcatagacatgcggcatggagagctaagaagaataaaatcatccgtttaaaagatgaagatagcaagtatgtggagaacaaggaacaattagaacaaatggctacagcttttttccagaagttgtacacgaaagatcattccgttaccccagcagaagtggtggatctgctcaagagcttggttgacgaacccatgaacttggagttatgcaagcccttttccgatgaggaaatctcagatgcgttgtttcagatcggtcctatcaaggccccaggacctgatggcttcccagctcgtttctttcaaagaaattgggacacgcttaaaggggagataatggcagcagttagaaagttttttgcagattgtgctatgccagatgaggtaaataacacatccattgtccttattccaaaggtgaaacagccagaaaatctaaaggagttccgtccaataagcctgtgtaatgtgatctacaaggtaatctctaagtgtttggttaatagacttcgtcctttgctatcggatatcatttcatccacccagagtgcatttattcctgaaagaatgattacggataatgtgttaattgcctttgaaagcatccacgctatccaaaggaacaacagcccggataatagcttctgtgcttacaaacttgacctcagcaaggcatatgatcgagtagattgggacttcctggaaagagctctcttgaaggttggcttctgcagacaatgggttgattggataatggaatgtgtaacgactgttaagttctctgtgaatttcaatgggtctcttctagaggccttctcccctactcgcgggttgagacaaggggatcctctgtccccataccttttcctgtttgtggctgagggtttgtcatctgtgcttaaccgggaggtggaggcagggcgcttaacggagcttaaagtatgccgtcggagccctggtatctcacatttgttgtttgcagacgatagcctgctcttcttccgtgcctgcctgcaacaagctactgtagtccagaatgccctaacctgcttccaagcctgtactggccagctcttaagtcccggaaaatgctctctcttggttgggagaagttgccctgatgcgactgtggaagtggtgaaggagattctgcaagtggaaacaccggcgtttgaaagtaagtatctcggacttccaacaccggaaggtagaatgcatgcgggacgatttaaacctactgaagagagactggcaaaaagaatggatagctgggctgagaaacatatgtcatcaggggctaaagatgttctaattaagtcggtggtgcaagctataccgacatatttgatgggagtgttcaagctgccagcttctacctgcgaggcttatacgatgatgattcgagatttctggtggggtgatgaggagaataaaaggaagatccactggtgtgcttggtaaaactttactcggcctaaaggaatgggaggtctggggttccgcgatatgaagctcttcaatcaggccttgcttgcccgccaggcatggaggctaattcaattccctgatagtttatgtgtgtgggttttaaaggctaagtatttccctaattgtgagctagtagatgcggtcttcccagctgaagtgtctccgacatggaaagggattgaacatgggctgcaattgctgaagacaggacttatatggcgaattggtgatgggaccaaggtcaggatttggcgggataaatggattccccgagcctcctctctcatgcttatgggaaggagcggacgctgccgtcttcgctgggtctcgcagctgctgaaacaaggggaaaagagctgggacgttgatctgatcatgcacgtctgtcacccacttgatgtggaagagatcttgaaatcaatttgtcgccataccaggatgaggatttcctagcttggcactacgaaaaatctgggattttctcagtgaggtctgcttatcgtttagcgtggttgaacaagttccatccggatggagaaggcagtagtagagaagcggacagtgatcgctccatttggcgaagaatttggagtacgcctgtgccaccaaaggtccgtattttcgcctggcgtctagcccgaaattatctggctacccagcagaacaggtgtaaacgaaagctgcaagcagatgcgacctgtactatctgcggccatggggaggaagatgagtttcatgcggtgatttcatgtacctagccaagggccctccgagaaactcttcgggcgagctggaggttaccggatgagcgttccctgtcgaagctaggtccggggtggcttcttgggggactcgataagctgagcgaaaaggagcgggcgcagtttctccttgtcctatggcgagcatggtacctgcgcaatgactgtgttttcggttctgggcaagcgacggtgaagggatctacagctttccttctgaatctttgggattccttgtgcccgtctagcagtgcaatgcaggaaaatgagaaaggaaaaacagtgtcggagggaagacaaagtgatgtgaatgggtgccgggaaagaacccaagtggcaggtgtgtggcaggcaccagctatgggatgggtgaaaataaacgtggactatgttccgcagactagcactggtagcgtcggcattgttattcggaacagtgaggggaatgttttactcacttcctagaagctgatcaggaactgcgcatcggccgaatttgccgaagcagctgcgtgcagggaaggaatatggcttgcaaatgagtgggtcaaggagccatgcattctagaaacggattgtgccggtgttgatagctatctgaggttggcagcggctaataggtcccagatttggccactaatcagggaagtgagagcgggtatgcgtgctgctcctgaagctcgtacggctctgattcgcaggggtgctaataaggtggctcatgagcttgctcagctagccattcggaatagggaggcagtggtcttgcgcctgcaggcgccggtgtgtgttgctgagcaactggctcaggattgtaatccttattctgaagtttaataaaacccctgtcttcccccgcaaaaaaaaaattatgatgtttccgtcgtccgtctaacttaaaaaaaagagagatcctaaaaagaaaaacgtggcaacaaaaaaacaaaagcgaatcggaggcggaaaaaaaatctcctccccatctcccgagatctttttttctttttatttctaaaaaaataaataaacaatctaaattcctaatcacaaaagggaacagatctaatctctaatccctaacttctgttatctatctatctatctatctatctatctacttattaaaaaaaatagcgaaaaataaataaataaagtccgactcctaccaattccctctcagaaagggaaaaacaagtcccactatagatccaattcacccttaaaaacaaaaaataaaattgatgtgtcggattgaagatctgtttgcaaaaacggaacctatcggtcgagagcattttatttttatatgattttaaattttgagtctgtacttttgtatttgagtccctataatttttatatttatatctaagtccctataatcttgcaataagatacttaaggtcgttttttattaaaaaaataaaagggaaagaacaaaggcagaaagctgcataaaaagaaaaagaaaaaccgcacaaaaaaaagaaaataaagaaaaagaaagaaaaacaacaacaacaaaactccgtttctcctaagtggcaaaaaaaaccgtagatccaattcctataaaaggcaaaaaaatggtgaaaaaaaagcgagatctgatacctttaaaaaaaagttcgattcctataaaggcgaaaaatttttgaaaaaacatctaaaaaagttcgtcccattctctaagaagaaaaaaatggttcatgtaaaataaaaaatatgcgcgagaaaaaaaaatggaaagggagaaacaaattccgatttctaatcagtatatatctcttcgctatgtctaatctaatctaactatttaaaaagagaaaatgcacaacaaaataaaaacggttcaaagaaacgtgtgagaaaagtcagaaaaaaacgcaaaaaaaacacgctaaacaggttttctatcttccataaaaaataaataaacgcgcgagaaaaattatttccatcgtcggtaaaaaaatttaaaaaaacatgcgatgaaaaaactatcagaaaaaacacgccatttctaaaaaatggtttgaaaaaaccgtgccaaaaaaaaacatcgtctattaaaaaaacaaatcagtccgaaaaatctgtcagaaaaaacgctaaattgatggacgcttgagccgggtaggatccatcgattttttgtcatctactacacgtcttttatttcgtcatatattttcctgtattggaaaaggcaaaaaagaacattcgaaaaaaacaagcaaaaaacgcgcgtgagaaaataattgtcagaaaaaacataaaaaaacacacgaaaaaagaaaagcaaaaaaagagaaaaatatggttttcgtcgccagtaaaaaaaagcaaaaagaacatgctaggaaaaaaattgttagaaaaaaatacgccatttttgaaaaatggtttgagaaaatcgcgcaagaaaaaaaatacatcgtttataaaaaaacatgtcgctcattaaaatataaatattgtcattgacatgattatgcatgaaaaagtatattatcgttagaatttttttcacccgttgcaacacacgagcatttttgctagtaacaacaataagattgaattagcattcaccagttgcaacacacagtcatataatactctaggttgcttgttattatattttcctctttcttgctttaaatattttttttcttttacactatttatccaatttgtaatatgattgtaccattatattcgttgtaattaaatctttacaataaaatatcatataattatattctaataaaagaaaaacatgtgtttcaagggactattgagttaggcagcctaggagatgttgataccatcgagccacaatcatagtttctgtttgggttaaagcaaaactgcaaaaccttatcgaataggatttttgctggtttgtttattaccagaattaggctgctgaaacattccttgccaactataaattggaggaccataggaagctttctgtcataagctgagaaaaacaatagacgagtgacgatggcgttcaaagcattcttcattattttagtggtttttgttagcagccttgcatctcctgcagtagcaagagatggacctacgatcaacccaacgatgggtaccaggggcgggcccactattgattcaagggtattcagacgtatacccaagatttttagacaaaaaaaataagtatatgtactctatacctcgtatatgtattcaagaaattaaagaaaaaggctaaaactactcattttgggccctgtttcatcgtttcttctctattgggcctaaatttcccacttccctcccctttcatctcagcccacaatcagtttgggccacaactagttcatttcccctcctcgcctaggcacagcaaaccaaagccctaattcccaaatcggccaaaccctaaccagaggaccgaggacgtgcgcggtgtggcggcgaggacgtgcggcagtgcggcggcggcgacttcctgctgcgtcggcggaaggcggcgccaaggcgggtaggagcctaggcagcgcgtcgggcggcggcgactgcagtctagtctgcagcgtgctcgtcggcggctgcggcagaggcttccggctgcggcgtgcgcggctgcgtcggcggcaggaggcgccgaggcgtgcaggcggcgcgtcgacggctgcggccgtgcggcgttggggctcggccaggcgtgcaggccgccagtccaccaggccaccacacaggtacgcgatgcggcagccgaacgaccacggcttgccggcctggcatggattgcgtgaggggcttgattcattgattcattgcattgatttgttctaggtagttcaatagtagttatgttttccggtggcgacggcttgtttcattgatttgttctatagtagttcaatagttcactagcaccgaaggattcaacttcctcagttcctgtcttctttatttttcagagtgttaactgttaagtgtatatttattgacagattgatagtataaagctgtaaatattaggaatttagataacttagaaccataatatttaattttcagtgtgttaaatttatatatatgatgatagtatgaggctatatatgagctgttgttaggaatttagagaatttagagagggtgttttcttcgatgaactatataaaaacaagaagcaagatgagcaacaatctacatttattggaagagaattttttgtacaagttaaaggatgaggacatcatcactcatttttaaaatatcaagcattgaaaagttctcctctaaattgtaagtttttttttatcattttaccattttctatcctttacatgttatatatgttgccactttcatatgtcgaacaattagtacttatatatgttaaagaatttggacttatgatcaattctatcaatttataaagttatggccatatgctataatattatacaattagtaatgtgtaatattataccaattaattattggacttctagaagtaaaaagaattttgttttacccctacctatttcgaatacccaacctctaaatcctgggcccgccactgatgggtaccgctgtactccaatctgctgacgttcaaggtttgctctatactaacctgtttctcagcttctggttctcagcaaaattcagtttatattactatttccgaatctcatgcaaagaactgcattttcccttatccagcgtctgcactgcccactcctgctccagttggccgagaggagctgatctatgctgcgatacgggcattcccgcgcccaccacgcctaccaccaaattgacttgccgtagtgatactgatgaaaggagatcagataaatatactagtaatgagtttgtgtaccggtgcttgatgctaatagaaatcctgtgatatgagcatgttgaataaactctcttcctgtaaagagggttaactaagtgcgtgattgtttcagatttgtttgggttgcggtttatacgttgaaaacacatgattaaagtaaaaaaaaacatacgagtaattcttagtgttctatcccttcttaaaaaaattcttagtgttctataaggttaaatgacaaaaaagacggaaaatcccctctaaagtgattctaaaatttaaaattgggtacatcaacacaggcaaaccatatcttcaaggcaaatcgacccaatccaatgaagttaagttttgaaactttttttatccattaaaaatttgtgtttccgcttgagttggacgagatgaaattctaatatacggttctccgagggggtttcgggtcagttacctatctcaataaaatatatgattggtccaaccaacatactgagattcagacaattgcaaatgatataactagtaatatgttcctccttatgtcaacctaatttattgctagtacaaattgctactggctttgctatgatcttttgctatcgcccaaccgttatagaggccaactttacttggttaatccgatcaaaattgtctagcattattgttaaatatttcagaggacaaatattatgtgattgtagtgtcttgatcgatagttcggtacaatacatcgtgtccaccccccatccaggatccagcatcgagtttgccacatagtcctaatttcgcaattagattatttgcgtgcaattgggatatttagttaaattaatctactaatataaaaataccagttcattaaatatcttttctaacccttagtctgtatatccaacagctcatatcaaggtttggatctgtccgttctaccacctctaaacagcggttaccgatcggtcaaagtaacaaaaaaaaacaatttttcctttcctgcgccagcccgccgccgctcttctcttcctcgcgcgcaccagcccgccgccgccagccctctgccgtctccgaccgccggacagccgccggctcagggcgcgcgcccgccgccaaccctccgccgcctccgactacaggacagccgggcgccgccgccggcttaggcgcactccctaccccgctgccagccctccgtctccgcttaccgcctgagcctcctcgccggtgaccctgcttccctgtaagaatggatatgaagtttgacaagtttgacagctagccagccctccgctcgtcggtgaccctgcttccctgctctctacgcgactgagaggaaggagaggcgaggtctgctcgcgccggcactgcgctttcaggtccgtcccgccctcgccgcctcgccctacggtgagcacagtgctgacttctttgttcgcacaaattcatccatctatgtcagtccatgctcagttggtcacattcaagattaacgcaaacaccgaactccaattagcttccttaactgatcgacatagaatgaatcaagacagtcactttcagtaaattggtatgtctggaggttatttcagtttctgacttacatgctttatgttatttcagacggtgatttacatggtatatgctctatgctatttcagtgtctgactttcacagtgctacaaccgtaagcaaccatgaggcggcatcttaatacagtgaaaaacaatgcgaacgccacagcagaattttcaacacagtcaagtatgttctttctgaagttttatcttcactatcttgctataattaatatttttctggccacaacacatttttatcacataatggtttgattttacttttccatgccacatgttttaggaagaggcgcactgcataatcaaacttaactgctgccgaggttaggagaaagcatgaaagggagaggtatgcttcactctctacagaacagaaacaagctaggcttcaaaagaactgtaagtataaacaacgtaagaaggaggcgactacatctctatcaggttgcatagatcccattgggtccaaacttaaccatgagaaaaaaaaaattcaccatgacatgtgaattatgtactcccaaaataagagtacatgtctgtgtaggttcacaaattatgaagggtgcccataagagatatcacaaattatgctggctttggtgctacccaagcctgttcaggaaccgtgatactgaatggtaacatgtttgttcctaaaatttctggagatatacatttataggcatcatgtttatttagaacaaagagagttatgcctcctatgatgctgcccaaaagaaatcatgttgacaaaccacatggccatagatcactacttatggtaaatgatgcattttcagattggttggaggcttggagctgtctatttcccttcatttcagccttcctgataaaaatgcatgccgcctacgttaatttctactgtgcagtgacaaagctttgatttgagacactattgtaggtagcaattcacgtgatgcattgcattacttttttttttttactgatgaacacatagctctattgtgcttatattcttctctgttggagcaggccttctatgggtcttggatgtgctcatcaactgttttgatcagtgaaggggatgctgttagtgatggagttagaacaagacataaaggtaatgatcaagttaatcggtgttttccttgcattttcaatatacacaatttcattccctgcaattatattcacgttttaagattggttttctcatctactcctaatcattgaactttttttttatgaaactaacttggttttgtgctgcacattttctgttttttgcaatccacgaagctgttacatgttcaaaacaaaattatagatggtcctgtacaaatttgaatgcttggaattagtgaatatagtactgtaaaaattatgccacccagctaaattcagtgacaattggaattaattttgcatgcataatctattttgattgatttattcgatatatgaatttgttctaggagcctatataaatgtgtggtgtgaaatatgaatctcttactgttcaacatgtactttgatagtccaaacttgattttattacaaatgcaggccggtttaacagaccacgctgttttttttaacatttcaatgtatgggctgtatttgctatgaattgagcacttctgttggttgcttgcaatgcatttgtagtttcctgccaaccaatgctttttgtcatcctcagtaactgtccatgctgctacacactggataagcaactgaaaatcaatatttttgttttcttatatttaagatcagtgtgtttatttcttcacataagggctactgccaattctttggtagacaacagatttcgcacaggaaatactccaatcttatgtcaattgctattttgcaggcaagcatgaagcatctatggtgcttgagacctactttcttattacatcacccaattttgcttgaacaagaggcatgcaaaacatttgaaggtagtcgacataattttattcagagtaaatttcacagaactacatatattttgaacaaatactttgctttgggccatatgagttggacaaattatggaaggactatagcacacactgcaagaatctattgttcctttagatatctttgttcattgcattagtagctatataacttgtgcgattatttgtgaacaggatggatcatgatcaaaggcagagggtgagctgcgccatgggtcgtgaatcaccgttgctatcgcctccaacttgtcgctggagccacgcgcccagcagctagagccaagatgaattcctgagagagtatatatatatcgacgtgcaagatgtgctttgcacgtgcacgctcactagtaaacataaaaatcaagtttgtcctcgcacgttgtcgcagggaccagaaagcaatgttacaaaactgcatgaacttgagatgacaatgagcccccagaacaacaaacaaagtaaaacaaacaaatatagctagtaatgtaaatacctgcatgccagagaagataaatctttagtatgacaattagcaagtttagtaaaatttatatctcattgaccttgagaagtccaactggaccgatgaaccaagcgcttggctggttcggtgcccggtctggcttttcttcctgccagtaatcgtccacgtgcaatgcacgtaaaaatcagtatatgaattaaattggacaaattgcttaaattaaacttgccaaactgcaagggagaacatttttattatttaaaaaaccataatgatggtagtacaattagattttatacgtagactgttgtaagcaatttttttccaaataaatcaaatttaaattcttggattcattatggcacacaattttgttcttcttagtacaattctgatgtacatcaaatgctcaatatttttgtttgagagtactaccactgaatacacatgcaccactatatccttcgatcaagaacacgtacaatagagattacttgacaatttcccgtaaataaggacttcactggttagaaactgattgaaagatgaagaataaacataatatagcataattaaataacatagtataattaaattgaagtataattgtgtcttatgttttctgaattacctattcttgatgtggatacccaatctatctggggagcacatggagaagcagacaattgtgccggctcacgtctgcacggagcccagcattgagggcttgggcgtctgtaaatgttggcatagataaacaaaaatcatgaggcaataaagaatcccatatgctgtatttggtggtttctatgcaagaggtgtaaataattgatctacacaaataattgatctagaatagaataattgttataaatacatataaacaaaaactaagaagataaaaactgctccaccttctgtagcaaaacaaagaagtgatacatatattctgtagcacgatatcctaaaggaaaaggttctcaatttagacgatatcctaaagatatcctaaaggaaaaggttctcaatttagacgatatcctaaaggaaaaggttctcaaattagcttgtgaaaggttctcaatttagcttgtgagccccatctttttacaggcaccatctccacacacaaagtttgcaccaatcagttggcatctccctaattctcataatcaatgttttatttaagaacgagtggcacattcttggaagtttttattaccaatcagtgatgaccaaacaacttccactcgtcgattttgactgtttcaggagaagatgtcgggaagcaagaatgtgccgaggtcataggtttttctttttggttgaatgttctctttgatgaggtttgaatctaagggctcttgtatctttttagttgtgtatatccttcgtgaatatagaggccgtattaatgaaaatccattatgtaacacaaaggtttaggagtttaaaaaaaattagaaattgagaaaaatgattgatgatgatgaatgatgtcatagcaagagccgggcctaacctcaaacagagaccgctccaagacatcggcacgtgttcgcacgcatggtagagaaacaacagacggcgacacgtcaccaccacggcattatcccacgcttcgctccgcacgaaaccttttatatgctcctaaaaaaagaaagaaaagtataaaaagaaaacacaccccgctgcggctaacccagatgagatcgcctgcctgacatttgagcccacagagttcctggacccacctgtcggtcacaaagctatcccaatcaaagccccctttgtcgtagcatacagggggtcgaacagtgctccgcgggataaactaaccttccacgtcacgcaacaagacccgatgagacacccggcacgtgggccatgatctcccagcatggcccacatgtcatgctcacatccacgcggccggtgtattccgcggaccaggttattccccactttaattttttctttccacacgatgcggctacggaaataggtgggcccaaaccgcccaagcccccctccttcctttggcttcgccgtctccgtccccgttcgctgtgcgccatcgtcgccttccctccggatttcttcagccttccgcgcctcgccctcgccctcgcgcttcgccgaagcttccagaagacgccgtggcgccccgaatccgcggctcccgttcgcgaatcggcgggcgataatgctgcaggagttcgtcgacaacgtcatcgccgtcatcaaggagtgagcacacccacccatccgcccctctctctcccctcgatccctacctccccgcggtggggggcttgcttacttcgttttgtttgcgggtgttttgatgaatggttggctagggtgcggaggatcggcgagccgaggtgggtcatgggtcatgggtgggggtggcgcgttagggggagtggtcggtgcctcggtagggtaggatttcatgctagggattttggattgagcgctgaggttagatgtcggggatttttatagctcattcatctctccagaatagccatgaaacgagaatttgttggattaggttcaatgtcaaaatgttaaacgaggagatgctgagaggagggaggggagggtaaggggtgggcagaaaaatatggcgtcgctattggctaagcactaattttttagtagtagtaccatgataccttgtgtgtagaattgtgaattactgaattatgccggctgcacaaaggtcccagtttgaaacagattattaaacggattatgtacttgattgtagggataaattaaatatttttagaaataaacttaataagtaccgtacaacaagtggtgtaagaatgcattagaagaaagtttcttttgaaaattaaaggtatttttagagacatggagcaaataatccaccatataacttgatgaagtagctgaaaaagaacagggcctaagatcactgagatttcagttaataaggatctcaatgacatggggccatttcgcttgacaccgttgttaagtgtgaacttcctactcaacaccgctttgccccatcgttggctgctatgctgtttgttaacctcttcttggtctcacacataagtatggatgtggaatttgaaccataaagaccagttctggccttgtttttttttaatctttctttgtagatgattccaagagctgaaagccttggacaaatatgggctgattgctgacttgtaccttagaatgcaaatttctgacattttgtctatgagtgtcccaggctttctaagttgttcttttttcaatgtagtatttatgtctttgctaagtgcatttgtggtctggggtttacttgcttgtacttgtttatggatagttttcatgcttcaataaaaaaacaaaaaccatgcatgctatctctactgtgaagtttataagatgccagttaagttgctcttattttagcctttctgtatgaatgagatgcactattgaattcttgcatttgtttggccagatctgtgaagacattcacatatgaatcactgaacaatattgcaaggttgataaatggaatatcagcactcctgttgactctattaccagggaaggccaacatgttagaaggcatcagtggctgggaacttagaccatcattccgtggcccacgtcttcctcgttggatggaaaggttatcttattttcattgacttaattatgctagatatttacaacttgtgatattaattgcactcctgtctcctgccatttttttctctgtggttttggacacaagttggtaactcactatttttttccccatctacaagcaacaaatccacgcagtttatttttgtccctgcaaaaccttcatagctttttctacaaagcaatttctcagtcgtgcatttgtaggcctatataatactccctcaattccaaaatataaggcataaccacccctaacccaaagaccaagaaaataattattatcatcttgtagtttggatcatcctaataaatacaatgcatgtatccaatagaattagagaatatgagagtggaggatttaaaaaagtaataatttaatgtagaaggggtcatagttaattgcctacatgcatgcatgccttatattatggagcatcttcaaaaagtggttgtgccttatattatggaatggagggagtagctttttggcatggttaaggaatgttctattgtaaccgaggaggacaagatagtgagtgatcattaacatgaagtgaattcaataatcttgaatttctgtatgtgctgcttgccattttgcatttggtttgtgccaatgtatgcttaggaggggctctgcccaatgaaagcttctctttgtttgctggaaaaatgtgataagtaccaatgggtctttagaattttgaataaaatttgtaccataatatgtaatgactgaacaatatggaccggattattttcacctgcatgagatcttacgcctaccattttagctttatgaagttttgttttgtattattaatattatgacttatgtatggttaatgtaacagattccacatctatttctgtgatgaaaatttttctctctctttctgatgactacacttatttgttctgatatcagtggggtttcatcgttcaatgagtttattcatgaactctctgtcgattctgatggtgaatcagttactgactcgatccctggggatgatgaaaacgaagattttatatgtccttcatctccattgtcccaaagttcacgattatcacatacaagcagtttcagtaggcgtgatcgccgcttgagaagacctattagatatgcaatttcatggattctttggcctgccagatttcttgtctctttgctggtgattctgttcaacgctatcaaatttcggatcatgcagacatctaataaacccccagaaagtccccatatttctaggaacttccgttctaggagagggcttcacattaaggatcaagttctccaacgaacaactgacaggaggcgtggagttgttgaggtactacttttataaaagtggacccttagtttgtctatcttatggcatgacaaagttgtgattattgtttaacctatttccctgaagaaattcatttagtggtttctatgtccacttagtcacaccctgatctctttttttttctttcaaatttaggacctccatcttgcaattgagattttcatcgaatcagtgtttgacattgttcataaaggcgcgcattatgttctttctccttctgaggtgtggaagaaattattttgctggattcatggcagcagtagccctgttgttgatgtaccaacagctaatgttggcagtgacaatccagccccaactgaaaggaagactatatatcgccatcctttgaacacggattctcggacatgtgaagatgttatcactgagcttgggtaggtgatcgacctatatgttagtatggtttagtaatagaatcgtaaacatgtatgtatattgttcaaacttaatggatgcataatcctgaatgagcatttttagcattttaaggtgttttagtactgtttactcagttgcatttgccacaaatttgtgggtatgtcctttccagtgattttctgcttttcgttatatttgctttgtgtcaaattgttgctaagggcttgcgttggtgttattctaatagatctagttatccttgacgcttgagctatgcttgaatttcaagatgtgttacccattattttttaggttttatcagtcaagtgcgtaatttttctcgtgtcaaatgaatctggaccatgttttggttaatgtgcgaattcctataattgtttatgaatctagagtcttgtacgatctctattttctgttcagtcagttcggtttattttgcattaaatccttttgcatcagtgttcattgtcaaattgttaatctcatcacatctttttcaggtacccttttgaggctataaaagttgttacttcagatggatatgtcctactgctggagagaattccaaggtatgaattataattattgcatgttaatatatttctcaacagttgtgttacggagattgagatatgaagcatccaatttttaggcgtgattcacagaaggtggtattgctgcaacatggaatactggactcatcaatggggtgagtcacaatcaaatgcttagtcatgatggcgtttctaatttcttacatgtttggtgttggttctttat

SEQ ID NO: 59017 - DNA, 834 bp, Oryza sativa
tccgggtatccgcggatacctggcccaatgggcatgggcatgggtgtaatattttgcttgtgggcatgcccacccgagacccgacaatgtggtgggtagcagcagggtctcattttttacccgcgggtaacccatgtccaacccggtatatgtattattgattttggcacataccttcattctcattccccttccttttggcccatttggcccattagcaatggacatatgtatagccaagtttcagggaaaccaaccacatgttgcacgccactagccagcttccaccaggcggtaaccccaccacccaccggcccccgaaacccaactcctctctctctctctctctctctctctgtgtgtgtgtgtgtgtctctctcatcaccgccaacgcgtcaacgcgtcaagcagagagggagaagcgaagcgaggtgagcggaaacgcggccagctgctgtggcagcaaaagcgagaggcaaagtagatgaagccaaagcaagtcatggattagggggagagagagaagggaagcgcggcgaggaggtggaggaggccggaggcgggcgatggcgaggcaaggtgtcgtcggcggtggcggctgcgagattatgcatgctggtagcggcagcggcatcattatcaagtcgacgaccacgccggcggtgagcccctaccaggtgagaccgtgagaccagcgcagtgcctcccgtttcccccctccttccctcgcttggtgtgctcacgctgtgtagtcaatggtttgcttgttgctggcttttggttgctgagtcctagcgtgactacgtgactcctaccgccctcatctctctatcg

SEQ ID NO: 59018 - DNA, 11478 bp, Oryza sativa
cagttatattagttccttaaagaactttgacatcaaagcgctaatgtttgtttataatcgaatgatcaattcacacatacaaaagtatgagcacactatgttactgtgttgttgaagatcgtactgttaatgtttttcagtaaaatgaaaatatgcagtagtggttagtcaaataaacttcaaatagttttgtatctatccagtttctatgtagtttatctgaagcatacagtttggtttcccctgattccatgtcgtttctcttgcagttgggtatcgaatggtgttgttggctcacctgcatttgcagcatatgatcaaggtcagtatttaaaactggatataatatactgcagatgtatggagtgaatgctaaaaatcctttatgggtgaatgcaggttatgatgtttttcttggaaatctgcgtggtttagtctccagggagcatgttgataaaaatatttcttcctacaagtaagtaatgcagtaatactagcaaagcatatcaggttttttactgcatgcaggaaatctattgtaggttatgtcattttggtctctgtatttttttcatgtcttatttgtttttgtctatccatgctaggtactggaaatattctgttaatgaacatggaaccaaagatatgccagcaattgttgaagaaattcacaagattaaaacttcagaacttggcaaaagtagacctcacataagtgaggaaacagaagatcaaaacgataagataaaaaatttggaagtgcaggcttcacaggacgatgaaagagacaatcaaccatacaagctttgtgctgtctgccacagcttgggtggtgcggtgatgttaatgtatgtggtgacatcaaggattgcgcagaagccccacaggttatcaagattggtcttgctatctcctgctggctttcatgaggattctaatgtggtgttcagcatggtagaaaagctcattttgtttgttggaccagtactagctccatttatacctggcctttacataccaacacgtttcttccggatgctactgaacaaattggccagggatttcaacaactatccagctttgggcggccttgtccaaactcttatgggctatgtagttggcggtgacagttcaaattgggtgggagtgctcgggttgccacactacaacatggatgacatgcctggtgtatcattccatgttgcacttcaccttgcacaaataaagagggcaaaaaggttccaaatgtatgactatggaagtccagtagcaaatatggaagcatatggaacaccagaacccttggacctgggagctcattatggtctgattgacatcccagtagatttagtcgctgggcaaagagacagagttatctcaccatccatggtaaagaagcactataagctgatgcgcaaggctggtgtagaggtttcctacaatgaattcgagtacgcccacttggatttcacattctcccatagggaggagcttttgtcctatgttatgtcccgcctgctcttagtgtctgacccaggtaaaggccgcatcaagcagactagtgtccgccttagaaagctgaagaaagctcagtcagaaattgagaatgactctgacagcaaggagcacaatggcatagataatgtggttacagatgagcaaaatgggcatgtgcatgctgcgtgatgtgatcatgtggaatatgctgaacatttgttgttagtttgtgaatagaacacgtgctgcctctggcatataccttctgcaacatgtagaagatgtgaggatggatagagcccagttctttctagcagtagttgtgttgatggggattgttttttatgtatccctgtaggagaacaagacaagtatatgtaatacatgaatagtggctatagtgttgttcatatatatcaagaactgacagggagaagctaccggtgttaaggatgtagatttttgcacttaacgcgtgctttcgtgtgttcgcgttttgtttttgctcttcctgtgaagaagtgatcgaaatgcaagtttcttagcagtcatttgtaagcttgctgggtaattacttagtattagtcaccggggaatttcataaactgagctacagaaaggctctgtttaggattgatgagattgatttggagttttgaactgctgaacttaatatcgttaaattgaacaacttcatactctttccgtttcacaatgtaagttattctaccatttctcacattcataatgtctagattcattaacatcaatatgaatgtgagaaatgctagaatgacttacaatgtgaaacggaggaattagcatttttgtaacgtactctttcttataacttaatctattttttcaagaggagagaatattgagaaaatatggctttcatggcttcttgggagaagataaataataagatgctatagcttcaagcgaaaacagtttgtgatatagatcaatcattcaactagaaatatttagaattatatagctttatagaaaaaagagggaaatattattaactatacattaaaaaaatcgaggataaactcctgcaggatcttaaacctcctgatttgctctgtaatattaactttttacaagaatttttggggcatgggaaactacgaagcaagtggctgcaaccatacaccgtcatcgacacttcatcgcatagagcggttacgctatggacaacgaaggtaacagttttaaagtaaatggtcatcgtttaaaagattttctagaatcggtagaaagcctacggcaagaaatagacttggacatttacttcagtgcctataccggagcccaacctgagatttctacgctagggtccagcctagcaccccacctgagtcgggaggcattgggctgcaccaccagtatccggccttcgcccattatggcctgctggtggcactctttctaaaccctatggatccacagagataggcacagcagtagccgaatggagatccgctcatatacagattgtcttgcctacccatggacaaattgtcgctagcagtgacgctaggtgatgagccagcaagatgaggtgccgaagccgatgaagtccaaagcctggtcatgggctggaagaaattggtgtcggtggtgtcatccaatatcggtggctcgacctcagcagatgaagcaaccgaaggaggtcacagatactcgacacccaaggaggacagagctaccatggtggagagtccttgtagaagcaaatcaaaagacgaggcagcctggggaatagtcgtaaaggaaaacatctgcttggcatggccgacgtcgtggagagcatcagcatccgttttcaccttgtggcaatactcgacgattggtagatcgccctaggtcatgagtggaactcatggctgaggtagatggcgcggggttgaagcatctaggcccccgttgttaattttggtaattaatgacaagcgctaattgtggactaaccgttgttattgagataatattttaagttaggtccacgtcatgtgtgcgcatagatgactatcgatggatcaaaatttgatggtgcgaagcgaagaaaagaaaacggtaaaactagttttttagttttaaaattgatcgaggtgtagggcgatcaaatttgctagtttattttttagtttcgccgtactattaagaggggtaatgatctagcaaagagatgattttaattgccacattaggtcattatgcatttagacttgtgctcgcttttcatcacacacacacaatcacttgggatttcactggtttcggcatgaccagggacagtcagaccggccacatagtggcggtctgaccggcgtgccctggccggtctgaccggccgaaagacggcggtctaaccggcgcataaggccagtctgaccggcggcacatgcgcggttagaccggccccctggaggccgggatggtgttgctcggggtggccgatacagagccgacggagccgtattcggtcagaccgagctgaggccggtctgaccgcccactcaatgccggtctgaccggccaggccgatggggccctctgacagcactacaacggctagttttctagccgttgcagagtagcacggtttgaccggccacatacctccggtcagaccagcagagcacaaagttgggggatttcgcccccaacggctagttttggttggtgggagtataaatactccccctccagcagcaagggggctctcttggcacccaattcaattgcatacaccccttgcacctctctcacacccacttgagctttgtgttcatccatctagtgtgttagagggttgattagccaagagtcaagtgcattgcttccatttgtagagttagtgtggcacttgattgatcatctccacgccgggtcatcgcttgttactcttggaggttgccgcctcctagacggcttgtggaggagttgccctgtgacctctccgagaagattgtggaggaggcccgacgccggtttgtgagtggtttggagttcaccaccttcggagtgaaggaagaactaccctagtgatcgaggtttgggtagtcctctccgtgggccggctcctgccttgcccaccccttgacgaagggagcgtgcggtggcttcgtggttgagcggtggagttgggctcgcctcaacggggagtaggaaaccggcgagtttccgaacctcggtgaaaaatctcctgtctccttgtcttatttgattgttgcatttacatttatgcaatttacatttctagagacatacttgagatcatatcaccctaggattgctaaacattgacataggattgtgatttactttcgtagagatataattgagccactatcaccctaggtttgcaaaacataacttagttgcttagttaaagttgaccctcaccaagcctagcaacttaggttaattttaattaggtgtcatttagttttaaatcgcctattcaaccccctctattcaaccaaactttggttatactatcaacttgccaaaaaaaaatttggtattatcaaatttcggaagggttggtttaggcagtaatattctccattcaggttatgcccttccaggcttccagtccccgtaacagacaaattcacaagaagcctttcttccccaaggtagaggtccgtccgaccgtcggagaagatggggaggggcgacgaggcggagaaggaaggcaagcgccgccgcggccgcggccgcagcagcaggagatcccgcgacgcctcctccgaccccgaccccgactccgcctcctccccttccccatcctccgcctcctcccccagccgcagccccgaccgccgcagccgcagccgcagcagcggcagcaagcggaggaaggcctcctcctcgtcacgccggcatcgccaccaccaccacaagagcagcggccggtcccgccgctcgcgcgacgacgacgatgaacggcggcgccggcggaggcggcgggacgaggagcgcgggaggcgcggcggcgatgcgtcggagtcgtcgggatcgggctcggaggagccggatagggcggaggaggcgcgggagatcgtccgcgacatcctcggtgatttccccgccgtcgccggggagctccgtcaggtagggttcgttccctatcgcatttttaaatttccgacgagaatttcctttggagtatgggttaagttgtcgacagacccgtacaattgcatcgcatgaaaattcattgctttgctcgaggcatacctctttttccatgaagagttcctagctgaactgtgtgaagtttcagtgctatttgtccatcttaagcagtcataacagtgaagatgaactggctgaactacatgtctaataactactaggaccaactatggccatattctccattcagttatgccttgttaagtccaatgcaattttcttttttgatatattgccttgtttaagtatctatagccatcaaatacatgaatagggggaatgccattgtcctaccctccaacctactaattacatgtttgattctcatcgtctgttgtcatattggcttggtttgtcctcagttacttgttctaatacgttgtgattactgattagcagatctacttaactcccttaatgcttcttagtatcatgccaaaactagtatatccacacctcttgttgattttgaacatgctaagtcatttgtcttatcagtttatgaatgatatttgtggcactcccagagttccagctatactgttatttcctatcctatggaccgtttctaattgccccatggaatagtacattaataagaatttctattaatttgcagcttcttcaaatgatagataatggtgaaggcattgatatttctggaatttctgacaagccattggtgaagcgcctaaagaaacttttcagatcacttaaactgagagaaagctcaaatggggcttacttgttgccaccaaagagtgtacccacccttgatgttgttggatcagcattagtagctagcggtgaactggctgataatgaaaataaaaatccagcgtcaccaactagacaggaacaaccatcatccaattttgatgtgcaaaataaaaatgatagcactcctgaagagccagcgaaaaatgatgctgatgaacaaccccctaaacggaggtaaattacctgcgttctagaatctatgcgagaaaacaaatggctctttgctgtagcttttcttttcgtcacaattgaaaatattatgtgtttggaaatatttgctatattttgctccattgttctgctagaaaatgttattatttcagatagaattattttttgttccaccattgctctgctataatgtctcatctttataatgttattgatacttgatagtttaaagctaattatagtaggccgcttgttaagaaccaagtattggtatttactaagttagtaatttactaagtggtcttgtcgcagcatgcattccacttgatggtagtgttcaagagcattagtttccttgagaaatagcagtagctctagcatcttttgatgcatagacatttaaatatctagctgctgccctttttcctggcagataatttattagtctccttattcttttcacaatgacagtagatgtgtatagaatattgatatttttacaaatactagccaaatgcccatgctttgctacggattaaaacaaattaatagtgatttttttgggacaattttgtacctgtagatgctatattgtaaggtgaaatatgatagaatcatatatgtagaggggttattttataacattaaagtacatgggctagttggtagagaacattatggagtaggtggtaaataaaaaaaaaatactatacttggtgaggtggtagcagattcactgccaccatcattgccctcttttaaaaagaatatacaattgtgatatatttcacgcagataatttttacctgatttatatatgatttaattcataggtaatgagagaaggttgtgtgttagtctttctatacccaataggtattgaactgtccattgtgcatttatttatttgctccttgtgttaacacttaacaccagaatgacatatcatgcccatattttaggtggtaatgtttaaggcattggcaatatcactgttatcaatagtcattactgatgccacatggttagtaccaaaggattctgacaatttttctacttctggtggatatgccagtgttctttatggctgttattgtctgttccatatgatgattatgcaaatgcatgagttacgtgttagccttattaaccgctggtgtcccagtattctctttcatgctgcttcttagttactagtatcatttttatcctttgcacggatatgttgcttttatggaattccttgtccagtcgatatgatatttagtcggtcttcaatgcggctgaatgttcttagtaaattcctatttgtcattcaaatgtcatccaacacaaaaagatgcttatctattaactcaatttattgtcttaacacaaggttgtgccctctccagggtaattggtcctgctatgccatcacgcgagttactagctgcagctgctgaaatgacagaggctcttagatcccggtacagttttgtgtttatctcttccttattttgccattttgtcaagaactgacagtgcatggacattggcagctatgtgatgccaaaagtaactcagttgatatgcgagaaaattgttaatatagttattcattgtttattctcctaatattaactgattgcattttctttctccagggatgctgaagttgaagctgatgatggttttctcataggccccccaccgcctgccatggtcgctgaagcagcatctgcaaatgaagctgagcgatttgaagaggtacattttcagtgataacacgatgttttgaaccttcacccttagttttggaacacttctacagattcaaaatttaatatactactttagattatcttgtgtggtcttgtttgcttcctgcttcatgtagctgaccaaatatgttttgcagttgtctggaccaataagtgggttcgttcttataggcttttaagttagtagcacatgatatactattattatagtgtggcagtggtttgtgttggcccttcaatcagtgatgtagtcaccattaatagaaattgctagaccaatcttgaccgatttcctgccgggttacaccagcttattggtaatacctgcccttaaccattagaaacaaaaattgccatgagaaccgcactcaagctggttgtggttgctcattgttgcctacttgcctggtatatggcaacacatccagggaatagctagccatattttatggagccattttgagtttatgcctccttttttcaaggtttgaagtgtgagacatatcatatgagcagcaataagcttcagttgaaatcagaatcaaatgcagagttatggagtcttaaatcaaaactggcacaagtccggttttggtttactggccagtaacctgcggggtttccaaaaactggtcctcagtccttaccatctctatgccagagcatttgtttattaatattcaatcagtaatgatcatataatctacttaaatggtgaattatttatacttcattctggtgataatcatgcaacaaattatgctctactcacatggcactatatggtgtttgctacttgaaacatctttgattgaactgcttacgagattttttccggtgtttatgaaactgtaataaacatgcacatgaacgtacatacagtgtttgttaatgtgaattctaactttcttgttaggctatattctgtatgcccattttcgttgtataatactcatttgtcttttggataattgtaattgatgttccattaggttggtcagactccaagccaaaagtacttgtttttgcttgaaagtcgcaatgcaactaactgcttttcattttctgggctacattcaactatttattgtatttttttgaattggttgtaggttactcgaatattggcggcggatgagaactcgccatatgatgttgtgggcatcaattggaagatgtcatctgataacatcaagaaaaggtagtaatttgtatgcatttgcttttcttgtttgcagttgtgtaatttgcgaatgacatgcatacatatacagtatacactgcgaagaaatgcacatatttcataggcctacaaagtagtcactgaaaatatggtacaggtcacaagcacaaatttaaagtacagatatccacacaattgcatagtgcaatgacgttttttatgtctgtagcaagatgcaaatgttgcacattatgctttcaaaaaatgatgtcaaggcttcaagaatatttttgttttagtcatttctggtgaatgcaacacctatcatatcaatattttctacttgtagcattagttcttttgaagatgatttaatacattagattgggcacaaagtccctgtatgcggccttgtaaaatttgtttcagaacagtggtcatgaaatgggcccaacattcagaaagaacggaaaacttatatggagattcaatttctagcagtcttactacttaggtctaatttctgctggcatacagccctgggctacaaagttttcatcgtcctcagtcgggcctcaatcctatgcgctgacatgtttttgactgtaaattgttatatatttcttaatttcagagataagtttcacaaaggtcatcccttctatgtaacgatggggttgtatctcttttcattaagaaatgaatccatgtgtcttttatctctccatcttatcccttcccctagtggtgtgcggtgtgcttgtctccatgcgcgctgtcatgccacttgggtagggtctccttggctatgcctgactgcatgagggccctaacctctaacctgcccagaacaaatttacacatgcagttataccatgcactcaaaatgacctttctgggaataaaactttaagattctcactaaagaacctgatagtagatgcagtttcatgtgaaatagcaccattccattgacctcacatgaaatttgcagtagtgtttcttacacatgaagtaaattgacattgaacctaaggcttcttcttatgtttgtggtgatatattgttttattagcatttttctaattattgtatcttgaggtattcacgtaatatttgtttgctggctgtagctcatgtatcgagggaacagcaaaatttatagtagcatttattacacacaataacttgcagcatagaaatattttataaaggctattgcatacttttattttgtaattcatgtgtaatatatttcatcatgctgcattctgttgttcagaaagtttctttaattgttcttgctgatctcttatcctgcatggcaggtactggaagttatctcttctagtgcatcctgacaaatgtcctcatccttcagctcaggaggcatttgtgaaattgaataatgctttcaaagacttacaggaccctgaaaaggtacttaatttttatatcatacccttcagctttatcatcctgtgaagatctcatttgtgaagttgtacaaagtactccactcttatatggaggagcaatagtaaagtagatgtttcaactactagggtatatgatatctgttaaatgaatttctgcatgcaagttgtggaattgtccttagatagttttggggtaaatagtgccaagagatgactgggtggtaactggtaatgacctctgatatgagtagagactagagatgagaattaacttgtttactgtttctttgcttgaaatttaatgcatgcagaaaatattgtaccgtgtcctgattctgaaccatacaaaatattaacttgcttattactagagactagagatgagaattgcaatccatgcatgtactgtgtcctgattctaaactac

SEQ ID NO: 59019 - DNA, 922 bp, Oryza sativa
ttattacatacctattgccttttgttctatagaaaccaagttcttgttaatataccagttggtacttttactgtttttcttttttaagaagttattacactagttcaccatgtcaggaaatttctttacactgatgtttctctggattattccctttgttccagagaggtgtgatagatgagaagataaaaaagaaagaggagatggaacaatttgaggtaaactcatttgcatcatatattgatgtacatagagcaccttttcttgttgaactaagatttcagatactgctgtcagctgcatgaaaaatagttgttacctttccttttttttcatctgtaggtcgagcttaaagcaatgcgcgaggccgcagaatggaggcggctacaaggtaagtttgtgcagcgtctagttatcaacaaaaacaccaaaagccataaacacagaaaaaatacatgtatttttaggcttttagcaagaagattaactattccattttctttatggggcatacattattgggcgtgaagaaccaaatgtactgctccaaatatgaatccctataatgggccattgacaacacttatgtctaatttttaattatagggtataattgattatagctttgttgtaaggtttagattatagggctgagaaaattctagatatccttctaactgttcattcctctttgataatcttgtgaacttcactgatgttggactgttggtcttccgtggtttgatttgatacatgcagttattgagggcctatacactttcataacccgtaattttttgtgaggtcctagccgtctggtcatcatcttctgtttgttcagcatttgagtatttgatttttgcaatttaaagagttgaatattgttgtagactgggttatagggtaagggtccaaagagggg

SEQ ID NO: 59020 - DNA, 711 bp, Oryza sativa
atcatccacagtatcttcaattccatgtgccagcattcttatctcttccacccagatttcatacgtctcattattgcgattgcgtacatccattcgagaaaggaattgatgtatcagcctgagctccctctgatgcggcccatgcttccttgaagctctgttatctgcgaaacaaactttttgaattttgaagtagcttggttgattgcttcatttcccaaggcaacacaaatcttcttcacagctaaaagaatcacggcttcagccattaatttctctgcacaaaactttggggacagccagattccgccccaggtatagcttgagtatataatttttcaaatatttttttatgcagtataacctgaaatataaaggattgtcataagtgctacacttgaatgccagacctatcaaattcagtggtagacaggaattggattttttatgtgagaagagggcctggaatctcggtaaaagaaatattcaaacgattctgcaattgaaataagaaattttagcttcaaataagaaattacctttttggcgttttccttgggctcatcactgcatatgaaaatgaagcaatgatacataggaaaaagatactttttagaaattcaagcaaaatgagtttacatctaatttacaaattcggtaaagttcagttttaaagctgatttatgttgacatacctgctattaatctgac

SEQ ID NO: 59021 - DNA, 1005 bp, Oryza sativa
atcttcccacgggattaaacaaaatatgatacccttggagtactctcgggtgaacttctacaatcgtatatccggcgcttgcggatgaactctgtaaccataatataccaaaagtatttctgcgccattgctaggaattatacgggcttaatcttaggcccgtcatggatgatgtcatctctatcggtcattataagcccgttacggatgagtatattaccaaaaaaaaacaaaatttgttttttttgctagcctcaggcctttgctagccatgctcatcttcatcttcctgattttgtgcaccacttctgtctgtagctgcgccacttcctgattcttgctctccatgcttcactcaacatgtgtagccctccataaatcctcgttatatcagatgggcgtgtacatccactctactatcaaacatattttcattcttgcaatctgcacatggacaacacatgtaatcgttgtttcttcttttccaatcctcctccgtggcatttataaaatttaatgcgccatttctatactccttgctatgatgttttacagttttcccatacatccaactttgatccatcgctgcaaaaatgaacaaaatattagagaaaaatcttgtaaaataagtattactaatttaatgataattgattagtatttttcacttacttttatgaattttctgtttttcttggaaaaaagacacaaaaattcatccccttcaacctcccaccaaaatagtgaatagtgggataactacagagaatagtggggtggagtatttgaagtgtgacatagatatcggtaacggccaatgaacggacatcggtggcgggttcttcgttatctcaatcgggcatattattaagcttgtcaccgataaaagacataggtgacgggccatagattaatctcaatcgagcctagtttagcgcccatcgctgatgtgtctcctccgtgatgggcttacatcttgggcttgacaaagattatagaggtaat

SEQ ID NO: 59022 - DNA, 1163 bp, Oryza sativa
gcaaaattagttgaggggaaatattcctcttatcctcctctatctttacccccaagaatcggagcaaactgttgagtattttatccgaatcgaactcgtttttgagtttatctccaaaaccgagtttttgatttcccggatcgatttattgcgggaggagtccgatctcttcaatccaaggctataaataggaccccctagtcctcctctttcgttttccctctttcccgtgctctctcgtgctccgtagcctcgtcgccgcgtcgcgcaagccgccgacgtcgccggtcaacgtgcagccgcgctgcgccgtcgccctagccgtcgccgctgcctcctctcgccgccggcgggtgcgcgtgaccgagggctagcccggccgccccttcccggtcgtcgccggccaccggagcccctccgccgccggtcaaccgagccgccgccgtcgcccctctcgtcgccggtcgtcgtccgacgtcgtttgtcgttgtggtgagtaccgttgggttcgtctcgtcgtcctctacgtgtacatgccctcctttttcccggccgaccaccctagctccggcgaggtcgccatccgagccggtcgccatggatgatgtcagcatgacatcatcatcttctccttttccagttttttctaatagattaaatcttcggaaaatcataactaaataactgtagatccgattcgagtggttcaagttgctaaatttttctaaaatcaagatctacatgttaaaaatattcacatgtactgtttatgcttgtttttgtactgttttgttgatttttattctttcgctttagtttccgacgttctgaaggagagcgttttcgttgagcaaggttcggaagtgtttgcggaagctcaaggcaagtcacacagatcccaaacaaccctttgagcatgttgaacccatttaaagctattattttatttcaactatgcattgttttcgaatgtcatcgggtggtgaacctttcccaattaattaatggccgaagatgatcttattttcctatgggttataatttgattagcatgaaccttacatattggattggttcagctaaatgttatatgtatgtttgcttagccatgcttatatttaatataaatataaattatggtgatatttaaatataaactatat

SEQ ID NO: 59023 - DNA, 1397 bp, Oryza sativa
  unsure (1)..(1397): unsure at all n locations
actagtatgccttttaccataaataaatttttatggaagaaattctgtggtgaactttcataagttaatttgtgttttcagaacaaactgagatttattgttagtttgtggagtattaactattgcatcaaatcttgcaatacgtaggctagattttacttttacaatcatttcttggaatatatatttcggacgaaaccgaggagcggccggagtggagagcgatgctgcgatgtcgggggaggagatggcgacgtcagccagtgcaccggcgaggaacagtggacggccagagggttcgggatactggacaccgctccggctttacggtgtatttgagagaagaggaaagaaagattaagaagatacgtaacatgaggcgagatattagagcataattaattgagtattaattatttaaacttaaaaatagattaatatgtttttaaagcaactttgttataacttatttttaaaaatgcacatgctgtttagccgtttagtaagcgtgtgcttgaaaaatgagagtatatcttctttatcattgaaacaaacgaagctatgattaagaggatgatgttataaaaaatatcctactttgatactcccttcgatttcataattcttgacattttaaacactgacatggtctttaaaaatatctttcaccttgtttttttattataatatatctttacctattataaaaatttaaaatgtttttgcctagggatttcatacgtcgcttgtccgattttttttcaccctcgcgcacgattttttccgcaggtgcgtacgtattttcgttagattcctttactaccctacgtagtgtccgtattcctttcctatattgttgagatgtccaggttcgcttttatccaggcctatgtcgctttgcattcaggcccaggcccttgataattccaatatatttacaccaaacagctacaagcgtatccgctttcagtgtttaaaaaacatctcaaggacaaataaactcctatatctatatgtatatttctatctctatctctattattataaaaattgaaaatatttttgttggtacttttgtaagatctctatatctactattataaaaattgaagatgtttttacccgtactttgattagtcatccgtgtttgagtcagttttaatttcttgttttggtttcaatctctaatcctcaaaatccgtaatttaaaaaagggtgaaaaaatcacacgaaaaaagaaaacgcccataaaaatgcgaaagaaaaacagtgaaataagtctgattcataccggaacggaaaaaataggcaaaaatgctaggtaaaaacaannnnnnnnnnnnnnnnnnnnnnnnnnnnnnnnnnnnnnnnnnnnnnnnnnnnnnnnnnnnnnnnnn

SEQ ID NO: 59024 - DNA, 852 bp, Oryza sativa
tttgcattttctgaccagaatgtatagagtcaaaaattcacccctttcgagtttgatccatcgccattagcttcatcagtaaaagcatttgaaagcccaagctctgcattgatctcatcatctgtcttctcttgtggtatagagcaattggcaaatgtcttatcttcgttttccttacaagtcctttgtataaacaagaaaggaaaatgagttgtaatttattaaccattcaacagataaagaaaaaattcaaaatgagtaggcaaacacatctgaaatgacatctacatcaaaaagatcaataatattaaaccaaatggaagaattaaaatatatattttcaatgtagcggagccacatgttggtaataaggttaatctttgccctctcaaacttcacaaacacaggtcatttttcacttttcagtctccaatgcaatattgcccatgtttttcattacaatatagtacatggaaactgtctgttatgaaagtattatgcaagacaaatcccatgacatcacctctcaagtcaaacgatatgcttctacatatatacattaatagtctacatgaatcccgtggaaagtatgagcataaatgaaaaaggcccatgaaatacgaatattttaaggaatggaatgcaatagatatctgtagttacactgtagaattgaacagcctctgtttgcacaggaaatactaatatgaaatattgaacatgggcacatctaacatgcaagaagcacctttcttcctctgggtaactggctggctgctagccaactgccaaaatgatagagcacaaacaaatgcaaaatgtaagatttactctacagattatctaaatata

SEQ ID NO: 59025 - DNA, 716 bp, Oryza sativa
agctcggtacccacttgacttgggccggcttgggctgcacagcacgcgcgcgagggagagagaagaggaaggaatgggccgaaaagggcccaagctgaggaggatgatttttattacttttccaattaaaataatcacttaaatgatctttcaattgttaaaaatacttcctatgctcaaataattccaagaaaaatcttgaaaatacttggacactcaaagtacttaaaaaaattataattagaccatttaatgattaatttaatatgtgggtaattactgaaatgctctttgtatgattaaaattaggaattgagctccgaaaaatccgagaatattccagagagtataattaaccatggagaatttaataaaaattaaatccatccatgctttatatttaggaaattttatttcccacatttaacttcacttgtaaattaatgaacatttaatataaattctgataataatttattaaataatttataaatcctgaaacgaaaatcagggtgtgacaggagccccggggagtgtttttataggcctcggggtgcggcatgaggcaggaaatggcagaaattgccggcgaagtgggggcggcgatgtcggggtggtggtggctgattttagggggacaagtgggaagggcaatggccgcgggatgggcgcgaggtagaggacaggggcggcaaccggcccacgcaagagagagg

SEQ ID NO: 59026 - DNA, 2799 bp, Oryza sativa
  unsure (1)..(2799): unsure at all n locations
nnnnnnnnnnnnnnnnnnnnnnnnnnnnnnnnnnnnnnnnnnnnnnnnnnnnnnnaagcaagatagtgaaattacagctcgaaatggttaaatatttctccaaaatgatttcacgcccgtttggttgccacggcacgggcatctcgtttttttccctgcacaatcgtatcaacgcccgcctttcgtgggggcaccatcaaccgagacacatccttcaaaatgttattgcttgaaaggcgaactaatgttgcaagaacaatgttgtcgccaaaattcaaagaactagctgaagataaccatccacaaatatttacggattatattcacaaaacttcatctgattatttacaggcaatgctgaatgctcatgctgaaaaaatgctggatgtagctcataaaccagcagagcgtgccagctgtgcccaaaaagatttcaagactgccaaactcgtatgtacatgatttccttttctccgcttatatatatttcacggtttaactaaacaaccacaggaataaacatgtgaacgaaaacgttatttcccatgttcatttcttttcatagcaacaatcttcttggtgtagaatatccatcctataacataagacaatgtcctccatcctctatacgccttgggcttagatatcgttgcaatgaagcctttcaatgcagctccaaggtcttgtgtgtcaaaggatacagatggatctgaacaacgatagtaatcttcactgaatgaggggtgactggtgcaatcctcataaaccaaagaatttgagaacttgtccactgtctgtgatacttgcggtggtgcatggccaccaagtgggggtaactctgactgatattgattttcattgttttctgcagtttccaatggacaaggatccaatgcactcgagggatcaattgagaaaatgtcaggtgatggtatgcttgactggctcaaaccaaacccatcggtaaaaacttgtgtagaaaactggtcatagtcattttcatgcaatgacgtagttctcacatcaaggagctgtgaaggatttgccagaagtgtttcattgtcacaggtgaagacattcttccaattttcatacgcttgcttcacagctgcatatgcttcagcctataaagagcaaaagttaaggtaaaaaaaagatggtccatatcctaactggtgaaggggaaatatacaagaaccttctataactaactaagtcgaataaaaaattgtgaataccttctccttttctctaagatcatcagcacaaacaaacttctcagatattaaccctctcacttctccaacaacattgaacacgactgctgttttgcttaggctgtctggatagtacaaatgcaccttgtcagggagaatacaggtttttgaatgctcaacttgtgacctcccacatctttgttgacatgccactgcccaatatctgcataatttgagcataaggtcacatatccacacattttgctgaacggccactatcatctacaaattcaggcaaaaagatagaaatatgacatatgcttactgaggaaaaaactagcttagattagcataacgatgtttaccacagaaaaacaatagattcactcaaatgtaagaaacatacagtttcatggttatacatttctcaacataacaaaataatgctgacaaccataacagtaacttctcaagctggccagtcttcccctacctgattagtccacatggacctacaaaatgctgacacgtggaacaaagagaagatgcagcctacagctagccagctagctacgctctgctttcctggttacaatcctctagatacttccaagctcatagaagtatagtcaataaattaaattaagaacacctcaatccttcggatgatctcaaaagttattacccctagaataaacattcacagagaaacacaaaactacacaaaatttaggaaaaactaggagaaataccataaattggaaaataaataattacatgttatagtggaaaaaaaatagctgtcaaaagaaataatagggccaagactttcttttgagaaaaacaatcaacaattcaagtctagagcccagatgcttttgagcgggtttttgaaactggagctcaaaaaataaatagagaaaacaatggaaaatcaaaatgtaaaaaaacagatctctaaaattgaagctcccaaaaaaaagagagaacacaactggaaatcaaaatatatataaaaaatagagaaccaaactcaaaatcaaaatgtaaaagaaaaagaaagcacccaacggatatcagttgcactgtatcgctctgacgatttccgatgctagatatggtcgattgattatgataattattgaaaatccaacagctcacaaacaaaattttccaatttatgaaagctggtaatttcttactgaacatgcatttttaaataacaagtaggtaacataataaggcatatattactattgtacttcaactctcaaactttgataaaaacaaaattaaagagcgtattatagggttattttcaaatattgttgggattttacaataattaaattaattatgtaaatacttgcaaaatattttgatcatgtcacggctataaattttgaagcacgccaatacgtgctgatgattttctagtttgatgtacatcagtacattatatgtaaatattcgatagaaagaattgcaacaataggcagattgtgtaaactcaaaaaaagaatgcaaaatacaaacatagaaagattcttttatctttgaacaaatgcgagtgatgagctac

SEQ ID NO: 59027 - DNA, 1074 bp, Oryza sativa
taacgtatccagggcagagcagcatatcgatcttagaattagctttcagttcacgcgcatcatacaaaaatggtgaccaacatgacccacgatgactacgtctccctctgcctcatggcgctcgcccaggcgggcgtcgggggtcagtggccggcgcagaaacagcagatcgacatggcaccgccggcaccggaacgcgagcttcttcggttccggtgctccgtctgcggcaaggccttcccgtcgcaccaagcgctcggcgggcacaaggccagccaccgcaagccgcagacgaccgcgttgcccatgcacgtaatcgacgcgccgccgccgccgtcggctgaggacacagcctcgtcgtcgacgacgacaacaacgtcgggcggcggcaggcacaggtgctcggtttgccaccgtaccttcgcgacggggcaggcgctcggagggcacaagaggtgccattactgggacgggctgtcggtggtgtcggtcacggcttcggcgtcaggttccgggtcgtcgagcgtgaggaactttgacctcaacctgaaaccggtgccggagacggtggccgctggcgtcacaaggtggggagaggaggaggaggttcagaaccctttgccgttcaagaagcgccggctgtcaagcccatcattggagcttaatttatagtagcatgttaattcatcgtaattccttactgtccagagattcattcgtttacttttttttcttgttaaaggtatcctttgtgattaattatctcttcgaccgtctttatattcgtgaccaaggaagaaataatttctgaatcatgattgatgaagcatctccattcaagagttaagtttatgatgccccaagttgatattgtcggcagtattaccatatgcttttttctccaatttatatctactagaaaaaatatctatgcgttgcactgggtgaaggttatcttaatcttattattgttatacggtttagctaaagtgaaattcattgtaggaatttgcttggatattgtttttacaatatcatgagctacaattaagagtccgatcgtcttaaattagc

SEQ ID NO: 59028 - DNA, 1097 bp, Oryza sativa
ataatatagcgtctatatatattgagcagattgagtacattaattttagattgaacaaatatacaaagaatcaaatgaatcaacactcctagaaccatatatgtcccttggcgacaatcaatcttggaagatccatggtcaccagcttagcttgttgcatactcgatgacagaaaccaaacaattagtgagttgaaaagaaaaaaaaaatcaaagaatagactctgttcaatagagtcgatcaatgggcagatctcttgtttttacaagatggcgtatgatgaattagttggacatcctgagcttcttgaccggcagtggactctgcacctcctcctcctccgcccacctcttgatcccggcggcggctgtgctctccggcagcggcatcaggttgaggtcgaagttcctgacggccgacgaggcggccgacgcggacgccgagacggagacggacaccgacgtgccgtcccagtagtggcagcgcttgtggccgccgagcgcctgccccgtcgcgaagctcctcctgcagatggtgcaccggtgcgggccagtgctcccggccgctgacgacgccgagtcctccttcgagtcaccagcggatgccagctgctgcgccgcggcggcggcgccgtagtggtctcccggggaaggcggcttccggtggctggacttgtgtccgccgagcgcctggtacgaggcgaaggccttcccgcagacggtgcaccggaagcggagctcctcaggcgccgcgggcgctgggcacagccacttattgcaggcctgcacctgctgctggcctcccactcccaccagggccttccccgcccgcgtgcaggcgagcgcggcgaggcagatggcgaggtactcctccttgttgatcgccggcgtgggcaggcccaaggacagcgccgtcgggtcgagcagcgcttgcagggcggccgtcatatctgtccccgttgccgtcgtcgtaaaacctaattaatcaagctgtatagtacgtagcagcagcagcgagcggtggatgatttgatgggattgattgctaacaagtacagtacgtagctgcagggagatggatggatgatgagctagcct

SEQ ID NO: 59029 - DNA, 1625 bp, Oryza sativa
gaatttagaactggatttgagatttttttcatcgaagtttattttttaatctttgattttagatcgctaaaaacacatatataaaagttttattcacaaattatttttcgtttacaaatataccgtttgacttattcgacgaataagcgaaacgatgagtccgtatcgtgtggaacggtggatgctagactagactactactttttgttttttgcacaagatatgataatacatattccctctgtcctataaaaaacaacatattatcggactaatactatgaatatgaatgtatcatatccaatcctagctagattcatttttctgtggatggagggaattcacaaaagaccaatctagtattgatgagagtttttcttatccaatttgttatactagaaaaagtatcttgttttttcttaggacagaggaattacgccggatgcgccgtatttcaataacgtgaagaaaacgatcctatcaggaagacagcagcgtgcaatgtaccttgctctgtcgatctcatgcaaatcacctgcaatacaccaccactatacaccgcaccatgcaaaggaatgtattgtttccaggtgtctaatctttttttttccacaaaattttctattgcttagaaaagttcggttactcctgtagcttaattatatgcatccataagtacgtacagctggttaaaaaaaatcagcaccctactgaagtgatgaacagagatcaagcacaaaattagttacggtacgacaaatcaaatcgctgtgatcgcgttgcgtgtagaaaggcgcaaacagttttttcatcagtctttgctttattaggcgcaggtcaagttttgcgcccatgaaacaacgtgcacacgggcgctagtacaaaatttaaattgagtacatacttttcagttccaaagagtagattatattactgaccaaacagcgggcgatcgatggactacatgcatacacaacaaagaaaaaaatgcgatcaggaatactggtagtagattattagtacttgcacacagccagcacacttgacttttgacaaatacgtaagcatggaaatctagcagacttcagatgcagacagtgctacttgttgttccggccagtgtcgtgtatatgttgttgtagtaggagtagtacaacgtatactctcgcaacttcccagaaatggcaaattccaaccgccacggtccaatctgcagaatggaaaaagcaaatggagcacgtgtttcacgccacattaattaattaattctcgtttttcgtgcgaatagagaattaatatttcatacagttgagaatagtttacatacgcttgttggccctggcatgtgcatcagcttgggtcaccggcttttgactgtgtgtaggcttgactatactatgtctcatttcatttattctctgctgagattctattatcatcaggggaaaagtgaattacaagcatgcatcatgaggtatataaaaaaacattttcagacttaaggctcttagggcatgtacaatggtagccacaagcaactgtggtctcaagactccacgtaggatagaaccacacaaaggtcacactacccacagtgaaaaccactccaaaacgtattttgcatg

SEQ ID NO: 59030 - DNA, 1573 bp, Oryza sativa
cacttcttagttcattcttctattgatgttccaagtgtttttctctttgtagttgtagatacctactccctccgttttttaatagatgacatcgttaacttttgaacgtatgtttgaccattcatcttatttaaaaattttatgcaaatgtataagatataaatcatgcttaaagtactttgagtgacaaaacaactcacaacataataaattataattacgtaaatttttttaataagacgaatagacaaacgtgtgataaaaagtcaacggcgtaatttattaaaaaacggaggttgtatatcacaaatatttagatatagtcccgcagcaacacgcaggtatcatatactccctccattccaaaatgtttgacgccattgacttttttttaaaatgtttgaccgttcgtcttattcaaaaaatttaagtaattattaattcctatcatttgatttattgagaaatatacttttatgtatacatatagacttacacatttcacaaaagtttttgaataagacgaatagtcaaacatgtttaaaaaagtcaatggcgtcaaatatttagggaaggagggagtagttcttgtaagtttgaccggcatttttgttctcttgcaatgatgctctgttagctactgcctgaaggctgtctaccattcccatacgcgtagcacaactccgtaaaaaaaaggctgatatgcgagcccgtgtgcccgtgctttactatgactagtcgagcaaaataagtccactttgactaaaatatagattcaatctgagatttgtatccctcaaccttaatatcggatattttaactcccaactattagtgcaatttgatttcctcgatagtattgactgtggtttcctctatgtgacatattgacttacaccatcccgctgagttagcttgtggggctcacatgtcattctctctccttcccttcttccttattcctttctctctcttcttcctcttccctatttggccctttcttctagccgacttcacaacagtggtagcggcagtggtggtaggacgacgatggggagtggcggtggcatcttgcgcacccatgcactcacccatgcatgctctcccttatggcaccatctccctagtcgatctctccctacaccgcagatgtagaagcttgcgctggtaacagcgcagcgctgttcccgcacagcggctggcacaaccaccatcgatggcgtcatgcgagtagcagtggcaaggcgcacgcgtgcggggtgatacaaggtggaggatgaggcaagcgccgctgtggaccgtcgttatcgatcagtttcgactgtcaatataattaaaatagaggagaactagtgatgcttgcaatgcataaatatgttagaataataatattccacttggattaggtatactaaccttttgcagagaatggcaataaagtggaggagaatcgacatcaactcagacaataaatcaattggactttgtcaagaaccagacttatgtatgaatgggccaagaactcagaaatgacacgatgaattaggccaaaattcacaagtctacgaagtga

SEQ ID NO: 59031 - DNA, 1525 bp, Oryza sativa
aattatcttactaataatgtcgttaagaaatacctacagccgaagcaagaccgcgctacagcgtgacgccgacacgcgttagtggcaagaccaatatgcgagctgaaattttgcttgtagggcgctcgaggcaaattggaatttcaaatgagagatgattcaccaattcatatttgtagtttaatcaagacatattataccaaggcatcataactagagactactaaaaaaatatatcaagattttctcccgtgtatttgtacacaaggttttgacttaaatttctaacagcaaaagaaaaaaacaaccgttatgttgtgagcacttctgtatatgtcccatcaatattttggtcagaatcattatttcttttctttgatatggtattgtgctccgaaagcctcttccgtttctttgaatcattgtcttgttccacaacaaggatttttatgtgtttttcttgcagtggctctagaaagcgcgacgcatagttgactatgagagaatactggttcgggtaggtatatgccgatgtttggtactgtttgcccttgtgccttatttatcgtcatggcaaagttaagccttacaggaaattatttccttttgaattggaatgggaacatttcatcatcagaggggcttagtgggattcgaggcaagaaaacccgtgtaccagaatgttgtcctagcacaatcactgtatcaatggtattctctgaaatcctcgcaccaccaatcttgtgccattgcaaagtccattagctaggtcgatattcctgagcaatatgatgggataattaagtttgagctttagcatgtgaggaggcaacccatttgggttcagaacgataattcgatcaatatcaggaaaattatactatcaaaatttatctataaatagtttaatatagagaaatctataagttataataatttttagtggatcaaatagtgctaaaactaataatgtaaatgaaaaaacaactgaaattagttagtaattgaaagaacttcttttagcccacatatgaaaaatctaattcattaattctgaacgcggccgacaacaacatggttgcgatagagagaaacgacagcggtgaactcttgtggtgaacacaatcgagtgagtacattgtcacaccccaatccggcaccgccgtacaacggcacctgacaggagcgtgtcgtaggaataacgacgcgaaccgcttcctacgaaaccgcgatctcagtaccagtcccaggacatagtgctggtacccacggtgacaaatatgaatcattgcaaatccttaaaataaatagaggacttatttaccttaacttaggttgcagctcagacagcccgagaatgcaaccaacgacacggaagagaaaactccaacaacaacagcagcagcggaaccaacgaactaacacccaacaccacaggcgatggctgggaaccaggacgaaaccctaatcttcacttcactttacttcacgacggaggaactatatatatttatatagagcaagg

SEQ ID NO: 59032 - DNA, 1136 bp, Oryza sativa
acccagggttacctcatgccacatagaaggatcaagtcctcacgtaagcttgcatgcctgcaggtcgactctacaaatccccttccaaccaccttgatcggtaagtgagcaagcttcttgtccttgccttaccaagaacccggtttgtccgaccccgccccggcgttcccaactattggcatgcgaggtttccctgaaccgactagttacttagccaaggtgtcccattccaccttgtggttgcactttgattatgctcgatgagtttcccacaggaatcggttcttatatgcgaatacgggacaatgccacgtaggcacggctcccgcatcgcgagttttcgcaattcattttattttcaagcacaccgacacatgtccggttttcaaggcttcacaaacccatttcccaagttttcgacaatcaacggtgtatgcgggatatttggtacacgcgctcagagagcacggataccaaggtaccacaagggtggagagacaaggaatcagggtagtacagcctacagggattagtgcgactactgagtaggtccgtcggtttggcacgcaaaccgaggccaagcaaattaagtgtgtgattctaataatgcaagttgcaaacaagataataatgattttccaattataggagcaattggtcaaagggtgacttgccttgctcaaggtcttcacgaggcttcacgaatcttcgagaaaacccacgatcgacgaaaatccggtaaccgcaactatatgcaaacaatcaaaacctaaacaaaagaccaaaagaaagaccatatttagactaattaatagttccattaaatatatctcaattttacagaattattggaagtggaacgggggtcaatcggacaagcggttgagaagataggaattttggaaggtcaatggatttttttagataaggaaatgatttatcggaattttctggaatacgaggaatggtttatggaatttatagaaataatattctcaagaatattattgatagtcactgacgtgcaggaccaagggaaatgatttatggaacaaaaggaaaaaagatttattaaatcccttggaaaagaaagggatgagggatgtgaattggacttgtatcgggtggcattggtg

SEQ ID NO: 59033 - DNA, 985 bp, Oryza sativa
  unsure (1)..(985): unsure at all n locations
ataatgaatgcagtagaatacaagagcatgtctctgattaagaaactgcctaatgcacaataaatttaatattagttatctagtttcctttgatgaccgtttggaggcccataaaaaaccaatctagtaccggatgtaacactatgaatctgtatatgtatatatatatatatgtatatatatatatatatatgtatatatatatatatatgtctaggttcatagtactagaatatatcacatccgattttaaattcgttttttataggacggagggagtatatatttagacatagcctaaatgcacactaaaaaataatcggtaacttcctttgaatattttaggggtcagctatatttgggaattataggcgaatttcgtacattttaccctttttatcctctagaccaacatttcactttttttggtgacttttggtgtggatccttgctaatatgaaaaaaaaaatctgtgtaaacatgcaaacatatgttaatccacaaatgaaaaacaaagcgaatgaaaaggtacattactaaaattgtgatcttttatactatgcaagtttggatcatgactttgcaacctaacttgactaacatataaataaaatcagataccccattcatcccaaaatataagatacaaccactttttatatgccttataatataatacgtgcatgtgtgcatacattgactattacctcttgatcctttaaattaggtttattttaaatcgtttaccatcaagcctcctaatcacattgtttgcatgtatgaatgtgatccaattgaggaggtgattaaattctttcttcgatgttttattaggagtggttgtcccttatattttgggatagagtaactgataaaaataacaaaactgtttttagtgccatgttatgccggnnnnnnnnnnnnnnnnnnnnnnnnnnnnnnnnnnnnnnnnnnnnnnnnnnnnnnnnnnnnnnnnnnnnnnnnn

SEQ ID NO: 59034 - DNA, 1092 bp, Oryza sativa
ctatagggcgaattcgagctcggtacctgtttcggatttgccgtatatcgactccgagcaagtttcgcactttggcggttttcgaccattacttccgggctttaaataccaaccggtacccttgagaaaatttaaaacggtccttttcgttttcaccggttgaaccaaagttggccttttttttttccaggaattccaccgacgcaaaaggcaattccaaagcgattccttctccggcggacctccgcttcggtgatgtcgtcctccgccagcccgtctaccgcgccatctgccgagtacgctgaggtaagttctcatcggctagatcccttttctcgcatgaaatcgatttccctcttcctcatcttgttttcttcttctctatctttgttcacatttgtagcacctatccaatctgattgcgattccaagtctatcgcatgagggacattattttctcggtccaatcggcaacctagaccccactgatttcatcatcggcgaaaccaacataatcccctttagattagccaaccttaatcttggtcactggaagaatacttttaagtcttggccatctctcagaaaaccacccctgagaaaagctggattacatggtacaagcgcgtatcggctagcaagaaagttcactgggatgagatcggaatcggccaagcacttgcccttaccatagtaaattcatccaaggatgaacccttaatggccgccgccacctacttctggtccaatactatcaacgcctttatgttcaaccaagggctgatgaacttgaacaccaagaaccaatacgatttcaggaccaaaagcataggtggttggtctggttatgtggcagcatatatgggccaaggatccgttactcctcgagagcatgtggcctttttactcatgtggctagaaaagtttcttttctgtggatccagctgtggtcctacaaccaactggcagtttgcagccgaagctcttgagccaaaaagagaatttcctctaggcaaaatcctcctcggctacttataccaaatgctgaacaatgcatcggccaaaatagccgtcagctcggtggttggagca

SEQ ID NO: 59035 - DNA, 3071 bp, Oryza sativa
ttgaagaagtagaacagattaggcaaaggggtatatcggctatccagcactatttgtctcggtgactttttgtgcaatagatcttagaaatttttgtaatcggctaagatactctagtactttactgtcttgacaatcctttgtgccgactaatataacttctaaatttgctcaaaaatttgcaattttccgctcaaaaatttgcaattttcctgtatgtgcccccctaattttacaatgtcaaaacattgataaaattataaaaacaactaagggcgatataaccatatcggccattgtgcatcggcaaaccacaaccgattacaatatggaaacaactaagggtgatacaaccatatcggccattgtacatcggcaaaccacaaccgattacaatatagaaacaactaagggcgatataaccatatcagccatctcaaggcgatgtaaacacatcggctatcatgtatcagcaacatcagccgatcatgcattaacccaaacacttgggtaatatttcttcaagtatttgccattcaatgctctgccatagacttccccatcaagtccttgcaacatgtaagctcctttagacaccactttatgaatttggaacggtccttcccaatttggcgaccacttgccaaatttgctacccgagttccaatcggcaaaatcaacttccatacaagttcaccttccgaaaaatccttgggcaccactttcttgttatagtgtcgagcaattcgctctttatccttggtaacctttgcaagggctcttaatctggattgaaccaagtcttccctttcattagccataaggttataatacttatcggttgttaaattatcttgcactcagttctccttgagccgattctaacctcccatggcaaaacagcttcatgtccgtaaacaagcttataaggagggacttggatcgatccataacaagccatccgataagaccacaatgcctcgaccaaccgagtatgccattgccgaggataatcagaaatcttcctcttaatcaacttgatcaagcttttgttagatgcctcgcttgcccattagcttgtgcataatacggtgaagaatttaacagtttgattcccatactatcagcaaattgaacaaactcatcgggcacgaaaattgaaccctgatcagttgtaatggtttgaggaataccaaatcggtagattatatgctcttgaacaaaccgtatcgcatccccagaatcaaccttattcaaatgaatcgcctctacccatttggtgaaataatcagtcgccaccaatataaacttatgtcctttactcgatggtggattaatcatgtcgatcatatcaattccccaacctctgaatggccatggtttaatgaaaggattcatagccgacgctggtgctcgctgaattgctccaaatttctgagaatcttgacatcctttgtaatacctgaaacaatcttccagcattgtcggccaaaaataccctgcacgccgaagcaaccacttcattttatgagccgattgatgagtaccacaaatcccttcatgaacttcgccgatcgcaactttagcctgatcggcactcaaacacttaagcaacattccatcaatcgtccgataatagagctcatcatccaataaagtatacttcaacgctttatatctcaatttccgagaagccgactgagatgtattttgtaaatattgatgtacatcatacctccaatcatcggctgttaatgcagcaaccttaaccctgatatctttgatcatcggcttataccccgatgccccttgggccaaatcattagcttcaatattttgttctcgagatacatgcctcagagttactagccgaaactccttcatcaactctcagtacttctcattataaaccattaatgtatcattcttgcactcatattctcgtgtcaattgactgatcactagcaaagaatcccccataatttcaatagcatcggcttcaacttccttgaataactgcaaccctttaagaactgcctcatactcagcttgattgttggttgcataaggtttaatagtataagcaaactcaaaacatgccccccgaggggaaattataaccaagccgatgccacaaccatgagtgtatactgatccatcaaataataaagtccatggcataatctcaaccgagccgattgaatcatcacgatgttctacagtaaaatcggctatagcttgtcctttaatcgccttcggcgatccatactgaagatcaaactcagttaaggaaaatatccactttccaacccttcctttcaaaattggagccgataacatgtatttaacaacatcggccttgcatatgacagtgcattcattggacaatagataatgccttaaccttggacatgaaaaatataagcacaagcataacttctccacgggggaatatctagtttctgcatccaagagccaatgacttagataaaacacaactctctctttcccttcaagctcctgaatcaagatcgaaccgattgacttcttaccggctgacagatatagctgaaaaggtatccccttctatggaggaatcaaaactggaggagagctacgatattccttaatatcgtccaacgctttctgttgctctgccccccaagtaaactgttgatcggctttcaatctcaacaatggtgtaaaaggctctaatcttccagacaaatttctaatctcaacaatggtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcattcaataaaaatctaagcagcggaaaaaaataagataaacggcgcagacgactcactccacaggcagcttgaccagggctacacctaatcctccacaccatcagcatcactgtagaactcctcctctgatgaatgattgcaaggtgagtatatgacat

SEQ ID NO: 59036 - DNA, 2060 bp, Oryza sativa
  unsure (1)..(2060): unsure at all n locations
ctaccgacggcgacaggcgaaagcaagggtggcggcgggtagcggcgggcttgggggtccttttaaaggggcaaggaggtggcggcgaaggcccacggcgaccgccgacgcgaaggaaagtttagggttcgaaggagagggatcgatccgaatcgaactcgaatccacggatttccaaacgaaattagccgacgattccaaaagagaaaaggtagaggagatctcgggaaacatttcccctcaattgatttcaccggagaaggaaaggcgcggccgaatttggaaagagacggcggcacggctcggctagggtcgggcggcggctggccggaggtagacgacagccttgacaggtgggccccccctgtcagcggtcgcacgcgcgcgcgccagcggacggctcggctgcggactagcccggcttgggccggggagagagagagaaggttttggggcgactttcggcccaaaggcaaaagagacttttaaaaacctttttcaatttaaattattcattaaatgcaattccatttattaaaaatacttccttagctcaaataaatcctagaaaaatctaggaattatagagttaagcaaagtatttaatgaaattttatctggcccgattttatattggaatttattaattaaaactagatcttcttttcaaggcttttaaaatcatttctaataattccaattaaacaaaaatttatatatttaggatttttagggtgtgacagtccaacgctttctgttgctctgccccccaagtaaactgttgatcggctttcaatctcaacaatggtgtaaaaggctctaatcttccagacaaattagaaataaaccttctaacaaaatttatcttgccgataatctcttgcaattctgtcttgctctccggaggctgaatcttcttgattgcattaacactcctttgagttacctcgattcccctctcgtgaacaagaaatcccaaaaactggccagccgatacaccgaaagcacactttgtcgggttcatctttaggccatatttcctggttctctcaaaaatctttctcaaatcggctatgtggtcctctatctctttagatttaacaaccacatcaccaatgtagacttcaaccaaccagtcgattagatcatgatatatataattcatgtctctttgatatgtagccccagcactctttaagccgaaagtcatcacaacccattcaaacaagccgattgcaccaggacacctaaaagctatcttatggatatcttcttcagccataaagatctgattgtatcctgcatttccatccataaaactaaaaaaccttgtgccctgacgcagcatcaaccagctgatcggctaccggcattgggtactcgtccttcggggtagctttattcaagtttcggaaatcaatgcacaccctgaccttgccgtttttcttgataacaggaactatactagaaacccattcatcatatcggcaaggacgaataaaactagcatcatacaatcgtttgatctcagccttgacaggttcaagcgtatcggctttacatcttctcggtggttgttggtgtggcctaacccctggtttgatgggtagacgatgttcaacaatcgatcagctgagtccaggcatttcataatactcccaagcgaagcaatctctgaattctttcaacagctctatcaacttggttctaaattcgtactaataaatgtcggcctcagtcgatcacctggacctatatcaatttcttccaaatcatcacccgacatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59037 - DNA, 1309 bp, Oryza sativa
  unsure (1)..(1309): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattcgtactttttccttaaaaaaatcatctccacatagatcaatgacatctttatactgatactaaaaccgtctgtaagactgtgattattgattaatatcatttcacatatataaatgttcgataaacttttgaatattcgtggcacgtttttcaaactgttaaacagtgtatttcgtgtgaaaattttctatactaaagttgttataaaatatcagaataatctattttttaagttcgtaataattaaaacttaattagttacacataattacaccttgtttcacgtggaacacttactagattttaccattaatcgtctttacaggagcccacaccatcgggcgggcgcagtgcgccaacttccgggacaggatctacaacgataccgacatcgacgcgtcgttcgcggcgtcgctgcgtgctggctgcccccagtccggcgacggcagcggcctcgcgccgctggacgagtcgtcgccggacgccttcgacaacggctacttcggcggcctcctctcccagcgcggcctgctccactccgaccaggcgctgttcgccggcggcgggggctccacggacggcctggtcaggagctacgcgtccagcaacgaccagttcgccagcgacttctcgacggcgatggtgaagatgggcaacattagcccgctgacggggtcggccggcgagatcagggtcaactgccgggcggtgaattaattcatgacgcatgggcaatcatctagcttgcagagtttatatatatggaaatgaaatggcatccaactatatatactatatttatttattattttattaattattagtttccgacaatgtgtgtgtgcatatatagcagaaatatgatttggttccattattgttatctggaaggtgaaaattaaagaggaaatacatatcatgtgcagaaattttcatatattgccgcaaattaagatggagtcttcatagatagaaaaaaagtacgaattacccctccccttcctaaactatcacggtagaccgaattaccccctaaaccaaaaaatcagacatcgctcaccttgaattttcaattctggacgaataaccccccttgac

SEQ ID NO: 59038 - DNA, 841 bp, Oryza sativa
gtaccatcgacaactttttaaatttgtcgttgtcatgcatccatgtaccacctgttgatctagctagctaggagtagattgccggccagcttttgaatgcatgcttgtcttagcaaggatgacaaatggttgagaatgatgtatgaactaatcactctccagctgttgcaacttgcaaacaagaagcattagtgaagaatagcgaattagttactaccaagtcataaaaacaactccctctatttcattttatattataagtcattttaacttttctctaatcaaactttatatgtttgaccaattttatagagaaatttagcaatttctacaacatcaaattagttctattacatctatcatcaaatattttgataatatgtttcttttcagttcgaaatgttgttatatttttctataaacattagtacgtatccttccatctgtggcggcctctcacatgcctggttttgccggccatcacagcttcatctcaattgggccaaaataaacaccgtcgtagaactcgtacaggcataatcaagttgcatatagctagagcccgtcatcgatgatactcatctatgacggtgtcacgcccagaaatttagcccaaatttctagtctattttgtgtattaaatccctgtccaggaccaaccagggtacacgaaacgacaaattaatatacagattcaaacgtaaataaagcgtaaaatacttacagaagaggcacttagtcctcacaccgaaacgaaagcagcagtagcgaaaaaaggcaatcctagtggagcttcagctccactccacaggcaaaactcaactggggtatgagccttggt

SEQ ID NO: 59039 - DNA, 714 bp, Oryza sativa
tttggcccaatctttcagtgagttgatgataactacaatttgggagaaacgttgacgacccgactacaaccgtacaagatgttgtgttgtgcctttgcgatcgatacacctctccgtgggttgttgatcttgtcggtgcagatcaaccttattcctgcaagcaaattgaagaaacaagcaagaacaagataaaagcaatctgaattgcaaataggaatgaatacacatgataagttggggttttcaatacaagcagatggacggtctaggtgccacgcgcgctacaaggaagtagcaatggttaaactttcttctaaacaaaacccaagaaaccctgaaggggtacctaccaatttataggggtgggaggatgaccaaggggtgcgaagggttgttctccacctagttgggccgcactccacatgggccccacttgggccggggtcccaaacaaagttacaagcccataggcccaagataggtgacgcaacaccttgtgattgcagcaaaacgacatggaatttggcaatgaggctggatccgttggaaagagggctttgagagctttctatcaagtactcacgggctaaaaacggaggttgtatgtagatttggcggccatttgaagtcagcagtgtagcaggtggccaaatcggattccagcacttagaggacttgatcttgatattttcttgttcatccatgatatgagca

SEQ ID NO: 59040 - DNA, 712 bp, Oryza sativa
gcattccctaaaccaacatctaagtattttaatacccaagttatcaatggcataaggtaaacaagatatggctgagtagtaggacccatcccacatgatattataaaacaatgcaatatttaatagaaatgagggacatttgtaaattgggtacaatatgatcaatcgtaatgcatgacttgccttgctctcgcactgatgagaccatagcaacgtcttcgaggaaccgcggattgacgaaatggccgaaatctacgcgacaaacaaagaacacaagcaaaacacactataagtctaattaaacaggaaacaaaaccattttaatggattctatgcatttttatgaatttactgagacttgaatggacttaatcggagctcggatgaattagatatgaattttagaagattaaatgtgtttttactataaaataaaaggccttaatggattttattgcgcaataaaggtccctactgacatcatcaaaggggggggggggttgcgccgacagatgggccctacttgtcatagactcaagggcgccggtctactgtggaccgagtccacgggaccgcggagaggagcaccacgtggcgcacacgtggcgccgacgtggcggccacgtggacagccacgcgggcggcagccgaatggccccgatctaccgagcgggaaatcaaatggctgcagcggctcgcggctgggcaatgc

SEQ ID NO: 59041 - DNA, 1498 bp, Oryza sativa
tgcctcgccgccgcctcctccgcccccgccgctggcctctccgccgccgcctcctccgctcccgtcactcgcctcgccgccgtgcctcctccgccgccgccgccgccaccccgcctcgcctcgccgcgtcgtggcctcctccgccgcgccgatgcctcctccgccgcggctcactgcctccattgtcgccgtctaaggaggagagagagagtgagagatagaagagagagactgacaggtggggcccacctattttttaataaataaattgctgactgtattgccacgtagaccaaaccaccgcggattgggttgaggggggtaattcgtccagtttgcatagttgggggtgaagaatgtccggtttcgtggttcaggggtgtaattcggacgaccgcgatacttcggggggaggggaggggggtaattcgtactttttccatcctaatattatctcgtactccctccctccatcccctaatataagatattttgatattttgcttgcactgtttgaccattcattttattaaaaaaattttagaattatttttttacttactttattatccaaagtattttaagcacaacttttcgttttttatttttgcacaaaatttttgaataagacgagtggtcaaacaaaacaattcaagcaaaatatcaaaatctgttatattatgggacggagggagttgatagtttattcaaaaaatttttgaataagatgatccattgccatgtcttgaatggaaagggagttgtctaggtatggaaagtgagatgattggatgaagagaaatttttgaataagatgatccattgccatgtcttgacactatatgtagaatctataatggatggtatcttcaaattaaattcctatccaagtatctctcttctctcttcttttatccacttatcctataattttcattcttaccttttatccacttatcctataattttcattcttagttattgtatagagagggtttcttacatgagaaatgatttcttcatctttttacctctcttctcattaactctattgccacattatattttgcttatgtggtaatgtatttaatactatggacactggatgacaaggagggttggaatggcctaatgagatactcgtaatactatttacataatacacacctactaaatattatacgctagctactaagggactgtttggttggttgccacactttaccacgctacactctagttataccacactctcttaggtatgtgtttggtaccctatagcaattatgtcatgccacacttttatagcttgggacccacatgccatactctcaaattcaaatttaaagctaattttgccacacttatgatcaactatttctaagccacactattgccaccatccctcaactaacctaaacttagttatcgcaaggctatccattaaccaaacatcccctaattacagagaccggccggcaaccttgaagccgccacc

SEQ ID NO: 59042 - DNA, 792 bp, Oryza sativa
ctcatcaccttgcttattattgcatatttacccatacttttgaacattacttgtgtttttacccctattttgtagataaaacctacaattattttgaactgagattttgtgagataatttatatctgagctgaacttgaacaaaattttgacacatgcaatttcatccaaaacgaggtcagaacaacatttattttataagcgaaaatagggagcagcacccctcaaccatgctcgccttgtgcaactgcatacgtcactatcgactcaacaaacaccatcgaggtgaggtgtggccgtgtggggcccgttcggagctcgcgtccaggagctgccgccgcctggtgctcgcttacccgcgctgaggagctactgccgccttgtgctcgtgttgaggattcgccgtctctatcttgcgtcgtcgcgccgatgacagctcacagcctccgccgctgtctgctgctcgcgtagccgcaccgcgcgaggaatcgccatcgccgccgccgcgtggtgctcgtgtattgaggagtcgccatctctgcatactgcttgcgtcactgagccgacgagccgtcgcctggtgctcatcgctgcgttggctcgtcagatccaccgccgccgcctgcgcatgctagaggagagtgaacaggtatgttaatactcagggtcaggggtagagtagtaatctaatatcttctaaattattttttcctttttcatttgtatttcttcaattcaatattatggaaccaccaaactgccatccatactatttcagaaaagcaggggaaat

SEQ ID NO: 59043 - DNA, 887 bp, Oryza sativa
ataccatgaccccaatctccaaacatcacagcaaaaagaaatgggaatgtgatgacagaatagacagctggattagcttcctcatatcgagcaatactgcaagaagttcatgattagcacactaccaaagttgcatgactaaaatatcattaaaaagtagggcctaaggattaaaaatagatcacatcataaagcaagtatgtcaaagtatcagacaaccttccaatgtttaatgaatcaatctgttttttatggtcaggttgtctagttacaaaggcaaacagagctagcaaaatgtgcacactaaagaagtcaacattattaattactacctctgtccctaaaactaatattttagctcttgctcaccaacctcaaaatcaaacccaaaagtgaagaacttcaaaatatagcagcaaaatatttgtgtcggatagctgaaacctggatcaagtagctagtagtacacatgatttaacaactgctttgctcaagaaatttaacatttgaaaaacatatacccacgaatactcagttcatgaatcataaaaacagaaagcatatgaatttcatttattcaagttgacacttgcaacaaagtgcatacccatatgcgtcaactatctcctggaaagcgttagtgaacttatcggtttggaaatatgtaggcggtgaatcaatagtgtccatctcatgaaatattattccaacttgtgaattactgtgaagcgttgcacgctgcaaaacatccttgatctgaagtacaaagtagagataagatatatatccttaaaagtatcctaaacagaatgagcacaatgaatagaccttcaaatgaatgtaatatttctgacctgtgatttagcaaatataggacaccatccttc

SEQ ID NO: 59044 - DNA, 1187 bp, Oryza sativa
cactcagtaccactgagttcgtcacggttcaataatatgccactgactttgtcgatttctattatataccatcgcctttcccttaacctctacgatttaccatcgccgtccacagacagtcatctatatgccgtttgtactgttattttttttccgtaatgaccgaaataccctttgattcatctaaccctaaccagtcaatcctctcttcgagcgcccagtcaatcggctcttcgagcccttcctagggctagcgccaatgccgccacgccaccaccgcgccgcatctccgcccgccgctgcatctccgccggccgccgcgctgcatctccacccgccgccgcgctgcatctctgcccgccgcagcgccgcatctctgccgatcgccgcaccgtatctcctccgccggccaccgcatctccgccgccgcgccgcatctctgccggccgccgcgctacatctccgcccgtcgtccccaaagcgacagccgtccccggcgccgccccaacagccgtccccctctccgccccgatcgtcgggcctggcgccgcgacaaccgccgtccccggctcctccattccttgcgcctctgttgctggtagtgccgtcgtcgtcagcaccgccgtcatcgtcgaaggaggtgctgccaatgggagaaaatgcccctgtgctgccgatgggagaagatgcccctatgctgccgcgcgccatcgtcgtcgaaggaggtcgtcccggtgccgattgccgttgttgctctctccattgaaatccaagatgggtaattgtcatcctgggatatgtacttgtaacatcttttccacgtaacttatttatttagcttttgtaatgttcaccttttatggatgatttttccttgcataacttggacattggatattatgtaccttactgtcaaattgtgctatgcaccttttatggatgaatttccttgcacacatgctgtacattattcatacttataatatgtcctcattattatttataatcatgttgagatatttttcacatgtgtagtcatgttgtacattctctctcaattattatcactctcaggaccctacatgccatggtcatagtgctactggtcttcacgcatcataaggacgtatttgtcttttcttcaatgcaaattaacagtttgtgcccgtgatggtaaattgtaaagg

SEQ ID NO: 59045 - DNA, 793 bp, Oryza sativa
tgaaaatacaattggtcaaccagtcacatcgttcattggctgaggagttcagcacaacttttataaaccaaaggtcacaggttcatggcccggtcaaaattagggttttcagcggataatttgtgtaatttcgaccaccttgagtacactcatagttgatatataggatcaactatttccttctcaagaaaccataaaagattgagtgagtttttgggccacctataggacaaatcataactgttttcactttttcttttagatataatgaactacttacacatgaaccagaatctgctaggaattgccatgaaatagaccatggtcaaccagctatagattaatatatgttatatactgccggttgtaaacaggacaagaagtcaccgggttgacataaagtcccattattaatacttgcatcgtagacatctttgtttatgccatgtagatctgaaactattcaagcaactgaaggatgaaatctttggatatttgaaacaaagatacctcagaacagctgatcttctctcctccagcagttgacataactcaaccttcagccagaccacctgaaataacagaaccaccaccaagtataaagtatcaactatcaatcgtacttaacaaaaaacagcaaaaggaagccaaaaccgatatactaaaacaaatagtattgtgccatgaacaacaaaaggaaaccaaaaccaatattctaaaacaacaaaaggaaaccatcaatagtacatcattctattttctttaaatgataaccaaaacaaatcataacatc

SEQ ID NO: 59046 - DNA, 2713 bp, Oryza sativa
cattagggcaagagctgttggaaagagcatcacgcgatttccatcaacaagaagcacatcccaaactcgaaggactgaaatgttcaaatagcaattaagtattaagcatatttcgagataatataatagctagatatattattagatcaagtacaaaaaaaaagagattgtaacatatagtcttgcagttgacaaaaatctttctcagaatgataacatttaaaatagagtaaatttcagaaaaccccatattttatggtcgaagttgcacaaaaccctagatataatgacttgtagtagataacctcaggtactacggtcctatggtttcacaaaaccctaaaccctatttatattccaaacaatataacatattgtcatcttggacacatatttactcaaactttcgtttcagaaagtatctacagaattctgaattatttatttattggttaaggtgattggtttaactcttcattactttgaataatattgtttcagatatgctaaaattaattgagatatgaatgaatgtagggatgtataccacaagccaaaatacccatggttttctacgacttcgaccataaaacctttccgaaattactctttcaaataaagaaaaataagacttaccactttcccatggtagcatgttcatgaatatagatagaaaccatggtccagtaacccatgcaacttgaacgccgaggtaatccaggtgatttactgcaaaaaaccatgcataaaagtagtcaaaattgtcggttaacatatatgccaagtcatgatatacagatattttaatacaaacaagaataatgcgcaaacctagttttggaaatttctcccggactaactcctctaaaacaagctgatcaacctaaagaaaaaacgaagtgtagcttatttaatgatgaatagtgaagtttggagctataagcacataatggcacatgcaaacactaacagaacaaaagataatacttaagaatacctgacattctatcatttcttcagaaaagtagccatcaaaataatcatccataatgcctgtcaatgccctgcgaacagataatagatttaacaaactttttagttcagctctaatacaatgcaacaagagatgtaacttgagagaacacagaaattccatgggtgttcttctgcaaaacctaccaaaatgcattctcctctggcattaggagaagtaacagaccagcaaagaaattcattgcctgcatatccagatgattgatcttagctgagaccagcattagtggcataaagtcaaaatttttggggaccatataattgtgcaaatagaatagtggttattgaataacaagagaagatctctctgtgagtaaattttaccattaaaaagtttttttaaaaaaatacatacatagaaacaatatttgacctctagattcctttttatatgacacttggtgattttcagaaatttacaagatattttgataatatttcaaaaagatttcaactaacatcggggaataaaagtaaaacagcactgagcagtgtgtgcaagtttgggaactgctaatgtcaaatcgtaaaggaagaaggtacaagtcaaataacataatggaccttcaagcggggaataaaaaggaattcagtaaatgaataatgaattcttgatcagcagaagctacactttgaaaagagttggcatgactatgcataatgctccatgagcattggttcgcacctaccatcaataaaaacaactggagtgcaggtatatcaataagcaaaacaactgtagatgtgcattttagttttatctgaagtttctatctactaatagtacactcatgtagcttgcaaattatacaaagggtttatcagtatcatccagtacttcaccttgaaaaagacgttcagaagaatcatatacaaagaagagtacttcctctgtttcacaatataagtcattttagcatttcccacattcatattgatgttaatgaatctagataaatatatatgtctagattcattaatattaatatgaatgtgggaaatgctaaaatgacttgcattgtgaaacggagggagtaagaaatactatgctcagaacttcagttttatggtgaaataagaaatatgtgttttggtgttgccctgttggtgcatgttttcagtcttatcaatattcaaatagccagcattcaccaaggcgctagttgtgtggcagattgttacctagctgcacctaatcgctgattaggccggctaaaaggtgcccatcggttggcttgttggaggaataagccaaacagcatatttgcaaacgaaaaataatttgtgaacaaaacttttatatatgtgttcttagtgatctaaaagcaaaggctgaaaaataaacttcgatgaaaaaacttcaaattcaaggttgaaaattcaaattttggctgataagcataagcataagcgaaaagatgaggctacatcttgggcaacagtgcaaacagaattacatgtgcaacagattggtcttgcaatatgcaaggtttcccaaagaagctacatcaatccagtgacaagaaaagtgacatgagtcagaagtaagggaaagccatacctgacagtaaccaactgatgggttatgtctcgcataagctgtgagcaagcgtcttaaagcatttctgccatcctcatctagtgcgggatgacctgggaa

SEQ ID NO: 59047 - DNA, 1284 bp, Oryza sativa
aaattccaactaaaatttggtcctatcatgtttacaatgtctgcctcgtaaaaaatcgagttaatttgcttcgattgtagcggacatccacacaaactccgatccttccatggatcagagaagctaacacgattcaaacactcctttctgagggagcaaaaaaaaaaaaactaatcacatcgtacacacggagatctaggactgcattgcccaaatttggccccaacatctcgcatcagatcgagatccccgcgcaaaatatcaccacgagaagaaaaaaaaagcaagtaaactacacgcaagcggaagtttcgtgcagcagaaacttcaaaaaacctccggcgaaaaacttccgaagaaacacatcagaaacagcaaacaccggcacgaacgccgagatgcgcgcgcgcgcccgcggcggcgggagacgaaacgaaccgcttgtgctccgaggcgatgaacgggaggctcttcgccttcatctccacccgcgccgccgccgccactgactccgcgccaccaccaccaccaccaactcctcctcctcctcttccttcccttcgctcgccggtggcgaggcgtgcagtgcagcggcgccgccgacgcaacgcgacgcgacgcggacggcgaagcgtgagcgagtgaagtggagtgtgaatgaatttagcttatcggcggtttggagggggggggtcacggctcggggaggcagcagcgccgatgattcgattcgatccgatcgccgtttactactactccgactcctccatcctacgagtcgtaggatttcgagatttgatctgtgtgcgtggaagcgtgaagctgcgaggtgacagattggggagttgggaaattggaggacaagtcttcacaactcgttgaatttttctttcgaccggttggttatttttttgtcatggagattggagagatggccagatggggactcgggaatgaccacccctcgtgggtttctcctcgtcgacatggacttggcgctgggcggggttcggccacaccgagatctcgattatccgtgccaagtggagctgtgttcgtttgtgtgctgtggactgtggagtgtagaggggcctgtggtgggtttttgtagagatcatttttaagttgggtattgatttttcttatatggatttgttgttggcgcatcgacatctggggaacacataaaatccatcattaagcttgtcttatttctatctttggcatactcactaataaagtatagctagtctttattgaggcatagtattaggagacgacctt

SEQ ID NO: 59048 - DNA, 12510 bp, Oryza sativa
acagagaactttagattttcctcgagttgcatcaagattcatacataaaaagtaacattatcctttctcattttcttcttctctcctacatcgctcgacaatacaagaggagtaagctctccaacgttgcttgcatcggcccatcgtccccgcctcaatgctcgcccaccatcctcctctattcccactgtttcggtaacactgtcttgttgttcgcccatgtacatcgctcaccgctacttcgctagcccttcactatccatggctatcattctaagccctagaaaaaaaaaccccttccccactctcactgtctcacaccctaaaccctaactagtcgagggtccgccgcctcgctgaagttacactactcattggagctggatgaagagatcaatgtgaatcatggcacggatctgatggtttaaaaatcgatagaactctccactaaatttctgtcacatggatgttagcaattccgttttaaaattttactcttaaaatttgatctccgccgatgcaagccagctgagcgctcaccaaatggtgcaggtgctgcacgccacaaaggatccatggtgtacagattatatttcggacgaaatgatgggtacgtgcctcctgcatgaagcggtgcgatgcatcaggcgagatagtagtaggaccaggcgcttcagcacagccagtgcagcagccttctgcaacgcttcagcgaaatgggatcgattaccctgcccgcctgccggctctctccggccggctttgcgtttttcccctctttggtactagaagtagtgagtactcatcacctcaaacttttacccgggcggctccagttattactgtaacagcaaccggatccataaatgtgtgtacgcttcgtccatttatactccgggccgtgctgcttgtcctctctgaattgaaccctctgtctcctctccctttgcatcatttcccaaagtacagcctggatgtgagtatgtgatgtgcatcgctcgttccggttggcatcaaccgtatccgtcctgatgttactccgatttggcaaccggaacaaactctagctgtcgacccgtcctctcgcgctcagctactttcatcggatcggaccaagctatctcgcgattcaccgatgaagacaggtaggagcagagcaatagaaggaagtgaaaagaattgatgagatggtgatcgactggcctcccaacaaacaggagacagggtacctgcagacctgcagccgtcctgacaagaaagtgagcacctaggcacgccggtctcctccttccttggtttcatcataaactgcaacttgagtggcaccccggccgaagtactcctatagcatccggttcaggacttcaggtggagctaacgggttccttttacttcgtggtgaaaacggagcacctgaattaggccctgtttagttccaaaggatttttttttaaactttcaactttttatcacatcaaatcttttatacacatacaacttttctatcacatcgtatcaattttaaccaaacttccaaacttcagtgtgaactaaacacagccttactgaactaccagtagtactaaggctctgttcggtatccccttttcccaacccctctctctcgtttttagtgtgtacgtttttcaaacagctaaacggtgtttttttaaaaaaaaagtttctataggaatgttgcttaaaaaatcaaattaatccattttttttttaaaaaaaagctaatactccctccatatttataaaggaagtcgtttagggtaatgtttaagtcagatcttgggaatataaatcattaataactctcaagttgttgagtttaaaaatataaaaattatatgaatagatttgtcttgaaaaatactttcataaatatatactgtcagggttacggataaggtataccctctattcttggacatacgttgtatactgatgcggtatactcgcgcgtatacggatgattcctgtgtacattaaggaaatctatcacgtgatagaaacaaaatttacagatggaatgagtcctactcggacaagactgggtctttaccatatcgtgaggggtccgatatctccgagtcctacttggagatcaactgacccgcgatataaaatggaccccctgggcaggacctaaggcatcgaatctcattgtcaacacatccaccacagcctacgaagctggagcctacaggagccaagtcgccgggtgatatagtcgaaccaactcgacaacggtcttgtcggtatcatcgagttctgttattccctttgtaatatgtggtttccatcatataatctcatatcaattggattagagctattaccttccaagtggcctgaaccagtataattcttgtcttttgtttgcttgatgtcatactacgtagatcctcataccagcgtaccccaataccctctatatccggtctacgggtatcccccgtcgacatatacatatatcatttttcaataaatatttttatagaaaaaagaagtcaaagttatgttttggagaccgtgtcgctgtcataaacgacttcctttacgagtacagagggaatacttagttaatcacgcgctaatatactgctccgttttccattattactgttgggaatgggaacagcatgtgcgaacacagcctaaagtccatactaggcattgtttagttaccaacttttttttttcaaacttccaacttttccatcacatcaaaacttttttacacatcaaaattttcctacacacacaaacttctaacttttccgtcacatcgttccaatttcaatcaaacttccaattttagcgtgaactaaacacaccccagcttatgctatgcttataaaagaagggtggtaaactggtaatgtaaggttgagtttagttcctaactttttctttaaactttaaacttttttatcaaatcaaaactttcctacacacatgaattttcaatttttttcttcaaacttctaattttagtgtgaaactaaacacagcctaaatatgcaactctgctgtgctgtagcacattaagcctgtccagtacgtatacgtagtactactaactactgctactatactagctactcaaatgacgaaacctacccgcttgattgtataggctgtgtttagatccaaagtttggatctaaacttcagtcctttttcattatattaacctgtcatacacacacaacttttcagtcacatcatctccaatttcaaccaaaatccaaactttggattcaactaaacacagccatagtccggtagtcccactggcattttcaccggtaatgcgtacagcagtgcgctgctgatcaggggaggctatggggttttcctgcctgtctacgtacgtactcacgacgtacggacgagctaatgctagcacacagagtaattcaggcgacgtaccgtccagatctcgatcgtgaggtggctggctggctgagcccgtcgatcgatggatcgcccagtgtcggtgggatagagtacgccgtggcccctcgtggcatgttcgcgcaaccggcgcggctcacgcgcgagtggttgaacgatgggcacactggtttagcacctagcaagctcgcacccaccacaagggacaacaccgccgccgtacatggcgtacagctagcggtacaggcacaccgcgcgcacacgaaccaccgcgaatacgatattgaggggtgcggcgtgcgccggagcatgcatgtgcttgtcttcgtatcacctgacaaggtcggcgcacgctagctagaaggccaccgtgccggccggccaccactccaccagcctaccgcggaggacggcagattgccgtaaatcgtaataggaacaggaatataaaaaaattccgttgccgggactcgaacccgggtctctcgggtgagagccgagtatcctaaccagctagtctacaacggaggttgctgcttgagctcggagattgctagtagtagtcagtagccccgacaaccagaccaaaataccaaccgatactgactgtcacactttgatagcgatcggaggtcaacttctacgaaccgctactgcacggcgcagggccttgcgacttgccgacagcgttcaagtcaaaggaaacattcagcattcagaatgctgaattcccacccgctcctttggctagaggcctgtgtgtacgtatgggtggatagcgagcccagattgactcgtgtcagctcatcaagataataagctagctcggctcaataagggcagtcccaacccatagtgttcataagtagtgtctatagtgccatgtcaataagacatcacaatagaaactacactctataacccatggtttcttaaagtgggccattaataaatatatcatctctcttctctaccaatcataattattcttcatctattatgaagacactattctctcccaatacataacttgatagtgtctagtgcataggttctcgtgttgaagctgtgtcttacatgagacccaattttttcctctcttcactctctctcttaattaatatagtgccacataagctaaaagtcctacataataatgtagttaataccataaacaccattctagatggagggttgggactgccctaagcaatcgagcccaaacaataacttggctcggttcgtaaaaggagctcgagctagctcattttggctcgcgagctactctactactagctgaggagctccacgcaagacaagtgcacaagtgtctgcctacctgcgtgcaaatgcgcaacgatgtgcatggcgatggcggcgctcgtcatgaggatgggagaaataaattacggttcagtaatttcatagcttgagtatttaggctggcctggaatggtcgtatggatggactgtattgtgatggggcctcaccagttgtccatattccctaataaaccaaaacggtttactatagagtaaaaattaatttataggtgaaacttttatatatttgttcgtagcgacttaaacaacaacactaaaaagaaactacgttgaaaatatcttaaaatcaactccaaaattaagtttaaaaaaattaaaaatttacttttgctttagcttattagcccaaccgataagggttattggttatttttcaactgtccttatgcatctagcgctcgcttagcatatttttctttttgggctattggacttgtgcatagctcgttgggctcgttaacttaacgagctaaactgctagcttggctcatcgaaaaattcaaacgagtcgagccgactcagtcccgagcggccgagccaaacgaagagtatggaggcggggacggtgggaagtgggtcgccaccttcctgaggtccatctcactgggccggcgaatccgcaggccggaaataggacggatgcatacgatatctgggccggatacatgcccgttagtgggcaagtcctagatcacgtcgccactggactgtactacatcacaaggaataagttcactttacatccctcaatttgttgccgagtccgaaatttgttccagtgcaaaaccgggtacaacacatccttcaacttacaaaaccatgcgaggtccctcggcagtattgtgcccagttttggctgatgtggcgtctacggggctcctttgactaagtcttcgtcccaagtggagcttacgtggaaatttgataaaaaaaaacccataggacccacatgtcagtttcatatagaaaataataataaaaaaatggtgggcctcacatgtcatccttactactctatcttctctctatcccctactctgtagtctgcaaggagcggtggcgagcagtggcgcgcgaagtcgatagggtggcgagcggacggagtggcgacggagagcctgcgggagtcgagatcgtccggggaagcaacgacggcaacgacggcagccttgtatcccgtcggcgaggtcacgctcggccattgcgcacctctcccttcgcccatcgccatcgagcccccacccacggcgcccggccatccccggcgaggagctctgtttttggtgggtgtcggcggagttggaacgaaggagggtcgttctcggcatcgatgtcgccatctccgatcctccaccgccaccgccgccctccccccctccattgccgacccctccccggcgtcgagaaaatcctcgcccgacctcagcaacaagaacgacgagcgaggagcaacgacgggaggagatagcccgcgcagctgtcgtgcttgccggcgacctccttctctgcctcttcctccaccggccacctccactgcccgtggcctgccgccgctccgccggcatgctttgaccgccatcttcgttggaggcgacgaggactaggacgacgacgacggtgcggtgacggctgtgaggtgacgctgtagcgcgatgaagaagaagagggaaagccaagaggggagaagatatgacatgtggggcccacgtgggccccaccatttttttagctgatatgtgggcccatgatttttattatttttccgagaaataattgtcacgtaaacgccacgtgggacggagacctagtcaaactagacacgtaggagccacctcagccaaaaccgccgagtcgtttacaccggttttgacagtttagggactggttgtatctggttttggggttcaggatgaaaattgaattcggtgtaaaattaagggacctctggtgtacttattccacatcacagcgcttggtgaattagctgatggattgacgtcccagggccggtgctggacgaccacggcccatgcgtggggctgtggccttggcgtcgcggtcgaccacgtatgtgcacggttcagtgatggatgaggtattaggctcggcggcgatccgtgtcgcgtgtcagcggtgcaacgaaagataaaaatgctccaaaatttaaaaatttccgttgccgggactcgaacccgggtctctcgggtgagagccgagtatcctaaccagctagactacaacggatcttgtttgataacgaactgccaagcttatatttccctttgtttctccaaacgaaaccctaaatatcctggaaaagagatactgataagtgctctgctccctatatccacaataattcagcatggtttcactgccaccttatataaaaccgtaaagcagctcgatttgacgtgcctaccatctctactataataaagataaaaaaataaactagagtagttatggacataatgcttgtctttcaaaccagtatcattgatcctcattgcgaggactatatcgaaatccgattgctttcctttcaaaaagagaggattgaatcgaagtcctaatcgactctttctttccgtgctagcaaaatgatcaaaatcttcagatatcatgttggtaggggaatggtctcatcgaaccggtgcactctcgctatttcaatgccaagaggaactatcaaaagcaagcttttagcgggcaaaataatcccatggtccaaaccattattgaagtttaataaactgacacatcagaagacactgccatgatctgcaggatccgctagctaccagaagttgttgctaagtgcgaaaagaaaggcaatgcgtttctgaataaattgcccgcgacaatcgcaagatgttctttttctgatgaaaagaacagtatctccaaacatacaaaaacgtcgtctttctctgcgttggaatcgtgagcaaatcgaaaggaaggaaaggaacggctcgtgctgagtggagctaggacaagttgaggaacagatggcgatcaggcgatggcgagccctacatgtcaagtgtgatccggatgctcccacgtgtcacccctgcccactgtgattaacgcactacctgcagtaggcaggggccaaacggttatggacagggagtcttgtcaggttactgtcagcgttttacctgaaaatggtaagggatattcttgcgcttctgcaggtttactgctgggtgaaagtgtttcccagtcgctttcccgaaggacatgatgtttcaacctgcaaatgcaattgtgctgagtgctgatcgttaattaattaatcaatctatagaatttatccaacttaatagtactatatttaattagctagattcgctacgttgaatgaccagctaacatcctccaccgaattccctatttcatttctctctgcatattgattgttctggttctacgggggcatatgtactagacgaatctttattagatatgaaaataatgaaacgacgcacgtcttcgagtgattatgatgtgcacagagtacaggtatgctgaaatatggatgcaacattgtgtttgctttcaagatggagcccaatatagctgagaaagataggcattgtcgcattgagttggtattatccatccaaagaacaattatataatcaatggccatcaagaataccttcttaatttgatttgagtttcaaacaagaaaaaggattcaaacaatctgatttgacaataatagctagagcccctttacttcatccagctttcactagaaatattctttgatatggtcactgtttagcagacagaaatgaactgtcgccttgaccaaatgaccagagagaactcagtgcgtgcatgcatgccagaagagtatgaacttaatctatcctggtggtagacatacgcccaagttacactagaaaaaaaatgctaaatttgattggattgcagtgccccattttattttattttttctaaaggttgctgttatcccaacttgctgatgttcaagcaaggaagtgcccatttcatgaatcctaccaaagccccaccaaagcatcaactgcaccctgtacacatgggcacatctccaatatgactaagatacgctaaccatctcttaattctttgtcacatttgcagaaccacatcttttctcttttgaaaacgtcggtaagacatatatagacaagatactcgtagctgtttgatattgatattgcacagtagtagtacaatctcagtggtttgtcaaaccgctcgttggaacaaaacttgtctttgccccctgggcctggaccgtctgcagtactagatctcattgagttctgaaaacaataggctacctcagggacaagactgatattttgagaagcaggacaggagcctggtatgccactacattgaaccggagaatcaagaccttcgttggtcatctctcttaaaaaggttcatagatcctaaagcaaaatatttttttagaggactaaagcaaattaaatttgatactgtaatatatttgaatattagataggggcaaatctttggccatttttctaactaaaacaattttggcctctatattaatcactttactttaatattcataaaaattttaacgatgtgtcggccaagaatggattttaatctattgaagggatgtcccctcatatatcttttttttctctcaaatataatgtaaatggtgttttttcgtttaaaaaaataatgtaaatgcggttatgattcttttttttttaaaaaaatacaatgcagagtatagtggcatcaatcactccataaaaattaagtttgaaatcgatctatacattgagaaaaaaaagagaaattcaggcaagaatagtgccaattctattcacacattggatttctgcatttcatttcatgaatgtacaagttaagtttagacacttgagaatctgtgaagtggtatatgtagattggatgagtgttgtaaacattttttttttgaatttctcacaaccatttaggtggtatttgagtgaacaagccgacattccctctagggattattgatttctctatttttttcatacgcttcgtgtatctctgtattaagattaagaaaatttacagcggttctctcgagcgacagagaaaaaaaaagagaagtagacaaaatgatttatctgtggtaccttaaatatgattttgcagaataaatgcctgttttagggtttaggtacaaaaacaaacaaacagagccggtccgaaagagaccggaccatgtgcctggtacatttaaagtatcagcctgtctactctaattccaaagtatcattttcattttttttttcactgaacctccacagagatgtcaaagcgtagagaatacaacaacaggaatgcatctgcatctcgtagactattagtttaataaagctccgtttccgtacttaaacaaatgaaaaaaaaaagttgattagaacgagagggctcactggagcagttgatcagagctagagtcgatgaactctggtctcctcccaacgtgcggcccattttcccggcaccaaattctgcgacgactcggctaaaatctgcgagacatgcgttgcaaacctccgatccatctcgtgatagatgcttagtactacatcatgccaaccgttcttctcccaccggccggcttgtggcatttgcagtaatcttggcgtataaacaattgcagcttggaacattctattccatgccatccaactcgttttctttagtggcaagcacaacgctgcatggctacgaattcgtcaagcctttccgcgtaatacacgtacaggagaatctctgataaccccttgtcaaagaataggagttagtgtgtgctagctagctgacctggaggaggacgatgctgtgtgatcatgtcaataaaaatcaatgcagttaggtgaggtaaagagaagaaactccatgaaaaagcatgaaagcttcctccccaaccgattgcaaaagggaaaaccaaacgaacatttgatcgatcgatcactgctcactgtcatgtcaaccaagctggcagccattgcaattgcaagccaagagaaggttgagaatatcagtagcagtggcacgtgcggctaacaaccatttctctttgcagggctcttgcttcacaccccatccggcttggcctccgacagagacccaccgacagcgagctccacttgttaaacgatgatgatctcaccgacgattctcatcttttaattggtcattttcaggtgtcgcattttcgcgccatcctgctgcaaaaagccatccctatcattgatccgctgtatacgagtgccattcttttttctggacaatggaataccacatttcggggcctccatattagttggtgaatgatgccctttccattagcttaaagcttctgaattacctgatttgaaccggtgaatatgacatatgcaaattttgatagaattgtaatgtgttgtctgccattagggaagaaatgtatatgtctagaactctatacggcaccgtgcaagcaaataggcgagctaatcatcctgtcctactgtccgagcaatctttaattttttaattggaatcgtccgagcagtattaatgtcctatttacgtgcaagtacgatgactttgttattaattactgtccttgttttgtcatgtgctaatcagggttagtttttttaatcgattaagagcgagcatgcttggtaaagctctcctaattctgcactgtttaaagacgtcgcaatgatagatcataaagatgcaatgctccattagaaaatttgagacaagatttcagatcattggtggctttctcaaaagttcaggcgatggctttcacatttgtgtggcttttcagactaatttgataatttcaggtggccaccctttgccatatattaatgcgttctacaaagctacacacatgtcccaagcaaggtactggttactaccttgcgttagttgatctactgcactgcaaaactgtctggactagggccggatgcttttctggccccggaggcatttttgctgctgttgttgttgatcagaaatcacgtgttcagttcacacatcagtgatctccaccttgcaaagtccaggcatcatctgggtacatttttttttaatagagatcttttacagtgcttgggaggtatgctaggtaccttccaatgtattgcacatccaccgtttattttttgagtgataatttagaagaaaatcaatataagcaggggtagtttagtactttttatagccacaccatctctaacttatctcgtggaccgttttttataactaccctcgaagtaatcctcgtaattctaatctcctgcgctcgtcgatctaatcattacggcctcacagcatcagtgcattttatttgctgtaccgtctattcatatatagattttagtctaattaaaactactttttccatctagttaaaatttgattcttcataatgattctctgttacaatctacacgcacgagaagcaaatattttctatttaatccaagatgcaactttcattaaccatcatcggtaactatgtggaaataaattactttgttttagattcgtattgatatatacttcagttgattaactcataaagtaccgtacgtaaattactttgttttagattgaggcgccaaacgtcagctgccatcgatctgttgcttaggcgcaggaacaatacgcacca

SEQ ID NO: 59049 - DNA, 23943 bp, Oryza sativa
  unsure (1)..(23943): unsure at all n locations
atttaaaattatctattttctaaaatgattttacttaaaatttattaaatagctatctcgttgttttaaaactttaaaagaccaaaccttattatccccgtgattctaattttatagttcaaagtcataccagttgttactccttacttcttcgtcacctccttccttatttgtttgctcgatctaccactgcttctattctctctctttggaatctttaaaaattactccctccgtcccaaaatataagcatttttagctttgaatctagacaaccatgtgtctagattcatagctaaaagttgttatattttgggacggatgtcgtagatattatttagatatagtttattatcatcattgagtttcatttttatatttttttagaagtcccatcaaacgttgtcactgtactcctgtatgacccatccgttgcctgggattttaaaaatcaaacatgattatcgtttagattcattttttactttctagaagtcccaccaaaccatcactggctttgccactgtacttctctatggttcacccgctacctgccctctttattgtccttgagattttaaaatcaaacatgattatcattggggtttattttttatttttttcatgaccgtgttgcttaatagcctatccatcgtccttgcttttaatcgtcattggattatatttggggttttgttaatagtttttagatgtctcatcaatcgttacaactgcttctattcattctctttggaacctttaaaaattggaccttatagtttttagagtttattatcttcattgggtttcaattctattatttttggaagtcccatcaaacactgccactatactcctttacgacccgtccgctgcctcatctctttattgtcattgagatttaaatcgaacataattatcgtttgtgttcatttttttactttctagaagtcccgccaatcatcattggctttgccactgtgctcctctacggctcgccgctgccttccctctttattttatattttttggatgtcctgccaaatgtcgtgaccgtgttgcttaatgacctttccgttgttcctactttcaatcatcattgggattctatttggggctttatcaatagttttgagatgtcccatcaaccgttaccactctactcctttacaggcatgttgcttctcccatctttattatcagttgtcatatgttttctagatgaattttttgtttgaaaattccataactttcattccgatatttttttatttagaaaaatatattcctactttaactcttataattgggtagcccgcgcaattgcgcggctagtacccgtataaaattattatttttacatatgattttatttaaaatttatcatttccatgtttctaatttaaagtttttaaaagtcacgttagttgctacccttgctcctctgccacacctttatttgattgcttgatctatcattacttctatttatcctctttagaacttcaaaaattagaacttgtagttttcagatttgattgtctcgttgggtttcatttttataatttttagaagtcccgtcaaacgtcgtcaatgtactccactacggcccatccactgcatcctctcttttttatcattgggatttaaaaaaattgaacataattattgtttgtgttcttttttacttctagaagtcccaccaaaacattaacggcttcgccactgtatcctctatggcccgcccatagagatatttaaaatcgaacatgattatcattggggttttactttttataagtctctccaactctcataaccgtgttgcttaatggtatgcccgtcgtccctcctcttgattgtcatttgattctatttcgggttttgtttatagttnttagatgtcccatcaaccaccaccactctattcctttacgggctcattttttctcccctctttattgtatttgtcatcgtagtgttctaaatggaccttttttttttgaaaattccatatttttcattccgatatttttttatttataaattatattcctacttcaactcttataattatttttctattttcataatttattttatttgttataccgaattttcattaatctctctatatggtctcttctttcaataattcttttttagtacaaattttagttatttatataatgtattccactctcatttttatttttgtattttcgtgtttttttattttgaatgtcaattactctcatgtcgtgttcttatttggagataaattatattcctatatgaactcttataaatatttttctattttcagaatttattttatttgttattccgaattttaattaatctctctctctatatagtctcttctttcaatagttcttttttattgcaaattttagttatttatataatgtattccactctcatttttatttttgtattctcatttttttattttgaatttcaattactctcgtgttgggtttttatttgtactcttctttcaacattgcttatttttaatttcgaattttagttattttactacttgaaatcttctttttgttaaaaaaaattcggattttattttatttatattttaaattttaattaatctcatattggattgttatatagactctcctttcaatattgcttatttttaattccgaattttagttacttttaaattgtatttttacttgaaaaattattttttgggttaatgtaggaatttatatccctcataacaagagtagagtacaaagagttagccgaggtaattgaataaatggaccagccatcaaatatatctatttctctcgtgtactggtcgtaccttctctttctttggctcctatttcttcgttattttgttggagacggcagatggaaactgtacgtgctgtgattgctttgtagtatctttttttttggtagctagccaccatagcaatcggacataaaatcatacacggacatagcttttttccctagattcctattacaatttttgtttcctagtcctagtttggtaagaaaagtgtatctgctgctggccaatttctataataaacgtatctgtatctgattaccatattaaaacttctatgctattaaatctcagcccttaaaatttagacaactaagatctaatggtgtaaagttttctctttttcttctattaatgtgagaatttctagccgccacaacgaacgtggtgtcttctttcaaagctgttttaataatataatagatagatagatagatacctggcccacattttcaagtacccacccacacataccttctgctatagatcgttggattgcatccaatcaacggatgccatcattcccaagcaccatagcaggtctctttttaataaaaaaataaagaaagatacacacagatcatcattccctctgtaaatctgtaactccatcattccatcaggaccgaaataaagctggaattcgcttgccttagaatcaaatcaagcctgaacctccggtcatcccggctgctgacagtaactagtggatgtgagtaaaaaaaatcaggacactggccgtcgagtgaacggaatttacccttgagattctccggccgaagatagtgtgggccttgcacgcgatagccactgtaaaacatcgggacaaacctgtcacctgctcgaacaagctaagatcgcgccatcgtgtggctccagcttctgcaaacaacaagggaccgtatattcctggagctagatttttggctgtgtatgtatgtagccaagcaacccttgttcaagtacaaaacgtggtacatatataaatgcaatcttggtcgaaaagaccggcgatttggcgtgtatatagccatcgcggtaatgacatttagccaagctattagtaaaagtgaacatccttttcagagggaacagcaagtgatgagcaagatggtcagtattgtaccaagtgattaaaaaaatgaagaaatgtttgttaactaaaaacgagatttacagggaaagtcatccctccaaatatattttttaaagaagacattatgaagttgttttactaaattggtatatattatgagcttgttttttttttgcggggatattatgagcttgttgatgattgaacatgaaactttagacttaaaatcacacattatttaccactgtgttaagtgtatctaatcgttaattaggctagcgatccggtcgcttttggtttatttttccaccctccgatttcttccggtgcctgccagctacctgcggcaaaggccaccacacgacacgcaccaacagacccctttccggcgcgggcccactcggtcaggctcagaaagaggccagccaagttgccccacctaacgcccgcctccctgagccgtccgttccccatccgatgtcccaccacccgcccacgtgtccccccttaccttgcctgctcgagaaggcaaaggctcgcgatgctacgtgagccgtggatcttgtatccgacggcggaaatctccccccgcgcgcagcagcaggcggtgcacacgacgtcgtcgcaacggctataactggagacgacatccgcgcatgttacccgccatatctgtctccctctccccttctcatctcccgagaagtagtagtagtagtcgtctagtagtagtagcctaccaccacctccctcggcgagcgggtcccaccggccaccgtccgtactccggtgagccggcattgcgtgttccgggatggcgtcgccgtacgaccaccagtcgccgcatgcgcagcacccgtcggggttgccgaggccgccgggggcgggggcgggtgcggcggcgggcgggttcgcgcgggggctgatgaagcagccgtcgcggctggcgtccggggtgaggcagttcgcgtcgagggtgtcgatgaaggtgccggagggggtgggggggatgcggcccggtggcgggaggatgacgcggatgcagtccagcgcgcaggtggggctccgggggctccgcttcctcgacaagacgtccggcgggaaggaggggtggaagtccgtcgagcgccgcttcgacgagatgaaccgcaacggccgcctccccaaggagagcttcggcaagtgcatcggtgagtccccggcccgcagcttccatcgatggtgcgatccagaaacagatagccgtaaattcagttccaaaagggcgattagttgttgctaacaagaacacagcagaaatatctctgattgaaggaatattgtgttggcgccatctttcttgttttctgtcaatcatttttatgctccgcaacagttgtgtgatgatgccgtgaactgttcatctttgcccaaagagttggcagggacagctctgcctaactgagatcggctctttgcttctcaactaatcccctcgaattaatgcttttgctttgcgaaatggtccattattaagcagtaaatcggtacagcaaaagaaacgagtactctgtacttctcttttgttattgcacatgcttacggagaaaatggagttatagcgaccggttcatgctggaggcagttaggcgatcgatggaataataatcgtgtagcgctaagcgaatcatttctctttttagatagtttggatgtctaacaatgcccatgattcatgatcttttaattgaactaagaaaaattaatccatggtggatctgcttggcatcaaaaggcatgggggactccaaggagttcgccggcgagctgttcgtggcgctggcgcggcggaggaacctggagccggaggacggcatcaccaaggagcagctcaaggagttctgggaggagatgaccgaccagaacttcgactcgcggcttcgcattttctttgacatgtaatggttcaccgtcccagttataatttccaagatgaacacgataaatcgatcgccaactgacgaaatggattttttttttccttccccctctctctgatgcatccaggtgcgacaagaatggcgatgggatgctcacggaagatgaggtcaaggaggtgaggacgaaagaattcttctggattggatctcatctgccattctggaacatggagagagaggattaaatatcgttttcttgtttggctggaatggatttgcaggttattatactgagtgcgtcggcgaacaagctggcgaagctgaagggacacgcggcgacgtacgcgtcgctgatcatggaggagctggacccggacgaccgcgggtacatcgagatctggcagctggagacgctgctgcgcggcatggtgagcgcgcaggcggcgccggagaagatgaagcggacgacgtcgagcctcgcgaggacgatgatcccgtcgcggtaccggagcccgctgaagcggcacgtgtccaggacggtggacttcgtgcacgagaactggaagcggatctggctcgtcgcgctgtggctcgccgtcaacgtcggcctcttcgcctacaagttcgagcagtacgagcggcgcgccgcgttccaggtgatgggccactgcgtgtgcgtggccaagggcgccgccgaggtgctcaagctcaacatggcgctcatcctcctccccgtgtgccggaacacgctcaccacgctcaggtccacggcgctcagccacgtcatccccttcgacgacaacatcaacttccacaaggtgatcgcggcgaccatcgccgccgccaccgccgtccacacgctggcgcacgtcacctgcgacttcccgaggctgatcaactgccccagcgacaagttcatggcgacgctggggccgaacttcgggtacaggcagccgacgtacgccgacctgctggagagcgcccccggcgtcaccggcatcctcatgatcatcatcatgtccttctccttcacgctggccacgcactccttccgccggagcgtcgtcaagctgccgtcgccgctgcaccacctcgccggcttcaacgccttctggtacgcgcaccacctcctggtgctcgcctacgtcctcctcgtcgtgcactcctacttcatattcctcaccagggagtggtacaagaaaacggtaaaattctcatcaggcgctcgatcttcctgtgactgcaatgaaattaagtgacatcatctcaaaatgtcaatcttgttcctgcagacatggatgtacctgatagtcccagtgctcttctatgcatgcgagagaacgatcagaaaagttcgagagaacaactaccgcgtgagcatcgtcaaggtaagcagctgactcatgtaactgggatccattctttcttagctgtttgcctgttactcataaaattggtgatgtgggtgtggcacatgcaggcagcgatttacccaggaaatgtgctctctcttcacatgaagaagccgccgggtttcaagtacaagagcgggatgtacctgtttgtgaagtgccctgatgtctctcctttcgaatggtaaccaattcacccttgtcgcatgaatgcatgtccaaaatgtggtttatctgagactatttctaactgtttttcctgcctttgcaggcatcccttctccatcacttctgcacctggagatgactacctgagtgtgcatatccgtacactaggtgactggacgactgaactcagaaacctgtttgggaaggtcagttgaggcagcacagctgcaaagagttgcaagaacaattagtttccctcgttaaacaattctaggagaataatgcagattgccaaaagatggagaactaaatcttagtattcatgtaggcttgcgaggcacaggttacttctaagaaggctaccctttcaagacttgaaactacagttgtggcggacgctcagacagaggatactaggtgactagagaagctcttctatttcacctaccaaatgcatttggtctacaatcattttctaaccctggttatcttcacaatgttgcttcaggtttcctaaggtccttattgatgggccctatggtgcaccggcgcaaaactacaagaagtatgacattcttttgcttattggtcttggaattggtgctactcctttcatcagcattctgaaggatctgttgaacaacattaaatccaacgaagtaaaattcttccctgataaatagtgtttccttatttcctacaatgttgtataactggaggaaatagataactaaaatgagttgatggcaacaggaggtggaaagcatacatggttctgagataggcagcttcaagaacaatgggccaggaagagcttacttctactgggtgaccagagagcaagggtccttcgagtggtttaaaggagtcatgaacgatgtcgctgaaagtgatcacaatgtactgtctcactctcaattcttcgctgtattttcaaatttccatagttccttcagtcatagatagaacataaactaatatatgtgggaattgcagaatattatagagatgcacaattacctgaccagcgtgtatgaagaaggcgacgcaaggtcagctttgattgccatggttcagtcacttcaacatgccaaaaatggtgtggatatcgtctccggcagcagggtattcgacatcttccccctcttctatctgaaatacttatttatttccagtgtattcctcttatttctgattgatctgttgcagattcgcacacattttgcgaggcctaactggagaaaggtgttctctgacttggcgaatgcccacaaaaactcacgcataggtgagcctcttttttcagcgaacatcgtcgatgcaacaattttgagctttgcagtaacggttgttaacaaatccataaatatgcaggtgttttctattgtggatcccctacactcacgaaacaactcaaggatctttcaaaagaattcagccagacaaccacaactagattccacttccacaaggaaaacttttaagaccgtaccaaaggacgtctaaacagactgcatatacttgtataggaaagaaatacgatagcattgggatagcaaatatagtcttacaagttttgctctacgatggattgtacaaaatatatgttgaaagctagtgtcaccatcgtgcatagattctggaatgtttacagatatatgtattggaacagtgggaatgcatgttagaaaaattgagttccaggtggtgcgccttgagcatgcatattttctctcttcagtctttctgccttcgccagtttttctgccctgactgtctgtgcattgcgtataagaacactattttgtggtgtgcattcagcactctgagcatttccagacaagttcctgttttttggaggcctgcctcttcttttaggctgagtattggcaggaatagttgcatcctttcgaggatacatagttgcatcctttcgaggcctgcccctttttctaggttgactactagcgttaacatatgcatcgttggatgtagatgctggaaccaacgctagtaagttattggattgatgttcatttgccgctccagtcatcatctgatcttccatagcattgtttgtgttgccatccgttatagcatagacttttcttggtctacccaccttaggtttgaagacaggagctgtattttgaagtgcgaatttatccgaaataagtgttttcagcgggatagttatgtccaatggcagcatgatctcctccacttccttccactcgagatcctcctggtctccatcttgatagacaacactgtaccagttactttcactatcatacttgtccactttccctacaaaatgcttgtccccaaaaggtttccttactttccgcccttctagaaattcaccaaaacgatgatcaacaggaggttctgcagcattacgtggctcaggttgtgattcggatgctacatcaggaggcaagtctggaactccattgataatgacggcaggctctctggcaactttgatgacagatgcagtctttgattcttgcatgccatgaatctcctccatgacctaacaccgtatcagttgtccttctatgtagctataacagcctggcacagagaggatataagaaacaatgaaacattcccaaactaagaaatcataagcaagcttagtccacagaacaagtaatcatgaaccaagcacttcaaagctaatgtaacatatgaagaaacataaaaagcattggtgagcatctaggaagctagaagcaccggtagttcacacatgtgacgtgatggttccatgatacatggcaggtctcagtatagcagtggcaggtattgctggagtacgcatgcctgttcagaaaaaaagaaattttccaacaagtgcggtgctctgaaattctgatacgtctgagccagtaaaattggcactgcatctaacccttgccagttatctgctgccaatctcagcactgcactagagactgaactcgaccatcaactggtcatgttccatttggtggtttactgctaatctaaagatcaacttttaaaacaaacaaaggccaattaaaaatataacatggcttgttccattagctctaatttcagaaataaatgggacatccaagttgaactaaaactaatttacgcgtttcagaaagggtctacctacaacagcaagtatctgtttttctcccggacgtaagtacaactcaaatccaaaaaaaaactgtattacaacattgattagaaaacaaatagaagtagtacctaaatatattccttaaaactagctcataaaagttcaattaattagaactcagcttcccaaatctgttccagaaccagctatctgaaagttttgatcacaaaataacatcatacacaatttggtgagagaactaggctgattcacaaagactcagagttgaacaaacaaggatgatgcctcttctttctgcattttacaataaaataaataagcagtttgatgcaaaaaaaaatatgataaaaaaagtaaatcaagcaaaacaccaagattttatgcccttccccaatcaggcttgccacatatgaaataaatcttccaacgacaaaaaagcctaagatcaatttcttcattttgcatgcaaaagtatgccagttgtggacacagcacattggacctagaagctaattcagatgttacaaaaaaaaaggtgtcatttgtgttagcattgtaaaaaccttttttttttcaagttgaggcaggcagcgttcccacatgcttttgagaacatcctaaaacgacattctcttctctgttttcggttgtaattagctaccatcataaagaaggtgaggaacccgtgttatcccataatagaaaggcagcactttaaatccaatgcatcatttctgatatatgaacatgttgtctatgctagggctctaaacaaggccaaatcataaaatttgttaagggtacgaggctacaggggcgaatccacgtacatgccatgtgatgcacaggcacaggctaaactttgacatcctaatcgtagatcatgttaccatgtaaacatgtaaacagagtattagatctaattcataggtacaatgaatgggtgggcataaaaatcccacaaccaaccgaaccaccattttttaggcctttgggttgacctttggtttctgctataccgcacaaaaccgctctctctcgccccagtgaggatatagtgcaccctacatcgtttaagtcaattcagcacaagtttgcaacagaattatcaatttaacatataaaaccatctgagcagagggcctaggccaccggttcatcagatacccaacagatccaaacggatgcacaacgcgcttcgtttactagacaaaatggaggcggcatttcatcgaacagaaagctctcgcagtataccaccgcagattatgatccaacggatgcacaacgtgtttcgtttactagacaaaatggagcaggcatttcatccaacagaaatctctcgaaggaatgtatggatggcagattcagcggactcacctcgggcttgcgctctccctgcggggaactgtgctcgcgaaactcggagggctctgtaggtacgcgccacccccccccccccctttcgcgggtgagagacctcgctcgccgtcgccgggtcgcacaaaccctaaccctccgacgagaagggcggggggtagatcctgacggcctggatctggcagcagccacgcagtacgatgggagcgcccgcaaaggtggtggccgttgagggaggcacggcgccgacgagaggcgggcgcgcggtggccgccgtctccggagaggcggagacggcgagaggtgagcgccgcaggcaatccctctgcgaagtgggggactggacagcacagccaacagagtcacagggaagatggggagcggatttaggtggtaggtattgggcttcagcctttcggcccatgtaggtttggatctgtttctggaggcccataaagtgttttgggctggctccatctcggctatggaagtgattatctaatgggccttctgaaactgagtaatttctttttttgttagaaacaaaacgcaataatttcactatttcagtgtacaattcaatgtgttcttttctttagcaatggtatacgtacaaaaattttattgggaaaaaaccgctcaaaagtttcacgtgttatcataaacgagaagttagattatgctaaaaaaaagaaagaatttagatgaggttaggtgtttgtacaagttcggtaagaaatcctaagggattgtttactttatagatattttcaatatttccaaaattttagcaaattagtaatatcaccaagttttggtagaatatactacatatgatgttgtcaattatctagacatggcaaatattaagtaataaactaaatgttgtcatatatctgttaattttaataaacaatgttcatcgcaaaaaaaaattaataaacaatggtatggtttaatataacatgaatctgaacatgccctaagtctaccatttccctttttaagagagataaaataaactttggtatatttgtatagtacctatgcatttttttaaaaaaaaacacctagtattatacaattgaagcgaagaatgaaaatgttttttttaaacttaagttttgtattaccgtttccattctaaaattaatattagcatcttttaaaaacgtagtccaaaggcgtaacaatttttcagaggagcgcagttcttttaaaaaaaatatagagagaggaatgcatttcttacgtcttcatgacgttaatgattctcttggacgattttaacatttacctgctcattgccatccaatagttttaccgcgttatcttaaccatgatcttacatcagtaacatcacctttgtatataccatgaattttgacgctacatcatgcatgtcttctcttttttttactgcgggtggtaactgtgatagagactttcacacgaaaacaacaaaatgatcatgttcctttcacttgggaaatctgtgtctgctgaagttctttgaccacccaacaaaatcttggtgtgttcacatttcagctgctgtcatgcatgaccccaaaatgcttaagctactacgcctaattgcgtttaatagctaacaagtggcaaggaatcactagctagctagtttacaacttccatttgcgggaattacttagaacactttcattaccaattaccactaaacaaattcaactttgtgttgtcacttagcatttctaaatagtaatatttatgcccctttgctgattccatctttttaccatgttctttcccccccccccccccccactgaaggaatttctgcagaaatcttttgacctcattgtcacattcgttgtcctgtttgtccttaatcttgaatccgtccttaaacaaattaatgatacttttccaatcaagatccctcgctggagtgcgcaaagatcatatctttttgtttttttgttctaacctcaagtaagagcttgcttattggtgaagtggttagggtgggctagtaccctacatttcttactagggtcaacaatagcatccaagtgtgcacttttagatgttaattcatgccatgtgttttgcttatgattgatttatccgtgaaagcaaggccatcatttgattctttgggccttacactggtgtaagcaatctccacaatactataactatatagagagggaatgcaacacctcacatgattcccttgttcttccttcctcctccacttgagaaagtggtttggtgcttctaattgtaaatggtttcttgattattttgcatgctactacaaatatgctttgccgttacacgccattgctggtcacattctcttcataaattgtaatcatcatgaagctaagtagctagctagctaatctacctgaagaatagcacattagccaacatcaactgtcgagcggcgttagctgaacaaaagaaaaaaaaatgactcagcttagctgaaagagggaggcggcattttgactatattctatatagtcgcacgttcagcaacagcaattacaaaattggtacatgaacttagcacaagaatttgtgccaaaaagagtactaattacacttgaaatcatagctagttaagatagattatctgcacaaagtactctgcttaccggccgacaaagattcggcagccaccctccccgcctctacggagagagggaaagagagatagccttgctcaaagctagaaattccaaagagtcagagagagataggggcagagagattcaacttctgcttgctctaaaatatatactaaggaagtgggagaattagtgcgcccttaattatagggctctcccagcataataatctcctttcctcatccctaacctatatgcagcattagaagccatttgcatgcctttggaaacttacttgacggaaagacaagaactgcaaatggccttcatgtgagcttgggaatgtctgatgttgtaactaaattattaaaaaaagcacggtacttagcttattggtagcccgcagtatatagggattagggagatgtcgacctccttcctgtcagtgcaaagatgcaatggtcactttcatgacataattaaatcgagcgactgatcacatgaatcccatagtcacatgcaaaagtataaacactcacatagaagagtttgaatcgaagtgatgatccttgctagctaatggtctatgctgtcacatgccattatgtcctgcctgtagatatatgtgtttgatttgcacttgttttgccttctctgattgtaattgtaaacaacaactgactgtcaaaactcaaaacctctttctcttacagtcaggagacttctgtgcatttttctaccgtttcttacagtcaggaattaaacagtatctgagaaattaaggaaggattctgctaataactgcaagagcaataatacattaactcaacatgcatggaggcttctcaattgctcttctaatcattgattgagtcgcattatatacacttgggttcttattcttgtttgactcatctttacggtatcatgtcctggtccctggcccggcgatggtgccggcgacgatcgtgcccgttgcgatcagtctaaaggtgtgattttttttggaggaggttcttgcattgctttctttcttctaactctcatggatgcatgattcccaaaatcgagctcgagatagaggcgaggattggaactgaattcgctcttgcccgttgggtgattttcttgccatgtcctttcgctacatttcattttcgtgctacatttcgaggcgcaattagttgccgctttaaatgttctttggtgataaaattttgcgattcttttgtgtggtcaaaagggtgtgctaatagtagagttaattgtatctgagctactgcgaatcgaatttttcccctcggtgtattctgtttgtgataactcggtttatcttcgtccagaaattttagccgcaattttatccccatatatgctcatttgtattatagagacatgacatccacaaagctaaaaatgataagaatccgggaatgccgttcctaaggaagcaatccgtcttttggtaaaaaaaaatgccaaaaatatcagtgttcctatattttgtttttgctaaaattttgaggggtttcggttcaattagaggacattggatcaattctaccagaggattgttatggttcaacagttggtactcccgttactggtaccaccctgtaccaaattatatccaaccgttgattctttaaggtacgattgagagtagagcatcggtctcggactctcggtcctcaaggcgcgattattttgcatcttcacggatgcatctaagtcgaaggtcgcggctcagcgaagcggtagtggctacgacggcagaattgtgtgaaaggcaagggaagacaacatcgttcatctgaggaaagcagcggcggcggctgaacgagactttggatattgtttgcctggagatattcccttgctagccgcatcctcagatcagatagaccaaacaaaatttaacatgaaaagtcaaatttaccttccacatcttgttctagcactaagtaccgagttctagcagccgttcgattgatccctagcatgttgaacggtgaaattccttattctacaaacatcacaaatgactgaaatatgtctccacttaattaattaaagcatactcccaatgtttttttatttgttgttaaggacatcaatagagacggtcagcatacaattttttgtgcacatatttaatcacggcctattctaaccatatattcacagctatatttaaaataactatgttattttcataaacaaaatgttaatacttacatatacctatgagttaatattataagtgttcaagaaaaatatctatcagagaatggaggaagtcaacatccctatttcctcctatgtacgagtgatgccagtatgccaccgtgcccataacctcagtcatagttctcccaattcccgctccctctgttccctgatacaaacatatgtaggattaaattttgtatgcaatataagtatttctcgtggcacaatgattctaatacacaagattgaaaatttatacgtaatataaatattttttgggacattaatacacatgaatttaagtatttaatttttagccaatcagatacttggggaataatgtgaggaatttaaactgaaacataatatttttctcttaaccttaatagctaaacaatctagaaatattaatattagtgacagatggagcagtacttagcaccacttctgtttttcttttctcaaccctaacgacctcacctagccactgagctcctctaagccacaatagacaaaatcaagtagaaacaatatttcacataaatataatgattttgtggcaactagttagtactagtaaacaagagttgagaaagtagaaacattattccaccggttgtccggttcatccaacaagttgggttctctgcacaagtaggatatatggccaaaaaggtccaaaaatgttatagtagtatgcagatgtttatttctcaacgttgagaatttttttcgatccgattacatgaaaaatgtataatacacacacttctactgtttgtccttttcttttcttttctaactctattatcccctttttacgcacataagttttccaaactactaaacgccatgtgtttacaaaagttttctatataaaaattactttaaataatcaagataattatttttaagataatcatacactaattcatcatttcattttatatgcatggagggtacatccccttgaacatactctcaagaatcatccggaaatctttggtctcactaaattcctagttaaaacacatccatgtatatttagtaatggtgtttgaacccttcattgttgagcggcaaaattcttttttaaaaaaaagcatacgtgctccaactctcgttccatttcatcagatttcataacaaaatactcttacacaatttgcaatcgccggccgaattcttgggaattgctcgaccagtacaccaccgctagtccacgcagttcgtggggggaaagagcgagaccgaacagctaaccaactgtagggcggatcacgtgtccgcacgcgtgcaggtagccgggccaatgggaactcgcaacgagggagggaaaggcggccattaaaccctctcacccaatgcaaaacaaagccgagatcagacatcatcgccatgggcgagggaaaatcgatcgatctgtccagcagatggttgcgcgtcacggacgcctcgcctgtggcagcgacctcgccgacagcgatccgcacccgtttgacctcgccgtctcgccatctcccacatgaagggaaccaacccaataatcccaccctcccaccaccgaagcctgaatcaaatacgagtggaactgcatggcatgtcacatcgcgtcacacttgatcgtttggtaataaaccttttttagacgagacgagcacggacgctagcttgcgctgcagggtgcgagcagcactaacaaggaggaggaggaggaggattcaggctcgttcagggctttgtggaagtaactgggaaatcacggagcagtagtagtggtagcagcacaagttgttcgatctttctcagtgtccggtcacgagagaaggtttctttttgtccctctttttttcttttttttcgtttcccagctttcatgatgtttctggcgaaagttacaataatactacacacaagggaaggtcaacgacgccactctgacctgacctgacctcctcctctcgcgcgctgcacactggcgctggcgcaccactacgctgcgcaccggtcgcccgcccgcgcgcgcccgccaccctgagctagctagtgcgtgctcgtgctcgaacaccggaccccaccgaccaccaacaacgacgccggcctacgcgccggtagatctccagctcgatcgttcgctcccctgatcggcggcgacagcgtactacgaggcgaggttcacggacagcatgtcgccgagggtggcccatatctcctcgtcgacgtcgaagccggcctgccgctgccgctccgcctcggcggtggtggcgcccggcgcgcgccaccaccactcgccattgtcgctgccgccgacgacagacgcttccgtcgcggcgccgtccttgcggttgtaattgtagcagctgttgacgctgctgctgttgctgccgctgcggtagtcgctgtagcccgcggcggagtagtcgtagctgtagctcgcgtcgaacgcctcccgctcgtcgccctccgcgtcggcctcgccgttcctcgcgaaccggcctttcaccctcggccggctatccgccagcgtcttcctgcacgcgtactgcccccaaacacaaccaaagcgtcagcacgaataatgggcgatcagagtgcaatttttgagcgtggaggaggggaatggttacagtgatcttcttgttgaagttgcgttgatgccgcttcacgcgatacctctcgatcctctccttcctctcctcggcactgtaccgcccgaccttctgtgagaatggcccgctgccgtcttgcccgcagctttcgccggacgggagcggccgcggcggcgacgatccgttcatcccctgttttcgtcaggacacaattcgtcagtcgagcttccatgaacgcagctcgattggaagtgtgcaccgtgcagttcaagctgttgcatgcagcttatattacctggaggtcgccggtgctgaagacgcggcggacggggcatggcgaggtgaactcgaagaggtcgccagaggaggaggacggcgaggaggagagcggcggcggcagaggcagctggtgggaggaggaggacgacgacgagaagaatgcgccgccgaagtggtcggtgagctggaggtgatgcgggagggagtgcgagctgatgctcctctggatgttgttgtagtaggacgaagggagcgacgaggagtaggacggcggcgacgacgacgacgacgacaccgcccctccgaagtgaggtaacccgccgctaacattgccgtcgaggtagccgccggcgacgcgagggatctgcgtcgggacggcgggcaaggcggccgccggcgagtggttcatgaagctgacgtcgctgccgtaggaggccgccgacgaggcagaggaggaatggcggaacatggcttctttttaatttggacgtaaaaaaagccttgggacttcgggcgaattgtgtgcttggggggaagctcaagtggagggggcacggtataagaaggggaactggggaagggcatggcgcgttatgtgcgctggcttatggtgccatgcactgtgagaggtggtagggtcaccgctcactcgtccatgcagtacaaaaaaatcttatcatgtcccacgcgaactataccgatatatactatatcggaactcatttcacaagtcaaatcgaatttagatggtgtgtcttgctaaaagaaaaaaaaacaaaaaacattatgcactgcaagaccgagagtggtcacatctccactactcctatattacaaggtaagaacaagtttaatattatagcactattatctttaaattatctatagttaatttaatagccaattcatataataattacatataaatatataatatagaagtaatattttgtcccatctgtcatacttgtagtctgtgttgtggctagctacaaatatgtagcccactacttttctctttttttatttatcttatcgatatgtatttatagctttatagctgatttatagtcggttattatacctacactataagtagaacaactaccgatatgtatttatagctgatttatagtaagttattgtacctaagctataagtagagcaactggtaggactgtaggagggttgaaagtatgcgtgtacagggcatctgacttttcttccttgtacaaagtcagatttcctgatgctgttgataaatttacttgctactactactacaacggttaggtgatatcagccgctgatgtaaaatccgacggccaagattttatgctcttgtccctttacagtagttctttacactcaacagatccacatatcattacccgtttggccattagaagattgcctagactggagcatctactggaatatttgtactgctgaattgtatggcataggcaatagtccttaaaaaggttgttttaccccttttatttatgaatgaatgaatgaaaggtgctattggaaactagatgcttttgccttgaaaacaaaagcccgcgaaatattctcattagccccctttcataaaagtcatgctgaagttaacaatttagaggaatgagtataggtgtcacagctagggaatatgctccaactaattacacattgattaacaaacacaacgaagttgatgccagggacctttctgtataaaatcagatcaatagggtacggaggtacagcttactgaaagatatttttgcgtgtatggaacgtcggcaagtacgttcagagcaattttgttttcacggcaggaaacataaacaagatgattcactgggtatgccgtatgcgtgtttccaattttaagcaagcacaccataaaatgagagaaattaggtaattgaaaacttataagcaaatcgacaaacagaaacagaaataaggccttacccaaatacacttgttgacaaactttgacagcacctgtcaaacacagcaccaatcttttagaacccccatgttttgacctttgacttcacgtcacatattgccaattaaatccacttactgagaaaaacagaatagtaatcaacactaactgaaactggaccattctctctctgagagtgagagatctagagagggaaatgaaaagtatagaattcatactgtagttagacaaagatatgctgcttgccagaagcagactctgatcacctgtctcaacatgccaaactttaacatcgaatcggctagagctccagtgctccacctagtgttccttatcttttgtgctgtaccaacgtccatgtacgtagcccatgagaatgagatgtatgtagtgctgctattagataaactagagatgcttttttaaaagaaaactagatgctttccctccaatattccaatacagtttgatacagagatacttgtatagttgtatatatgccattttcaaagatcttatagggttcattgttgcacgatttgcattatatgagaggactagggaaaaaaaagaagaggaaatcccatcactcgcctcttaaggcagaagaaaagtactgaacagggtggttaagatgatgggttagctaagactgtttactcatgaaacaaacgcgtgcatggaattgcaacaagcacggtgtgactagaacaggtgatctttctttttaagttgtcaaaaggagatgtaagtcagttagtgtacttgcatggactagtattcttttattgatttaacttaattattgatccttctaacctcacgctatactccaaatgcttccatctttcaatgtatactgctacttgaactgtctacatgttaaaaattatgtcttaaagccatgctttaacaaataacttgtacaattaaatctaaaaatttgtcagttgatcatggtagtcatttagatatttccttaagtttacaaatttctatcattttggcctggaacattcaacttagtttattcatgcatagttgcagactacatttagctacacaatcatagtctgttgcagataatgccttaattctgtttccatttttcctgtaaaaaatctaagaatacagtcataattcataaggttctgtaaccaacgttgactataacctaaaaatgcagagtgattgtcctatactacaaggttcctaaactgaacaactggatagacataggcaggacttgaaagcagcttcagaagttgacctgttaggcttggagtttctgggacgcccatcatcttgcacactcatttcaggcctctgttcttgcagaactatgtttaaaataaacaatatatacaacttctaaactagctcatcgagcaacaattttgtagtactgttgcagtcgtgtacttaaagtactatgcaattatagaacgataaaacaactatggagcatttcaataaggagctaaggaccactcaatagtcatacgataaaatgatttaaagcaatgtatttcacctcgaagttttatcggaagtagattcagacctacaacatttggatgagctttatgagattcaaatctggcatcttagcatgtccagtcagtccatttcatatttctttagctcgcaatatctaacaacatatcaaggagaaacgttagccattttcatcagatgacatgaactagatgaataaatagtttctttttgtttttctttaatgatttaacaagacatttttctcttcctgaaaaattcaaaggagttaactttttggagaattttgaccaggtctattagaaagattgacagcctaaagattgatctcccaatgttacaaacagaagaagaaatgcataatgacaatcctgatggtgtttaagcctctgccaaacgtatttgttcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59050 - DNA, 1839 bp, Oryza sativa
cttggactttaaaataatcccactaacaaacttcactccagaattctccgaagcccctagatgcacaccctgtgagcattttttttttgtgttacagttttcaatcaaataaggtcaagtgtttaagtacgaaaattaaatataagacctgttcaagtaaataggcatttccatcatccatttccttgtcatatatgtgttcatctagctcccgctcagctggagcagcatgattgtgagaagaagcaagaataccacctgcctgcaagaagttatttgaggaaaatatgggaggaagcaaacaaaggaggaagttgagcacaatcgatattactagactggcacagatagcagctacaataaaaacttgtgattgctgagcagggttactgttcacaatttaaaccaaataaagtgactactcatcagttacaagcagcatgctcttgtcaaattctatgttttttataaagaaagttccatatgcctatcatcaaaaggtgtcatgtactggtgctgatttttttagttccatcttaacagtcaaagaataactggaagaattaattctatgttttcaaagaattgagatacaacctttgacaagaccatcttgaattcaagaagctcattgtatgtttgtagtagtttctcactatttgtattcatctcaagcagatcattctcatgctcgcgcaattttgcctgaaaggaaaaaaggcaagtccttaacaaattattcattttttccttcaaaatagctattagcttcagaaataacagaattgaacggtaataaagacatgagtaatgcacctctagctcctccaaatctatatctggttgcattgcaggtcgaacagaggactttacacctgccttgttgatctgatcattgaaaaatcttagtttgcgtgacatttcagagcatcgctttacctgtaggagaattgaaccatacttaacaacatcaaactacgtaaaagttattcagcagaaaattctctgcgtcaggcgggaaacacaggtgtcaatgtgcatctgtgcatgcacagaagtgacagttgacagaaaaaatatcacaattacagcatcaatctattatattctggtggaacataaataaataaaagcaaggaaccagttatatatattatgaaataatctctccttttttttaatatatgacaccgtttactttttaagatacatttgaccattcattttatttaaaatatatatatatatttattattgattttattgtctcttgatttatcgtcaaatgttctataagcatgacttaaaaaaaattacatttgcataaaaattttgaataagacgaatggtcaaacgtgtgtcaaaaagttaacagtgtcatatattaaaaaaacagaggtagtaacttgattggatcacgattcaaggtatcgatgaatatagtctgacataagaagtaagttcctccaaaatatttctcaacatgataatccccgctgcatgcttcctaaagctaaacaaggtaaccgcctgacttgtccattcactagtcccaagtaaacaatggtggtactccctcatcaaaatataaggcatactgttttctctgagttctattaaaatatagagcttgcatgcaaatttattgatgctttaccttattttccccgatgtatactttgaatgctcactaatcattttctctataattcattaattccctaggcattttaggtaaacaaaaatggcatgctcattttcagttatgttctcttgattttataatcatcgtaatatttctgcacacacaaaatccaccttaaattttcaggagagtat

SEQ ID NO: 59051 - DNA, 2569 bp, Oryza sativa
taaaatggtacaaattacaaggcaaagattcatgcatagaccgcaaaacaatgagacctgctaggatcagctaagcacataaatgtatttaaaccatcaccgctccaactcatgcttagagcaagtttaatagtatagctaactattggctattagctcatactaaactaacatgtatagactctattttttgtgttgctagctcttgcatgagagccaacacttctcatttctctctctctctctctctctctctctcttccacataagcttatagttagcttatagcgcactattgtccttgctcttatcataggataatctcgcgcaatagcacattgtttgattcgctccctaacctaatgcatttatatgaacaccgcattcattccctctgatctaaaacaaccccgccacccactatccaatcaacgtagcagcccaaaccagctcagacgacagaaacacgcgagccgtcgcgatccagtgacaccaggcaaaaaaaactagtcctccgatctgagcaccgccaaaaaccagatccaacatgagcggatagcacgacgcgcataagcgagcgcggtagagatcacgattcacgaggctagatcacacagatccgggagggagagaggggcctctgatgcgggcagcgactggcgccgagagcgagagatagagagagagagactcacgtccttgaactggaggagcccgagctcgccgaggtaggtgacggcgaggcgcgcgctctcggcggggatgatgagctgcacgaagcacatcttctcggaccgcaggcggtccatcggcggcagccggtcgaacacccccatctccccggagcagccgccgcctccgcctccggaagcttccaggaggttcgcgaaggccccgcgcgcgcgaggagggagagggagcccggtggcttgtctcagatctgaggccgcgggttcggtctccgaacaattctatttttctcccttctctgaaattctatagcgctagtgcgcaactgccaataccgcacggaagagagaggagaggaggcgcgcggggggggggagggaagcggctcggaaggcggccggtggcagtggctggcatgtgggcccatgcctccctggccctgggtggtgggcgcggatcggtcgcagtttcggtcgcctgcaactccagtccctctgggcgcctcgcgtttcgaggttttcacgcgggtgtagtggtgtaccgaggccaccgaccctgtcggttccgcgtggccgtgttggttgggttgggtccttaatttggggtccctccagagtccagcctgagtgcctgacgagtgtgaccggtggcagtggcagtggcagtggtgggctggtggcttgatcgacgtgggcttcccgtcacctcatggccagaatatacgggccgtatcagatttcagatggaataagttcaattcgtgactcttaaaagtaagtgatcaaaatctaatccatggtcctaaaccacaaaaccggatatatttaccccaaactcttaaaaccggtgcaatttgacttcctaggtggttttagagaacggtttcgctgacgtggcacatacgtgacagtattaactcggtcttctttccacgcggtgttgacgtgacgcttaggtagcattagaaataaaaaatatgtatgggatccattagtcattcacacacaaaataaaaaattgtggggcccactgacatgtgggccccacatgtcatcccctctctctccctttcttcttcctcccttctctctttctctctttctcttctctccccttcggctggccacggggagcacgagcggctggagctggagcggcggcgggcggggccagagcagcggcggcggtagcctctccatcggcctcgccaagtggagagaggagatgagaggagagcaggtgagggaggaacgaaggtggtgggttacacgagaggcggcggtggcgcttgagggccggaagggagaggggagaagcggagccgctgagctcgtgttgtcgccgccggtgcctcctcccgcactcgcgctcgcccgcacgtcgccggagccgttgctcgacccgctcgatgcctccgccgtagacgtctcgcgcccgctgccgccgtcgacgtcccgcgcgatgcgaggattgatgcggggaggtggtggacgacggtgacgaggagctctaatcccagggatgcggatggatccgaaaccgtagttggctcgtagaccaccgtccccccgctcgatctcgttggcgtcggcgctgccgtcctctctcgcgtcagctatagtccgccgccgcttcagctctcgccgaccgccaccaatccggcccacgcctccctccaccgctgccagctccagcctatcaccgtcgccgctccagctagctcccgctggccgcgtcgcttcagaccccgcccaccgccgctcgctccccgcagacggccgaagtggagagggagaacagaaagagtgaagggaggaggggaggtccgggaggaagaagaaagggaagagatgacaggtggggcccacatgtcagtggg

SEQ ID NO: 59052 - DNA, 5264 bp, Oryza sativa
  unsure (1)..(5264): unsure at all n locations
ggagacagcggcggcggaggaggaggccgttcccgcgaccgccgctcgccatttcctccgcgcccaccttctgtcccggcggcctcccgcctcagcgtcacgcccgtcacagcctaccggttgcctgctgcacagaggggcgggcggcaaacggtggacgacgccgcgtgggagcgggcggtgggcgtcggacggcgatgcgcgggggcgggcggtcccgcgccttgagacgctcaaccaggacgtccaccacgtccccgatgctaaccacctgctggtgcctagcggcggtgccgccattgttggcatggtggagcagctgcgtgggcgacgcgaacgccgccatcaccggggaggcggcgactgggaacggcgtggcgctcgctgatggcgacggcgaggcagcggcgcaggaagagcgtggcgagcaggtggtgttaagtttggcatgcatttcttttttgtgagatttggttattttctcgatcgtggtctgatactaacactaacaaattcctttccttttgttagttccccgtgaagatgacgacgctcttgcacctggagaagaagaccggggagcagcaaacgtaggtggtctctacgagctgtacgcggcgttgccgccatgcggagaaggaggagggggctggagtgggccttcttcttcatatgctgtagctggatgagcggtattggtcgatgcagtcctccgagtcgtaggcgagctcgcggagctgcttcatccactccaggacgaagtggtccacggtgccgtcgtcggcctcggattgcatgcggtggagggtgttcatggtggccagctcagcgacctcgctaccgacgccattgagctgccggtattcctcggtcagcaactgaccaacgttgcttacgaggttctaagctgcgttctccatgcttcgatctctctagcttggttggctggaagctagtttggcgaccgtggcggagatgtggacggtggccggaggcggcggcgaggcggggccgtggcagagaggcaggcggcgaggcacgccaacccagctccggccacgggagccgccgtccgcgccgactaccaccggagccgaccgagctcgtcgacccgccgccgcctcccaccacccgcccccgcgcggcgccgtgcgcgccgaccgccctgagccctacagcgcgagagatagggggagagaaacatgagatagataaagtatatatatgacaggtgggccccacaataaaatgctgactggattgccacgtgtacgccacgtagaccaaaaccaccgcggattgggttgaggggggtaatttgtccggtttgcatagttgggggtgaagaatatctggttttgtagtttagggggtaattcggacgaccgcgatagttcaggggggtaattcgtactttttccgaatgacaaatgggtcccacatatatgtttttaattgaaatgccacctcagcgccacaccagcacacaaactaggtcaacaccaccacaacagcgccacgtcagcgaaaccgccctccaaaaccaccaagggagtcaaattgcatcggtttcaatagtttggggggagtgaagatatccggttttacactttaaggtcatggattagattcgtgtcactttgagggtcatgaagtgaacttattctatttcagatccatttgcaactgggtgtcagcccaacttgtgcatcgtggaagggccgaactgcaatgaacaaggtattcctttttttaataagtctattttatgtccctcgtaggctcattattgaatcacatctctaagtacaaaaccgggtataacgtctacaccaacttttaaaaccggagcaaatagactagttcgatggttcaggattaggtttggctaatatgacacgttaaacacggtcagacttcctgagtcagaatgggctatgtatggttctacatcatgacgactttcgcgctccacctagcgaagtcgatagcaaaggggaataagaacctcgtcttctagtgaacgtcgtcatgctgcatacatagtccatgttggctcagcaaatttaaccatggttaacccgtcactttggtaaaaaccgattcccaaacaataatcgaagttttatacttgcacctgttttaaaagttgaggtagatcaaagagaaaagatgaggaaagcaaaatatacttgttctctctctctctcttgtcgaagtccctcttacagcttgactacgagtttcacaaggggctcagtagcaaagctccgatcagtccaagtctgcgcatttttaaagacctatttgctctttgattactactcgtatgggttgattaagttcatggtaatggtcacgtttcaaaaaaaaaaaaaccatggtgagttcaggctttacaggcccagcatttcatttgtttccgcgaggccgatttcgagttttgacttttaaccacaaaatacattatgcatgttctttaatttcgcgtccataaactggaaacgtatcgtggtcaagtgggaaagctcaggattattggatgcgatggaaccgtcaggagttggcctatccagttcagcgaccgtgatcatcggcccacgaaaaggacgcgccatttaatttgcttcgaccgactgcagttagaggcacagttctgtcgagagccattagcaacggaaaagatgaactttcgataagcaaaagagacaatgaggttgagtgcgatgcgacgctgctgctacagccatacaggcacagcagagcacgcagcttagctcgaccgagtgataatgatgcaacagcgaagccgaagctccctgacgtcgacgcggtacgtgataaagccgaataaatacgccatatctccctctggtagttacgagcgatcgcggcacgagcgggtgtgcgtgcgtgcgtgtacgtacattgaatgcatgcgcgagagcggccggtggacggcgacggagctagtactacgagctggccgtagttgtcaacggagcagtggatacaacggcaagcaagcgagagccgagaaccaacgcaagtacgaataatcacggattcacggtacctgccccccgcgcgactggccgcctggatcttctcctgcaaatctgcttgagaaaaccgtgaattgttctgcgtggccgctgtaatctctcgcatccgcatctgtcaaaacgtgaccccgcgccgtgtgccacagtggtagatttcgcttcagacgatcagacgagacgacggggtttcacatgcggcgcgcacgccgggcgcccggcacgcggcttcaccgccccccccccccaccccaacccacccacacacacgcacacggcacacacgcacacacctcgcgcgcagcgcacgcggcgtggcatgtcgcgggcgcgagattaggaccaaagcaacggcggctacgcgggggcgcccgggggggggggggggcatcgcggccatggagctcaaaggtaaaaaaaacctcctgctacatgtcgcccgcgcgtgtgaccggtttcgtacccccaacactgggggctcctccgtatgcacggggctacctttacaaaggcacagacctgccagtctcgcggtaaaatgttacaaacaggattcaccgctttgctagattgcctcgtgattttagttttcagcttggcacgtagtactagcaaagctgtgctagtgcagtagtatttgcagaagccatccaaaagcaaggaagcgctaggagcacagcacgctttgttctgcagaagctttttacctttgatcgagctaaacatgatggtactctgcgtgcaagtgctgctgcaatacgtacgtttctactttctactactactttcttttttttttcagtcgtactaaaaacagagcagcgtactcaaattgccaacgaggatcgatcattatccgagatcaacaaccttgagcgcgtggcgtcgagcgcgacggcagcatcagtatcagagaactgttcaaaacctcaccaaaatatcgtagtaaacaaaaccgagcactgattgtgcagattttgttcgcattgatttcgtccacgggaggccaaaacaccgaaatgattgttcttcctcttgcgtttctgctcgctgcaggccttttttcctcaattctgaaatcctcaagatctgtcacaccttcccgccttatttataaagagcaggacatcctacttgcctagaacaaagctctgcttcaccttggggcaatggcttctcaaggcatggtatattgataggaaggccaatccaggcagagaagaggagagaagaaaggcatctcccagcccattgtgggttctagttgaggtgaggcttcttcattcagtttcgtttgctcctttttctgaacatcctacatcgtaggggtggttacatcaatgcattatgcatggctccaatcagccaaaaatgttttgccgcctctttactgggattggttgctgccacttctcatgcatttctgatttcctcattgaagtaatctccaattttgcccttttctctcgcatatgttctgatgcccaagcctagcacctacctgccttgtttagctaacaagcttgcttctttatccagatacaagctgtaaagctctgtttgagttttgtctcatcgccatcagtcttatgaagaccagctcacatgcatacgtggctatctaaattagttattccggagtttaaaccagtgataaagcaagtgtctttttgtttttgctaatgaaaggtgtgtttatttgggtttgcagctgtcattttggctaggtcctgcaactacttttgcaccatcgccatgcatgattcagctgagtattagggtgtggacgccattgctgctttttttgtggggagttgagtaaggcgaaagagagagcaaacaaaaggggaagccttggggtggtggattcttgcttgcttcaggcctacctttctgcagccttaagtttggtggttgtagtggtgtgtgtataatgtgttatcttccaagggaccatgtaggcctctagtagtgatcatgagagccatcaccgcccgtggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59053 - DNA, 1990 bp, Oryza sativa
gtacttggcgctgtctccaatactgcatcgtatcttcggctttgggcattaaggtttgctttttattttgttatattgcatactttcatatctgtaggtgctcttcataaatttcatgtctttctttcgtcttatattagtttggcgcattctgagctatcaacagtcttctatgagaaactgctggtacttgcttgggggtaagtattggtttggtctttcagatttcaaccaacttcacttttaatttgtatagcaatgtttttttattcttacgagtgtcttggaatgcatcttttcgtctaatcatggatacctcatgaatatatggtatctaaagactcaaaagtggatagttgcttacttggggtatttatcatattgttcacaggtatgacaatcttgttgtgaagttagtggggcttgtaattttttcttttgctactgcctttatattgctggggatggaatcattgagcgccttccttcatgcacttcgtctacactgggttgagtttatgaacaagttctaccatggggatggctataaattcagacccttttcattcgctctgctagctgatgacgaagactgatgcatacaaaattcagcagataaagagattaagcttgtttcttgccatttttggagcacgtgagtggaattctttcgaccaagatgggtttccccaatacacagcattttgtcagaccgccgggcttcttccgaacgcatgtgtgcagtcctggttgagattgccagcgtggtgggaggagattttgtaagttcacggcaatactgtagagggcaggtttctcgtacagttcctccagtggagaagcagattatagatgctaacaacaaagatagaaatgtagatttgctatgtctacttttagctcttatactttgtccaagtgactgtcccagtatcccttaccacttgaaaatggaagttgcagtcgttttttttaatcattacgtgattaggttgtaacgaagggtgacaattattgaactacaatgtttgtcaattcaaataagaaaagctaaagcatatatggtttcccaagatgttacaaatattgatgaacaatatttatcaatcaatatataatttcgttatctcaactaattgataatactataagctcacgggaattcgccactgtcatcgcttgattgtcttggggcttcctggatgagagaatctacttttgccattgatttagtccaattcaacaatttgctgtttgtattgtcccttgtataatataacgccgagttatcaattgttttgcaatatgttattttgtcagttttttttcccaaaatacacatcaggttaacagttgatttgtcccatcagaagtttaaaaactatgttctttatatagcctctttaaaaaatatgaaattttgtgcatacttttcaagatttttttgcatttatccgttatatactatatagaatacatttttgcgttattttttttaatttaaaacatcttttatatcatacacaaattgtgtcattatcttttgtgtgagtaaattctcttatacgcaaaaattaacttttttttaaaaaaaatgacaataaaaaaaattaaaacttatatgcatgcttcatggttgtgtaagaaggctaaaagtcacttttttaaaaaaataatgggataaaataattgataatcttgttttctataagagtattttgggtatgtttttaaaaaatatacagtctaatgatatattgagaatgatgataaatcgataaattatagaaatagataatattaatagcaaattattaagatgatacaagattttttttagcttatacgatgggtgaagaaaaaaaaggacaaagatagtataccatgtatacttcttatgttaaacatgattctagaaaagtatttatatggtgaaaacagcaatgggaatctagaaagtgagacatggttgttaatactcaaatttagc

SEQ ID NO: 59054 - DNA, 2344 bp, Oryza sativa
gggacagaatcaatttataaataaatcatttcttaaagatgttcaaaacatcatgctgctagttggtgaattatgatagtaacatgcccgtgctaacggtattatggcattatttgttaatgcaaaacagtcaaaagatgatctatgttttgacaattaaacatataatgggatgtatatatgattcaaacaaaaaggaaacagtgattatgaacattccaaagtggttcgtccagtgaacaggcaaaggatcccattccaccctaacatgtgaactataaagctaacatatgcaagaggatgagtagtatatacctcaagaatgaaccactaaccactcctagtgggaggacatgcgttttttccttcaatctgaggagaacatgtcaagcacatgaaaccaagcagaaggtcatgacagattgcactaaaccatgttagaggccatagattagattggatcatgctaatgctatgcagttcatggtgcaatcaaattacagttgatttgaatatgcagttggtagcaaaaaaaatattagacaggaaaacatgaatttatgataaaaaaatggaccatgttaactctgctcaatctaggatagaaactgaattgatcttcactcctaatagaccatacaactctctcattaaaaagtatatagatctagggcataaaaattctgcaatttgatcatccaacacaaattcctgatgcatgaataaaggaaatccaatcattgaaccttcaaggataccataactctgactaaataacgtatttgctaatatttggcaatggaccaacggacctcagaaaactacaatacatgatttgcaattgattctttaagagaaatttcagggattgcaaaaggatcagatgcatatttatgatccatatggctatggaaaatatcttgattgttttggagattagcactaccagacatcgataagttgaatacaaacgtcaatgattaactgggctttttattcttatgctcctacagatgtcgtggctgccctgttgctcattattgccataaaccagagtatccaagtgtgattagcggaggaaaagaaacagcttccatctatccaagcggtgccgcacctcaccacctctatctatctatctctctctctcttgataggatggtttagtggtttagtggtttagtgtggtgacttgcaagataatacaaagttatacttaagtgcttttgtgtagtgattaagtgtaaactttgtatgctacaagataacaaaaaaggtatgtgtacttgtgtactaatcaacctttacataaatactgtgacatgaaagatctatgacgtgcagaatatataggccactatataccaaaaaccttatttcagagtttagactttagtggccgattcttccatggatccggcatgcacaaataaatcaagaatgagtcaggagctgaatgcatacatccagtaggccaacaaaatacatctaactaatcatataatcttaaaggcaagcaaactacatccagcacaacagaattaatgcatacacctagcagcaccaggccatcaagatctatatcttgcaaattttatacttactatggttacatgttcttctgaattagagaaatttcagggtgtgatgtaaacatatataccaattgcaaagcgaaaatttcgaaccggaaaagatgactaatttaaatgagacacacacacacctgaaacactgatctgatgttgaggaggccggatgctggcagtaatatttggaagttaaattcaactgcagtatatgaacgtcagcacatctactgtcagaaaattagttgattcaacctgtaactgttgacatatagatttagtttattagcatctaataagtatcgaatgtgacttgacagaaatgtgattacatcggatgcagaagatttattataagatcggtgcaagaagataagtgctgaatgattaagagaccaaatttccccggacagaaaaataaattactttcattgatatggaatgaaaagaaaataagaaaaggtctgaaaatataaattttgcactgaaaaattgaagtgaatttgacaaacagatttccagtccactggtaaacagatttttgtccctatacttacctaattgacaatatataagattagtaatccaactcatgtttgctatacgtgcacatgcaccatttacacacaccgacaaaaccagatcgatttgtaagatatcgaaactaatttattggatgaaataggatggtttccttcaggatacagccccaatacttttgagtatttcaccatttagtaatatcatagaatcca

SEQ ID NO: 59055 - DNA, 2607 bp, Oryza sativa
ccgtataagctaggttaatggttccttagcatgcttgcaaaacatataattcagttagttatttgacaatgttcatagagtaaatagatatgaaaataaagctccagatttaccagggaccacacgatctggcagcttggctccaacgcaaactaaacccatacataaatggctgaaataaagaacaattggttatttcattgcacagaaggaaatgaagtacggatgctttttccgcataatcctttgtaaatataactccatcaaattgactaccatgttcttaacatcaagctttattttcagcctccatcgttgagtcgacctctcatctcatgcagagcctgctaaacatttttagatttacattaaacaacaaaacatccaagtcaaatttggcacacaaatattaatttgtttgaggatttaggaacagaggaatagacgagacatcaccttaacatgccccgttgagaacctcgttgctgctgcggcgacttggcgcttaaaggagatagggttggaagggaggggcatggtgggaggaactaagaaaccgaggtgacggattaaggaggaagacgccgcacgtctaccgctgctctatctcctggccgcggtccgggtggcgacgcggcgcgatggggtccgaacggcgacctgaacgcgggcaacggtggccagggtttagggggatcgaagtcaaggcggcgtttggcgaagggcggagagcaaagggcggcgggcggcgcgggatggggccatgggggtgcgagggcggcggttggcgatccctccggagggcgaaggaaaagggaaaggaaaccgagcgctggcgatttggcggagggcgaaggaaagtggaaaggaaacccagcggtgatcccgcgtgtgcgattttccgcctagtgaccccgcgtactacgtagttgattctgatgcgttggatttcacagaagatgatatcgaccattaagtgatgaatgaaagaatgaaagatgagtgaaattatttgttgaattatagggtagactaaggaatatattatttatcaacatgttacaaatgttgaagtacaatttatcagttcaaatacaacctttttctttgttctatcgacaaattgaaaacatatgcaagttcacgagaatgtgccactgtccttccccaagaataacgagacactagcaaaaggtaattgcccataggagtgtcactgtaggatcgaatcacaacaactaagccaaccagagggaggggtgaatggttggtatacccaaaaaccgaaaacttttagcggaaataaaagttaccctcgaattcgacgaagatcggtctgaccgaagttgtcctgccggtctgacagcgcctgtccccgtcggtctgaccggtgtagatcgatcggtctgactgccgagatcagctgccgcttgctatcgccgccgccggtctgaccgcccgtatgccgccggtctgaccgccggtatatcgccggttagaccgccgaaacccggtgaaacacaaattgaagaactcttaaagtggatgacgactttattgattctctctgtgtttacaaagggcacaaacatcactccttacaaaaatttcgactaaactcgaaaccctaactcaaaactcaactcaattgctctcaaaagcgataccgggaagcctcacactccccctctatttatacccgagataggcagtctaaagccacgaaccaaactcatactagaagtcctaaacaccttaggaaaccctctagaacaagaaacaaactttacataaccaatcataccaaatttggactccttccaaattcaactccgcatcccatacgcacacaatacctccatcgtatgccatatggaatctccatcaaccacgtgcgtcaactctagcctaagtatcccgcatgatctctgaccaccacggatgacagagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctattcctgtgttctggtggatctgtgcgtgaaggaatacagagagctcgaaagcgagagagagttcaggctccagaacccctccgccagagtccccctctcctcctaggcctgggcctcctttttatctggtcaggggtcaccacaggggcctctagctgcctaagaaaggaaacatgctttttacaatgagggctagtctacagccggaagtgacctctgacaagcagagcacacgcctcctgccccgctcgccagctttcccggtggacgcccattttaaccttcattcaatggccagcgacttccttgccatgctcgcgctgaagcctggaatggatctgaccgggactgacgtaccaactccaggagttagcacgccggctccggctagggacgagagccgggaagctctcatcattctgacgggacggggcgaggcgtgtgacaggccgcctgttgccacccaacccgcgatctgaccggtctgtga

SEQ ID NO: 59056 - DNA, 11163 bp, Oryza sativa
  unsure (1)..(11163): unsure at all n locations
accaatgcacttgttatcggatggcatgtaattgttgtctccctcttacatttttcatgcatttgttgtttaacactataagtctaaaaacattctttctttgctgagaaaaaaaaaactatgcttgaactgcatgtgtatcaactattatgcatggtcttttaattttaaaggtttatccaaggttaaatggtgatgcacacgctcatttctttgtccgctggacggtaagacaccttaattgtatgctttagtgactgcattaccctagtatgtttaattttaaataatctacagttatattgtagattgatggatatcggaagacaggctgctacaatttagactgccctggttatgtacctgaagcaggtataagtatagttccaggagttgccattgatacagtctcagagcctggaggaataaaacatattatcatcttcaaaattttcaaggtaatacaagattatgttttttaagagctaaaatagtaagtatgttcaaaattgtaagacatgtactcctctaatctcctcttctgattttgaacaaatctaggatggtgccggagattggttactacactgcggatgggactcagaaccatacctaattgggcgttttcctgcatccttattcaccaccctacgtaacaaagctaattacatgaaggtcgctggttatgcggtggctcgaacgacccatttggctccaatgggaagtgggtatcttccaaataatccaaaagctgcatcattcagcaacgtgcaacttattgatcaagatggccaaacatccaagattccacaagatctacctgccactcagactttcccatccatctattctgtatctccaatcaattttgagggtaaattcacatatggtgggccgttagaataagaaacaatcggtgcagcttttctatataatagaaataatcattgttaattttgattatgaacttgtcatttgtagagaaggtttaaattttttttatctgatgtgttgttgcatatttgtatttttaaatttctaagccatccatattccaatgcaaaggcaatataacttgggtcgcacgccatgcacaatcccaatttgtatatatacgtataaactttatatgcgtgtatataaagtttatatatatgtatatatacatacgtatatactaatgggactagaggggtatgacttttttttaacgaatcgacgagaccaccaattttattaaatagagaaggagaaaactgtacaaaaggaattttacaaaagcacaaacaggactacgagtctacgaccctgacaaaaaggctaattacaacgccaaccagacagcgaggcttctcgcacctgcaaggctccacgtttttgcttcctcttttatcttggatagcaggtttgatgccggcaacttcttgggttggaaagtcctccggctcttttcatcctagatctcccaggccactagcaaagttaacgtgcgtagtgtcctttttggtgcttctctggtactcatgatggcctcccaccactcgtgtaccatagaagttgctagccagcgatgagtgctttgatggccattgccagtccaaagcgctatttgcagcctcgcgcggctggtcgccaatcaggcatccccacgatatggtctagccatccaagtcgtagatggaatggtgtttaacccttccctgaatacgaatatcctggctaccatgagtctctttccaaatacggtttatggtgtacggtatccatggggagagttccattatctgaggggtatcccatatttgctcccttgacacttcatatttgctggagtaataatacaaaagtactgttttaaattttccttttgtctacactgaaaacttgtacgttctctagataaaagctccagttttatgcatgacctgtaatggaatgtggaatgtgtcagggtatatgtactccgttcgtgctgttcagtactagtgagtgttttactcccgaaacatactccaggagattagtggtatggagtagttgatcgagtagaaaatttagccacttcaggagactagcaggatggagtagtatgtgagagaacattgctgaatgcttctcagtattgtactccacacaataatatgtgcttgcaaagttagagatggcaaccaagaatcggagattcaaaataaaacttacagagcttttgggtcaggctctttcagttttttgtttcgcttatctcagctagagaaaatgagatgaactaatgtcaagagcagatggtgttcataacatgcagacaatgagacgttttgttcagcaaattaacatcatcatcatgccatgatcgcacaagaaaaaatgtgagatctctagtaatttcgttgtttcaggatatcgacagccattacaaccagtttgccaagatgtcttacagacctgtacttcagaacctatatgttttaacctgtaaattaagtgaattaagaaaagacgccattccttttaacctgtactccaattgacattcaggacctgtatgtgtaaacctgtgtcattcagacaactccccaaacatacttgtaaccatataacatttttcatagttttttttcttcttcagaacaaagaaaacgtaggattacccaaacagacatttacttcaatcgacattagtatgggcattatcggattgacatcacatacacaattcttatttgtcacactgacagtactcaaattcagattgcatacatacccaattcacatcacatttgatcagtactctaaactacttctaatcagatcagcgttccagtagaagagaaaaaaaaaagaacatctaactgaattactccaatcatcaatgcagtaaatgaagttagcttccaaaacctggtccaatctgaaaacatttgcaaatacctagtctaatatgaaactaaggtattaaaacctagtccaatctgaaaacatttgcaaatacctagtctaatatgaaactaaggtaataaaacctagtcctaagtgcaattcactcattaaaaaaaggtgtttctgaattgaacgaagggagtatttggtacattcttgagatacctaaatattgaatgccccctctagaacacatgccattgcccatacggcaagcatcacagtcgaaacaatacggacgttacagaattatatgttaaccagcattattcaatgctagggtacttgcaatagatttgtgccacctgatacatgtatgggaatgcaaaagattgcagaactaccaatatgtgaaaattgctctgaatatacaggcaaaaacaagcattaaaccacttatgaagcaatttacatctgtgaagcaatcgccacagccaactgttaacaccctttctaaaccaacacccttcaagtgctttagtcttctactaataaatatggccctaatgtgggttcttccttaacagatggataataactgcagcaaaagggagtattgtgtcagaactagaagagcgcgaaaaagtataaaagcactcggagaatttttcacatgtgcagctcaacatctccagagttcacatgtaaaaagaataaaaaaatacagatgtagtatatgtgaaccttgagacagaacgggcaatttttagtgaaaaaaacatctaactgaaaactgccccaaggatggcaaatgatttctgtacaaaagatcttacctcacagaggacaccagttactgaaaattttcactgtcctcatctttaggtgtccccattatgatactgcacgtgtaatggcataaacagtgtcagctagaaaaaaaaagttgaatgtgcattattactttatatcttgtttagcttcaaggatgaaccatagcattgtgctgacaaatgatactatgctagtgctaggttacctgaggttgcatataacccatcccttgggtgtaagccccaaccatctaaaaatattatcagtatgtcagtgttttcaaacatcagaaagaacaaagcagtacaagttactgataccaaccccttgcgcacttgagctactagcgccactgtgcggaccaattgtatccttctttactgaaccatcaccagcctttgaggacagcttactatcaccctaccaagaataaggaatagtggtatggttagaactcaatacatcttgaatcttgatgcacaaaaatagatcttttactaaggcacaaatatagatcttagagtattactaaggcacaaatatatatttccaggcaaattgaacagtgacatactaaatggatgcggttagctttccttcaatgtatatgaagcagaggaatgaaagaatgattcaggtgttaaccttacagttcagagtaggatatgtacatttcatgttgagcaccaactatctctaatcaaagggcataattgcatatcaattttttgtgggattgttctaaaagcaggattacaagagtgacacatttttgcgttgacaaaaaaaaaattcacatgaaaccatagcatattgttggggaaaaaaggggattttgaggagggtagaatggtagatggtgtacctccatctgcagttaacagtgcacatccccacgtattgcaaatttgccaggaggacagaagagacatcagatattcatacaacaacgaaaggtttaacatttatactggcagagagtacgaagcgcacaattacctctctgtacttgtgtaaatagatcttcaacggatcaacgtactcctcaaagccaagcgtacccatcgcaaagaggagatcttccccgttgatggtcttgcgcttctccttctgacatttgtcgctcgccctgtcccatcccgcaccaccgcccaaaccacaaagcaaagcaaaatcacaccctaaaccaaccatcacaaaagaaggtgtggggagggcaggatcacggtaccgagcccgcgcagactcactcgctggtgacgaaggagatgaactccgagacgcactcctgcagggtctccttggcgtccttggcgatcttgccgttcgccgggacggccttcttcatgatgcggctgatgttggcgatgggcaggaacctgtcctgctccctcaccccgccgctcctcggcgggctcccgctctcgtcgtgccccgcgtccgccatccccgcgccgccctccaaaaaccctagatccatcatcatcatcacagcaacaaaccatcagagatggtggtggggagaggagcagccgagcagcgtcgttggatccgtaccttacgaaaaaaaaaaaacgcgcgcgcgcgggggtggagggagtcgcggagaggagaggagagagaggggggaaggcgagagtggggggaggaggagacggcggttggtgaatggtgcggtgaggaagggtggggaataggagatcggacgctggagaagggagaagcggcttgggccggtgcgatgggggcagccggggtatccgggccgttcgagaccctgggtgctgaccggtggacccgggagcacttgctgtttgggctttatttggtttgctctcttttaattattattagagtatattacactttggtctaccttttattacccaagtttcaatttgaactacccttaaacctatcttttcaatttggaccgggtaaatttatcattgttgcagtttggactaccgtaaacaatttttctcgtcatgcctaacttccctttcaacaaacatatgaaccatacatataggagtttggccgtatattaaagttgatgtgtttaagattgttaattgtactgaaaaaaatcgttcgtggtggtccaaattgcaacaatagcaaatttataatgtggcccaaagcgtaattcactcttattattatattgtatctactatagatgaaaatatatattagcttatatctagtaatcgcagaacaaataatttgaactggactggggaatttcttacgcattgatctggattgggaaatttcacatcatgttcaaatttacttgtagaatacttctccgtttcatcatattgtaagttgttttaaattttttaagtcaaacttcttaaaattttaaccaagtttatggtaaaatataacaacacttgtagcattccatttacatctaatattgaacatgttttgatatatttttttctttgtatgaaaaatattgttatatttttatataaacttcggcagtacatcatatagcgttggacgggacaatttatttttaccaatattgtagtatatctgaaaggcttagagtagtaagaaaatacataattcacatcatcaatataattgaagatcactcgttttagtttttttaccaattgatctgaagaagagctgtcatcaataaaattgaagatcactcgttttagtttttttaccaattgttctgaagaagagctgtttttagagttgtaaatgtttaggggtgaaatgcaagccccggcaaaacgatgaatttcaaaaaattcagcacaaatcggatggtttggccgtttgggagatgaatcaaagggatgaatccaagcaaatgcaaaacataagcgcaggtatcatattagagtcacagtaaatatgtgcatgtgactagcagtaagccagtaaatcaaagggacgccgacgaagataaccggaaaccatacgagcatataaaaatcaatagctaaacgatgcttcaggctcaaacaaagaacagatgaacgaaacgagctggagtcatcaaagaaacaaacaaaacattggcgcctcaaaatcggagaaaatagctcagcacagtactttccccttaacagaagcaaaaatctgacaaggcatggtttttaccaacacaatcttaagttaacaatataaagagcgcactttaaacatagcaaggaaccatcttcttgagcatctaaagccttcattcttgagcatctaaagcctttcattctgtctattccatgcttgccaaccaagatgtaccagtaatctaagacctcggcttctccttcttctccttgaagagagcaagcagagacacaccagagaccttgacgaccttgaaccggacaccaggaatatctcccacagcatggcccttacgaccaaatccagcaatcaacacctcgtcctggataatgacatgagaaataagtacaggtgacacagcaaacattcaagaagttcaggataaagaatgtacattttcctcaatgaagttcaggcaaccgtcattgggcacaaaggcagcaatcttcttcccattcttcacaagctgcacacgagcacacttacggatggcagagttgggctgcttggcctcaataccactgcaatagagccatcaaatttctcacattagcataaactcacaaggcaaagggtgacaaaaccatattatagtttctacatacatcttctccagaacgatgcccttggcatgagatgacccagcaaagggtttcttccactcattacccaagtggctcttcttgtaggccttgtctgcccatctctggttcctgcggtgggtcttgagcttgcgcccagctcccataccacgtgtcttcctgcattttgaagaattcatggttcatgcaactatattaaaacaagattatggtgtacaattcgacggtttgacatatagtgcggtgctagaaaagaacgtgtgcagaatgaaaagggatgaaatgaacaattgaaagagacatgacatccaaatacagactaatagcaaaagcataagaaagtgttctttgatgaccataatatgtaaatttgccatcagaagtcgatagttgtttgcaaagtgatgggcttagcataaaccacaaaaagatttgacagctaagctaagggcgattcctttaaacaacaaaaatgataacagtgtgtatgctaacatgcataacctcccagatccaagtaaattgatataagaaattctgattacacagcagcaacggattgatatcgcttatgaatatgtttagtgttgacggtttataatctgatcagcactggaccgtcaataagctgagttccatcatcacacgcaaatttaccaaaatacaagtatgacgcatacaaaaatcaagtggtatattcaagcatccagctacgagggaactcgactaaaccattccagatcgctaaacctatacagacaaaatccaccgcaggagagtgacagcgagcttaccccatgttgacggaagggcagcgaagatctccgaggaggcgaggcggcggcggctgcggcggcgaggggagcgcgagctgggagcggcggcggctgcaatagaggagagagataacggaaagggcagagaagctatttatttgcggcggcgtagctgtctagggtttgctaatgggccttcctgcttcaagatccgtgctggatggacgacggcccagatgttgagaagtggatcgcgggaagtgatagaatccgacggtggacctggcatgccacgtggagaatggacgtatagcacgattttttcctttatttgatagtaatatgttcatgctaaatgttaaggtgcaatattatttgttaacaaatatatttttcaaaccggagatggtctggtatgaatgaatgaatatataaaagaaaggctatatccagagctcagtggattttttatgtgcagatctctcaattataactcatgtcatgcacggattttttttttgagcttgtgataaaatattttattttaggataatgtcacatatctctattattgtttgccacacatttgataaatattttattttagaattagtttgtattcatattgaagccgcccattctaaagcactacagtgtgatttatgtcacatggccctttttttgcgtggtgtgataaaatagtttattttgggatcatgtcacacttttgtatgggtgcgttcaataattagtctattttaggatatttttttaattcctattgaaatgggtagtctaatttaattttgttatgtgtataagcataatgtatattgagacatgtaggtagtatatattatcgtgggagatgcagcgacgtgcgcgcattcactctccaaagtcgtgcatggtcgcgtgagaaattaaaaggttggaggttttaaaagttgaattgaaaatttcaatttgttgtgtacaattttgaaaacgagaccatagaatttttaacttaatactggagtaaaaaatgtcaagttaatagttttcacaatgtataacaattgtttgtcgtcttgttaacgtcttctttcaagatctacatggcttgactactattttttgtcgatggcaaaattagatactgagagagacacgtgttatatagtcatgtgatcagcgacacatgtagtacgagatgatcgggagaagataatcacannnnnnnnnnnnnnnnnnnnnatgatatgctggacaaaacaagagtacgttatagagtaacattccgatcaacaatttacaatgttgttcatattaccttctaagatggctatgtggtattgcacattaggaaacttaaatgagtggttttgaataattaatatagcatgtttacatattgttaatcattggtgatcaatttatactatagataccataatggtattatatatacaccaattgtaggtgagagcaaaaaatggggcaaaagcaaaaaaaaaaaaggaggaaattttaacatatatgtgcagcatatacatcatatggtcaaacttattcaacttatatgcaaattagataaatccactttataaaaccatcttatggtgttatattaacggtatcatatagtttgggaggtcggatgtccaatttcaaagtgcaggtgtttggtaaacttttaatcaaaattcaagggggggtttagacttaccgaaaactatcaatttacattaactaatgtcataaaggggacatgaaagatcactgtttatatctttaccaattgatctgaaagcagcgtttgcgatctttgtttcggatattttcaattgatctgaaagccgcgtttgtaatcttgttttggtgaggtaagcacccggaagatgactaatgtcacataataacccggtggtttgagagagcctctaaatttaggcaacaaaattccaattttcgtcgaccaaattcgatgatatgcaaacgaacccaagtaaatgacatgcgttcattctgatgattcctgcagcaccacttctatctgtactctagagtaccacatagttggcctaaatatgtattagccacagggaactccaaagagtagcaattcgcagtgaacagagctaagccgaacaatacctcaagggtcaaggatcctcaaacacaaacacagataaacattggcaactaagataaaaactcagcatagtactttccctcgacagaagcaaaatctgatgacaaggcatggtttttaccaacacaatcttaagttaacaatatagagagtgcactttaaacatagcaaggaaccatcttcttgagcatctaaagccttcattctgtctattccatgcttgccaaccaagatgtaccagtaatctaagacctgggcttctccttcttctccttgaagagagcaaggagagacacaccagagaccttgacgaccttgaatcggacaccaggaatatctcccacagcatggcccttacgaccaaatccagcaatcaacacctcatcctggataatgacatgagaagtaagtacaggtgacagagcaaacattcgagaaagtgcaggatgaagaatgtacattttcctcaatgaagttcaggcaaccgtcattgggcacaaaggcagcaatcttcttcccattcttcacaagctgcacacgagcacacttacggatggcagagttgggctgcttggcctcaataccactgcaatagagccatcaaatttctcacattagcataaactcacaaggcaaagggtgacaaaaccatattatagtttctacatacatcttctccagaacgatgcccttggcatgagatgacccagcaaagggtttcttccactcattacccaagtggctcttcttgtaggccttgtctgcccatctctggttcctgcggtgggtcttgagcttgcgcccagctcccataccacgtgtcttcctgcat

SEQ ID NO: 59057 - DNA, 1851 bp, Oryza sativa
cacaaaggcagcaatcttcttcccattcttcacaagctgcacacgagcacacttacggatggcagagttgggctgcttggcctcaataccactgcaatagagccatcaaatttctcacattagcataaactcacaaggcaaagggtgacaaaaccatattatagtttctacatacatcttctccagaacgatgcccttggcatgagatgacccagcaaagggtttcttccactcattacccaagtggctcttcttgtaggccttgtctgcccatctctggttcctgcggtgggtcttgagcttgcgcccagctcccataccacgtgtcttcctgcattttgaagaattcatggtcaatgcaactatattaaaacaatattatgatctacaattcgatggttgacatataacatagtgctagaaaagaacgcgtgcacaatgtaaagggatgaaatgaataattgaaaggggtatgccatccagattcagactattagcaagcataagaaacagtgttctttgatgaacataatatgtaataaatttgccatcagaagtcgatagttgtttgcaaagtcaggcttaagatttgacagctaaacaaatggcgattcctttaaacaataaaaatgataacagtgtatgctaccatgcataacctcccagatccaagtaaattgatccaagaaattctgattaaacagcagcaacggattgatatcgcttatgaatatgtttagtgctgacggtttataatctgatcagcactggaccgtcaataagcttagttccatcacacgcaaatttaccaatttacaagtattgcgcatacaaaactcaagtggtatattcaagcatccagctacgagggaactcgactaagccattccagatcgctaaacctatacagacgaaatccatcgcaggagagtgacggggagcttaccccatgttggcggaagggcagcgaagatctccgaggaggcgaggcggcggcggcggcggcggcgaggggagcacgagctgggagcggcggcggcggcaatagaggagagggatagggggaagggcagcgaagctatttatttgcggtggcgttgctgtctagggtttgctaatgggccttcctgcttcaagatccgtgctggatggacgacggcccagatgttgagaagtggatcgcgggagtttctgggcctcacatttttcgcttttgcttatacttatcagttaaaatttaaatttcgaagtttattttttagtatttgtttttaaattgctaagaacacgtatataaatattttatacacaaattatttttcatttaagaattatgagtcctttttttgtagcattagttgtgcacgttaaatatttaaatgcctaattactagtcgctttgtttcaactacgactatctctcgtatataatattactagatgactacccgccgtgtgctgcggaaaattaagttgcataatatgtacaaataagacgtaatttgattatcaaaactaaaataatttgatataattttgagactaaaaataattgatattgcatatttttaagagagaagaaagaagagacaatttaaaccatagatctatcatccaaaggctataaattattggggtgatgtggcttaatgagagaagagagaagtagcattatctacacttagtggggatgaactaggattcttggtttgtatctaagtgcatctaattttgaacgtagttatcgttattttttgcttgttaaaactgtttgcatgcctttcattaaactatagttgtgaaaagttttgacgaaaatcaatgcaatgtggaactggcgcctaactttag

SEQ ID NO: 59058 - DNA, 2014 bp, Oryza sativa
tagtggtcaatttagttcgaacaagaaagtgagtgtcagtgatatgggcccagggtaccccccatacaaagggaggaagccgcctcaaacccacgtgccgccccccccccccctccgggagggggggtgttgaagtggtggctgtttccgagttgggaccccctcctcgctctgattcgtgattcgtgtgtgcgccctgggcaggcgttcccagcgcccaactactgtgtttaatgaggtcctgtcggccgtggcacgctgtatttaatgtggcgagcatgcacactgacaggccactagcagcaggaatgacggatgtgacggcggacaggcataggacagggcgctgtctgcacatgcctactgctagcaggggacatggcctacgtctaccctgtcccgtcgccattgatgaggttttttttcctctcacttggactcggtccagcttttctctgcacaggtccgttcaagagatctctaccccttggtggggctggacgcccaaaagtcgtcgatagttaagaaggaatgacatgggcatccacccgtactgctcagcatgatgggatggggcccatgtcgtggtaaggtgcgcatggcttcacacgtcgggaggacgagagacacattaattacctatagagaatgttttcctttcccttgaagctaagtcttgggccttttgtggtaaccccttaagatataaaaggagatccatgcctgaggggaaggagaggccgaagaaaagaaagcacttgtattctcctagcataatcaaccacacataggagtagggtattacatttccacaacgcccggaacctgtataaaccgattccgtccccattgcccccgaggggcccgaatcctctctgaatcgccttcccttcatttctcaaaccttcacccgtattcctggtctgaaccataaaggggacccccacagtccttgcttgaggagtttaccctccaacagtgagcaaatgaacttatggttttgaactttagtgggagaaaccaaccactgtaccaactctaggatttttgtcttttaacagagccattagtcttttgagtagagttatgggtttcatttaccagccacctcttagtccacacccaacttgaaaagtgttatcgatacataagtcgcctttgccatcataatattttcattttttctcctttttctaccaaaccatcaaacttttattacattcaaatacaaatagtttgctgaaaaaaatacactatattcctggaaaagcaatacaaataatctgttttaccaaatcaaaagcatcttgtttttgttagtggagtgtggagaagagaccatgggcataaccaaaccaaaaaaccaaaacaaaaccgtttgtcacaaaaaaaaaacaattaccagacgccacaaaggccacggcctacagccttttcagcccacgacccaaagacattagccggaggcccagccaagttcccctatcaccatccaactcgtttccccacgaaaccagtccaccaccatctctagaactttccatctcgcctccgcctccgcctccgcctccccccacctcctaagctccaaacccaagaaaccctcctcctccgccgcccgccgcccaatccgacccgccggagcgcgaagggagaaacagggcagccagaagaagaagaagaagaagaagaagaagaagaagaagaagaagaagggaggatgccgccgaagaaggcagcgccatcgaaggcggacctggccaagaagcagaaggtcgtggaggacaagacgttcgggctcaagaacaagaacaagagcaagaacgtccagaagtacgtccagtccctgcatcaggccgtccagcccaagcccgacccgaccaagaccgccgccaaggcacgcaggatgctcagatcgaagctcttcttaccctatttttcgattgctttgcttctctgatgttcgttgttttttttttctgtttgctgtggatgtggatgcgcagaagaagaa

SEQ ID NO: 59059 - DNA, 18275 bp, Oryza sativa
ttggggctaaaacaagctgtacgtagaggaagcatagcttcactaggatgagcacagcttggtatttttgtaagatgttgcaactcatatgctggttacgatgatgatgacatacattttattatgcaggtgtcgatcccaagtccatagtgtgtgaattctttaaggttggccagtgccagaagggttttaagtgcaagttctcacatgaccttaatgtccaaagaaagggtgaaaagattgatatttacactgacaagcgtgatgcaggtaaaatacactgatatgggttttaattgctatttttgtactatttgtccataattcgtcagttcatctgtgaagattctcatatgctttttcatggcagaaaccatggaagactgggaccaggagactcttgagaaggttgttgcgtcaaaaggagcagagtaccagcagaataaacctactgatattgtatgccctactcaacatattgcctgtgatccaatcattttaagtcatccccattgtgtgaatgtgtggcatgtcattttccaacttgttatgaatgaattaaaggttctagtattttgcttcttttttgtaaatatttgtgctaggcagtgcttcactgcttctatatttgcttttgcttcttgtgttgtgtcttctaatgcatgataattggatactcaaatctgaccatgaaacagttatgttttacaatttacacagaccatcttatggttagcatcattttatcctctgaatatatgttgcatacagcagttattagggtgtcctcttggtcatatcgttagcaagccacctgtgttgattttagttctgaatgcacctggaacaactagaggaaaatctgacatatgtcatgttgcaacagtggttaacatgatatggtgtgatgaattggcatggtgggactctttcttagttgcagctcatgatatggtatgatgaattgctgcgtttgttccttgcatttgggaactaatctcccacgcacggaaaacggagtgactcattagtgcataattaattattagttttttttaaaaaatggaataatatgattttttaaagcaactttcgtatagaaatatttttgtaaaaaaacacatcgtttaacagtttgaaaagtgtgcgcacggaaaatgagggagatgagttgggaaagtaagctgccgaacacagcctaagtagtcttactgtcattccaccattgctctttacttactaggattctgtgtggcaatttggctatgtacatagtttcgcaatgtgcatgatgcaacatcatttttaagtaatagctttcacctataagttatagaagccattaagattctagcctaataaatgtttgttgattatttcattcccttacaagggctagcctaacctattgaatgccaatatattggcagtgagggaagtttgatgatgcacagtttgaaaatatagtaaattaacaagctatgattatgctctgatgcatttgcatctgttctaacaagtcatatttattgtcttcattgcattgctgctacgatttacaaaatcagttttctgtttctttatgctgtatctgttgcatttgtaacttgtattgccttctttactctctctctctctctctctctctcctggaagatgaatttatgtagcagtgaaaccataagaactccttttgttttgcaagctgaaagatgttgtcttcaaacatgatgttgatttggtaattcttttgtcttgtaggtttgcaagtactttcttgatgccgtggagaagaaacagtacggttggttttgggtttgcccaaatgggggcaaagattgccactacaggcatgcacttccacctggctatgtactgaagtcccaaatgaaggccttattggaggaagagagtgaaaagattgctatcgaagatgagattgaagatcaggtagaattacgatcaacagtcaaaattgttctgtctggaatattgaattttgttgtcttctttccacttgttcactattatgacgatctgttgccatgtccatctaacagcgtaaaaaggtaaaaacaacaactcctatgaccacagatttattcatggaatggaaaaggaagaaggcagaagaaagagaagctggtctggctgccttgagggcagagagggctaagaatgatcgcatgaggtagtatttgctcctattagtttatcgttttgagctctcgaggcttgaggtacttactgtgatagtatttgctattgtgtccagtggccgtgagctgttcatggctgattcaagtgtgttcgttgatgatgctgaagcatatgatgtatatgaaagacaggaagaatcagaggctaatgaagaaccggtaaattttcattcatgtgctataatatttgctcctaacaaattgtttgattaatgttacaactaaagattgaaagtactaattgtttgagggagcagaaaaggcccagataccctcccccaaagattctaaagttatataatggaactatcagttttggcagatacaccttgaacttaaaattatttggggagcactccttttgtattccctttgttattttcaagactattgacatgcctgaatcacaagtgggttgtagatacccaatcagaacatatgttgggctgttgtccttcacatatctgaaatcaagtctatggaaaaatgaaacatctttttaggcacttttacagaaggcggtaactgtatctatgctcgatcgcctcctgagaaattaaatgaataggacaaacttccaataaagaagtaatctgaatcttatgccaaactgattttttcttcttccatgaatgtacttaggtttatttgttggcgtgacacttcgtagtgagattattttcttagcttatttgaatgtatttattgtgcctgaaacacctgtatgcgttgaagttgaataggtatgcctggatagaatggtcaacatgaaatacacatatcatgtatccatgtcacgttgttatgttcagttcaactcattgttttcagtaaacttggtatcgcgatgcggattgtagtatcatgcaaattgaataccaatataactacatataactgaataccaatattaaattcaaattgaaacaaaagacatctcataggatcccaatcctatggtccgattttgcttggagaaaagcgaccctacctatgatcctaatcctaacaactttggttccttcaaccccccaaaataattttgttcctttatattttccgcttgaaagggattttggcagatagtagataagtgcaggctgctctgtggcaattcaatgaatgtgttacatatatttttatttccatgttgcagagcaataaaaaccaggatgaggggccaagttcatcaacttctaatggcaaggaggtggaagagtccgatgatgaagatataaatattgatgatgacctggacattgatgagttaaacgagcttgaagcaagcctgtcaagaacttccattcagattcgagaacctggcgagggaacatcatcttgagcagtaacactctggactggaaggccattgagaagtagaacaccatttttgcgccttaaattgcctacttgctttagaaacaaaaaaggtggaaggtggagcatagatgcaagtgcaatttgtttcaaccagactgatcatctatccatgattagtgaatgatgctcagtgctgttatgacatgacaattgattttttgacgcatctgccctttatattatctttgcgggagttacgttgctacttgtgaataacatgactactttttggcctcgtgcacactataaccgatttttgatgtgaaacattgccataagttcatcaggttagtctttatcctttgatgaaattcttttagtttgcccctttgcgaggtttgttgctgcctatctgttgaatcgtccttctgttagtttgcccctttgctgccgatctgttgaatcatccttggataaatcacatagagcaatcttaaatgtgcatatctagtcgaggcaaaattgatcctgattttatagcactgaaagttacgttttcactttagtagcatcatgatgttacctcccttatgtcaacgttctctgtttgaagtcaaggttggctggtattggctcagcctttcgaaaaaaatacgccgagccgccgaggcaacaaccaaaagataatttgatactctctctataggaaactaattggagtataatctaatctggctgtacatgtgcacgacaagaaagaaggaaatgatggcttcttgattcaccggaaatatttgcattcgtaaggaatcacaacgccgcgagatagagttgtggaggcgtggagccctgcccgccttggttgcgttctgccggtgaggttcttgtgctgtactcccttttgtctataaaaaacgaatgtagaatcggatatgacatattctattacgatgaatctgaacatttatatgtctagatttatagtactagtatgtgtcacatctagtaccaggttagttttttagaccattcacagtgcggtgaggtagcgtgtggcaatctctatccacgtcggcccaatgcatacgtggaggagagaaggaggtgaggcgcgcgtttttaccagcttcgcgtggctagttttggctccgagaacctcagcaaattgttagagaaaaacacatgccacagagcaggagagagagagtgaagaagctcgccggagagggagaggagtaggggcgccaaatccgagccagatccacaccgagttcgccatcccatccggcggcgacgagaggagctcgcccgcggaggtggtgaagcgacggcgccctcgctagccaacgccgagctcccccgccgccgaatcctccgccgcccgcttccgcgtgctgacctcgccgttgtttcggcgaggggggggggagggtggtgcgccggcgagcgccaagcgcggcacccctgccgtcggcagcggaggagctcggcccgactcggcgctatggggtggggaaaaggagtgagagaggaggataaaggaaaagctagtaaagtgataaagttggtattcgtgggacccactaaatagaccacatgcactgagcgaaggttgttgcttatgaagtttttagtctacgtggcagttttggctcctcaaaatttagtgacgtattgtgagtgcccttatgggatgactcctgttagcaggattggggattgatgggattaatggtaccggctatggatgtgaggttgctggagacggaaccacaccaccaaagagctgatgaaactggccgtcgcagcaagcaatcggtcgagcaaggctgcaagggtgagtggcgatccaggcgagaatgttttttattttttttaacctttttaaattttttacttttaaataaacacttctcaaacttattttcaatatctgaatcttttactcatgctagccgaactggcgcgatgttaacaaccaaatttggtacgtcaacacgcgacgaacaatactaccataccgatctcgctggtatgacaacattatttgaccatgccgatctcattggcgtggcaacattagttgaccataccgctcttattagcatggcaaaacaatacaattgtgtctgttataggttgtgtgttaatgttgttttaccataccagatgaattggtgtgatcaaataatttagattttaaaaaaaagattgtggaagggtttatttttaaaattaaaaattaaaaaggttaaaaaagaagaaggaaaaattctccagacgatggggcagcggcagagcacgcgccgtgccgtcccttcttccgatagcagcaggacggcaggacgatgttgctacggtgcaacctactattcgatctcgagagagaggaaacttttgacaacaaagcgacaggaaattgaccgaagagttaaaaaggaaacggaaggtaactgtgctatcaaaatgaatgggtaactttcgatattacaaaaaaaaaatgacctttcaatgctataaaaaatataattagtttatgagattgcaaaattaattttcaagacaaatctaagcataccgttttatatttttgaagtaattatttaaagagaaaatttatgtccttgaaaaaggagatttttttattgttcaaatttctttgataaatgcgagttctacaaaatttcatttcaaaatgctttttctttcattatgccatcgttgtcagctttctgtcaaatgcactctaccctagcttagcgtgtagaggcaaaatgtacttgttgcatggggttaatggaaggctaaccacgatttgtcatactcacataatttatcgatggcttcaacaatttttataatcaatcgtttatcgatgacaaaatatagatatcttaataaagaatctttgttcgttcataatagctcaatcacagtcccatcgttaatcattcagcttataaacataaccaaaaattaaattttagagttgattttgatgttttttcattgtagtttatttttcagtgtttatttttaaatttctacaaacatatataaaaattggcaaaatttgctacgggaaagtcaaaatttgtgtaatttgttggtagacatcgtaaaaatgtgtcacggccaaaagacactttaaaaaactggtaatttgctagagaacattttggactcaattggggagagaaattcttcaaaaagagaagaataccctaaggtcaaaagcttttgagctaagactgtagcaaagatggagtataatgtatgctagtggtgtatttagggtgacggtaaatttagatttgcataatttctaatcttttactttaatgtcatgtttgaagggcgtggtattagggtcattctcgtctttttaaagaaattatcaatccaattaagccgaaagtgtcttctatcaaattatcagttttttactaatgtttttaagctgtgacacgttttctcgatgtttatcagcaaattatacaaaatttgagtatcatgtaccaaaatttaccataaaaattttacttataaattaatttttaactattaataaactgttacggcttataatcagtactcaaacaagtttgaggtagtaccgcgagattttttttatgtaagataagaagtagaaacaccaaacgtatgcagtctgcatgcatgtgacaagatccaagattctacatacaaacccctgtaaaacccatatcaattactactactacatactgacaccaaacaaaacaaggaagatttaaaagcctcgtagacgacacacgctacacagagaaaccgagcatgatagctgcaggtccctctggtgcaccgaaaaagggccatgcacgtaattcgcatcatggtaagtactatcggacactaacacgtatgaggttgagttttttttttttttttttggacggagcaagtacgtgcaacatgcactatgctgctttttttttttaaccaaacatgcactctgctttcactctgccgtgcactatgctttaattagtgagctcgctggtcatttcttcttggcgccgaccacgggggccggcctgccactgcctttcttgtcgccagagccagcgccaccgccgcccgtcttctcgcaggcaagcgccgccgcggtggccacggctgccgcggccgccacgatttgctttcccatgctctccttgacctggcccctccgtggcagcgggttccccgacggcgccttgctcaggcagcgcttcaccggagcgtggctgctcgttgccatcgatgatgcacacactctctcccgcttcgatcgaccactgagcaagtgagcagagcagacaatgtagttcttcgtgctttgtacttttgtagtgttggtgttggtgagactgatccggcaacaaccgcgtataaatagggagatggtgaacagcgaaccaaggtggcatagtacgacgtgcaagcagaatgggtgcattccatcgattcggtgatgcccccaccgtgccaaacagccgaggatggtgatgcaaaagactgcactaggagtaccgggctgacttggaccgtatcttgtcggagagggtggagaggcgaagctaaccaacctgctgcagtcaagccgagtccggaagaggccagtggaagtggaatactgtggagtgcaggacggtggaaaggccggtggggtgcgcgcgcgaggcggttgttctcggtggccccgatccgctttaatttgcccgagattcccgtagatttgggcggatcgtagcggcgaccgcgcgcgtccgggttcgtcgtcgtcgtcgcgcagctacgactggccgccggctgccgctagcttgacggcatcagcattcagcgacggaccgggcccggccacccgcggttgacgcactgctgactcgtgcatgcacgcacatctatcgagagcaacataagctcctctaaattcgttgtattaggttacatcctattcagggccttttaatttagaggaaaaatataggaattttgtagaatttcaatcctatagaaaaattttctatgaaaccctttgaaacaaatgattgaattctatcgaatcctttgaaattcgtatggaatggacaatcctatagagattttggaggaaatttagcaagagcttaatctcttggtaactttcctttgagtctctctcatccaattcctgcgttttttctgaggttcaatcaaacggtaattcctgtgtttttcctgcgttttgcaatgctctgttttacacttacgttactatcaaaatcttacgttttctcaatcctgcgattcaaataggccctcaattctagtttggttttcttaaagagttagggaataggctgcatcacaagtgaacactgaacagaacatgttcgtagctcccaactggatgtgtacgaatctaagctgcacattctgctcataatccattctgcttaggatataatcatcgattctgttctagtatgggatagaagcgcgatcattagggaataaccgaaaggcgatcagccgatcatgagagaagaaccgaaagctggagcgaggagcagcagcagctgagctgagccgatcagccgatcatgagagaagaaccgaagggcatgcatgacatcaccgagaggacgtcacgatcgatcgatgccgcgtcatcgatactgccaagcggagacgccgaaaaaaaaagttggttctccattctcatcggtgagtttgggaaactgttttggatctgacctcctgatttattcagactgggtcagtctgaatattttgatgtcagtcaaaatatgttcgcaaaaatacttttaagatgcagatttttttatcggttttattaccacatattttacactgctaaacggtgtgttttgtgcaaaaactttctagatagaagttgttataaaaatatcaaatatatatactttttaagtttataatctatactattccctccgtaaaataaaaactgaacctaggatagggtgtggccccttctagtatgtccagatttattatactaggagaggtcacgtcactttttaggttgaatttttttaggtggagagaatacttctaaaagatagtagtggtggtgattttcatgccaccagcccaccaccaccatcactggccatgtgacccgtgtcatatatacatacatatatatacttcctccattccaaaatataagacataaccacttttaactcaaaaaccaagaaacaattaccatcatctctttgtttgaatcaatccaactaatacaatacatgcacccaatagaattaaacatcttatgagtgtatggtttaaaaaataataatttaggagagaatagatgctaattaattgccatgcatgcatgcacgccttatattatgaaacacctttaaaaagtagttatgccctatattttagaacggagggagtatacgcttcatactttactcggttttcctcaataaatccattcctccatgctcttggctcacactacttctagaccattaaccaatttctataaattccatagtcctgactaccaagtacttgtaagaagggcgtctgcaattattaagtgaatgaccagtcttaaattcatgtgtccgccgctagacctaactgataaactcaaaggatttggatcagcaacagcagttgtagtactaactgcaacttatgtaggcatagctgcttagggcagttccaaccctccacctagaatgatgtctattgtattaactatattgccatgtataaatttaagcttatgtggcactatattaattaagagagagtgaagagaggaagaaactgggtctcatgcaaaaaactggcttcaacacgagaacctatgcactagacactgtcaagttttgcattgggagagaataatgtcttcataataaatgaagaacaaatatgattggtagagaagagagatgatgtatttattaatggcccactttaagaaaccatgggttgtaaagtgtagtttctattatgatgtcttattgacatggcacatagatactgtttatggacactatgggttgggactatccttagagtacatttgatctgaatcaaacgacaccaattagtcagagcactataacaaaagtgttgtagaataaaatattgtttatggttcttggtttgatcagtatagctataaatgcggatggttgatcatcaaaatgaatggttgcagatacttgtaaccctaaaattgcagtcgtagttaggactagctgttcttaatccgatcgaaatcacatatttacctgagcactgaggggctgaaaactattgaaagcaacagcaacagcagaaggcgtcaggtacggcacactgtttctgagcctaactggtactccctccgtcagattcgtagtactagaatacgtcccatccgatattaggttgctatattctgtaacggagggagtagagtatatcacacttggttacttacgcctaacttgcggatcctaataattgcgcacatcattcccaagattagttatcgttttattaactgcaagttccctagcatcgtgctacatagtctgagtggtattcctatgtggcgatgtgatacggacatactatgagttagctagctaacgtgtatgatgtccaatgattaagtgacactttttttctgtctaatataatcatccatctcatcatatcattagctccttgtgcttgtgcgttcactgttcagagaagctggttatcctccctgataagaacagccgggaggtcagtgtgctatggttttgtttagttctggaatgatccagtcacccagcacaattgactggctgagtgttgcattaagcaaatctggaccggatttgagggaattttctcgcgcagtggagatctatgataaatctcgtaccgatccagcatagtgattcgtccgcgggattaatactgtaactaatccatagattagcgccattattgaaacacgctttcttcttattgttgttattattctgctgtggcaaagtaacttttgactgtagataaggctatcaccaatgcggtgcttcagcccgtgcccctagcgacggccgtccccttttccatcggcgccgtcccctggtgagagcgcgtcccttagctgggagatgtgccccctcccccccccccgctcccccagctccttttcgcccaggcgccggtggaaggaacccgttgcgtgggtacgggtgcttgaggcgacgccccaagagcgaggatttcctcttccacccctctcccctctcctcgagctcctcggcgacaccgatggagctcctcatcgcactcagtcacggccgccggcgatgggagagagaaggagagaggcgtggcgccggcggcagtggcgagaaggagagggaggcgcggctggagaaagagagggagagtcaagaggcggcgacgacctaggacggcgccgggatgtcagatccgcggcgggggtggcggaggcgacagatccgcggcggagtaggctactctcgtcgccctcgccgacgaagcttcgtccggccgccgcctcgtccgcctcgagctcgccgcgcgctcgtcgtctgccgcctcgagtttgccgtccgccacctcgatgtggcgtggccggtgctgctccatctgccggggggctagatccggcttcggcggcaccggatctgctgcctccggggtcaccgccgctaccttccacgagagagagagagagagggagagagcggtgggagagagagcggcgacggtgactcggtgcgctctcgcgtgcgtgcgatggagaaatagagagaggagggggaagagaggggtagaataggaaagagaggaagaagagagaaatatgtttttttgggttgggacacttattgagctaccctgtattgtaagggcgagtactttactctaagagtgtctcagattatggatgcctaaaaaatgcagaggagtatccagtgtccggtagagataccacggacgagggcaaacggccaaactagcgatggcgtggagggcgacgttgggacgacttatgggatcacccgctagcgtagcgacacccggtcgtatcacttcactccgcggttcattcattggttccaattataaaatgccctgcagtactgcgctaactgacatgtgggtcttcccaatcccgactcgtcgcacggtgccgtgcacatcaccgcctgatggcaatcggttgtgaggctgtcacgtgctacttgcgtccgcgtaccccgtggtccccgtggattcatggaccgtggtcatggcagcggcgcgcacgcacgaaccagcacaccagcaaatccgtgcagcgaaccagcgaatcggagaatgaaggcaacccgccggcgcggtgccttcgtcagggaaggcgcagcggccagcggggaccgggtaactcgaaggatctggcgatctatcatggcagttagcgctcggcagatgggctgatagcggaagcggtggcggagcggaggggctttagaccgatggctacggaacatggagcccctggaggctggagacggagactttgggtacgtatacgaatgcagctgcatctcgacgtactagtaacagtgtaaggaagtactaataacactctcattaccatcaaaattatgctgcacatcagtacattaccaaaccagacatgagactgccaggaacacacctccgagtctctccctaactatttcttcactcaagaacaaagcaattgccgaggaagcgagatactctcgaagtctcaagccatacgctacggggcggaaaggggggaaaactacacaccaacaactatgcacaattcctatgcccaccaccgtagtacaccagaacttccatcagtttgcaggcgctgctgctcaagtgttgagctgtggctcccagttcttgcctccggggcaccacgacgctcatctcctgaagctgtgatccctgttctttccgggcaccacgaggctgcccagggccttggcgatctgcagcttgagctgccccctcttcagcggaggcctcttctccttgttgcagctgcagctgttgcagggatagctgtactccattgcttgtaagttgttttaacttgctcttctcctctcctctgagctgctgctgttgctgctgctggtggtggtggtggttccgtggtttgtgtgtttgctggagcctggagaaggagagtgctgctgggctggcttggagagttggagatggagtgtgcaagtgcaaggcaccactgatttatagcggaagtttttagccatgtggcgttggtttgcgcgtttttcatttatccttgattactcacatgttctgtcagttggggtcccgcaataatttcacttttgtttttagtcatgtgtttgtttgcgcttctgttgagagtgtgagctgagtcacaactcacaactttgtcacaagtctcactcctcaccattttgccgctttcttttgggggggaaaggggtcatctttaaagcctccatgattaggtttggttaaccccgtggtgattagaccacttaagaagtttaaacctcatggcaaattgacaattagtttattgatatgtaggcagagatgctagatgcttgggtttcgttcgttagatgagtttgaagaaagatattcggtgcatgcgaaagaagaaagtttattagcacatgattaattaaatattaactattataaacttaaaaagataatttatttgatttttttaaaaacaacatttatatagaattttttaaaatgcatcattaacaatttaaaaaacgtactaatgaaaaataagaaaactaaagtctggagttgaaaaaacaaacaagatctaagtgctcactagattttgaattaattaattacactaagtgctcattagattttgagttaattaattgaattgcgctgttaggcactacagctgaggatcgaagaatctaagaaaatttgtttagcatcagagtactaagtgctaaacatgattacatgaacggtaggagaaacgtaaagtcactcactgacccatctgtctgtgacagaagctgttagagagaggactccaaattattgcactccagaccgtgtcacgtgatacttatagattcgtagggctactttacattttgttggcccacatgcgggagcagatgggggtgggggaaagcatggatcacatggcaaaattgggcgtgttttaggaggagcggttggtgcatcgatagatggtggtgattggtggggctccttttgcggtggcctctgctgtggggaagggacactgatgtgctgatggctgcactatgccactcaaaccaccaccgtgcacgtgcagtgcgtgagccccgcacctaaagccgcggccgcgttgctatcattcaatcggatcagtaaacaaaatcatctttctatggcaaacaatattaggttaattgggtccatgccattataattttcacggttttaaaatatatcattactattcatcaatttgtaaacatgttattataatttttcttatttgatatatgccactatgtaccccttcaaggcattctacaaattttttgggtaaaaatgtcgtcgtcttcctcctccattctcctgcttaaacttcttgaggatgttgttaacgagaggaaaggagtgaccggtgggcttctcgttatttcattccggtccgcagtacacaagtggcaccacgagactgtgttcggcattgccagttcctatcctctccccctcgttttctgtgcacatgcttttcaaactgctaaacagtgtgttttttttaaaaaaaaattatacgaaagttgcttaaaaaatcatattaatttatttttgaaaaaaaatagcaaatacttaattaatcacgtgctaatggacagctccgttttctgtgtgcgcaccatgggttgggaagactgtcttccgaacgcaggagtgaggagagaatcttgaagcgatcctggccattaaaatgttttccttattttcaatgaactgaccaatagcaagtctctatattttcctgttatcaaaagatcattttgatcctggctccatagtaatatctggaccatctgctgaaaattgccaaggtcattccatgcttccagcttccacagccatatacagcacagtagcactaaaacttgcatctgcatcaccacacatgaccatactggataaagtactaacgtccatgcttgtggacgacctcgcctttcaaatactccgtattaaatgggaaaaatgtaaagtcttttttacatgtcacgtgtcagtatgtaaaaaatacaggagtacgaagtagcaaataagaaaggcaaccagaaaatgcaacagcaacagtaattctcggtgatgttgatgccaatagtgacgttctctttcataaattgctggtagattcattcatttcatacatttttcatgtgcctatcgataacttacaactcatcctgattgaatgaataaacacaatttattctctcccatcaacccgtggctaaaaagattaaatctataaacctaggaaaaaatggttgcaaaacaaagacaaaattaagaaggaaaagggagtaggagaaaataaataaaaagaataaatacaacacatacttttatattggccgtagattgtggcttgaactaccctttaataccacggcagtagttaaccatattggtaaaaattcgccgatgggtgggcttgtgattatcaatccaactttatttcttccaactgttcttccaactttattgtggtctccggcgtgtctaatctgtgctcactatctcttctgggtgtatccactctttgttcaccctcctgtggagagtctccttgcttttcatcatccttcttgggtgtgtcaaccatttgctcagtattgctattaagattgccgtttgttgactcgtcggagatattctgtttgccctgtaaagaatcaacggcgccagattgatatcacaacgtgtcaaaaaaaagattgatatcacgaaataataaagggcatagcaattcatatctcattgtttaaagccatatacttctaagacgagagaaatgcgtcgatcaatattatgcctgagagggtttgtaaacaagtaatgttatttccagatataagtcacaaaccaggttacattcaacatgtttgttaagaaacaatagcaagtgaagtcagttcccaaaaaaaaaggggaaaactctagcctaccttggtactatagtttaaatcagcaactaaatttagctatgatatctggataatggtcaagttgatgcaaatcaatagataagaagtttaagtgatatggtaaactaaatttaactatgatgtggattattgttcggaatataacgaccattagtaacaattagcatagaaggacatttcatggatcacactgcttgatcacaatcataaaggtaaaagacatcaaaatatttcaccatctttgcagtctgctatataaataattgcaatggtcctcatgctggactatgagtttttttagactagaaagagatttattgtcactacacaggaaaggaatccagtaatccactttccaataaaaattaccttgttcttgtcacgccagccaagggaaaacggagcaagcaaacttattcttctaggttgaaactcctgtgatgaatcttggttcacttggccaggtgatgcatcccttgttggtgtcctaaaaataaaaaggttacacacagggacaattggtataaagcaaatgactggaatttttcacagaacattttgccagtattgaatattattgcatttatgtaatagcataccaacacttccataccataaaaagaaaggatatattattgcattcaataaattaatttatcagtttccaactttccatgccagtgtgtgtagaatgctataataccataataccttggagaaggtgaaggggatggcaattgtgccttttgctggcttgattgatactgcagtgttgcttccagcatagtttctgccatgactgctctgttctccatttgtgctagtgaagccatagcttcctcatacttttcctgcatacaaagtcaaatgttataacaagagaatcattatattgaacaggcatgtatttgctagattatatgtcaaaaaaaatgacagcaaaatggagtccattccatgaataaaagcattacagagttcaaataatgtatagactaatgaagcatatagttacacaaacatatctagttggctaatccattgcagaggaaattattagaaacagtgctgtcctccaggtgcaatcaagaaaagaatgaccatttcatgtttcaacatgacataagcattagaacagaaaaaaatacagtacatagataatcgatgaaattaaactaacctggagcacatgtgcagcatatttctgagcagcagcatcttgctcagcgaatatgcgcgcatcctcagtgactttctgttcttgctctacacgcatcaggacctacatgcattacctagttagtttataactagataaaccagtagtaaaaggcatgatgtagtagtgacaaggtttattcagagcaacatattggtagctactacacctgaagcattgcttgctcctgttcctgcttgtctaatagagcttgccttagat

SEQ ID NO: 59060 - DNA, 1009 bp, Oryza sativa
cagtcgcagccctcatgttttccgtccacgatcccgtcgtcatcggccttgcacgtccgccgcgccgtgccacgctcgccggcttcgcccttccgtcactggcctccctgccgcgttcgccgcgtgcgtcgggcgcgccgtccatggcgctacccctccgatctctccggtcgccttcggccacgctcggccccgtcttccggtcaagttccgccatcgccggtctgatcgcgagcgaggttgtcacctccgcaacgtcctcgttgtcgccatcgatctcatcgccacggctgacgatctcctgtcgatgcgcgacccccacctcgtgtttcctcctccacatgtcttcttgatccaatgttgaaaccttctgctctgataccacttgttataaaagttagccgatatagcggaacgacgactaaccttctcgatcgcttcaatcattaatcacccaagacatgccagatgacgacacaggaacacacgatatttgttaacgaggttcagccgaagcctacatccccggggctctgattatgggcgctcctccccaaccaatatagctcctagccgctacgagtccatggccatgccgccatcatctccctgcgtgtctacgctacattgtagtcgccatgattacattgtggtgccccctctctatttaagagagatgacaggttacagagtccgactctaactctacccctaacacctattacaactccaagtccaaccgtaaccaaataggactagtatattcgacacctattctaacaattcttaatctttgtgccctcaaaataagccttatattttgaaacagttggggggggggtactagctaaatgcaggtggctttgcaacagataaaaataaatgcatgtcttattggtacaaaatgtagttcatagttggtgggtggcagattcactgtcaccaccgctacactgtcttccttcagaaggagtacagatttgtgggttagtttcaaggtttgactgca

SEQ ID NO: 59061 - DNA, 1995 bp, Oryza sativa
  unsure (1)..(1995): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacacctgtaacttaatactaaagatatataggatgaaatattagcatactagcatctccaatgaaataacactgactgtccgcacgaccaccgcacgaactaacagttcctacattacagataaattgcagttgcttgtctgattatctatattgtaagaactagcaatgatggcacttgcaggagattagggaatctaaccatactatactactgacaatgaagacacttacttggagccaggcttcgccacattgtgaaagatcttcttggcagcaatcttggcttcatattcactacgaatctgtgtcgctgactcatccccctcacccgttgcctgctgtatctgctcatccattgtcgtgagcgtcccaaaccgaacaatcctcatcaaccttttcatgttccaagctgagatatttttctggttgagtttatgaagcttgtcaatggtgatcccctcctcaatctggtgctctcctttctcttttgacagctgcttgctcccttctcccttaggaatcaccccggacatccgaatactcctttgccctgaaagattcttggttggtacagtggaacggagctcagctgggatggttgctcctgcgcgttgaagctcatgcatctcagcaaggaattggttttcgtcaactaggggcggcccggagagcgtctcgatgacaaactggttgaacaatgcctcctgaatccggtcaaagtatgtgttgacatggaaggaggatgccagcaccttgagcagcagcgtcttgacgaggcggatgagcgtggcgacgaggaagcagaacagtatcttctgcacgtagggcagcacaggcgagttcgtctcccgctggacgttcttgtcgaacatgaagtgccaagaggagagtaccaggccgagccagagcgcgttctgcacggcgctgcgcacgccgtacacgaagtagagcacgcgcttgcgcagcaagaagttgcgctcgacgcagaacacggcgatccggatgacccagccggagacaaggcggccgcagatgagcacgaacacgaggagctcccacttccagaggtgcagcccccagaccttcttcccggacagggccttgatggtgagactgcacgccaatgccgcgatgatgagcaccaagctgagccactgaaggatagtgatggcgtccagcttcccgcgcttgaattcgtcggggatgtcctcgtccatgaatgggtcctcctcctcctcttccaacgggcccgacttggcgatttgcccggacttgccggtcatgaggcccgagatgaactggccggacttcgtaggcgtccgcaagacagaggatctcctctcctcgtcgccgacgggagggaccgcggacgccggctggggctgcggcggcgggtccatcagccgggatcgcgttttggctcgcatcaagtgtcccgctgcagtggaactggacgtgcagcgaacaacctcgccgtcgtcgccgccgcgcctacggctacctccggtgtcggagtcggagtcagaggacgaggcgacacgccttttcggttggaaggagactcgcgcctcgcgttccagggagtttgagaaggatggctgcgcatgcagttgcgacggcctcccgagctcctccatgtcgaggtccagcgacagctcggcgccggacgccttctgtttccgaaggaagttcccgatgagacgcgtgggcggatcctcgccgccgtctaccgcacccgcagcgtgtgccggctgcggcgatagcg

SEQ ID NO: 59062 - DNA, 7833 bp, Oryza sativa
cccccgcggcgtgctcgccgtggagtcggtgttcgggctcacattccccgccccaccgccatcctggccggggaacgcgaacggctcgcggcaaggcccctccccgtcgatcctcacgaccacctccccttcctcgccgccgtcacgatcggccgccagtccggaccgctcatcgaacacccccgatcccacccgcggcgaggacttgcctgagccatgcgacctcaggctactcttccgccgcacctgctccatcgccgccggccaagaaacgcccactccaaagatagctagtactagtagccactctcctcctcctcctccctctccccccactcctctcggccggcgtctctgctatacttagccagagtttaactaggggattaatactgcctctcgtttcagttaacgatgcgatggaacgttccggaacaacgtggaggcgcgcagctagctgccaacgcttgtcctcctttccgccacccccgcatcggggcgcgcacggaagccgcgtcttccgtgtaccggcacagccactcgcgccggcggcaacgagcggcgcggggtttggtggccactccacgtacgtggcatggcatggcaggtgttcggtacatgatcaggaacaggatcaattagaatatgtgattagtggtaaccaaacgattgtggtccgtgtaattctgtatgtgttcgaatcttctgtgggcgagactagcggcggggattcgggagtgcgtgtcgcaattagcattttgtaaagaaataaaaatgattgtaagtggaattagcattcggtaactaagatttagaaactgtgattaacgaggaagattatataatcagggcactaaaaaggctgtgtggtgagaacgtgaactgctgtggctagtggccatttttgtattgggtaacggcgacgggaaaagtttagcatcttggtgatggatctcagggttgtggtgatttgtgggtggcagtggcactgtggtgctgactgatctcaaggtcttggtaattgtggaactcacggtcgtgattgtgggattgctgtgatggatctcacggtcttggtgaatgtggatcacacggtcgtggcggttgtgtttgtgccggccatgtttcagagaaaagtttcgctccatagacgcaaaaaaacgatccatatacacgagcaacatgtgatctctgctttcagttccgtctcttgcctaaacactccattggcatgtccgtttcttggttactgtcatataatctcgtgatttagatagatggtcatcatttcgtcataaagacatgcactggcatgggagcacggccaagatttggaatggactgtgcaaacagctatctttgttctgtttggcaggcatgtaggaaacgaacaaaaaaacgtttagtcggtccaaatcagggtgcagcgattagcaccatatctgatcaggccaccagctaagtaacatgttagggtgggcctcaaaagcaaacagaagcaagacagcaagtacagaacatatggcatgcgaatgggattctatatatctggaggcgacgcgacgtggagcaacacaacaaatgaaactcgtgtgtcctatgttagcttcggttccgtttgcatcccgttcgtgggaaaccaggtatgatggattcgttgtacaatattggacagatcaccaattcaccatcgctttcgtcaaccgagcatcatgtgtgtgtgctccctttctactccctagtagcttgacttgagacctaaaaaaagcacagttcctacctcgcatatgttcctagatatgctcaccacatcaataccggtaaagaagaacgatacgtgtacgtgcgaaatctcgcgacagacagataagtgcggtcatacgcaagagagacgacctgcaggcaacgaaaagctgctgcaattttttttttcgtctgtatatttactgttcagtaaacgcgcacggcctgagctggctcgtagcaggtcaatccaacgaccgcgacgaggccctgagatttcagttcacaccacggtgccagctactttacgcctcggccggctatgcagcctccctccggcaactgcaaggatgtacagtacgtgcgctgctagattgcgccttcgtctcgtttcataccggccggtgacgcggcagcgcgagcggccatggcgctctgcatgcgcaaggggaggacggtacagttgtatgggccaaaccagagtaccagacacgcgccggctgtcgcgtggcgtgtttccgcggaaatcgtagtagtaggtgtgcgtgttcggctgttcggttttggcggcttgccgtcgacagtgatgtgcccatgcactgcgcgacgcgcctggtgttttcagatgtattttctgtcctccgtttttttggcctctcgtggcgtcgtctatcacgtaaactaggctcgcgcgttacgtcgtgagttgttacttgttagcttcgcgtttgtagagttcaacgagaggacaacacgaacttgcaagcagttaaggcagaccaaaaagaaggataggcatgcgggcagtcgggcacgcacaccagtcgggagtatttatcaagtatcatgcaaatgaaaaggaggtatatgcttcgtcagagccaggtgagcccggtcaggtagaaaggagattagcactttaactactgtgataggattggacgaatgtaaaagaataattaaagggataccctctccgttgcaggttacaacacgctttgactttgattaaaatcaaactactttaaattcgactaaatttataaataagtagtttcattaaatcgataattaaatatatttttataataaatttatcttaggttgaaaatattttttttacaagtttagtcaagcttgaatcagtttgactttaactaaagttaaaacatcttataacctgaaatagaggtagtaattatttacatgatgaaaaatttaaaagtaatccatagttacagtttagagtgttgtttcggtccttctttttgtaccacgtggtactagtaccatgagatactaaaatcctgaccgttgttggtcattggtgtggttagcgcgagagagccacggtggaagggtataatcgtaaatggagggatttttggatcggtgcaaggtttggctgagttggggaagcgcggcagagtagcagaaccctaggtggcggcggtggtatcccgttcgcggcggcggcggcggcggcggcgcatccttggttctctgggaagagctgcagaaggcaaaccatcggtttgccattctccccttcgcggcggcgcctcatccattcctctcgacaccgcctttttccccttgtccaaatcgtcgcgggacttcgatgtatgcgtgcgtgttcggccatggatgagtgaagcttacaatttcaggaaagtacaagaagatgtttgagatggatatgaagtacaagcacacaatttgttctagacgtttgataaatttgtcatgctcttgtccgttcctgtagtattggaggcattttataatggagtcattggactgtaatcaatcttgatgtgttttcctgtaatattacgttttcaagctgtgttttggtattggttacttctggaattgaagagatgagtttaatgacatggttgcagctagttttatatttctgtatgttttatggtacatgcaatgcttggtgatttctggaattgaagatatgatggatgtattgcaatttggagttgtactgacatggctgaagctaactattttatctgtatgtgaacatggtatatgtgaatctgaaaatgatgtacttcactcatgcatgagactgacagccacattcataattttgatgtcatttcagatgtgagaaatccgaaaagcattgttaaaattgatatgttaaattgcaggtagcaaagtacagctcagacataatatagtcaacagtgatacatatactctgaaatcttgtacataagaattacaataacaactagggaacccatgaaccaacttctagcgtggtctgcctcttttttgagctttgaaatttttttcttatatgttgcttcggtagccaaaatcctggcagccatctcaaattcaagtttcattttgtcttcctcaactttcgctctatcaatatagttagaccattcatattgccgcctggttggatttgtcatgctagtacgatccaatgcaagccaaagcttctcgaatgccttctgcactcttggatgccatcttggtctacccagattaaagtatcgcattggtcaacctcctgtaacattggttatttcatagtattattatgcaaattttcttgcagcgaaacaatggtgaacatactcaaatccggtcaaacaaaaaacgaacagcagaataaaatcaaacaaaagcttactggccactgcggcggatggcgcagaggatggcgccggccttgcagctgctgcgccggccacggcggcggcgaaccttgaagcgtatggcaccggcccttgcagctgcaccgccggccactgcggcggcggaccttgcagcggcggcggcgacgactcctgcggccgcggcgctgccaggatgtcaccacccgtacggcgacggttacagaagcgctcgccctcctcctcagatgaacacccgtgcggcggcgctagcgtgagatgcgatgggcgacggtatcgtgagatgcgatggggatgacctaaacgaagccgcacgtagctagaaacgttgggaccccacaccggagcgaacctcgcgcatactcccatccccatcgtacccctcagcaatcaacggccggatgaagactggtacctcatggtactggtaccgtgcggtacaaaacgatggacgagagaaaatctatacagtttaagggcatgttcactttgatgtcattttcaaccataccattatttgtcaaagttgcaaaaaaaatatatacgtttagtttgttgccaaatttgaccaatacataagaaatcctgccaaaattttggcaatattgccgtcttgctataattttggtattgccaaaacttgtaaggttcattttggctacaatctgaatatgccataaatcagaaagctaaaattgtcaaatattaagaaagatattgccgctagcctgctacactccttcctatccatacattatcgtacttataccaatttgttccttaagagaatagagaattgaagtaggaacaacttgagattggatgccaaaaaagcttacgctggaggatctatttgactagaggcggaaaaccctaatgcaccggcgcatgcaaccaaccacattggattttttacaatttggtccttttcaaaaactaattttacaaataaactcctagaaaaacttatcccataaatgatcctttttgggacgtcagagttgctggtgccatggttcaataggacagcgcgacgccaaaagggtcctcgccaaggcggtgcaagatgggcagcgtgaacgcagtgtcttctcgctccccgtctccgcgatccccaacacgtccctcccctcaagcacccgcgggatgcactgccgctgcacgaccatggggctatgcatcccctagtaaatcgcacacatccactagccattgcgatagcccaagttcgacgaaggtggacagcaccatagcggattccgcggcggcggtggtggccacgacagtagggcctagttggagtcacaatgttcgggctccatgacgcggagctagggtttaggggttctagctggggctcagcttcttgcttgggtttcttcttgctggacttgggcttggagaagaggaggaaggggcgggctacgccgtcgacctccatggattgcaggcttcgtggtgatggaggcggaagagggtttctggaagggaggaagcaaagcacgcagggtaagacggggacgcacgcacgcgaatttgggaaaagcactaagaaatggtagcctccctgcccacctagaagaggcagctagcggcggtgaaggcggagttgccgccggatgcgctgggtgcgctccacgtcgaagtcctcgacaacatcatcgaccgccttcacatctacgaggtggttcgcacctcggtgctctcatgtgcatggtggggctgctgggagtcgctgcccttcgtcgacctaacctggagccccgacgtcgcggcatccgacgtcgacgtgatcctcctccgacgctctgccaccgatggccgttacgcgccattcctttcccgccagccgcagcgttcatcggcgggttcgactcactcgggcaagccgagggcctcacgcaccggtcgaatgtcgtagactcaccatcaccgatgaagagaggggagaggaggaaagagggagcccccgtgggccccaccatttttatttttttttgggtgtaactaactatcatggttaaaaataaagtattcctcaaatcctacgacttatcgaatatgcggatacggcatacctttgtatatatgatgtatttccgtatacaataaggaaattcacaagctgttatggaaattatcctcacaagaagaggaatgttagagtcctactcaaagaggattgggttgatactatatagtgtagggtctgttgtcttcgagttctactttgagactaagatgactcagggtataaaaggcacaccacttagaggggttcagatcattgaatcatagtgccaaacacaatcgccatagcctacaatccggaggacgtgaagcctacttgccgggagatctcatcgaaaccatctcgacaagggatctcgccggtaatatcaggatcgtcggttctttattgtaatatgtggtatttccatatctatctcatataaactagattaaggcttctaccttacgaaggcccgaattagtataatccttgttttcttgtttgcttgatgtcatatcgtataaatccttgtaccaacgtaccccaatactctattcatctggtctacgagtatccccatcgacactaacatgtagggtcacgattatattatttgccaaaccaaactgccacgtaagcgccatgtcaatgccacgtcagatgaagaccgagtcaaattagccacatagacatcacgtcagctgaaaccgccgtccaaaccatcattggaacttattttgcactagttttgatagttgagggacccgttacgtattgttttccgattgaaggatcaaaatcggattcttgataagttaagggccctcagatgaacttattcgcccgcaataatcttaacaggctataccgtgtgatgagatgggccgtggaaggtctattgtggcttaagctcaaaatagtgtaattggttcgaccattcctgacatctccattgcggccgaggtgctgagcaggccttcaatgcagtgggtctctccgctcatacgggaccagctcaaagcttcagtctcgcggtctcgccagtagtagctagccagccacgagccagagtgagccagccgcccccacattactccgcggtcgcccaacggccgccaccctcgcggcgcacacagctccaaactttggaaacgaaaacccctcgcgttccacttaaaaacctcgccacaatccgttgcgcttactatcaacgaagaggctcccagacctgttgcgctttgcgcctcgccacaatccaccactgtgccctctatcgctcacgcggtcacgcccatcgcgccgcgcggctcccgagatggcacggcacgcgaagacggactccgacgtgacgagcctggcgccgtcctcgccgccgcggtcgccgcgccggtcggccta

SEQ ID NO: 59063 - DNA, 13758 bp, Oryza sativa
cgtgcaccactcccgggagtcttccaccggccgcctcctcttctccgaccagctccgctccggcgccgctgccggcgtcccctggcgacgccttgcgcagggcagcggcgccggcagcgtcggggacgacgacgacgacgaaggaggactcgccggggccgcctcgcagtggaggtgctacgccctcggggcgttcgccttcgtggccgtgttcgccttcttcctgctcgtgctctggggcgccagcaagtcatacaagccccacgtcgtcgtcaaggtgcgtctctcacctcttggcttcctcgttcactctcgttttcccaagaaatcaacactggccattttagccgtcctgcgagtagagatggtagtgtagagtgtacatttccgtttatttccttcaccttctcaaacgaacaactaagtagaaaatttagaaatgtactataacccctgtcaatctgcccaaatgttttcgattgaatgcaactatatgcaagttttgagatatcggtactggcaccgattgcccccgtcttccttccaagagaagagaaacacaagctgtgtacatccaatctgaatgcatgcatttactagaggcagcgtccgttccgacgatcgtacacgcattttgccaatgaacagctgtaggagtactcctacctagtaaaagcatccgcgaaacatgcacacaggaatactaggagaacgagtactacttaaaacaatataggagcaggagtttttgcttcctggacatcatgcggaattgcggatattgcgatcaatttgctagccgtttctgtgctggtgccattctagtgaatcaattgaaatttgaaaggagtataaaatgtagtagtgctactccattattgacttgctgtacgatttgctgttcctctccatgtgtgtgtagagtgtggtgttcgagacgtaccacatccagggcggcacggaccggacgggcgtcccgaccaagatgatgtccgtcaacgcgacggtcaggctgcgcttccgcaaccggggcaccttcttcagcctgcacgtcacctccacgccgttccacctcttctacgacgacctcaccgtcgccaccggccacgtacgtgccctttccaccaccccaaccctcgcctttctgctcgtacttctacctgaatttgcctatgccatcctcgttacgtttggtgaatctgaatggattgggtaggtgatgcggacgtttccgtgcctgattaggctggcgtaaatcgatggtagttattgctagttactgcgtaacaactcacaaacaaacgggtgaatcaagagttggatctgggctctgtacaatggatcagtagggttgtcccgattattcgtactgtgctcttcattactaacatgagttctatcacgactatagtggagtactaatctcctatgccattccgaccgtgatgccagcagtccgtggaatttttgccggtttagatcagcttttgagcatccccatgaacatcatagtgtggtggagtatactaacctactgcctaggtgcgggagaaagctaaacctaacagcacggttcccttcttatttgtctctgtccttgattagttttttcggcagctcttcactcggaagacagaacaaagttgcgttttaaaaaaccggctcctccattgtcatcctcgaaccggggatagcttgcagccttgcattgccatttgcttcctcgacggagtggatcatctcagatgagacttcgcagccatgcattggggctattctgaggcgctgttggacttaagcatgatagtgcattgttttgagaatttgagtgtgcagcagcttgcattcggccattcaggcaggacttggatttagcgttttacacacagaacctcttagcgtttacacacacacagacggtgagctcgtgagtcgttccgcagtaacaaaaatatcatctgtcaagttacccgctcggctaactgcagcgattttctttcactagaatactggtgagtctggtagtactgtgcaaagtgggggcgaagtgcatgtgatcaagtaacaaatactcctactactactagtactacacagaaccagcaaaaaggggacctggaatggaaacgcaataacacccagaggcaagcagtggcgtcattggctatcggtgggcatggtgttcacgtgactcgagtcagggatgccatcgcttgccatttgccgatatgagcagattttttgttcttgtcacggcacaaagaccagccggtaactgatgtaaggactgaccggttgagaacgactactcttcagcctccctctgctatagtttttttagaggaaaaagacaacacttccctgatgactgtcttgccgctgctgcatgcgctaccactggatactccgttgcatagtacaggcaaagagccaatgtgatatgtcaggcctttgttccatcttcaacgtcaacactcaaaaggattgccttttggcaagtactataagcacctttatataagcccttttatgttgcccctaaatttaccacgtagattaggtgatgagtcggaggagaggagttaggagagagagaatgagccacccctcatgcaaggggcaatctccacacaatctccaagaaaaatataagatgatgtgtgagagtaaactaatattggggtttgtgtactagaggtgacatgttgtaattgttatctcttaattaatgaaaagatgacatggtttaaattagacgtggcactcacctccaccataaaacttgcccttagggcatgcccaaccctccaccttggagggtatccctagctcgccccactttttcgcccgggaccatcgccctgcaaagaatcgcggacctctgcagagcgccgcgcacctctgctcgccccggctcgagaacagcgaagcacgcttggagcggcacgttggcgaggtcgtctccccgtgacggatccacgatggaagatgccgccgccgggaagctccgccggccaccgacgcatcgatctgctccgctactgtggaagaagatggcgaaggggtggactcgagagaaaggcgtacccgggaagctccgtctctgccgcgtcgctccctgccgctgacgcgtcgatccgcggccgtcgcgtcgatccacgtcgccgctgcttcgatccgccgctgccgcctcgatccccacctcctgcgcctccatctgccgccaccgcgtcgatctgtggccgcagccgcttcgatccgcgcccgctgccacgatccccacctccagcggctgctcgatctgctgccgccgggaagctccgccgccaccgctgctcgaggcgccgaggagagagaggggaggtcgtgctggggagggcgccgccggagaaggggaaatcgcgccaccaggaggacgggaatcgagccaaggaggggagcctagtgatttttagggggtatactgctaatattggatgtatatgtaaataaaaataatccaagggtttaaatgtaaaatatgaccgactgacaggtgctgcagtgtaaaaatgagatgtgggtaagggtgcgccctgcattgggcatgcccttactgcttttctatgtttcagacatcacacctttagcttacgttactttaccgtagttacagtacttttgccgtacgctttgtttactctgtgctgcggcgagggaatccttttgctgtacaagatgatggcccccagtgcgcagcaacccagccctatcatggttcatagactcattgacttgctgtgcatgttccggtctgtatttttgttccttgttttctaccggacggtaaatagtgcaagtgcaatttttctcattccgacagaaaagtttcccgtgcaataatatactggaagtacaatttattcggaggatgcacaaccaaaccgcactacagtacactgcactgaacgatcgtgttgcgtgtgtgctcactcatgcgtgcagatggcggagttctatcagccgcggcggagcgggcgcgtggtgacggtgtccgtggtggggaagcaggtgccgctctacggcgccggcgcggagctgcacagcaagcccaacaacggccgcctcggccccgcggtggtgcccgtcaggatggccttcgtgctgcgggcgcgcgcccacatcctcggcctcctcgtccgctccaagttctaccgccgcgtcctctgccgcctcgacgtccgcgaggcaagcctcggcaagcccgtccacggcgtcgccgccgactgcgagtaccacgacgggaggtgaccacgggcccttgcattcagacgctgcgtcgataccgtgggcgtggattgttaattggaagctctgaaactagacttctgggggtggtagtagtattggtaacacgaggtaaaatccaatccgttgtaatggaacaagtgttgatgctaacagtaatcctgctaattctagaaaattttacttgctgttgaaatctgtactaccattggcattaactcatgtctgaagctccggccgaaatatgtaggccatcattccagcaatatacactactaggtgatattacaacaagctgggctggcttctatgacatagcagttgtcaatttactatctgaagaagaatccttcccttccctgatggagatttgcagaggaataggggaatagtcattcgcccatcaggatagtagacaatgggatggtttcacgttggccaaatttacaatgtacagtatgtaaatttacaatggtttcaggttggccaaatttacaatctactagcatactcatcatgcttgctcatgctgcacaatggccaacatctcacttgcaccagattgccctgctcgcatcctcatgctgataatgaaggcaatgagctgcagagtagatatactctattcttagtatggcataaaaagtgtgcactgaacatattcagttgaaatcttaccgtacaaaagccagcacacatgatactgaaacctttgaatttgaatggcgctgtttctgaaaggacccatgctgccgcaagaaagcaaaagctatggagtaaattaaaggaaacaagggttataaactaggatttatttacaaatgaaaaaaatacctgttagaggggtaaaaattagtggagctaatatgctggcaaacgagcttatgcccgatatacagccttgagcaattccctaagaggcaacaccaaagtaataggaataatgagcgaaacttagcagtcatgtcaactaatacaacacaggtcatcatttgaaatactcaaagacaatgatcagcaacaataggaaaaaccaacctgctcatttgatccaacactcttcgatacattggttcttatctagaaaaacagagaagaagatgattaatattgttctgaattgcttggaaggaaaaaagtttttaataaactgttgggaaaaatatggcttacagaagggtgaacaaaagcactcagaattataaacaccgcagataaatatggtacctgtagatgattaagacaacgttagcgaagatatgtgtaatggatgactgatattggtttagtgaatgctggaaacgcactattgcactgctgaaccagcaagcaactaaacctgattgcaaattagtgcaaaacaagagcgtagttctgtctatacatttggatatagccaaaattgcattcttttgggtaagagtctaataagactacaagagaattattgccaagtccaaaggaagtacccaatatgaccatgcaatgccatacaggaaaacctgaaatataatacaaaattgttcagggattacaatcacactcgctgacattattgcataacggttcaaaaatgcaagggaaagaagctgttacatgagtacatcctcctaggagtcctataataagcagtatatcctcgccaacaaatcgagccaagaccggcattacagtcagctgaacagcatgttatcattagtcagaaatcagaaaatgtaaaaaaagcaattcctactccgggctggaaagcctaccatataacagttctgctgaaaaaaaaaatacaatcgtacctgtgacagcattcctgcagcaccagcaattaacagaagattagcgaactcatctttgctgtaaccaaactgtgccttcaggtagtactgcagacacatcaaccgtaaaagaaaattcgtgttaaatttaactgacattgaaactgaatacttgtcagattaggtgggggatagacaccagtaatgcagtctgaagcccatgttccccaagactgtaaaagaaggtaacaattgctgcccctgacagggtcaaactacaggcagcagcaatgactcatcagcacattacagtttatagtcaaaattccatcaaacataggtgtcaataaactctaacaaaagaatatgagtatcggcacgaattgcagttaggcaagaaagaacttaacctgccagtgagaagcgaaaccatgtctgacaacgacggcaccccgcccttgtgcggcggaagtctcggtgagatctcctcatcggaggaggacgaagacgaagtcgcggcggagcaggatgagccttgtaggaagggatcacatgcttcgtcaacgaaggagttggctccgccggaatctgggacaacggccctgagatagatggccgtcgccgcggcgacggccgccgccacctggaaggtggttgatgtctggaggaaccgcgcggtgagtgttccggagacgaaccccgctgccgacacgccggagaggagcccgaacgccgccgctcgccgcctggcgccgacttggtcggcctgcgtccacaaacttcacctggtcaaggactccctgattgggcggtgggccgcccacttctgttacgctgacgagtgggcctaatcgccgtattttccgtttgttcagttgtactgtattggtagtttgtcctttactcctttttgtgtggtagtatacattctttctgttgtcgtaattgtacaggtcacatgttctcgttaaatatacgtattcgttattcaggatgcgtatctcaataactttgaaatatgtatttggatgatcgatctatcatagtgaggttttcattaccacgtaggcgagcaagaggcaatgcatgctgccctcgcagaagatgccggcgaggaccttaacgacgtagtacacgtagaagtacaccttggagcggttgcaggccagtataactgccagaaaaaaaagtggaaaacatatgaaaatgtgcacagatgcattatgcagtttcatcaagctagggtgacccaagtcatgctgcaaagagcatacacaacggcagaatggccacggtcaccggcagtgtcatcagcgccttcctgccgtatttgtccgacaaattccccacgatgggagtcaccacaagagcccccatccctgtgatctgcgcaaattagccaaaagccgttccattttcacaaatcccacccgcaaaatgtgacttaaataatccgaaacgcgcgatactcacggcgctctggaagccgctgaggtagatggcgacggagcactcgtcgcggccggggcagacggcgtccatcgtcacgtcggtgatcgccgggatgaccatgtaggaggcgaagtggaacatgaacgccgccacgaacaagtgccccagcacagccaagtccttcatcctggcgtctctaccaaatcgacagcttaagagaaacacggttaatttgcatgccaaaactccgggtctacgttttatactcgcatgcacggcacgcaaggacaagaaaaatatacatatcgccaatgcaacgcttccaagtaagagaagcagaaaaaccgaagcatcgatcagtcgctcttgcttagggtgatcacccacttgatctcgtcactaaaagtgaccctgcatttttgccaggtttgcacagttatattgcgccttgtgaacatacttttacgtgcccaattccccaaacaagccaagcaaaactgtaaccgtcccgatgtttgttgcagctgggagcctgagagagtgatctgaggacgagaacctgtgattactggagctagctaagttgtcgctgccgatggtgattggttagtgtggtgccggtggcttgtacgcatggcgctgcaacagagcactagagctaacatgcgagtgatggatgatgtactgatgtgttttttagagtgcactccactctactttcggagctactgctcgctgattgggtcttttgtagcttgcagccctggaactctgtttactcgtggaatacggacaccgttggtcttgcttctgggaaaagctgggataatcttgcttggctctttctgcatttggtgctggaagtttgcttcttcagtgggggaaatagcttagcgcactcttgattactagggagattagatctatgtttggtagtagctgagcctcaacgacagttgaagtctcaaccctgaaccgaacagaactactgaagtgcaggggagtatcagagaaggatcggcatttttttgatgtactagtactagaaatatcggaagaactgtatccttcaagactgttgctcctatatattttactatggtccatatactaatttacatttctaagttctatcctcatttttcacgtatatgtttttcaaattataaaatttttctatagaaaagttacttttaaaataatattaatcggttttcaagtttttaaactaatacgcaagtaattatgcgttaattcatcatcaccctgttttctgtgcccaagggaaaattcccaacccctactcccgaacacaccctagattggtgataaattggttgtcgtcaatgccaataattttatctacaaagtgaaatatcgtatttactattcagaggggcacttttttttttcatcaatccaaaacagccctacattccaaactcaataaaacgcaactggaacggatgatgggcttggtgacccactgaaaattgcagagtccgtccaattgacgataggggatgtcgtgggctgtggcctgcctgtgattcttccaaacttaactcggaagccaatatgcgggcgtaaatttcactccgtattccgcctcgacccacctacgaacgtcagcctaagtttatttttggcccctcatttatgtcgctgagactgaaattcgtcctcaaatcgcagtacaacgtgcctctcaactccccaaaccagtggccccgagatggtacggatggttgtttctactgccgtggcgtggcgttgatatggcacttaaagtatataaaaaaacccgtgagactgataccaatgaatgttcggttaaaaaaaaaatggtacgtcctattgcggtttaaggatgaattttagactgacaataaattgtggggcaatagatgagccccatgggcaggcttgtcgaggtcagcttcaaactgtgttggaatatcgaccataagctggaataacgtcagttcacgtaccgtacatctgtatgagcagacgtttgtctactccggaacatacatgcgagcagcagacgccgtccttttcattcctgatcagtttgtttgtttgtttttttttaaaaaaaagaacttgttcattgttgatcaatttgttcgatcagctgttcgaagacaggccgcctcgtctacaagaggaatatcaaacccctgcaaacaattaattccttctccccacgcataaatagcagtgagaggcgaacgagaatattcgtcaaataagaaaatggacgcgttatccagctcatacatccagccgcccggcctatgccgtgccttctccctctccctgatgccctgatcgatcgatgggcggccactgccgaagccatcgggctggcgtccacggaaacagcagtgatcgcgcccacgagccccatgtgagcctgtgcgacgcgcgcgcatgtacgcccggttctttcatagcctttcggctctgtctcacggttatttcaacaagctttcggccttcactcacatcctgcagctgctactgatttactgaagtgatcggtgacgatggaatgctcatgcatgctacattgctaacgacgcttcgatcgagttaattctttatgtttgcacgtacgtatacgcttggacgaagtttgttatgttcaccgcctcaccggttcacgtggttgatcggttcgtgattacgtacagaccgaaaggagggagaggagtcacgttaatttttttagggtaaagagagagctttattaatgcttaaataaagggttacacttctaatttaataaatctagaattcttgcgaaagcacacaacctccactccgcgcaggacctagaacacattgccatttatgctaaaacatgtgctaccctatttgcttatctctttatcgatttaataaatctagaattcttgcgggagcacacaacctccactccgcgcaggacctagaacacattaccatttgtgctaaaacatgtgctaccctatttgcttctctctttatcgatttaataaatctagaattcttgcgggagcacacaacctccactccgcgcaggacttggaacacattaccatttgtgctaaaacatgtgctaccctatttgcttctctctttatcttgtgcacttgcacttgctgaaggcattgcatcactcctttaatctcttcaatcgtcgtcgcccaggccgatttcaactgatcatgcctcattaaatctttaacaatttctgcattgtccatctccagcacgttaattatattggcattgatttgtacgtgtacgtactacgtactatctacctgctcgtgtgacagcaacatgcataatgcattggtagctaactaggctccaaaatgcagcagataatttatgaatgtactaggctaaccgaatacgtgcacgtatgccaaaattgacagcctgaatattcgggtgtgtgtgtctccagcagtagttcttctcgatcgacgaatctatacacaactacgtgcgtatagagacactcgtcctacttagtactcctgccgtacgtatttattgtacgtactcccttcagttggattaatttcatgagaaaagcgagagtccgatccgaatatattcatgtgggttgatatataagtttttcatttagcaactgaagacatgcttggaagtttgaaagcgcgcagggagtttcgcagcaaagttcactgcaaatgattagatcctaattcccagacaggaactaatttcaatttgtctgctacaacggatatgtcatgagtatacacggttgaaaaaatatttcaagattattattcgtgtagtacatgcagctagcatatacttatacttttgtgcatgcatggcaggcaaaactttttcttgcccgcaggctaatacagcgaacagtccacttgtaaagctgttgaaaaatccggaccaaacctgcaggggagcactagtgctagtctccgatcagaaattcgccaatagcatgtgatgtatgggcccaagctagctagcgtccatgcaaatagggtttgacacagataactatactacttattcacatctgagtatgcatcaatattaaaacgaccgaactaactaatcccattgaaaaaaaaatgattccacctattgcgtggcgtccctttctaatctttacacagacaggtgcctatgagctgtctaattcgtaaacctctctaaataaaactctagcttcagacacgcagaaatgttatttttatatatctatatattctcgttctccactgctcattaggacagccagtttgcgagaactctgagaaaagaacagcaaaagccactgcaatagaagcgcgcgagcgctgagagtatctcagatccatggagatggaggctgccacgccggtgccgaggagtgacggcaggaagctggcgaggtgcccgaggctgcagatggacgccaagacggtcactgccatcgagcagtccacgggcgcggccatcgccgacgccgctgcggctggcgccgagggcgccggcggcgggatgcgcgtcaagatcgtgctgagcaagcagcagctgaagcaggtggccgcggccgtcgccggagggggcgccttcgcgctgccgccggcgctggagcagctcgtgagcgtgctcaagcggcagcacgcgaagaagcaggtggcagcggctgctgatgtggtcgtcggaaggcgccgctgccggtggtcgccggcgttgcagagcatcccggaggagtgctttagctaggtacccacgtctacgaatgtgtagtcgattcgcaacatgtatagcttcggtgatcagtccctcctttttttggcgatattcccttccttcctataggctgcaaccgatcgatctagttgggccaaagttagtgcccaatggttgcatcccaactttgaaatgtcatgtattttaatctggcatttggacccaaattttcctccgttttcctggttcgatgcatgtacatatctctgcacacgaatagtattcaataagatgatgagctgggaaaaggaacaacaaagtgtgtgaagtgtccctttctttggcttcaagttgtgtcctgcgtcaggtaataaactgtgtgtggcagcgaggtagcagatggagtgttgctgggaaatgggagccagcaaatccctaaagattcctcttccagtacgacaagatctactcctacagtcctactacacaaaagggttgcagttacgtgttggcccaagggtgtagcagtggcatggcctactgtgaatctgtgattgtgtatgtcacatgagtccagtggtcgaggtaatcttgctagcttcatttcagagtcgaattgaaacttcgaaatagagcacttatcctctttccgtgaacaaggaatggaggatatcgacgccgttatatatggcagatcgttcagtgcctgtgagaggggaagttaacttgccatgaacacaccatcaaaaattcagtcattggatcaggaatagactgtaaattgcctttgctgctctagtgctatgacgagagggaggggaagtgagtcagtcatagagagtaagaattaagaatgatctaaatttagcgtgcgagtgacaaaagcgtaaggcacacgatcaggattcaggaacgatggatggttcagatagctatgttacaccgatgtcaaattaatctcgagttgcttagttagttactaaccatattgtgtgtacactaccaaagtatgttgacagttcacgtacggtcttcgttattaaccaccactagtcagtgtagggataactacattatatcacttatcaaagcataggtagtccgggccgtgggtacgttcagagggttttacacagggaagtggtacgtgttaattccttgaatcctcacagctagtagtatcgatcgaaatggatcatggatgatcatgaatgctagctttcacgtaccatctcatcaccgtgccgctccaaggaaactatggagctcacgtcctaaggtacatatacagtactcttctacataacgtacaggtccattcctcgtttcagacctgtacttgtaaaacaccgactaattaaaaattccaatcgtaatactatggctgtgttggatccaaacttcagtccttttccatcacatcaacctggcatacacacacaacttttcagtcatatcatctccaacttcacccaaaatctaaactttgcgctgaactaaacacaaccta

SEQ ID NO: 59064 - DNA, 2830 bp, Oryza sativa
ccccacgcgagaagccacacgagtccacgagtcgcacccccggcaacacgagaaacggctggatgaaccagcgaaaatccagcccggccacacacgggagagctctagtagcgcgctgagcagccagcgccgccgccagagcgcacatgccgatgctttcccggggccatgcctcgatgccgcgacggatgtgacgctgccatccctcgttgcgtagacgtgcgcgagctgcgagccggtgggttcgttcgcggtggaaaggccacaacccgacgagacggctgccgtgtcgatgacgcgcgcgcgcgtacaaaacgccccagcggtttgcagacgcccgtgccgatctcaccccatccatcggctgggccgcgcggcgcagcccgcgggcgggcggagacaggagggacagctagtcgcgggcgcgcatgtgacggcctacctgaaagcgaccgtgcctggctccgagcgctttcgtgggaggaggcaaagggggcgcagcgcgacacgcatcgaccggctcgggacagctcagtcacacgtctcggcgtacgaactggttgggcgctagagcccgcatggaaaggatgatgagatgatctggaccgtgaggccacgatccgacgggtggatactggcggggagggaaaacagaacggtccagcggtccgtgcacggtggacgggggtccacgatgtgattgagtccctaccgtgtctgttaaacccaagttggctgtactggatactacgcgtcctgcttatccgaaataatttcgacgattgggactcgtcccttcaacagcggtggcaccggcacgtcacgccagcatcatcatcgcgtcacgacctcccccctctctcattttggttttcttttttccggatctttaaattatgtggcgttgggcccaaccgatctagtacatgttacctgcaaaaaataattcgtggtacaggtacccatgattcaactctgcatttgtttacctgcgtcgtacgtccattttgtgctatccaatgttgatcacattattcgcttcacaaggtaggagtaggagtactgtaagtaacttgagtgcgagttaaaatggtcaacctgtacactcactcgccgagttcagctactactccagtaattctcaagtaaaaccattgcccttcatcccgaagcaaccagcacgccttttccgaacccgatcgaccatccgatcagcatccaacggttgagccgcgcctgagccgtcaccatggagtaccagagcagtttcctccacgcaaatctgggatcgccgagcagagctgcgcaaacgcaaacacaacataaaacccttccacaaaatgttgacctgaaaagcagcgcctccttcacatgcacgttgtccgtagcgcgtacatctcacgtacttggctgcatgtattccggccgcaagcgaacaagaacagccgcagaggagcaaagctctgcatttcaacagcgtagtatagtagtactgtagtagtagtatttgcttgtggtcaggagccttccttgaagcaacctccaaggtggcagcattgcaacggacgaattaagatccaactaatctgcccatggctcgtactttaggttactaatcaagcatcattttataaactaattagcctttcctaaataactgtggctggcatgtgggcccggggtggccaaccctggccagcaaccgcacgcgaaatacagcgcaagatctagctttgtccatgtgaagaaagctatgtacgatggtacatttgatatcaattggttcaaggcattgtttagtatggtttgtgttattaattattgcttatttgtttatgcagtggtttgcacccaaagaaatggctgctacgagagctagctagcggccaatccatcgctctctccccatgttacttccccctccaaacatggcgattggatatgcatcgcacactgcccctgatataagaaagagcagtagataatagctatctagataccccctgagaaggcaaagactgcggggctttgacaagttagttagttaatcatgagcagaagaaacttgcaatccaccgttagtagaaagaattcgtttcacatacaccggtttagctatacgtacgtacctacctaccttgtgaataatgcaggcaatgtcactagagatagctagtgttgatcgatcgatcattcacgccccatatcttagtggttgctgcgatcttggtatcgtacaggtacagccacttgacgtacgaatattgcgtctagcacgttattgcctgcgttcatttggctcgattgaattggaacaacgtcccgtgtttgcgcgatcgatcgcgtttttcttgcggcctgcattattaatttccagggggaattcgaacgattccacgctgctcctgcgatttcaatcatggaggttggttcaccctccgtccgcgtacgttgatacgctacttgcgcccgatcatggcgcgtcctcgatctgtttataaaaacgaataaattcgccatcagatgatcgtcgggtgaacggaagtgtagttgaacgcttgatgtgcattgccgtcctaattctggtgggggcagggggggggggggagttcgatctgattatgtctgttaactgacggttaggacttaggactatgatctagtcagttagtttgagatgtttttgatgtatacagtttaaattaaaaattcgtatcaacgacgttcgctcgactgttctatcactacaactatgtgtcatggggagacttgtttcatcatctaaacacgcaaggattcggctcgagagccctgaaaaggacagtaatat

SEQ ID NO: 59065 - DNA, 1719 bp, Oryza sativa
cctgaaaaggacactaatattatctgcgatatatgctgaaggtttctgacaaaacctcttctcaatattataacggattcatccgattccattcctctgtttacctctgctctgtatacatactccggatagttcaactttatgtacgctaacatatgctaaccgatcacgtggataattaatactactacgtgtctgcatatgcgtaatacctgacggtcgaattaatggcagtgctacagtgttccaccggcaatgtggcgaaaacagtaaggagaacatgccaggggcgctgctgtagctaacaatgtctgtgtcaattgtgccatcctaaccaaatgttcgtagactccacgagtcatcgagtcgtgaggagtgacaacacgttacttgcaaagggcctcccttccgatcgatccaatgatcccggcccccgtctccgcgagagggacggccatgtgaggcgcccatttctctattcaacttcgccatcttgattagtccctgtctcatgattgtttttttgagtgttaattaaaaaaacttcgccctttttattgtcatgtacattaagaagaacttaaccacagaagtggacgtacttttattttttgttagcgtgggggcaggttggggtaggagtcgatggatggcccacctgtcagggagagtgggggtggtacacggttggagttggagacagttgtggctgcgctcaccaaaaggcaaggcaaatgcatcagctcaaggtccccggagtagtatataagtaggttggtgcgtcacattactcggcagcggacacattcactttgccttcgctttagcctttgtgctgtaacttgcaagaaacgtcggagtactcgcttgcgcgcgcccgcggcggcggcggcggcgacgagcgatcgcagcgggtgacgcggagatggcgtccaggtgcttcttccccagggaggccgaggccggcggccggcaccaccaccaccagtccaaggcggctgcggaggcgctcgagcagctgcaccacggcgggcgcgtcctgtcgcgggaggacgtcggcggcgcagtgcgcgtcaagatcgtggtcagcaagcgcgagctcaagcacatggtcgcggcgctcggctcgggcaccggcggcggcggggcggtggcggcggcggcggcggtgacggccgcgggggagcggcaccgtcagcgcgcggcgggcggcgccggcggcccaggcgccgagcagaggctgcagtcgctgcggcggcgcagcatgcggagggcggcggaggcggcgcggcggatgcaggcgaacggggagtgggagcccggcctgcagagcattcccgaagaggtttactgaatattataccagtagatggcgtcgttagtgatggttaatcacttgactaattaaggttgggttttgatcactgcctgctaagtctaagtggtagatgtacttgtacagcgctcttgatttgttcccggttactgttgagggttaaaccgttaatcctcccccaatgagtttgtgcatttttttttcactgtaaaattttggatggaagagaggggaggtggtgtttggactgcaatgcaactgctcctgatggtgtttgagtgactgtgagagtgattcagcgagtggctgaatttcttctcctttttgtttgtggcactgtaaaagtttttactgccactgcagctgatgtaacatggttaatt

SEQ ID NO: 59066 - DNA, 2971 bp, Oryza sativa
gcatgcaattttgtatatttccacgctttatttactctctcttctaatgtatgccggaaatgagaaagattgcgagatatttgctgatgataacgtgggcattcagaaaatgtataacaggaacagaacagagacgacaaagtatgactaaaatgatttacatatgtatagttggagggattagcacatcttagtccttatctccttgaaaggcagtgggtgccactctgaaatacaccaaagccattcttgattatagctattaatgcataatatttggccagtcctgtgaatcatatttgctcatcatgttcgaaatttggacgctgtcccgtcatgaccccacgatgcataaaagattgatagtgaaatctgaatctatttttcaacaacggtccatgtttaaaccaccaaccctcttgttttgacagaactttcaggcttggtcactccacgaaccaccggtctgtctgctcggcaagggaagaacaataattcagcatttaatctgcttttgccttttgtacttttctattgacatagaagccatgcataattcatcgctcatcctcttgctgcaacaactaaccattgcttccgcttcacgctcccgataatgcctggactgaactaataagctgacagacgacggcaattgcagcacagcgatctcgctctggtaaagaaaatcaaaacaacaaaacaaaacgtagaattcagaaacttcatctgatggttagatctccctcgtgcttgcgatatcccaggaggggtgaagttgaaaacgcatagatttatgcaaccaggcgtgtgtgggagatcgaaagatctgtactgcttttctcgagagaggtagctgatggcccgggactgctgcgaacaagaacatttgggacttgtaaaatgggcagcgtaagggttactcgcgttgacatttgacgaacctgccactgctgcatcttccaaagctccccctacaggttaattaacctgacgacccttgcaagtagcttcaacgaccctatgctgtagacttgcagtttacatgcagtaggtcaataggattagtagagaattagagaatcatcactacacctaagtcctaatctatatactgtagtcatttgagacagaatactgcaactgaagtatgttcataaccaatggtaaaagagaaaatactgcaactgaagtacgttaagagaattagaaaactggaaaattttatgtacgtaaagagaaaattttatcctcgcagcctgaacctccgaggcgccgacaacgttctccacaatggagtaaaactacctgaggtaaaaccactgcagatcttcgtgctacacctttgacctagggctttctgaaactttatgcaaaagcgactagtaacacacagggctggggtaatgtcttgtaaaagattacgcataattttaataacggtagaatttggtgtcataaaaatttgtgcacaatttacgaacagccgttttgtttccacaaattcagctcgctgcaactattgaatagtcttatattggttgtgaaagggcaagtgacctagtatataagtgggggagtctctcacctcattggttaatttttgaggtgggaaagaccatttacgattctacaattgctatctgagtctggttagttcaatatctctaacctgagtggcaaagtgtgcgaaggcatgatggaccgtggatgcttgtggagcctgtatacctgagggaccgtagagaaacagtgaatggacggtgaaaggccgagggacaccaacgtatacctgagagaccataaggaaacggtgaaggggtggtgaacggctgagggacaccaatatatgaaggggggagattattgaatagtccacattggttatagaaggacaagaaacttaatatataagtgggggagcccatccctcattggctagcttttgaggtgggaaagatcatttacgatcctacagcagcagcgtgaccttgcctcacgagctgggctgcaaacccgaaaaggggaagcttagtgtgatctctcccttgtgttatgaaaactctgggctatacagacaatatccatcacaatacagagtttgggcttggctaggctgccattcaagtcatccaaggctaggttgaacggttgatgctagcctggcgtgacaagaccagtcgtttggaatcataaaagaagttactatagaactttcgaagaaaatttctctaaaatctttcaaatataattacagtgtaactagaatgtatgtaatgtaacttgtctaaatctttcaaaatcttatggcaactcaagtggctagcatggtttgcggaaacgaggtcctgagtttgatcctgtgcaagtgcacaagtaaattttcacacgaatttttccctccacacgctagcacgaatcttaatgcaaatccgacgaccgaaaaatcaagagtctttctccctattttctatcgacaaaaatctagcaaatccataaaaagaaaatcatcacttccggtggcaacctatcccggaggggcaagaaaaagatagcttgctcgggagagtcaactccgctctccttcgagagcaaacgtctctcatgcaatcatccaaatcgttcactaaggcaagcccaacaaagtagcaagttgagtttgccttaccgaacaacggaacatactgaaaatccatactggcagccaactttctgtccttctcatgcttgcccgacgacaggtatcaaccattttacctgcagccttagataatggagtaagaggggtgagattgggatagggatatgagtggggggttgagatgagatatgaagaatggatggttaagattaaaaattaccattttagaaggtgggaaaagattttaccatcccattatccaaagttcggaaattgcttcccatgtgtcgtccgagcaaaagagaaaaatcgaacccgcttcatgcaagc

SEQ ID NO: 59067 - DNA, 6554 bp, Oryza sativa
ctgtttttattgtgtttcataaaattatcaaaaataattgctactaccctccatcaatgcttgcatgcatgcattttatcggtctttaaaatgatttttcttctaaactacttatccaatctatgattcgattacaccgttgtattcgttgtaattaaatctttataataaaatatcacacgattaaattttgatgaaagaaaaatatatgtttcaatctattaactcttattgtttcataagtgatagcaatatgtttcaacgtgtatcttcactgtgtttcataaattttttaaatgttttagttgctgtttttttgtttcaccatatataaattaatgtttcacttgttggtcagctgcaacattttgaccgaccgatgttttttttgatatatcggacgttcgattggtagtattctccccaaagttccaaacacaccctagttgtttttttgtttcaaccgggctggggttgggaggagatggaacagatggagaccgagccaccaaaaagcccaaacctgtaacaacaccccactgacccagcagcgtaataggcctcttgcctccttgcgttgcgacccagccccctgtcccctggctcccctcctccagcacccgttccgtctccttcgcccgccgcctacgccgtcgcgccgatctccatcaccgcgagtagcggcgccggcgtcgtgctgcttccggcttccgccgcatattctcgcctctgactccttgcgcgcaagccagtctccacgtcacatcagcctcgactcccgtctcctcgcgagttcgtcggccgcctgcgtcgacctcttatacatcgcgcgagcagcggtgccgtcgccctgctgcttccgcctccggtgagtacccgtgccgaagcacatcctctttctttctcatccattactaccttcacattttctctttgcccttaccttatctttctcttctagatctagaagcttaggtttttctttgtcttaaccttagtactaactttttttttagaagatagaacatatttgatccgacttttgtaagaaagccaaagaaacttactgtagttcatcatccaacgaaaagaaaaaaaacagattcctaccaacgacactagacaccacaaacagactactgggttgcaagtttcagaagtaacatcagggccataggcaacgacatcagaccctgtttagatgagactaaaactgttaagtccctatcacatcggatgtttggaaactaattataaatattaaacgtagactattaataaaacccatccataatcttggactaattcgcgagacaaatctattgagcctaattaatccatgattagcttatgtgatgctacagtaaacattctctaattatggattaattaggcttaaaaaaattatctcggaaattagcttttatttatgtaattagtttcgtaagtagtctatatttaatactctaaattagtgtctaaatatagagactaaagttaagtccctcgatccaaacaccacctcaaacacctccaaaaacactcaaaacagaaagtgacaggattacagttctcatagctaaacttcagacattcagctatccatcaatctccattggcagcacgtcaggagacttcagcacttgaatattatgctccataattcgatcacaccacacctgcagcatactgtgctcctattcattttacaggaccatccatctctgaatctgcgcaatcattttatacaagattgtctagggtgattttaacacaatgatttggaaaacaaagccattcctagtaagccacaaaacacaagccccaacaaccttattactgactaagagtaccccacacgatgttgtgggtttgtttgtgattatgcatatttatgttcatggtaaaatgaggatgcgggtacagtaactaaattttactatcgacgtacaatatcacaatagatcttttacctatcaatggaagcatatgaccattgatggatgagatatcatcagcaaaatggaatttttgaagcatggcatctttgcaactgaattttattactctcaccattgatcagcatggatccaggcctagggcagctagagctcaagccctagttctgggatccaaaccccatgcaaattccatattaattttagaaagaatgcttgaatttatagagagctaggacaaggtaatagaactaagccctggtgtggcttcaagctgtctccgcccctgaaattgatctcaacgttaactcatggttctgatgtttttttcttgaacgtttttggtagtatgactaagccttggaaggtttttatgtgtaccttggaagtgcttttgctgtacagaaagaaaaggagattatgaggagggttttagaggaaattaacgtgttctttatatgcactgcaaacggcttgtcaaactgttgtggttaattactgacaattggcaagagtcgcaacatattttgcttcaatttttttccggacaacactgttgttttggcttctttacctttttacggacaacagtgttggtttggctgctttgccttgacagttaatcacgtagcaaacttcctcaacaaaggcagttgcaattcatatatctaatggtcattatcccttttcctttgatccaagagcttctactttttttaatggtgtgtcttaacagggaggcgctgtgtgtggtcaaaaattaaaggagagggagggagaggtagcatatttctcccccaaaacgtttgggggttcagctgaacccccatgccccaccggtaggtctcacagaattgtacatcatgcaaccttttctcctgaatttccagggttacgggacagtttgcatggcatgatcatattttgctaaggttctattagagtgtcattcgatggcccatttcatggacttaagggctttcatcctgcgtgcacgtgttttaaagctttataggcaggccttgcgcatgactcgccgagctcctgtgcatgcacgcggtcagacatttttaaacctcgctttcctatcttttctgtctaatgtttactcttgaagttacaactaaatattcttgaatgttctttgtccagatgagttgaggcaaactgtaagagctgagattgaaaaaaatcgccgttgtgacgataaacagaagattaagttcttgatcagtgaaggtctgcaacgattaaaaggtcttgatgagatgcttgacatgacaggaaatagttaacttgagtttcatgtgggaatctactgttgtattcaattctctcatggatccatgtagttatataacacactttaccctttacaaagggcaagacatttgttgttctctagtttcatctgcggaacctgtacaatatttggggctggattggggttaggttggctcagaactacagatcatggaccttttctagaagtcagctggtttccacaccaagatattttggttaattgttttctgtaactttcttatcaagggatgtaaagtcgaggatagttctgtattttttttctcacacttaacatagaacaggactgaaggtttttccagttttgagctaattggttttcaattgtactatcctttcatgtgaaattacgaacagaattgatgccattgaaattacttcttttgatcactgaaatttctagtatcgacgaagaactaacaatcaagaaagtctgcctgcttattacgcccatgtaaccattcttccatcaaactttttgtcaacatagaacgagctattaaatggtgctactttaagaaagaggaaataactaatactacaatacgtaaagggcagaaacagatctgctgctgtgtctaaaattttaagcttcaatccctaaagctcttccggtactgacaaaatcataaacatttgacaaaaaaggaagaaagatgaaactttggatcgtttcagcagagattcatagcaacaagttaacctcaaggaactgacccagaaacacataagtagtacatcagaacttgacttcaagcagcatcaggtaacataacccagaaattcacaagtacagcacaacaacagaactgaacccagatttactagcatcaggacttcaggattcaacagttcaaaagccaaatctggatttcccccacacaaggatgtaaaattttacagctgcaggccttggatattcgtcaaagatatctcaaagcaacataaagattgtcatctaaattggaaaaatgtcttctgaaaaacatgaatgtgttatcaacaacaagtttggtctattcacagtattagctattccattcattcatcacctagaataaatccgggcaaaattgttgacctgtcagagtaggaaagggctgaaacctgcataagcctactgatttctaccaacaattagagcaccaaggcaatttacacgcagccccgaatcctccaaaaaaaaacacaagatagccaacaagaaatcgccaagaaccgctctccagagcctagaaactgacgatgacgatcgacgagaactcatcaagaactcgtcaagaaccaagaactgacccatgatcgggagggcggcgacgctgccatctcaagaattcagagcaggcttggtgcgcggcggcgaggtccccggcgactgcgtggtgacccaggcgttgcagacggggcagcgcggcgagatggtgagccaccggtcgacgcagtcctggtgaaaggcgcggctgcatccggggaggacgcgcacggcgcgcccggcctccatgccgtcgaggcagatcgggcagagctgctcctcctcctcttcctcgccatccccggccaccgccacgcagatcccgcccagcatcctcagctcctcctccgagagcccgttcttgtcgtcctcctccgtctccggcgtgcagggcggcgtcggcggcggcggcgggtccggaggcggcccccgcgccacggcctggaacaggtagcagagccagacgcccagcaccccgagcatcccgatggccagcgacgccacgcccacgtacagcgcccagagctcctggctctccatcccccctctctctctctctctctctctctctctctctctctctctctctctctctctccccctctgcacagagcaattcgttggtttgatcggaggcgaggcagttgctagccgtagcgatggcgatggcggtggcgcgctggacgttttataggtgaggccgtcgcggtgccgatctaatgggcctcagaggccgggaaagtctaggcccacaagctctcagtcaaggcccatttagaggtccagttctagaaccattggggaggaagaatcagtatcggagagtgaatttggagcgaggcaataagatctcagcggaggaggagacgagggggagggagacccagcgagggaggagaggaggattccgagcgctgcagccagccatggcgaagcaaggggtgaagaagacgagggacgcgaacaagaagcggatggacctcatcctgcgcctaatcctcgcggccaacgtgagcggtccccgtgattccctcccccccttctgttttcagatccgtgaattgcttaggacgctgctagatggttggtttttggttagattttatttttggcagtggtcgtgtgatacatgagtttgggggtggtaattttggtgaagaattgaattggactagctgatcttgcctggtccctggagtagttgtctgggctatggtagttatcgtgttcagtcttcttcttttatttatttattatttttttgggaaggtttgagtcttgcatgtcaaggtactcagtgagagggaggaaagctctagcgtagttttgtcttgtagaatcaccttcccttctgacctcaacatgttctgtgatggattctaagtttgtttgtggaacatgtcatgttttggtcatatcatgggaaaatttatgatcacaaaagttcatgatagaaaggttataatcttgccttggcggcgattaggtgcttggtgccatcttgcctccatgcattgcattgatgcattttattttgttcaacaaggttatgtatacatggttctctttggtacttcttttcataaaaattgaagtaaatttagggtaattagaaggttataaagatcactaaaccccaagtcctcactctgataagatcaaacttatgctctttattcttgactaccggagtaataatcacttgaattttatgccctttgtgtcgtacttaaaccagaaagaaattaggagtatcacttaccaggagtatctcagggcatctttcactggcttctagcctactgcatctgcgaaagttgctaatgcaatcgaataaattagagaaagaaaagaagatgaaatcatctcatatccaatattcctgtggggggttttggtttgtaaggttggaatttggatattggtgggtctattctggatctcaaatttagttttataacctattatcttaaacactatatagctttggcaatattaatatttctcctaaaaatgccagt

SEQ ID NO: 59068 - DNA, 6557 bp, Oryza sativa
tcattcttttcttggaagtatgccatatgggattcctttttaatttttacctgttggctgttcttgaggaggtaccacagtttgttaatgtaaattttggtatctcttgatgaggtaccacaaattaatactaaaaactgtggtacctcttgctaccttctcaaggaccgtaaaatcagttatatcacaacctaattatatactttagctattttgagttcggagtctagtacctgatttcttgtataacttaatttgttgcgcaggttatttacatagtagtgagaatggctgtaatgcattcgtctttcacctggaagcattggattggtcttgctgtgacatctgctgcatattttctgccgtacaagcaacttgccaatatgtcagagccagaatactctgagaatggagagttaattaatgctggttatgacttgaacgctggtggaatgtccgagtaaggaaaacacaattgtttttaattattctacttgaaaatgaattattggatattttccatggaaaattattaactttcagttgtggaccttgtaaaattcgccacaaagaccttgatccagcttctttaaaatcagttaccaaattttaaagctgaaattacatgaatactcctaactaaaattagagagctttgaccatcacagtgggttgaaacttttagaattttgacatcatccattgatggaatacatcaacttgtacatgcaaaacttcgtatgccttctgctgtataattgaataataaatcgtcatttgcttcttttcatgcagatatttacaagatgtgatatatatcactctctttgtgcagctgatgtctattttttctgataaattttggtggacatatttggtggtaagattcacacacaccattcttgacttcaattatatttctgtttactatggcgattactttttgttgatgtcactattggtgtcacccctgtttgggatgcccccaatatagaataaagtcaatatttataaactacataaacctgcttgttctgtagcatgttacaacatgaaaacttggttgaaaactatttaaattcttgtcctcatcctctttctttatcctatgtttgtatgtttccattatttgattgatgttccagcatgtctggtgaagattctgtgctgaacttgatattatcattcaacctaattatgccaatggcctaggaatgttatccatgataccatgaccgtctgatctatgcttgtaacttattttgtgaccactggttcataaggtggttttacagcggtatatttgaataacagccacactgcagtaccaatttagattaccgtcactgattgctactactgtaagctgttgtgctcttactttcaatcagtttttcctcgcaatcacaggcatgttaggaatgtaggcacatggcatcatggccaatgagttaaaatctctagaaaattattgtttcgatttatttttgttatacaggcatctaactatggccccctctttttgttgttaaataaaattctcaatgcgcattgcagatggtagctacatatgatgagttgtgcacaataccaagaggcattgccaatcattgttaacttgttattaaccacatacctattgattttcagattccagcttatggtggatacaagatttccggtctgttgagaggagcatttttcggtggtagttcagaggtaaaaatagagtgattgtcagtggcagtacattattatcacaaccgacatttggatatgacttatcagtattgtacctcctgtctgcagggcgaagaagaggatgagaagacccgaaagaaaagggagaagatggagaagaaggcatctagggggaagattatcaaaaccaggactcgttgatggcacatgtagtgtatcggggctcgttgatggctcatgtgtattattgtttgaagggtaggtttgctttacatggctgtccaactgaaatgtaagctgtcgggcagaattgtttcatgaattattcgatcatttgccccagcagcttagtagtagcacaaatttgaactaatcctcttaacttatcgataccagcattatcaatgagcagctctcttttgggttagcatttcccaacaatgagatatggcatatgagaattttctagagtcatatggctgtgttcgctaggggagaatggtaacctgaacagtgcacatgaaaaacggagtattccattaacgcgtaattaattaagtattagttttttttaaaaaaaaatggatcaatatgatttttttaaacaactttcgtatagaaactttttgcaaaaaacgcatcgttcagccgtttgagaaaatgagatgggagtgttggaaactttcccctcttgcaaacacagttgttttccaagcatttgctgatgttgctttcaactatcatttgcaacattttttactcctttgtgtttgcaaattacaatcaatcgtgctggtgtttcagttcattcctattccggcgacagagcaggcagtagacggcgccggcgacgaaaaaactgacgaaccaagcgttgttgtaggctgtctcaaatgccttggagacgctcggtagaactccaacattgtgcaggaatcccggcacgatcggcgcaactccggccgccatcgccgccatggcggcgacgttgaaaccgccctggaaatagtaaggcccgtggctgtcctccgagtagagcgcgtcgacgtccagcgcggttcgccggacgatgtagtggtcggcgaggatgatccctccgatcgggcccatgagagccgagtagccgagcagccatgtgtagacgaagctctcgctggagctgagcagccgccatggctggaaggcgatgccgagcaacgcggtgaccagcgcccccttggcgaacgtgaacttgcgcgggctcatgctgacgagcgcgttcgccggcgccaccacgttggcggcaatgttggtcgtgatggtcgcgaggctgatgccgacgatggcgagcaccgtcgtcaccggcccgccgatgcggccgaggagctcgatggggtcggagatgacgtggccgaagatggcctcggtggcggacgtcacggcgaggccggcgaaggtgaacatgcccatgaacaccggcagcccggcctggccgagcacctggtccgcctggctccgcgcgtaccgcgcgaagtccggtatgttgatggccaccgtcgcccagaagctgatgttcgcggtgagcgacgggaagaacaccttccagaactcggcgcgcgtcagcctcggcggcagcgagaggatgcgcccgaagccgccggcggacacgtaggcccaggccagcagcgcggaggtgagcacgatgagcaccggcgccgagtacttctcgagcttgcggatgccctccatcccgtgcatgatgacgccgagctgcgcggcccagaacgcgaggaagcacgcgaactccagcggcgctgcaccgaggcctggcaccggcgcgagcagcggctggtacgacttgagcctggacggcaggaggaggaacacggcgcggccaccgatccaggactcgatgccgaaccacccgcagccgacgagcgcgcggatgaccgccggcaagtgcgcgccgcgcaccccgaacgccgctcgcgcgagcaccgggaacggcagcccgtgcgtgaccgccggcgcggccgtgagcacgagcgagacgagcaccaccaggttggcgaacgcgacggtcgcgacgccctgcagcgccgacatgccgaggtcgacgaggctgccggcgaggtagtaggacggcacgccgaccacaaggccgacccagaggctggctaggtcccaggccgtcatggtgcgctccgacggcggcgtcggcgacaggtccgactcactcgacgacatcctgggcctcgccggtagcatccgcgggcgcgacgcgagcgtgagcccgggactccgaggaagaagaggaagccgcggcggggacgcatggtggctcttcacctcaattcggtggcccaaatggcttcgatgccgcgcggcgagagctctcgacatcgccatggacatggccatggccggtgggggaagcaggggaaggagaagttcttggttgctttgctcgatgaggaggagagctcgagaggatatgggatctcgtcgcttggttggttgcactgcgtgccactgttcaccggggcccactgccttcgacagcgaggaaagattccgttagtgctcggccgccgttggatcctcgctctctgagactgtgactcgcaatctgaaccgttggatgggaggagtattattttaaggacatgtgagacgtgtttggggaaggtgattctgactttggtgagagcgagacgaggatttggagtgttggacacttttgccgtgaggttgattggctgatctaacaaggggtacttgttatgaccatgtgatgcgatgataggccagctttgggttttttttacatgataatctcatccaagctgccatctacatgtagctgccaataggaaaattttgccaacttgtgatttgtttatagttgagtttttgtcatgactggcgaaccccttaaccacgttccctttgagatatctgcataagtgaaaagagaattccaaaatgccatcaggatgagccacatcatcaaacaaatattaacccttcgatacaacaattcggttggagttagacacagttattaagatagtaggtagaagtgaatggtggaggattgtgattggatgaatattagaggtaggtgggaaaagtgaatggtggagggttgtgattggttgagaagagaatgttgatagagaagttattatattttggaacggagtgagtagcaaacaatattattgttgttctagaaccttcatgcaatacccatgagatacttcctccatactcataaaggacaatgtttaagtcaaaacttgggaatataaatcatgaataactctcaagttgttgagtttaaaaatgtaaaaattatatgtatagatttgtcttgaaaaatactttcataaaagtatacatatatcacttttcaataaatatttttatagaaacaagaagttaaagttgtattttgtacaccgtgtcactgttctaaacgactttctttatgagtatggagggagtatgtggtaagaaagatatgagaatgaaaaaaaagtacattgacaaaaaaatcaccaatgaatattcatagaagttctattgcataaaaaataacgagtattaatgtatagatgaatagctaattaacctggtgctatcgattatttcattatgccttaaaattacaaatcatgttgcatggaagacattccattggagcagttcatactttagattgatgtcattttcaaccatacaattttttttaaagtttccaaaaaaatgttcgcgtttagtttgttgccaaatttggtaaataaataaaaaaatcctgtcaaaattttgacaatattgccatattgcctgaattttggcattgaaaaaatttggtaagatttattttggctacaatctgaacagtcttataagatttacgttaaaaattgtatatatacttctcaactggtcatgacagaattgcaatgtgtagaagatgtgagtatttacattattaaatttagaaattgaaggaggtaatggtcacggtaacatatgataaattattttttaaaataatattcttaatcacaaatcaaagatatagatatctgttagtgttatagctatacttcaaaatgtgttaaaaatgtatttgtttttaattattattaaaacatttaggctcattaacacaaacaacatataagcacatctaatagacagagaggttatattcgcacaaacgtgcgactcaacaggctagttgctaatgaatgatccgcaatgagggcgttgaaaaaacatttcatagtgtggaacaaatgcgatgtactacaaatatggcgccccgaactactatgcgtggtttataaatatagggccccaaactactatgcgtggttcctgccgcctgatatacttttatgcacgcgctaattccctccctctctctctcgcggctactccttctcctttcacttatcttttaaacgatttttctattaaaataattttctgatttatgatttaattatatcatttaatctttaccacaagaccttaccaaaaaaaatgaacgttgtttcactccattaagaacattgtttcactccactgcataaatacaacatttaaaactgctaactggagcatcaacaaccaattatatgagacaataagttctaacgagtgaaacaaaaaagacatacgaaaaatatgttatatttgcaaatacttaatgttgttgaagtgtttttatatatgtatgaaacaataagttgtactagttaaaaccttataaaatatttactgaaacattaagaataccatgtgcaacattaaaaattcaattaaatatcaaatatttttcagtggaggataaccatgtg

SEQ ID NO: 59069 - DNA, 3148 bp, Oryza sativa
ggaggataaccatgtgtgctcttattgtaaaattttaattttaacgaatttaatgtacaattaatcatagattgtataaatagtttaaaagaaaaaaatcgatgagtttgttacctacaaacatatgaagagtactacttagcataaaacaaaaacaagaggaagcagcgagagggcgccgaggatgacaactatgtggcgacgctccggtgaggcacggcatgatcgaggatcggtagcgttctctggggttcagaatcttaaacaccgactctctggatcttttatagccgtccgattaggcatgtacgaaccggatgagcggaaaaaataatccacaatcaaagaccgcgtagtccgttagccgcacgaacaacaccttaaccacgccgatgcgcctgcgctactctgcacacaggacacagcgcacctctgattccgtcatggagaccagaactactctcgacctcaagccagggtgcttcttcctgtacgcggtacgccaacgtggcggtgtcactgtggatgttaagtgcgtatgccggagcctagagacgagggcgtcgaggggccgaagcaggggtcagccacgatgtatgggcgctccggccctgtggcgaagcatgcggcgggggttcggtgaataaaaatccgactcccattgggatatctgccggccgttcgatccggcatgtgcggcacagatgagccgaaaattatcacggtctcgcacaccccgtttgggctgccgtctcccgtgccgttttctatcactcatcagcgcttgacatttcatgaacctttcctcccacaaattagatgctggagaaatacgcatgtacacaccgaagaaaaaatattaaaaaaatgaataatacaagtgaagaaatgtcacaaaccagtatttaacaaccgaatcaatccaaacacaaacaaatcctcaaagcagagagaaaacacgcaagatgtgtacaatttgccatgcattcagtcgtgaacgcgccgccggcgcgcactcagatatggacgtggcagttcacccgatcgaacgagctcggcgacgagaagtcgacgaccaccggcgagcagctcgcgcgcaacttgtagcgccgtgtcctcaccaagccgtaccggaaccgcaccttgcccttgatgtgcacgtccaccggcagcttcccgtcggacctgtccttcttcacggtcgcctccacgccccgcggcagcgccgccctcacggcgggcgcggccacgtcgatcctcttcacgttcagcggcggcaggtcgaacccgggcgccacggcgccggcgaggtacgtgccgccgtaccacaccccgacctcgaccgacttgtaccacacggcggcgcgcttgttctggttgtatgcgcgcagggtgatgtcgaaggtgccgttgaggctgccgccggacgtgaagttgaacccggtcaccgcggcgtggtcgacgtagacgagcagcggcttcgccgggcggaccgtcagccacaggatgacgatgatcaccagcaagacgacaatcgccagcagcgccgccgcgatgcacttcgacgtcgttggccgcggccgccgcgtcgtgctcccctgacgcgccattcttccacacacacacagagtaaactatcgctagcttggtcactacagggaaccagatcgatcgagcttaacccaggagtttgtgattaagtttacatcgtagcgtctctatatatatagcaacaactggacgatactttgagtagcgagaggaggttccacgggctgtcacacaggctgtggttggagtaggcggcggttttggtacgtgttgttgccgacgagagctagctcgatcggtgagacagtgagacgatcgctttgcctctttcctttgcacggctaagcgttcgtcgtgtcccatctcgtgtggtcttttggtttgtaggaacctctcgagcgagcggcagagcgctttggatggagctttggttttggaatccttctggcacactcctgttgcttaggaatcattgtcaaggggagggaaagcacatcgcaaagacagcctgcaaaacgggtgcatatgtatctaggatgaactcacatattcacatatgcgaattttactttgggatgaaaagcgggatgtagaagagccaggaatgtggaaaggcgccgaccggtgaaaaggtcgtgtggcgtcctagtgaattgtacatttgatgacagcccaccatgtgaaacaaggccgccacttcagcactgtgggcctggctcatgctcggcccagcaaaggccatttcaccaggtttttttttttggaataagttcacttggtggcccttaaaagtgatcgaaatctaatcagtgacctaaaccacagtaccggatatctcgacccccaaactcttaaaaccggtgtaatttgactccctcggcggttttgaagggcggtttcgctaacatggcgcctacgtgtcagtgttgaccttgtcatcgtccaacgtggtgtttgacgtggcatttatatgacattaaaatataaaaaatataatttaactcacttgtcaatcacacaaacaaaaaggtgggacccacttacacatggggctcacaaccatccgctccttcccttctctctttctctctctccccttcctcttcccctttgttgcgctggagtggcgggcagggccggagcagcggcggcgacagcggacgagggccgagacgcgagcggcggcagcggcgggcgagggctggaagagagggaggagaggcggcgctgccgagatcatgcccgctcgccgccgtcgagctactcctctactccgtcgctgcctgccgaagcaccgtcgccgtctgacgctatcgccgagatctcgcccgcccgccacccctcattggctacctctgccatccccgtctgaggccattgtgacattccggcttagggcttaatagaattaatagaatactcataccaacaagttgcaacttcttttccagaagccgataactctgaggttaagcgtgctcggtttgtagcaatttagggatgggtgaccgatcgggaagaattgtgttggtctgatgacctataaaaactgccagatgtaagtgggccccgcctgggagaggaggtgggatctttt

SEQ ID NO: 59070 - DNA, 2639 bp, Oryza sativa
cttttttagaagccaagagattgtcctggaaattcttccagaaaaaacttgtgtatgtctgtgagcgcagtttatgacctataaaagctgtcagatgtaagtgggcccggcctgggagaggaggtgggatcttttccggaagccgatctctaaaaaacttgtgttggtctgtgagcgcagtctatgacctataaaagttgccagatctaagtggccccggcctgggagaggtgggatcttttctggaagccgatctctaaagaatgggagaggtgggatcttttccggaagccgatctctaaagaactttgaggttaagtgtgcttggcctagaaatctatggcctataaaagctgccagatgtaagtggccctggcctgagagaggtgggatcttttccggaagccgatctctaaagaactctgaggttaagtgtgcttgcctgggagaggtgggatcttttttagaaaccaagagattggcctggaaattcttccagaaaaaacttgtgtatgtctgtgagcgcagtctatgacctataaaagctgccagatctaagtgggcccagcctgggagaggtgggatcttttccggaagccgatctctaaagaatgggagaggtgggatcttttccggaagccgatctctaaaaaacttgtgttggtctgtgagcgcagtctataacctataaaagttgccagatctaagtggtcccggcctgggggaggtgggatcttttctgaaagccgatctctaaagaactttgaggttaagtgtgcttggcctggaaatctattgcctataaaaactgccagatgtaagtggtcccggcttgagagaggtgggatcttttccggaagccgatctctaaagaactctgaggttaagtgtgcttggcctagaaattctctgaggttaagtgtgcttgacctggaaattcttccaaaaaagacttgtgttggtctgtgagcgtagtctttgaccccgacatgggagaggtgggatctttttcggaagccgatctctaaagaactctgaggttaagtgtgcttggcctgaaaattcttccagaaaagacttgtgttggtctgtgagcgcagtctatgacccataaaaattcttccagaaaagacttgtgttgttttgtgagcgcaatctatgacctataaaagctgtcagatgtaagtgggcctagcctgggagaggtgggatcttttccagaagccgatctctaaagaactttgaggttaagtatgcttggcctggaaattcttcccaaatgcgcacgagtgaggacaaagtgtgcagaaaagacttgtgttggtctgtgagagcagcatatgacctataaaagctgctagatgtaagtaggcccggcctgagaaggcgggacgttacagcatccacggcgccggcgcgagcgcgagcgcgaggtgaggcaccggcggtggcggcgacaacacaagctcggcggctccgcctctcccctctccctttcggccctcgcacgccgccgttgccgctccggccccgcccgctgctccagcgcagcaaagggggagagaaagggaaggagaggatggttgtgggccccacgtgttagtgggtcctactatttttttttgtgtgattgacagatgggtccatatatattttttaaaattttaatgccacgtaaacgccacttgaacgatgactaggtcaatattaacatgtaggcgccacttcagcgaaaccggccttcaaaaccgccgaggcattcaaattgcaccggttttaagagtttgggggtcgagatatctggttttgtgatctagagtcatagattagatttcaatcaccaagtgaacttattcctttttttttcaacgtgggagtatcagactgtgttgggcgagctacagtgactaaaagcgagctccacatccggcacctcaagtaatttcttattaaatttggaaggcaaagctcctttaggaaaattattttcaactatttttctataaattacaagtctgctttcattttctgggaatcaaatattatgcttctgtttgtcttatcatttctcaaacattttagtctgttagaaattatcggtaataaatatgagatatcctgcacacttacagataatcagtgagaattctctatcggatttgctagatttctgttaacagaaaacaaggagaaaaaatttcgattttttggccgtcggatttgccttgagattcgtgctggtatgtggaggggaaaaatctgcgtgagaaagcctgtgtacttgcaagggttcgaacttatcacctcactcccgcacctcaaggtgaccagataatcctttggtttcaaggggttcgaacttagcaccttgaacttagcttgtgcacttgccttttttttctcgctcgcacggtggacggcgagaaaaaaatggattggcgccaagattcaaacccaaaaaagggagcaatgccagaattcaaacccaacacacggaattcggtggtgaacacaaaccattaggatacatcaagttatagactaacttgagcaaatgaccatactccatataatactccttcggactgataatatcaagaattttaaaccctgagagtattgcgtaccgttacatgggt

SEQ ID NO: 59071 - DNA, 10266 bp, Oryza sativa
  unsure (1)..(10266): unsure at all n locations
gtctctttaattattgcccacaggaaatggagagtccaagtttgttagtagtactaataaactcccttccctcctcacaatcagagagagagagagatcgcgtgcgatttgacagagatgctgaattgctgatatgcttcgatcatactggatggtacttgttgcatgcacacttgacacggcttcgacggcgctcgcctggtaggtgatccatagcaccacacaatcacaatgcgagcgtttcattcgagttagcctcaccaaacatcccggtagctattaataagcacggctccggccgtcaaataagctaaaaaagtctacccctaaactagccgaaagtgatcgatcttaataatataaagcagtcctttgcttgcctgagcagcctaatgactagatagattgacaaagggcaaccttatcgttaaaagatatacttcgtctggatacataattcttaacgataataacgtgatattcaaaatatatctagactatatttttctattatataatattattatagtattttaaaagacaaaattatatatgttgttctagtgattttaactaaatatttttaaatttattgattagtcgaaattataaaagtttaatcctaacattattcaaatgtcaaagaattttgtaatcggagggaggaagtactagatagtaatacagtggtgactacctatacaactttcaatgaaaacctcaatacaatctttgaaatataacttataatataattatattgtaactttaatataattataatgtaacacatatatgctccctggaaggtaatttatacgagaaacttgcgcggctcggttggcagtgtaatcatgaaagtacttgtttaaaaaagcatatgcaattaatcttggtaagtttatacgtgacaactaagtaataccattgcggaccgtagatattcgacgttgttaatgggcgactggtcgcactggggcacgccctcgtgaccggtgatcccctcctctagtctccttagtatgtactctctccgtttctaaatatttgatatttccttctaaaaaaatatttgatgttgttgatttttttaaacatgtttgaccattcgtcttattaaaaaaattaagtaattattaattttttttattatttgattcattgttaaatatattttcatgtatacatatagttttacatatttcataattttttttaataagacgaacggtcaaacatatgctaaaaagtcaacggtgtcaaatatttagaaacagaaggggagtacgtatgtatatactttacatacatatataaattttatacatatgtatgtaaagcatatacatatgtatataaaattttttatatacatctaaaaaagttatatgtacacatacataaaaatttatacttatacatataaaatatacatgtatacgtatatgtacacagaggtaatatatacacacaaataatatatacgtatatacggacacatacaaaaaatttatacatatatacaaactctatacatatatgcatacaaactttatacgtgtacgtacaatatctatgtgcatacgtataaagtttatataaatacagacgcgtatactacgtacatacggacgctgccgtgcggactgattagcatctgtggcggatgtgtgcacgtatacgaatcttgccaggagcttaatttccttttttctcccgaactcatgtctgtttctgtttgtttgcggttctgcgtgggcagtgggcagagttggctacccaacggtccaagtgaccgtcgcgccaagccgcgaacccaaccggcgaccggcgaccaatcccctccgagactgtctccaatctccggtcctcctccatggctagcgtaggcgcgtagcatctatttatgctctcagattcagagtcctaccactcgtacacacgccggtcagcaacatcacatgcatgctagcaagaggttttcgttagcctacgccctacggagtagtagtagccgtatcacattacatgcgcgctgcggcacacaattgaagtcttcgagttgatctgccggtagatctagctaagctggagtcactttacacttgcatttgcatctgcattgaactgcactgcattgcattgcagttgcactccgtctatctagctagctagccacgcatatgtgtactgcgtgcagatggatccccatttaagcgtctgcgcctccgccaccaccatccccatggccacccttcaatgcggccgtgcattcaatggctcgccccgcggttaggtgcccgtcgatcaccgcggctgatcaagtgatcattgcctcattggccactgatccatccatcgatcggtcggacgcccaacggcccgcgcaggcgccaatttatggtcgaccggctccgtgctcctcgcggccgagcgaccgaaccggtcaccaatcacaaggcaccacaaactatggtgatcaatggatcgactcaccactcgcaaggcaccacaaactctgatcctgatcaatggatcgatgcagaagtcctcgtcgtaggtagtgttcccttcaaactttcaacttttccatcacatcaaatatttagacacatgcatagagcattaaatatagatgaaaaaaccaattacacagtttgcatgtaaattgcgagacgaatcttttaatcctaattacaccatgatttgacaatgtagtgctacagtaaacatttactaatgacggattaattagacttaataaatttgtctcgtagtttacaggcggaatctgtaatttgttttgttattggtttacatttaatattttaaatgtgtattggtatgcgtcaatttttttttttgccaagacaactaagcacggccttagtatatgcgagtgtagcgtacatgcatgtgtgtacgtaggatcggagttgttgcgtgacttgcgtcctgctgctgcatcgttcatgtacactggtacatgcagagagagagagagagagagagagagagagagagagagagagagagagagagagctcgcgcttggtggtagcagctaggagtagcagcgtagcaggaccggtgcgcgacctgcaataaattggcatccatctcgactgtgctccgaccagttctataaaaacctcggtctctccctgctgcactctgccatcctcattgcttgctccatgtggagtcacttagcgcagtgtagctagccatcaccgggcattctcatcggatccatacagccctagctagcagctgtacgtacattacagagtttgttgccagaggaaaatggaggtggggacgtgggcggtggtggtggcggtggcggcggcgtacatgacgtggttctggcggatgtcccgggggctgagcgggccgcgtgtgtggccggtggtcggcagcctgcctgggctggtgcagcacgccgagaacatgcacgagtggatcgccgccaacctgcgccgcgccggcggcacgtaccagacgtgcatcttcgcggtgcccggggtggcgcgccgcggcgggctggtcaccgtcacctgcgacccgcgcaacctggagcacgtcctcaagtcgcggttcgacaactaccccaagggccccttctggcacgccgtcttccgcgacctgctcggcgacggcatcttcaactccgacggcgagacgtgggtcgcgcagcggaagacggcggcgctcgagttcaccacgcgcacgctgcggacggcaatgtccaggtgggtctcgcggtccatccaccaccggctgctgcccatcctggacgacgcggccgccggcaaggcgcacgtcgacctgcaggacctcctcctccgcctcaccttcgacaacatctgcggcctggcgttcggcaaggaccccgagacgctcgccaagggcttgccggagaacgccttcgcctccgcgttcgaccgcgcgaccgaggccacgctcaaccggttcatcttcccggagtacctgtggcgctgcaagaagtggctgggcctcggcatggagaccacgctggccagcagcgtcgcgcacgtcgaccagtacctcgccgccgtcatcaaggcgcgcaagctcgagctcgcgggcaacggcaagtgcgacaccgtggcgatgcatgacgacctgctgtcccggttcatgcggaagggctcctactcggacgagtcgctgcagcacgtggcgctcaacttcatcctcgcgggccgcgacacatcctccgtggcgctctcctggttcttctggctcgtgtccacccaccccgccgtggagcgcaaggtcgtgcacgagctctgcgccgtgctcgcggcgtcccggggcgcccatgacccggcattgtggctggcggcgcccttcaccttcgaggagctcgacagtctggtctacctcaaggcggcgctctcggagacactccgcttgtacccctccgtcccagaggactccaagcacgtcgtcgccgacgactacctcccggacggcacgttcgtgccggccggctcgtcggtcacgtactccatatactcggcggggcgcatgaagacggtgtggggggaggactgcctcgagttcaggccggagcggtggctgtcggccgacggctccaagttcgagccgcacgactcgtacaagttcgtcgcgtnnnnnnnnnnnnnnnnnnnnnnnntcggcaaggacctcgcctacctgcagatgaagaacatcgccgggagcgtgctcctccgccaccgcctcgccgtcgcgcagggacaccgagtcgagcagaagatgtccctcacgctcttcatgaagaacgggctccgaatggaggtacgtccacgcgacctcgcgcccgtcgccgacgagctccgcggcgcggacgtgagggccaccgcaccatgcgcgtagaagatccgagggccccgctcgcgccaagattcgtgctgatggaggcatggaacattcaatgtgtagataaagagagagtacgagacagtaagtaaattaaatgggtttggtgggaacatttaagccgcttcttctctgaatttaccatccggatcagagaaacttggatttttttttttttgcaaagacgagatctacttggatttggatctgagagagcagaagcggagaagcaaaaaagagaactaaagaaagagcaataatttgtgatgtagctaagatgcagagtactttgatagtatttgttcgagttagtttgtgttggtgaccagccaactattatatttattttattctattcttaagagacattttcttcttttccaagcctcgatctatcactatgtgattctattagcgacttgctaattaatttgtcaaatagatctataagtagtagtaaacgtgtacttaaggttgcctacttcttcacgagaagttcctcagttttccgcatgtaaggcacaatcgttttgctagatttccattgcgaaaagcagaaactctgaggttggcatgatgccgttttcgtccgtgcgcatcgtcgccttgatagcgttctgttgcgcaattagatccagtgagggatcggactgcggagaatttcaggcgcgtaacgacgatgtgcagagagcatgcacttgtcacaggggttaatgtgcaataggcgacagcgatatgtgtttgtgttcagttgctcgtgttgccttctgaagagaggatctgagaaaacgattgatgatgatgttggggcaactggtttagactacatgttggctgtcacgtttggttttggttgatgcaactacataatctaaccacgcctaccttcttttcggcaaggatatatggctttttcgtggactttgacatctcattaaaaaaaaaaagaagtataccacactgcaggcgtgtcagtttcacctagatgtcctgagacaataacagtcttgcgttgcagcaatgaggtcagatccagcggtccagcctccagttcacagtcagagtcctcttccatgtagtacatcctgcaagcaccttacctaaccaaactaaccgagtcaagcaaacaactaatcagtcgtgaatacgggatacttgtaaacgaaattctcgacacacaccaataccagtggctgttttcttgtgcgaaacgggcgcaggaaacacgagggcatggccaattccgttcaacaatcagttttgctgatgcaacttgagcatttcggggcagcaaccatacacgtctcatctatcgcgctggtgctagcacatcgcagttactccgctggtgcatgtatatggacagagcagcgggccacaccgtctccacgcagagtgtcggttcgtcggggtgtcacggacgaactcgtttccccgaacgtttttgtttttgtttttttttttttctggaaagagtgctggaggaggcaatggtgcgcctgtgcacaatttagtcgcatttcgcctgacgattttcctctccaccgtctctctccgttcctctcctctgctcatcttatctgttcgtctgaaaaaaaaaaaccgtttccggcggacgcacgggcggaggctcggccagcgttctcctcctccgcgacaccgactcgcctccgtcgcgcgcgcggccggcgagcagggccggaggcgcagtgcggacgggctgctgctccccttccccgaccccctaccgcactagtattctcccctgtgcggccggccggcgagcatctcggttcgaatcgaagtatcgaattgaaggtattccttctagtttcgtagccctcctctctcttcctcttccatgtgctggtgtgggtaagattgggagtcgattcggacttgattgatttgtttccctgtcacctagccgtcccacctcgtcccgatttgatttgtttgttgcgttcgtggtgcggtactaataacagttttgtgtcctaacaaatttgtgggggttcagctcaaccccgatatcccacgttagatccgccccctggagtgtagaactgtgctttggttgttggtttcgcggagaaatgtaggtatggagccaaggggctgtgacagtttggtaccgggatcagttagctagaactggttcggctccgagtatagtaggatcaccgacttggagagtgtagccatcacatcggtacatgccactctgcttgttaagaagggaatttgccggaggttggaggcactggtgggattaaggaggaggtagaagagcgcaattatgccatattgctgctagctcgacaggaggctgataacacttggacagaaatggcatgaaaggttgacaaatgttttgtgatggcagagacagcctatttagtggcaatcggcaaaacagagataggtgaaactttcagtggtataggagttatctctgacttaaatgatgcacggggcaattagtgacagaataagtactttatctccttggcatttcattttagagcaatgggtggcactgtagttatttgctcacagtaggtgatagtgatgtagcaagcttgaaagcttgacatgtgattttgttcattgtggttttaagatgaaccccaaaggtaagcgttctagtaattgctacttctacctccaacttccaggtattattaaatttaattaaatttaacaaacagcacacagtttgcctttatactctcaatggtcatgtacttctccattaaactcaactcttttgcagttgtgtggaactgtaatgatgcacgctgttagtgacttggtcctcattattgttatttgttaactttcagcctttgtggtgaaggcattaaacagaaatcaaagtagcatgagcaagcactaactgggaatctccataatacagcattccagtgagttgaggacttttttttgtcactacagaaactaaggatacctgcgtgatttcaaaatttcaatgtgtgattagctcagtgaaatcctgtccaacttgtttcatattcaatatgccaccatggtgggggaagtcttcatcaaaagaagtaaagaagactgccaaagaaaacctcattgacacatttcatcggttattaagtccaaatgagcaaaaggggagaacaaaatcacgggggaatcgtagacatagtaaagatccaactgctgagaaaggttgctggtctactgcccaatcacgctctgcatccccttcaaaagaggtttctcgttgtcaaagctttgctgcagccagagcacatgcacaaccacttccccttcctagatcccgtgctatggtggcacgtactgcttctgatattaccgaatcaaaggtcgttttggaaaagcgtggcaaaggacaacaactaccgctccctaccacaaattgggttaaagaaagacctgaaactaccgaacctgttgcagaattatcaactgcttctatctccagccatggttctatagatagcgatgatcctggagatttgcgacttcagggacctgtggcaaatgacaccgacaatgtggctaaagttgctacaaccggtaattcaaggtatccttcttaatccatgatttatccaaacacatttttgtttgtgtactttttttaaaaaatattcttatggatattgattgctctgtttgtgaagtgttgtgcataaggagtgttctagtgccatcaccagaaagggcactaaggaagtgacgatgccaaccaatgctttcttgagtaatcaaattctatctacaagtcccagaggtactgttgttgctgacagttaccagtcaaatttacaaaattcacgaaaggttgttctggacagtgctcccaatagtgtgatgtcaagcccttctcgaagcccaagaatattatgccctgatcagattccaagttcagcattttgggcagttaagcctcatacagatgtaacttttgttgggtctgctcagtgctccagtcctggttcagggcaaacatctgggcataattcagtgggaggtgatatgctagcccagctcttttggcaacctagccgaggtagtccagagtgttcaccaattcccagcccaagaatgacaagccctggtccaagttcaagggtacatagtggaagtgtctctccattgcatccaagggctggtgggatggcacctgaatctccaacaaggcgacttgatgaagggaagaggaagcaaacccacagattgccccttccaccactaagcatatgtaacaattccacctttttgccaaacaattccaccccaactagtcctatctcacatagtcctggtagagtagaaaatccaactagtcctggatcacggtggaagaagggaaagcttgtcggccgtgggacatttggccatgtatacattggctttaacaggtatgccctttcgatgctcggaattggttgatgttcatttttaatttcgatgcaaagcacaatatggttttcatcattaataaatcctacaatggtactaactcattcagctcttgtaatctctcccatatacttatttctcatactacatcctgaatcgtaataaatatcatggtttagtgattagtaaactggcatgttttaaacagagtctcattcagaaatatttcaccttcaaagcctaagacatcattattctttgagagtgtaattattgaagtggtcttgtcacaatgttgtttgtaacaagcactctatatatcctttgagtagtgtgccactgactattttattaggactgatcatcctttgtttctcttcaaatttgatataatataattctctgtcatttgtatcagtgataaaggtgaaatgtgtgcaatgaaggaggtcacccttttctcagacgatcctaaatcaaaagaaagtgcaaagcagttgtgtcaggtatgacatttttctccacgtttactgtccttttctttacgctatcttctctgctcttatattattctttatttaccaggaaatattacttctgaatcgtctgcaacatccaaatattgtacgatactatggatctgaaatggtataaatttatgccaccagttgttatcttctgttaataccactcctgttctttttttacttgttgaacatgtgtgatcattccttttctaacaacacattcataaaaaaaaatccttttctaacaatacatttataaaaaaaaattaaaatctaactacgtgaaggtattttccataacaaatctactagtaccattttcacatatcagatcttttttttttttgcatacactccatcgtttgtttctgttaggcgtatagtttttcaaacttttgcaaga

SEQ ID NO: 59072 - DNA, 2409 bp, Oryza sativa
ttgatcacccaagacatgtcagatgacgactcaggaacacacgatatttgttaacgaggttcagccgaagcctacatccccggggctctgattatgggtgctcctccccaaccaatatagctcctagccgctacgagtccatggccaagccgccatcatctccctgcgtgtctacgctacattgtagtcgccatgattacattgtcgtgcccccctctctatttaagagagatgacaggttacagagtccgactctaactctacccctaacacctattacaactccaagtccaactgtaaccaaataggactagtatattcgacacctattctaacaaactccaccttggcgaatataagccacctagaagtagtagaatcaccatgccgatccacctatcctctagacttgggttgtcttcttcgcagcttcaccgcaagccgcccgacgagtctgcgccagacccgccgccaccaaaagcaattgctatcccagcaaccgcttcctcctggactccacctgcaatagtgcaccctcgcagcttgtaaagttgcgactccaccttctctccagtcatcacagtcgtcttgcccttcatgatctccatggtcttcttattccgattaccgcgaaatattaacccttcttcatgcaaggttccaagcgaaatcagattcctctttagccctggtacatgcctgacaccctgaagaacatgttcacctccatcttctagcttgattttgacttcacctactcccacggctggataacttgtgtcatcgcctaagtagacaaaaccaaactcactagacttgtatgaaaagaaccactccttccttggcgtcacgtgaaacgagctagctgaatctaatatccacgcttctgcatccttagactgtgcacttgacattttgagaagatcacaaccatcgctatctgagtcatttgaagaagtcgctgcattagccttagcttttcccttcagtattgggcacttcttgcttatatgcccccactcatcacatctgaagcactgcaccaccttcttctttttgttcttctttaccttatgcccagcatgatcttctttgactagcaaaccctccgcttgagatgtttcaccctctttgttctttctcatctgatcacgagccaacaacgcagaagtgatctttagttttgatggtctccttgccgtacgtcaaagtagtcaccacatgctcatacgattcaggtaacgaacacaaaagaactatggccttgtcttcatcgtcaacttccacatccatcttcacaagatctgtgactagttgattgaaaacgttcacatgtgctgtcagatccaccccttcctgcatctttagcccatacaacttctgcttcagatacagtttattgtcagagtcttggacataaactgagcttccaacttttcccaaattatctttggtgaggtctcctccatcacatggtacatgacctgatctgaaagacatagccttattgtcgcagccacctgcaactgcatctcctcccaatcgtcatcctccatcttggccggtttgacacccttcaaagcctttgaagcaccttgttgagctaacaaatctttgaccctagtttgccacaagccaaaatttccagagccgtcaaacttcaccaaatcaaatttcatacctgtcggcgccatcttgccaacccgcgacctgactggtctgtcgccaccagaatactcgcccttctcagaaccgtccgtattcgtcttcacaatcccgtcttgtgatccgatctcagacattcaacagcaaaccacctgtccgccgccgcaccgatccaactaatctgcttcacggtttttctccgtcctgcttttggttctgtccggtttgcacacacctgtacgcctgctgtacgatcttgccttgagcccagatttgtgccttccgtggtaagcttacgagtgtctcgatcaattgcccgtcgccttttctgccataggttcacgtcctgaccgctccttaaatagcatcagccaccgggataccgagtccagatcgacttcgagtccggatggacacgtcaagccgagtccgcgtcgatgacataatttcgtgccttatcagaaacggtctcctgaccagctcccacacggaattaggcctttgatgtttgacttctcctcacatcttctctcacggcagcaatccacgtcgtctgttctgcatgcccatgcatgcacgcagcttgtacgtgtcccacacaaatccaattgaaatcgtatgcactcatgcattaagatgcaactaattaatccatgcatggaattaatatcctgcatgcttgcaacaactcgtgcatatctcttgctcttggccaccatctgtacgcgtactgtatgcatgtga

SEQ ID NO: 59073 - DNA, 702 bp, Oryza sativa
tccatttccttttgtcgttagttcagcacttcagttccttagatgtaagctaccaagttgtagattattttattatttgtcatgttccataatttgcagggacattaaaggtgcaaacatactggtagatcctaatggtcgtgtaaagcttgctgacttcggaatggcaaaacatgtaaattctctgtttcaaattgtaaaaaaaaaaatctttctcatttgtcaggaataactaaaatttaaagcaaaagcattattagatgtaattccttgtatcatcttcataggaagaaatggtgtattgtgctttaccctttccctcgtgttctcttgcacttgaggactaccacttgtgctagatcaatccattcaataagagataaccattttgttttggtccttaccgtatctgtcagcacatttgctggcttacttggaccaaatggttatgcatgtttctatgctagttactaggcagtagtttgtttaccatagatgtagtgccattttattagtaatataagcttgtataccttcatgggccgactcttatgggccatttggataagtgattagttgtttctagcaagttatatgtttatgggaaggtccttttgtctatagatgtttcttctttggatatttatccgcgcatatgaacttcttttctgccaatccatttttcagatcaatgggcagcag

SEQ ID NO: 59074 - DNA, 824 bp, Oryza sativa
tattctggaataatctctagattggattagtaccatgcagagaactttcgtaaatgtgagcctcctcactggagctagtacatagctcagttggcatgtttcttgtttggctggaatggttatcgtcccttctaaagctttgatccttcttaaattccgtactgccagaaacagcataggtgtgcatcattctggtttgcatgggatatatattctgatactttaaataataggcactcccaacatgcacatgtctccatgtagaagagccaccagccatgctgctacatgatgtgagcattaacattttcttcaccaaactaagatcttcaaagattgattttggcgttgataaaaagttttgagagctcagaccagttgagttttcagcacagcaagacatcaatgcatgttccttttgctctttgctgaagcacacaggttcatctttatgcagaatttcatggctctcggatatttgagctgtgccggaagattctggctggccgacaagattccagatcccagtcaatgctgatactaactgtggagtggttaatcttctatctatagatttgcttcctgactgagtacttggcttcgattggttattggcattacgatccttagtaagaaatgcatccagatcaaactgatgaccatctaatggaagacggtggtaattgattgttggttttctaacttttggagctccacattttgagctcatcttttacaagctagcagcaaggtcataaaggaaagctagtaatcaactgactgagatctgctagaggcaagaaatgatagagcaaatttagcac

SEQ ID NO: 59075 - DNA, 12960 bp, Oryza sativa
ttgcagaaatatcccacattccgtaattaaggtatttcaaaagtttagtacctaatttactttcagatttgttaattgtgtttacagaatactggaaggccttgtttttctattttacagttttacacctacgagagcctgaagcagttcatgttgaaatcagctcctgctaatgccaatcttgattctgggcagacagttagtaccctgagctataacttgttaaaccgtctttgtgtctttgttatcattagtcaggactgaagttaaactcattggcattctcactactaaattcagtttttttctctaatgttttcgtgcgtaatacagaatttaaattattttacattatgtttagatcatagtgtagtatcagattttgtttcatcagtaaggatgtaactaaactacacctattgttagtatatttagcatgtttgatgatgccatgttaccagttcttgtatttgaacaaacatttgcccagaattctagtcggtagcatatgtatacttcaatatatgtttgtatgctagtgctgaaagtgggtagatgaaagcctgattggtatgactgtagattgtactgtaaggtatgcactgtaatagaagcaaagtctcgtgacttattaaacaaagtctatttgcagttatattatgcacataggctgtgttcttttgttgggaactcctttcctatgcacagaaaacaaagcacggattaatgtatgattaattaagtactccctccttcccaaattgatcatcatatatgtttatgcatcaagaccaaggataatttaaatcacatcatcaagacaccatgtacacattctctcataatgcatgcatcgattaaaacactataccaattacaccttagcatgcactcattctcccatgctgcatcaatcgtattctgatgaaattcgtgtccatgccatatgatggtcaatttgaaaaattttgaatttcattatatggtgatcaatttgggaaggagggagtattagctagtgtttttttttttttgaaaaatggattaatatgatttttttaggtaactttcctatagatttttttttcaaaaaacacactgtttagcagtttggaaagcgtgcttacggaaaacaagggaggtggagttgggaactcacgctaaagaacacagccgtattctgtttgttctttgttctctgcttggatcagcaccgcacaaaaatcactgccaaaatcattgatattttgcattgcagcttttctgtggaggttttgctgggtctactgctgctctgtgtacaactccatttgatgttgttaagacgcgagtacagttacaggtaacataaagcatgctttatatctgtaaatcattatcatcaattaaattgcttatctggttttactggctgaagtcacacgttggtcttttcaaaagtatagttgctggtatgttattggaagtaaactattggttacagcagaactaaactgagtattacccatgtttgttaggcactcagccctattagcaagtatgatggggttcttcatgcgctcaaagaaatttttcagcacgaaggcttgcagggtctttacaggtacggtcatttccgcaccatattggccatgctattgaatttaggttcttatacaagtactcaaattattaagcaacatatgtatttccaggggtttggctccaaggttggctatgtatatatctcaaggggctatatttttcacatcctatgagttcctcaaaacaattatgttttctgaacaagagcttcatgcaaggaacttttgatcacagaatgatgcagcgtggttcaggaacacttaaagcatctgagtttcaagaacaatctcatgaactaagtgggatggttctattaggctagaggattgtagacttgtggttactgaaccaaacatttcttaggtcttgatagtaaacatttgtacaagtgtacattacatttttggatacataggcaaccaaactggtgagcagccatttttgagtagaaatcacatctaggaaagcaaaattttgtatcatcaacacagtttgtaaattcccttacaagcaacctgtgactggatgtgcatcctaattcctgatattgaattctgacagaaaaaaagaaggcaagtctttttttacttgaatatatctgctgcacagctgcacttacatacatacttacatccactcaaaggaaagagaagtagtacttgaaggtagccctcctagcagctctctctgtgttgctgccttgtgcatatgcatgaaacacaaaggaaatacgaagcgcaaaaaggttcaagaagcgaccgacggcgcgtgcggcctcgtcgcgccagcgtgccgcgcgaacctgaccgagaagttggcctcgcactcgccgtcgccgaggcccccgttgtcgaagttctgggagtaaccgagcgggtcgtagttgagcccgctggcgctgaggacgtacgtccgcaagcgccggcgaggaaggccgatccacctaagcctccgccacagcgccgccaggccgaggccgaaccgtccccagcaggacgcggccgcgcggcggctgcacgacgcgcgcgtcgccgccgccgccccctcctctcccatcgcccggaagcgtatgcgaagccgaggagaggcggccgcagaggacagcaccgcgttcgcgcgcgcgcgcgttccagtcagtgtgacaggaggtgtggactgtggagtggagagcgttgcgccgtatggcccgtagcggcgtcacggccgcggcatggggtccctgcaattgatgcttagttcctggaatcttggtcgacgtggggaatcacctgcactggatgcgctagtatatgtgttgcaagttggcaacaattgaacgtgagacaattagacaaaaaacgagcctggagtcggtaattctctctggcaaaattggcatccgcgcgggcgcaataagacagttacatttatcttgtgatgtgaacatttgtggcttctcgttggtgcttgcagatggagacaaacttgaaaatgacccttttcccccctcttctgatgaaatgaagtgcattttcctacacgggacaagaaaccgtttatcggatacgggaggcagaaattgactccaagtccaagctgacgaactgaaccaacgtactgacatacatctccaattctctccatctccctcctttaccgtcaccgtgagaagagctccgggcagcgcggatcttggaggggcaccttgcgtgggtgtcagacaagcacgtcgtgcgcagagcggtatccatctcgacgcagcacaggaacaattaaaaccaagtgaaaccccgtgcattattttgagaatttagtatgataacaataaaaaaaataacgtgtaatatagctagataacatcagattaagtaaattaatatggtttatgctaatttaaatttaaatagtatgtagaatggtgatttaaacataaaaaacaaggtgatatgactttatggaagaagaaaagtaggagatagtttggactgtagattaaacatctaaaggctaaaaacaattaatgtgatatgacttaattagaggaaaaaaaagaaagataatttggaccatagattaatcatttaagcactaactaagtgaggatgaactatataagtatatagaatatcataaaaaataataaagatatacattgaaacattatatgaattatgttggttgataatttaacatgtatgtatttgaaaagctcttaaattataaaaactataaagatataacatatttgtatgatgtttaaatatgatgattgttagtggatgataatgtggcatcttgttaattagtggattagtggatgatgatgtggcatctttgcatgttaagcttaaggagttagtgggggataactttatagaagataggattaggaacaggtataactcaggatgtaaattaggcctggtttagatccaaactttttcttcaaactttcaacttttccatcccatcaaaacttttctatgcacacaagcttctaacttttccgtcacatcattccaatttcaaccaaacttctaattttagcgtgaactaaacacactctaagtgaactgaagtcagaactcagaacattttcagaggttacctgacagtagatgagataatgagatatgctgaacaaaacgttcatgtaaaaaacgaactcagatattgagagctggcatgtactgcagactaacaccaccaagaagaaaaacgagaaaaaaactgagattagctctgcattaggctttcttcggtttagcatgttcttttcttttttgtaatggttacatttctgttaatgaaaatggggggttacacccttgattaaaaaaaaaaggttcatgccaagttgttgttgtgccaaccttcctaacaaaaaacatttttgttagccattctgcaagctgagagatgcatggagctgaagtctaaaccacacgatgttaattacagcccatacaactataggatatggattttcatccctcgagaggatgtcctctcattgtttgcatgtcatttaagtagttataatattttttaaaaaaaattgacaacatagattaatatgaaatatatcattccacaaaaatgcaagcctaaatttaacttctataagttgcaaaaaaaagaacaaaataaactaaaaatagtaatcgcacattcaattcgcagctatatttgttatttttgttacaactttagaagttaaattttaacttgcatgtttgtaaagtgatatatttcatattaatctatcttaccatttttttaaaaaaaatttatgactagatggcatgcacgaaatgagggattccctcgagggataaaatcactttctcacaagtcacaactttacatgtactgtatgttggtagcttattagcgtgcatgactgcatgggtatgtagggtagatcacccattaattcatcgtggatcgaacttacatacgaaaaggtaaacacgaagtgtgaccactccatatgaaataaatgttgtgaatacaagaacgatgcttgttcgcacttaagagctctcaagtaggagcagatacaaatgctctcaagtaggagcagatacaaatcaagaattgagcttgggtattaaaagcgaggagataactgcatttatgctgtcattactcatttccatagtgtgcagaattatctaccatttccttccttcacaatttcgcatgtggatgaaggcatgaagctcaagcgaagcgtgacggaacttgtggccgcaagctaggaaccttaatggttgctatattaaggctgttcatcgtgcaggcacaagttcatctccatgcattccagtaaagaccatttttaggacaaacacatcggtttcaaaaaaaaaaaattaggacgaacagagcaatctcttcgcatgcaacagcggccgccattttccctagattcaccttccattggtagcttggttgttcaccaatggcgcacttaggggcggtcctctgcatccgtgttgctctcgtcgtcgtcctcctcccgtcgcttctggcgaccgtcgccgtcgcgcacaacgacaccggcgagcacaagaactacctcatcatcgtgcgcaagccgtacgagtacgaccacaatgtgtacaagaccgtgtcgagctggcacgcgtcgctgctggcgtccgtgtgcgacacggccaaggaggagctcgccaccgaccccggcgccgagacgcggctcatctactcctaccgcaacgtcgtcaatggcttctgcgcccgcgtcaccagggaggaggtgtacgagatggccaagaaggactggttcgtgaaggccatcccggagaagacgtacaagctgatgaccacgtacacgccgaaaatggtcgggctcaccggcgccccggcggcctaccatggcggcttgtggaacaggagcaacatgggcgaagggatgatcatcggggtgcttgacgacggcatcgccgccgggcacccgtcgttcgacgcggccgggatggggccgccgccggccaggtggaagggccggtgcgacttcaacagctcagtgtgcaacaacaagctcatcggcgcgcggtccttcttcgagtcggcgaagtggaagtggagaggggtcgacgacccggtgctccccgtctatgagctggcgcacggcacgcacacctcgagcacggcgggcggcaacttcgtgcccggggcgaacgtgatgggcaacgggttcggcacggcggccggcatggcgccacgcgcgcacctcgcgctctaccaggtgtgctccgaggacagaggctgtgatcgggatgacatattggcggcgatggatgacgccgtggacgagggcgtcgacgtgctctccatctcgctcggcgatgacgaggccggagatttcgccggggatcccgtcgcgctcggggcgtacacagccatcatgaggggcgtctttgtcagctcgtcggccgggaacaacggcccgaacccattgacggtctccaacgaggcgccgtggctgctcaccgtggcggcgtccacgaccggccggaagttcgtggccaccgtgaagcttggcaccggggtcgagttcgacggcgaggcgctctaccagccacccaacttcccgagcacgcagtggccgctgatagcggacacccgcggtgacggcacgtgttccgacgagcacctaatgaaggagcacgtcgccgggaagctagtcgtgtgcaaccagggtggcaacttgaccggactccggaaagggagctatctacacgatgccggcgccgccgggatggttctcatcggccctgagttcatgggctcaatggtccaacccaagtcgcacatcctccccgtggcgcaaatcgtctacttgtcgggggaggagctcaaggcctacatgaaatccacgaagagtccgacggcggcgctgatctacaaaggaacagtgttcggcgaccgcaagacgccggaggtggcgcccttctcgtcccgggggccgagcaggcagaaccaggggatcctcaagcccgacatcaccggccccggggtgaacatcatcgccggcgtgcccgtgacctcgggcctcgccacgccgcccaatccactggcggcgaagttcgacatcatgtcaggcacgtccatggcggcgccgcacctcagcgggatcgccgcgctgatcaagaaagcgcacccgaagtggtcaccggcggcgatcaagtcggccatgatgacaacggccgacacgttggaccgccggcggaggccgataaccgaccagaaaggcaacaatgccaatatgttcggcctcggcgccggcttcatcaacccgacgaaggccatgaacccgggcctcgtgtacgacctgacagcgcaggactacgtccctttcctttgcgggctcgggtacagcgaccacgaggtgagctccatcatccacccggcgccatcggtgtcctgcaagcagctgccggccgtcgagcagaaggacctcaactacccgtccatcaccgtcttcctcgaccgggagccctacgtggtgagcgtcagccgcgccgtgacgaacgtcgggccccgcggcaaggcggtgtacgcggcgaaggtggatatgccggcgacggtgttggtgacggtgacgccggacacgctcaggttcaagaaggtgaaccaggtgaggaagttcacggtcaccttcaggggcgcgaatggcggcccgatgaagggcggcgtcgccgaggggcagctcaggtgggtctcgccggaccacgtggtgcgcagcccgatcgtcgtctccgcccaaaagttcttgaacggtaacacgagctcctccgatcacgcgggccattgattgttgattacgtagctttgccagtaaatggggtacttgattagacccccaaggattataaactgccccctgatgattgtcctcgaaaaaagatgaagagaaagacaaaataactctattagaagatggaccaagatgcgaagggattgcgtggccggaaaaaaaaaaaagcaacatgggattctttttccatgatggccatggcctggatatgtgcccctgaaccaaactgcttcgatattgggcttgatgggtttgttacggatttagacctttatacaattagcatagctaaaatttcgatcttattgttgtgggttggatattggatgatagcactacggcactacctttgtggataagggatatatctcacacacaattcattcaaatttagacatttagtagtagataaaatggtgaaaaaaattacattaacggcacacaaattttgataagattttcttttgttcttttgaaaggtctccgcgggggtagatctccaatgaacacgcacattcacaaaatttgataataattttttagaagtcaaccaatacaatatactcgcacagagtcattgatgcaaatagaaaaaaaaaaacaaaaacaccaagaaactgctcgccaaggacgccgtgctgatagagaaaatttccacgcgtatgtacttaggaaagttcctttttattaagaaaataggataaaaactttgtctcgtatatattaataaaccataagtattcaaaaacatgttgtttagccatgaagtcaacttctggattggtcgattggtcacttcggctctaccgttgtggctccaccgttgtgtgcttcgctataggctctgttcggctgcacttaatttcattgttgtgcagccaacacaaacaatgtgttgtgtctgtagcagcagctgtatcggccagccaaacaatcccatagagcgtcaaaaaaccataccgaaacattctcagtgcgctaaattttttttcatgaaaaacagtctaaataatcattgtcgatgataaataataatcccttcaccgtttggactgaacaatatagttagtttcgctattggtgataatatgttatacacttctagcgtatttttagagcaatcatacaaatacactttctaaaaggaaaattgcggatctcggatagtatccatttcgattttggaatgcgttgaagctccaacgggtcacagggttttgacaaggagagagtcgacctttatttatttctttcatttattgccaatataacacgcgctttgcagcttgctcggcagtcctggtcaaagtcgcctcatatttaatttatctttcacaacgcttttgcagttttaatgtatttttactggcacaaacgtacaagcaaatatcaggttgcaaaattattttctattaaccaaatgggccagctgcaaacctacaagttgcaatagagtgtgttcgtttgaatcgtcaagtcctcgttttcttgcaaggttaggacgcgcaagactgtactacgcaggatgttggcctgctgccttgccctgtcgtgtcgtacagtacatagcatgttgcgaaactttctcttgaattgcccctacgcgttgttagtacattattattattttttcggtttgaaacatcggatgtatcgttattttgcttaggtcataaggtcattacaactgccaggttccagcagtcgaaaaatcgggtggcagacgacttttgtttgctaaaatacaacatattgaggatcagccgatcatgatgttttgctgcgattgcaagataatgatcgccggatgtttagctgcgattccaagataatgatggccgcttgcttgcacgttggcttctaatctaatgtaaagtacaggattaatcttcctgacgacgataatgtgcacgtcgcagcgttcattaacggaaaaatagcatgatatccaatgggtaaattgatccgtatataaatacgacggcatttgcaaaaccagaaaaacagttatacaagaaatacaattatactcaattctaaaataccttttaatccctttagtgtagtagcaaattcggcatgagacaaattcggttcctagtcatctatcatccaatgcaaattgccgcggtcccagcgaaacaagacctttttttaattttaaaaaaacagcgacccagagttgacttagctttaggcaccgtttattcttcgaattatctcatcgaactcatccctggttcttaaccgccgctaatgccaacatatctcctccctccccgctcgactcgactgtctccgtctcaccggcaatccggcggcaatggacggcgtcggcctcggcgtgcacaggcggtgggacacgtcggggagcgggtcgcagtacagcttcaggacgtcggtaagcagcgtcgcggagatatccaccgaggtgggggtggaagtgagcccgccgccgccgccgctggcggcggcggcggacaaggtgtttgtcgcagtcgccgcggacgtgaagtacggcaagagcgccttgcagtggacgctgcagaacctggccaaggatggcgccaaggtcgtgattgctcatgtccactgccccgcgcagatgatccccatgagtaagcctccagtcctcaatcatttgtttgatgatctgcgtcacaggagagagatttaagattggataccttttaatttcggtaatttagcgacgagtttggttatttggatcccgcttccgttttgaatctatggttagcagtttaataatggatatgattcgttgacattggcgacttgaaagccgaatgccagtgcaaactatgcatactccctttctggctttcttacagtacaatagacatttgcacgcccaaacgttgcttgacgaagtttctcatgagttgtatgattgtatctgccggcaatgctgacttcgtgcagatattctagaaaatacatacaattatttgttcatgtagcattattggtcctgtaactacttccaaaatcctattttgccgtcgcttcgtggaaaaaagtaacctagggtgtattgttaaaatgcaagaatttctatactaatttcaatatacctctacgtgggactattaccaaatcccaacaacactactacacatgcatcaaaggtcatcctcttattgcccagggtaacaagttcagaagcaatacgttaatatttgcaaacgatgcaactggttcacttctgatttctgacttctagtgcgatcagaaatcctccatgatttgtttgtcaccagtgcgatcagaaatcctccatgatttgtttgtcaccttttaaatagcttgtccttgattcctattgtttcagtgggggcaaaagttcattataccaagatgaatacaaaacaggtgaacgactataggaacaaggagagagaaaaggcagaggagaaactagatgaatatcttctgatatgcagaaaactgaaggtgttcttctcaaccactcttatgtctttcctaatgagcaatcaacaaagtaataaattacctaatacccaattatgcattctactaatattactcgagaagatatatcaatatatatctcaggaataatttgatcaatatttcgttttctcaggtcagctgtgagaaactaataattgaggaggacgacattgctaaaggccttacagatcttgttgcccttcatggcgtcaccaagcttgtcatgggagcagcagcagacaaacactactcaaggtgaccacaacctcataagttttttttttctgatgactagcacacacattgcacatttaaaactgtttcacaaaatattgtttcttccctgataagtactacctccgtttcaggttataagactttctagtattgtctacattcatatagatgttaatgaatctaggcacacatatatgtctagattcattaacatatatatatatatgaatgtatacaatgctagaaagtcttataatatgaaacggaggaagtagcattcagtgtttgccgctagcaagaattgagaaacagaaagtcccctcaaaaaaagaaatgagaaacagaatggtctgtaaagtctttaacagtttcgaacctggatgttttcccaatatgcaggaaaatgaacacacctaagtccaagacagcactcaagatattggaagcagcagatccttcatgtaagatatggtttacctgtaaaggacatctgatatgtacaaggtaaggttaagccaagcgggtcaaagcagtcttacgatagatggttttcagtgatactaacatcagaaaagcacattgaacaacacgtgaaaaatagctaagcttacccgtcaacattgcagggaagcaaatacaaccgttcctgcaataccaccatcacctgcacacacagttgcatcaacattgtcatcaagcagcatttccagccgtatgagatcaatgtcattgcacccgtcagagagtgaagcatcaagctcaagcggaagtccaaggcacaatctgaacagatcaagaacagaagtggcaaagtatccctcacaaggatctggcactgcaccatctcagttatttggacattcagatcaagatgtcaatgaccagccaacaagaacagcaatgggttctatagattcctgggatgaatttgagagatcgcaaaactcctgctacgattcatcaagaaatagtgatacagttagggtctctggatcagcaatgcagcagcccatgtatgaacctgatgatgaccattttgtatctcctcgtaaactggtacatatcgcctgatgtactgtgcaagttgaaaaacataagagtaggactcttctcaatgaaatgtaacacataactgaactttttgtgcaacacaggagaattcaggcgatgatgcagacatatatggtagactccaagaggctcttagtgaaactcaagacctgaagagagagacatacgaagaatcaacgaaacgtcggaacgccgaaagaaatctgatttcagctcttcaaaaggcaagtcattttgcttcaaaagtc

SEQ ID NO: 59076 - DNA, 12436 bp, Oryza sativa
ccaagtgctccaagcagataaagagaagctacaacaagagcgagatgccgcagtaagtgaatctcaagacttgcgcctgaagaacaaacagagaatttccatgccgggtgaagatctaaacaccgagttctcctcttatgagcttgaacaagcgaccagaggcttcgatcaagaactcaagatcggcgagggcggttttgggagcgtctacaaaggcacactccgcaacacaactgtggctatcaagctgctgcacccacatagcatgcaaggtcaatcagaattcgaccaggaggtaatccagttcatcagatcactcacataactccatcaaatcaagttggcaaccatggctaaccaagcaattgacaccattattgcagattgctgttctcagtagagtacgacatccaaacctcgtcactttgatcggctcttgcagggaggcatttggcttggtgtacgaattcctccccaaaggcagcctcgaggaccgcctggcctgcctgaacaacacgccgccattgacatggcaggtgcgcaccaggatcatctacgagatgtgctcggcgctgagcttcctccactcgaacaagccgcacccgattgtccacggcgacctgaagccggcgaacatcctcctcgacgccaacttcgtcagcaagctgggcgacttcggcatctgccggctcctgatacagacgaacaccggcgccgccgccgccgccaccacccggttgtaccggacgaccacaccgaaggggaccttcgcgtacatggacccggagttcctcaccaccggcgagctgacgccgcgctccgacgtgtactccctcggaatcatcatcctgcggctgctgaccgggaagcctccccagaagatcgccgaggttgtggaggacgccatcgagagcggcgggctgcactccatcctcgatccctccgcggggagctggccgttcgtgcaggccaaccagctcgcgcacctcggcctgcggtgcgccgagatgagccggaggcgccggccggatctcgcgaccgacgtgtggaaggtcgtcgagcccctcatgaaggccgcgtcgctgaccgccgggaggccgtcgttcgtggcccggccggacgactccccgccgccgtcctacttcgtctgcccgatctttcaggtagcaaaaaatccgtgattaaattattcctgaaaaaaatcgaggcaaaatttcctcgtgattggatgatggcttccatcggatgctctaatcagctgaagaaagagtcaaaattttcaaacttaattttaaaattaattttaagatattttaaacgtaattttttattgacttttaaattatcaagaatatatatatatatatatatataagtttacccaacaatttatttttattttctaaaaagccaaaggaatatgagtaaactatgggggatgattcaaactcgtgttgggatggatgtgaaagcaggaggagatgaacgatccccacatcgcggcggacgggttcacgtacgaagccgaggccatcaaggggtggctcgacagcggccacgacacgtcgccgatgacgaacctgacgctcgagcaccgcgagctcatcccgaacagggcgctccgctcggccatcctcgagtggcagcaacagcgtcaacggcatcagccgcaagaggaggacgacgactgtacatgagcaatctctcatcaatcatcactcaccgcagttgatatcctccatacctggcgcttcgcttcgtcctgactgtagatcctgcacatacattagcattagctttgcttgggttgaaatttgaagatccaagattgctcgagaaaaggggaagtttaccctgttcgtcttttgtgctcgttaatttgatttgcgatttccgctgtggagtacagacatttgcagttggtaatcctacccaattttacccatgttgaatctggttctgatccgtcttcccctgtatataagtgacgaacagcgaaaagagatgtgcacggaggcggcggcgggcggcctcccgtgatcgtgaggacgtgaggcctgatccatcccggtgcacagtggctggcccgtgaacagtggccttagtcactgagaaaagtttaatcccacaaaattcgtggcccatgaatgctaacgcatcggcccatccatgcctctgcttcgggaggtggcccaagcaaaacttttttatataggcccaagcagaactgttcgttgtacttgtgttgcgtgctcgcttcattgcttgacgctggtcttaaactataaactgcatcaacttgtcacgtccacgtcgaatgctcggtaatttccaagttactcagcttgggtccacgcggcaaacatcgtccctgcatacagtagtatacaatacatctccctttagcgacatacgcgcgtatgagctacgtttgcttgcttgatcacgccaacgcgagcgcaaatggcatctcgtcccaccgttgtgtaaagtcatagcgtcgactttggcttctggtcttcaaagaaaaaaacaactttgcgttattaactttgtgagtcaatgcatgaaatgaaaaatatattcggtgctgactacttctgctttcttctgtaacttgatctcgaaatttccattcatgaaacggctgggcagttactctgcagctgcatggtcttgtgcttctcatttctcaacgtcaggaagcagcaatggatagcgacggcgaagagtacgacgcgatgtggagcgctcggtgcagcgtcagctcgtcggccggctctctgcaggacgccggcgaccagtgggacgagcagagcctggccgccggcgaggacaaggtgttcgtggccgtcgacgaggacgtcgagcacggcaagagcacattcctttgggcgctgcagaacctgtccacggacggggccaatattgtagttgctcatgtccacagccctgcacaaactctcagtaaaggtaagcatcttgcttctcctgctttgacagctacaatcacctggtgcaattcagtttacatttctcgatggggacaaaagttcactgtaccagaatgaagcctgaagagatcagcgagtacctgatgttggcgaaggaagaggccgagaagaacctagatgaatatgctctgatagcgaaaagcacaggaaaagatatgaaggtaaaattgtctcattactttttttgttagtgcttgtgaaaaaaattacttgcatcaagtaacgtggggacgaaatgatgtttatcagtcaaaatataatcaatatgagcatgaacattaatcctactatttcagactgattgtcagaaagtactaattgacatggacgatgtcgcaaaaggactcgaggaacttattacccttcatggcatcaccaggcttgtcatgggagcagccgcagaccaacactactcagagtatggaccacatctgcctaatgtagcgtttttcctgtaatgttttcaagaaaattttactatttctcatcgcaaataaaaaaaaaggggagagagatagagagagaaatttattcctggaactggaggctctggtacttaagacggtgtatcggactatgtggataacttagtacttgaagctctgaagatttatcaggactaggctatcagcgtcagcaaattaatgaactaaaacttcagtcgtaaatttatttcattctacaccagcatcaggagtccaggactaatcaaactacataggtagcaggaatagatagaacattttatgagatgaatccatactaaatatatgtgcacaaaccttatgatattataacctgtagggaaatgaaagaaccaaattccaagatagccctcaagctgatggagactgcatccccatcatgcaagatatggtttacctgcaatggccatctgatatgcacaaggtaaagtcaagtgaatggtcatttgctacctgactttttgaacttcatagagcttagtgcatctcatgcataatagtacttcgtacagcatgcggagaattgtaggacacataatgctacatttgagtatctttacttctgtcaacgaattgaactaggataccagtgtattgcactcttaccaagaaaccaggaaaatgactaaaatccattagttgtgtgcacttacagggaacccaatgaaaaccttcttgcaatatatgtgccgcctgcacaaagcaacacggtaccattgtcaatgtgcagcatttcaagccaaatgagttcgatagagctgaagaaagaagcaccaagctcagaagaatatactttaagatcattggctcaatcggcaatgagtgattgggactacattttcgggggtgactaaactgactatcctaacatatttagaatttctaatttacacccttgcaaaaaaaaggttatattggattttcttgcttaaatgatttatgcatacagcatcaaattgttgttttacatgaattcaaggggccaaaaaatgatatgtagtttcaatagttctcccaaaatatagtttcaagaatccagaggtttcaataatttatagcttaaatttaatactctctgcagtcatgaatatttgatgttgaagacaatattcagtcaaacttataaattccgaccatcgatagtttctcaaatggctagtttgaattctgaaaacaaaagaaatggtatgctagaattcgccttgagaagaactatcataatatcataaacttattagattttataaacttgttataatataaattaatggtcataattttagaagtttaaccgatcttgccctaaacgtcaaatattcatgaccagaggtactagtatgtttcttctttgcaagctatattcctgatctgtgatgaaattactgaagcttactactaggatttatacctcagaagtcataacttaaacagtaggacatgtagaagcagtgggtcaaaataatcgtttttagttatttagaacaaccgtgttaatcatatatctgcagaaagaaaaatgaactcctacatgaggagaacagatgatttgagccatgctgttggcatttctcttctaaacgtagtcatgctaatctctattttattcataataatgaactccagattggggaaggacagggtatggttcattaaggactgatgatgcaataagtattcctgaagccacaactctagctgcgattgttgacgatacaaacaaacaaagatcagtgatgcactctcctcaggaatctgacagtgtcaatttctcatcaccagcttgtgatcccgtaagactactaatgctaaatcattaagttaccaaagtaactagctgtaagtaaatctctcttaatgattggtggcatgcagcaacaagaagaagaagaaccaaatttagatgaagacatgcatgatatacttaatgaggcatgcactcgagctgaactactcaagaaagaagttgatggtgaatctagcaagcgtcgcaaagctgaaatggatctacttatagctcttcagagagtaagctttgttttattggctgactctgtagcttgtatatttgtagagaaaaataaataaagtaaccctcctttggccagcgtaccaaatgtgacgtgcctccaaaatactgcttaaattaatttctctttttaggacaagtataactaaattagtcttacaggttcaagagtcagaaaaatcatatctacaggaggtgaaccagcggaaagaaactgagaggacacttgcaagacagaggctggagatcgatgaaatgaaaaggcgacacaatacattatatgatgaactacaggatacaaagaaacagaagcttctgtggagcaacatatatctgagattaaatctgctgcaaaagattatgtacaagagattactgaatattttatacaagaatcatgtgaggaagccaagaaattccaaaagatcaagatggatctgcttgcgatgcttcaaagagtaagcactttggttcaggactcaggagcttttaatttttccaaaaaaaaattgaccaattatctaaaaaatacgtgacgaaaatccaaactattattacaggttaaagatgtggagaatttaaaccgaaatgaaaagatgcagaggaaagatatggaggaaaagattgcaagacagaggatggagattgaagaaacaaaaaggcagcgagatgaattataccatgagttaaaagatgtaaaggaacagaagctctgtctggaacgacttgtaagtatggcagtatgactcagattcagcatattggtttaattcttgcagacgatcttactgaaaactttatataggattcatctaaagaaactaagaggagaagaaaagctgagagcgagatgctctccgctcttaagaaggtaagatactaagacgtttgtttcagtggtctgtactcagtactatgaattgcaggtttgtcatgaaaatgtggagtactcttacaggttcatgacctggagcatcagtatctgaatgagttgaaaaggcgggaagcggtggaggagacatttgcacggcaaaaagaggaaattcaagaaacgaaaagagagctaaacaagatacgtagcagacatatgacagagatcaaagctcatgaagaaaagcttgcagaaagcatccgctttatccaaaagattcaagcaaagtatgacaaaacactacatgagagagacactgccatagcagaatctgaaaaattgcgccaaatgaacagggatggagcttcaatgatagcaaccacccagatcgccgacttctctttttttgagctgcggcaagcaacccaagactttgatacggcactcaagattggcacaggcagatttatgaatgtgtacaaagggttcatacggaacacggctataactgtaatgttgcttcatcctcagggcctgcaagggcagttagaattccatcaagaggtaaatgagataactaaagttgaagctatatagccatacatttccctttcagcagaagagcactgaatcatcattttctgtatatgtggcgtcataactgcaggttgttgttctcagtagactgaggcatcctaacgtcatgatgctaataggtgcatgtccggaagcttttggcatggtgtatgaattcctcccaaatgggagcctcgaggaccagctctcgtgcaagaaaaacacaccaccactgacatggaagatgcgtaccaggatcattggggagatatgttcagccttgaccttcatccactcacagaagcctcacccggttgttcatggtaatctgaaccccatgaacattcttcttgatgccaactttgtaagcaagttgcacgtctgccagcttctcagaaaatacaacaccggaaataacacttcaggaacatcctcctacattgaccctgaattcttgtccaccggagaactcgccccacgctgcgacgtgtactccttcggcattatcatcctacatctactgacaggaaaatcaccacagaacatcacaacaatagtagaagatgctatggagaaaaggcagctgcattcaatcatggacacctccgcagggagctggcccttcgtgcaggccaaccagcttgcgcatctcggactgagatgcgccaatttgagtggaaggcaccggccagatctcacgggggaggtgtggggggtgatcaagcctctgctgaaggatgcttcccagaattttggatgcaaacaagcatttgaagctctatcagatgacacacaagcaccatcctactttatctgcccgatcttgcaggttggtaatttgcgaccacatgataaattgatgtgatataattgatgatttcacacaaaattgacggggttctaggtcgatgtattagtagtgctatactggtttatccaattgggagtatgtattcgaacttaccagaacttttgctccgatggatggtgaacaggaggtgatgactgatcctcacatcgcagcagacgggtacacgtacgaagccaatgccatcagaaactggctcgacggcggcaacgccaggtcgccgatgacgaacctgagtctcgaaaaccgcgagctcacgccgaacagagtgctccgctcggctatcctcgagtggcgacagcacaggagatgacatcaacctattcctcgatgcggactcagctcatctagatgcttcatctcacctgtaaaatatagtgggggatttctggtgttacctgaacatggcgtgtgcctgtgcagaagtgtgcctctaaaatctcaatcaccatctatcggcgtgcacctactctactatcttaggtcacaaaaggtggatgctcatgagcggaatcggatccttacctgtgcgcgcggacggcggaggggcggcgagtgctggcgccgcgccgggccggtggggtcgatgtgacggcaaccgacgcgcgctccggctcggattcagcgcgggcggcggcgaaggcaagcggcggattgcggcagcaacgtaggtcccctcaccggttgcgcccccgccgcctcgccgcgaagggcgatgctgccgcacgctgcgctcgcctacggccgccacgcgctaccgctctcaccggcagagtcgagccggaaaggcagctcggttggtgagtccggtgggctcgccaattctcatgggcctatcgccgctacgagataaagaaggaataagttcaccggaggtcttaacagcgagattttttatgtcccttaagtacaaaatgtttacccctaaactcaatgtttatggcagtatatatatatatatatatatatatatgagtggtttcgctgacgtggcatcttagttagaaaaaaaaattaaaaaagatacgtgggacccacttataagttgcacatctcttttctactcgttttctttccccttctcttctctattctctcttctctcttctcttcttcaggccgacagcaggcggagagccggcgggcaagcgtggacgcaggcggcgggcggagagccggcgggctgctgtcgccggagctgcatagccggctcctctccgaccaccgcgcacccttgctctccctcctccgccgccgggacgacgagctccggaccaagatcaagtaccacctcctcgcgctcggatggaccatcgcctccaagcccaacctccctggcctcacgcccaggctccgctacgtctccctcgccggaagcatgcatgcatgcatagcaatacacaaacatatatatatggtgctcaactaatggctaggtcctcgcatgtgcagcgggtgcaacaacaagagcacggcgacggcgatggtgcctccgcctccggccacctccgccgcggcccagtgctcctgccggcgacgacgccctccccttctcttgcgtcaccggccggcgccgccggcagccgaacctcttgtgacccgtgggccgtggctccgcgcacgcccgccgctccgctgccgtgctcgcccgccgtcgcgctcgcccgcagcccggcggcgcttcgacggtgaagagaaaagtgaagaggagaagaagaaaagtgaacaggagaaaagagaagaaaatatgtgaagatgacatgtgggccccacgtaattttaaaaatttttttgctgactaggatgccacatcagcgaaaccacccacgtatactgccataggacctttagtgcacggtttgtataagtttagaggtatacatttctggtttatggttaagggacttaaaaaaaatcttgctgttaagttgagggatctccggtgaacttattccgataaagaaagcccatagacaccccaggcggtgtgggccccattaaaggctcaagctcaagatacacggcccagtatacaacggtgggcctcggccatgttccgcacgttggcccgtgaaatgcagatatactcggccctgatcaggttcagggcatcttctcaaaataagaaaatccatgaaataataagtatcatattttttttaagaacacggcaaagatctgcgtatcatttcattaagataaagaacaaaagatgtacggtgttagaaaaaaactccgacactcgcccaccaagaatacaacagaatactatcgacgtttgatgtctcgactacggtatttgcatggcatagggatcgttggtactaggatatacgcgagactgaggtaaaagagacggagacatcgatttttatacaggttcaggcccttgaattgtcatgtaataaccctacatcctgttggccgaagccggtcgttgcccttattcaccataatcacaccagtacaatatttagggtagcctatctaactgttgtcaacatggcagtctgaaggtctgactcgcagtcgacaacagggtagtcttcctcctcgaatccgtgctggcgagatcaaagatagcgctttcgtctctactgacagtgtccggagacaccataggggactagccgtgcctatctctgaagtcgatatccggcgttttgtcttggcgtatgttggcttgtatgttgatcttctgtcttgatctattattccgtagattgtggtgggtgttgattgtctgtgttcgtgtcccctctcctcctacgaggccttgtatttatacccataggtatccccttgtccaagtagaactagggaaacaaatatggatacaatccgagtagtcattgtcgtttccatgtagaactctggttgtctttccttatccggaactcctcctatatccgcaggttgtttccgtataggacatggtatgtggtgggtcctgccgagatttagtcaactactattaggtatgtggtatccataaccctgacaaataccacacacccaaagaaaaaaaaacacaaactagtgcattagcagcccagtcctagcaaagagatcatgaagcctagcagctcctgctaggcaccaaagagcgccctcattagcgatagctcggaggacatcggccaagcataggatagcaccattaaatacacaattgttcatgtgcttccgatcgaatttcccaagcgaccaagatgattaaagagtttagccctttcttctcattagtaggtaaaccccttactgttcttgaccctcaattggcaaacctagcaataacctgggtttgaaaagctagagtagccaagccgttgcacgaccaaacaccatacttatcaagaaaacacacaagtgactaggatgtgactaatagttttctgagctagatcacataatggacatgtaggcgggtgttgaagtcctcgcttgtccaaccggtctgttgtccaacaacgattattaattgccaaccatataaacaatctgtatttcaaaggcatccaactctttcaaattcttcttctaggtgcaaaccttaccgtcccaacaaagatggcctcatatgcagatttagaagtataaattcctgagtttgagagcttccaaacatgctgttctggaacaagtatcatattttaagacatactatcggtgaatataacttccaaaaaaacgtcatcttacgagtcaacgcgttgtagaaatgacatatattgctgttagagttatatccattttactccgttaacctcgtcacattttaacagtgagaaacggatggaacctaacggtaatggtatttttaggtaagttagcttgtacaatattttttggaagttgtgttgttggattttctcctaaaattcagcgggttactgtatcccttcgtcctgcagtccgcatggtcaagcggttgtactgcatggacgagctctagaggtgaacggacatgcacgagtacacaactcgagtcttctttacatcgtttttgcacatctcgcactcggtagcactgttctcgccgtacgcagaagcggcttcataccgctatttctactgtggtagcaggattcagaattcgcaaaattacataaggccacgaagggagacaggacaagacagcagggagacaacaatggcgttgtcgtcgtccccatgcacgaaggcggcaacctacacgctggcaaatcatgcaagatcacaggatacagaatcgccgaaggtaatagctttgggctgttccggccatacaactgaatggatgacagcattttggctggcagtgggccgtgcgccatggcgctgtccaagttctttaatcatgtggtgttattagcatctactcccggacagggtatatcgagttgtctttgcttggatggcttcttgtcttggataagcgcgagaaacctatcaaatttattctgccaggttgctttcatgaattattagtatttcggatggacctgattgatcttctctttctgtatgcatgccctgattaagctccaatttaaactctagctcgtttaagaaatccaaagtactctatggtttgtgttatgtggtaggcccatg

SEQ ID NO: 59077 - DNA, 1866 bp, Oryza sativa
ataaataattacttaaattttttgaataagacgaatggtcaaacacgtactaaaaaatcaacggtgtcaaatattttaaaacggagggagtatgacctaacgaccaccggccctgaactatgagccaggcagtagttaggccctcactatattaaactaatatttgcggaagagaactgatcctcgtcgatagctttttatactttgctggaattgaatttcttattgattagttcatcctcgaagccaatcatttggcttcaatcatctggagcatatccacagacaccatcctaccagatactttaaattgaaaataaattcgcacggaaaaccctaaatcatccccataaattctgcaccacgcaaattaaaaaactgatctggaaaaaaaatcaaaaaactgttaagtcagtaaaccatcattcgcgtggctgacactggagcagttggctgtggcgctggcgccgcccagggggttaggcagctgcccggggcggcgcatgtgcgcgccacggacgtgtggcgtgcgcgccgtggccggcagggcgtgacgcgacgtgcacccgttcgagtggcgcacttgcgctcgccgcggtggtgacgctctcccggcactgcctgcctgcctgcctctcatcatgcggctggcacggtggcaatggacaaggtggtaacaaggtgaggggaaaaaaatgaattttgaaacttgattttaaattgttatggggtttttcatcgctttctttttaagcttgcttttaactgctaagagtgaaatataaaaattctatccttacaaatagcaattaaagatttaccactggattcacatgttataaactgttagcgataaattattgaatgccacatcttaaaattactaaaaagttaaatgctcccatgcactagttgcggctgatgaaagaaacaatgcaaagccagcgagatactgatgatacagtggtacggctctgcagctttgttccaacggcttctcgattttttcagcagcagaaacagttgtggcaacggtcatcactcatcggagctcagagtctgctccccccgccaataatacagtgatatgtgtacgtgttcgtcagttagtgcgagtacaattgcactgagaagaacaggagggaatagttctccttttcggtaggattattgaaggagatgggatgtattttatgcttgttttttcccatagccatctgaattccttgattctgtgggctgaacagctagactgtttcagcagtgaaatattggagaatgatctgttcttcggtggaaagattgaggtcgttcaaagctcgggaccgaaactgacatgcatgatagtggtatttttgtttctcaggatattcagagcatgcgaagtggctcatggaaaaacgttagttgcaaaatttcaagcacaagtgaattgatggtcttgtccctgctctttattttaggaaccttgttctttaattctgaagttgtacagttctgaatttctgatggctcatcctggactaattactgaaaattcaggtcatagaaattcagcaacgaaacatctgcaaaataattttggccacaatcatgccctgcttaggtgtaaaggacgaaagtttccatgcttagctgtagcatggggtctctgaattgctggaaactctgtgcaatagcaggcctctgaatatcaatcaagaacgtcacccaggctttttccgcaaacaaattcagtgcaacaactactgaaaaaacaagtactcctgtgcagctcgctttgcctcagaaactttactttctctcttcagatttttcagtacatgtagctgcactatacctgggccctttatcaccaggaacacc

SEQ ID NO: 59078 - DNA, 2559 bp, Oryza sativa
agtataaattgaaaagggtaaatttgtctttttatctaattatgtgggggtaatttcgtgatttcacgtttcatcactggtcagatccgatccacggtcacccctttgtggaagtcgcgcccagtcgtcttcctcttgcgagcagcgagcgccgcctcgccgccgccgccattgggaatcgaatcgatttccctcctcctttcctcttcttgtgtcttttctggcgacccaaaaccctagttcttgagggaggcgatgggcaggcggagcagcagaagggtgcatgctgctgtggcataggcgcgcagcttccgcagctcgcagcggcaagggcagccatgcggcggcaggtcggatgcggggaagaataggctagggcttgagggagggcgccggggacgcgggagacgccaggcgcgtggaggttcggcttctcccggcgccggaggaatcgggatggaggcgtcggcgcgggagcaacgacgccggagcagcgacgcgagatgtatcgtgaagaagcggatgacgatatccacagaaaaaacaactgaaggaaattaatcccagtgaaaataattctctaatttaaatgaccaaaaagcccttttcagattttcacctaataccaaaactaccctttcatatactggtagtatatactagcagtagaatataccataaaagtccttaaaaaaaggtttctaaactcgaatcgaagagggttctaaactctaaaagaattagccgctaacatggatggactgtacatcacaaattctcacacacatgacacatatattataatcatatatgtgcccccatcactgtcctttcgacgttggctttggatcccggacaaaacagaaagaatccttcgaagtgagggaaaggattaggcatcctggctagtaggaggagtacaacagaagaagccatacttctagaattcagtattgcataatgcaattaggctgtgttcttggtggaagttaagaacctcacctctcgacacgaaaatggaacgatggactaacatacaattaattaagtattaataaaaaaatataaaaaaaaaggttaatatgatttttttaaaaaaagtaattttcaatagaaaatttttgcaaaacacacattgtttaaccgtctgggaagagtgtgcgaaaaaagaggaggagttaggctgcgttcggatctcggagatgggaactcattccctcctcacgaaaaacggagtggtccattagcgcgtgattaattaagtattagctaacttttttttaaaaaaaataacttttatatagaaaattttttaaaaaacacatcgtttagccgtttgaaaagcatgcgcatggaatactagtaagagcggttgggagtcctttgcaacgaaaacagccttagtagcaagcacaaactaactcagctttagaggcccctcatattgatgtttaacttgttatggggcatttatttctacacagtctcatttatcaactgaaactaaaaaggttgtccaattccgtcctccttttgtaacggctcgcaaatacaatgggttgtttagattcatgtcattttaaatcatattattttttataaagttatcaaaatgtacatatatttatttatttttaccaaactttactaaatgagataatccaacaaatggcatttaaagcgttcaaatccaagaaatgccatcgccgttatgcttccgtccgtttcacgccgttaaaatacaatgttcatcctataacacttaatggtgtggaatggacggaaccctaacggcgatggcatttttgggataaagtcgtttgtacgatggcatttcttagaactcatatttgtcgatggcattttttgaatttggatgattgtcaatggtattttttggattatctcttagtaaatacataaggaatcatgccaaaacttgacaatattgtcaacttatcaaaatttaattgggattattttggcgataatatgaacagcccttacatttctgaagaattatagctcaaatatggctatggccctgtttggattcggagggctatttaatagccctccggaatcttgctatttaagagtattaaacgtagattactgataaaactcattccataacccctacgctattctacgagacgaatctaacgaggtatattaatccatgatttgctacagtaatcagccgctaatcgtggattaatatacatcattagattcgtctcgtaaaataggctagggattatggaatcggttttatcggtaatctatgtttaatacttctaaatagcaagattccgaagggctatttaatagctcggagcatccaaacaaggcctatgtttagatccaaacttccaactttttctatcacattaaactgtcatacatacataacttttcagtcacatcgtaccaatttcaacccaaactttcaactttggaagaactaaacacagcatatgacagtgcagttcagctcaattttgttcggagcctaaaaaaaagaaaagaaaaaaagctcatttggataaggctatg

SEQ ID NO: 59079 - DNA, 1560 bp, Oryza sativa
cccttcgttggcgctgccctggctgccatctaccaccaggtgatcatcagggcgatcccattcaagagcaggtcttaagccccgcgccgccgctgcgcagccgacgacatgcaacgcaatcgtgatgtcctgtttcccgcgcgctactgctgcgcatctgtcgattccctctatctctagtccccaagatgtttttcctatctgaaccctgaacaactcaatcgtgtaatccagtactcagtcactgtatgtttttatgtgatggagatcttaattcttaagttatcatctctgttgctggaaatccggtttcctcttcgtgcatgaaccgcgcctttaatacacgtactagaataatcttggcaggcagcaatgctggtatgatcctacgaagcctgaactatgaatgtgaagggaagaacgaagcaaaagagaaaagagaacaaaaaggtagctctgtctagttcccgaccgagtaatgccatgaaagaacaaatgaaccctagtgagtgtactataccaggatgagtgatgagtccagccttgcatccatcaagggctagggcttagcgatcgatctgatgaggagcggcggtttgaatctgtatgaatgagttagtggtgggcctggcttatgtgcgtcaggacaacgataacgatgaagatgaggacgattgatggtggccgggcgcggtgtaaagaaggccggctggccgggtagtgcgatggggacccgctagccaccgggcgcacgctactactactacttgctacgtaccctacggcagcgcggcacatgggaggtttggtggggtgtttggtctcgccactagggacttggaggcgccgaggcaaaaggaagttgaaacttggaagcaaagcgtgtaaaaatataatggagcagtgtagactgtagagatagatagataagtactatactagatacctgggtcgcatttagccatttactacccttttgcatttcgccttcgtcatcctgcttcagggaaatttggcaccagggaatattgaggtttatttatcatcatctcatccctcaaaaatatatgctaaatggaaaattaaaatggaaccgttccaaatgatcctatgaggatgcaccacccatcccatggttcagacgatttcccacttaagagctcctttgaatcaaagaattttatataggagtctcatacgatttaaatcctataggaatattttctttgtcgctatttgattcaaagattaagggtttctaaatccaataaaattcctatagaatggctcattgcatatagattttagaggaaatctagcaagagctagattttagaggaaatctagcaagagctccagcctcttcaaaaatttcatttaagtctatatctctcatccaattcttacattttcatgcaatccaatcaaacgaccattcctatgttacacgtgtgttttgcacttgcatttctataataatcctatgtttttcctattcctccgtttttttcattttcctattcctccattttttcactaatacgattcggggtgcaggaa

SEQ ID NO: 59080 - DNA, 1880 bp, Oryza sativa
aataattaatgaaattattcgtgtactatgatacagtgccaggcttgcagtaaatagatgggcaaactggctcagcagctctcatcaagctccaactcaatgcctatccagcacacctttgggtgaaatcaatgaccatggttgcacccaaggtgtggtggaccagatctcaaatccagtggaggcttaagttttacccgatcctcaaagcccttctgtgaagcatgctcagaaggcagtggcttatcatgcaaattccacacgctcacatgtcccatccttccaaattgagggctcagaatgtcagcttcagggactgccctctcctgaaaacctagcgagggttgtttcactctaacaaaacgaccaaggaccggatctggaggctggtttggcaagggctcatcaagacatctcgatgtaattgtgaaaccctcattattgtaagctaggtgtcttgcatggttaaaaggaatagctccattaccaccagtcagaggagtggaagcacctgaagtagttcttgggctcgaaatcggagagggtgacattataccattttgatgttgtggagatcttgacctcagatgagggctcccacatggagaaacagggcaagatatatagcttcgtacatgaatatcactgcaagcaccgatgattagagtacatacatttccatgcagatatacattcactgaactgttttttttttaaaaaaaacgaggaactgtatttcttataggagtacaggactgagttatcgaaaataaatgacagcagggtacagaacaagggtaaaatgtgaaaaatattacaatagcattaaacactgcttgaattttacagtgggagcatgttgcagctcagatgaattaagcagggacatcaacaaaacataaaagcacatttgggcaattattcatacttgcatgttgaaaaaaggacattagtaagatttctagtagggttcacttagtgtcctcatatataaaaaattcatacaaaggtcatttattttgtattcatttgaatgtcattatttaggggtaactgccaaaataaaaggaggaggagatagttcagtaatgtgcagctaaaatttcctactttgaaatgttagctaatttacttttcgtcataccaaagcataaggattatgatatgagaggtttggttgcggttctaatttaattttttcagcagagatttataagttagctactgctcctctagaatatttagtacacacactccaaagcaatattcttatgaattagcaggtagattcaaatattgaatgattcacctgtgcacagaagaaaatttagcagctcttctctggtaaatggattgcccttccaaacccaaagaagacatatttctggcatgcccgaccacctgaaatgtcacaagagacaaagcgtaagaaaaatggaacaatcaattgtccatctgataaccaagaccttaatactctaagtaggccccagtaacatttatctgtcctagttagctacaacagccagaaagaagcaaatgaaaggaaacaaggtaaaaaataaagtaaatgatttgtagaattaatgcatacagctgctaactgggcaaacatgcatgacagatgtttagctaaaagacaacatgttccaggaaagcagttgataccttcagatctggtttgcaggatgtagtagacaactgtagcaatggatccgacagtgatttttcaagtggagatgcatttcgtataaatgaatgctgcaaaagatccactgctgttggacggctggatggattgcgctgcaggcactgtcttataaagtctctgccctcttctgagaggtgatctggtattggtggaagctccttactgtttc

SEQ ID NO: 59081 - DNA, 968 bp, Oryza sativa
aatgtctcaaaaagtccaagataaatagaaggtgaagaacatataaagaagtctaacatgcaaaacctcaaccaaattttcaatatacaaaaaatatataagcattcacatggtaccggtcatcatgtggttcctgtaccacttgtctgttttatattcaacataaaaaaatgaatacaaaattaaatcattgcatctttaaacaacctttttgttttggaatttttcaaacatagtgtcatgttggattcgtcagatttcatcaaaggggatgctgggcctcctggccaccacaaacttttgctaactaaaaagagcattgggaaaataagacaaaacaatgagccatgctgaacttgtttttttaattaaaataagtactgaagcaaaaccacaacaatgatacagtatccaccattcatcttctatagtactcccttcagccaaaactatatgacatttgacttttttatggtcttcaaaattcactgttgaatcaaatattgtagcaatgtgcagttattcaaaactcgtagcaaagtgccattattcaaaattcaacgttgaatcaaatatggttttacattagaataagtataaaatcttgtaagtttatgatattatgataatacttttcaagtcgaatcgacacataccatttttaagttgaactaagcccattagaagttatgatggtcaaggtttcaaaagtatgaccgtatattgtcctaaacgttcccctaaaaagatagtccgaaacatcaaatatttatgaccaaagggagtaccttctcatgaaaagaaaatgtgtgttgcacaaaaacataaaatacagcttaagagcctagtataagtactaaccccttcatattggctccatggtggttttgaggtagccatctctaaaaccgtgcatcttaagctccatatgtcaacagcaagattacatccattagggctgcaggaat

SEQ ID NO: 59082 - DNA, 1531 bp, Oryza sativa
agtttaatttacaaccaatcaagaatagtagaatccaacagatgatatattcaaatcactcccttatgttgctacgtatgacaaactcaccctctcaacacctacaaagtgtaagttagcttgatatacaaaccaatcaaatatttagatggttgtacgtgtcaaatatggctaaatctttcattggctacactttccttaattgcacatgtttcacactaaactgaccacataagaacagggttgtttcaataattagttcagaagtcacactcaaattttagaagcaacaaaaacactttaaatgcatttagctataacagaactttaatatacaaatgggaacataataacgcaagtaagaagaatgtataccgcacaaaaaggatgtcagcaccgcaatgttttagtccagcaatcctaacaaagcattggctacttccttcttcgtgtctgctagacggagctgcattctcacttccgctatcttctgcttcttgatcttggattccagggtgcaagccttatcatcactaatgaactcaaaagctctcttgaaggttgatccacatggatgctgggcctcaattccgttcacaaaggaagcaaggttgggatacaaactctgcaattcagcatactccctccgtatgcttggtacattagcatctttatctactttttctttgtgattttcccctcctgttaggatgccaccattttgggtgccagcggtggcctcctttggcataacactgtgtgtgtcgccatccaatttcccattgtcagccttccccttcttactcccaaccaaagtaccatcatcgctagcggcagttgtggtggcctcctttggcatgacgatatgtgtgtccccatccaattcctctttgccagccttctccctcttactcccacccaaagttccatcatcatcatcagtggcaattgtggaggtcacctttgccgtgccactctttgcttcttcatccaatttgtctttgtggcttcccttcttcttacccttggttggactagcagcaagagcagcctccttagatgatccaacctttgtttccatacctgttttctgcttgttggttttccccttcttattctctgccagagtaccacccttttcattcacagcaatggcggcttcatccaccttatcttccttggcggcttcctttgaatctccactcaccttatctttcttagcttgccccttcttgttctttgacgaattgccagcatcctttgcgttctttccccagatttccgacgatagctgatacatccgcaggtcatcctctttagctggtaggtcgccgccgtgttcaactttcttggcagtggcctcgtaccgctgcttgagcctccgcaccttctcatacatgtccgaatacttgatgctcttcctctcgaggctatcgccgacagcagcgatgatcccctcaactttaagctgagtgccgtggctcttgaaatgggccacgaggacctcaagaatcttgacctcgtcatccgt

SEQ ID NO: 59083 - DNA, 10390 bp, Oryza sativa
  unsure (1)..(10390): unsure at all n locations
ggccttcttggccttgcccgacggcgcgggctcaggcgcggccctcttcttcttggcctcggctttggccttcttcgccgactccttcttgacgggctccggctccggctccgactccgacgagtcgccttccacctcctccccttcctcgtcgccgccgccaaccttccgaagctggaaaccttgggcgtaggtgtcagtgtcggagtcctcctcctcctcctcctcctcatccgacgaggcggcgccgcggccgctgggcttctggggcggtggggcgacgggagactccctctcctcctcctcctcctcctnctcctgctcctcctcgccgcttgaatccgggaggactggcctcgggaggcggcggcggcgggggcgggggcgtcggcgcgcggcgctggcgggccatgggtgatggatggctcgctcgctcgctcgccgctagggttttggggcggcggaggagaggaagcgggggagatgcgaatgcgaatgcgagcggcggggttctcggcgtgggctttgggcctttgtggcgggttgatttcaggagactgttgggtttcactgacgcgtggggccgggtgtagcgtacgctaacggttcgaattccatttttatttacttgttgtatttattttgggcatttcgtaaaggagaaagttctttcaaatgtcgcggtttgcccggaggagatcgaggtgaaaactgaaaaccgatcatggtaggttttaccaaaacagcgcgaaagccgatacaaaccatagaaccggtgacctttttttttgttaactatgtatgaaaactaactaaaatcaattggaattcacaaattgggtcagggtggtttcaagcaatggcggagctagaaaattttttaaaaccggataaatataactagtatttgttatagaaatttcatcaccaatttactcactaatataaaattttaatggagttttcgcctgcccagacgatgcctccgccattggtttcaagaaaaccaagcgattctaaaaaacaaatcggatctgtgaatcccaatcgagaattcggggcttggggtttgtgcaacttcaaagtaataacatcaagatcatctctcggtcttttatgatcggaaaatacgcttgagatcaagagaagcaatttaatgtggcggcaacaatatagagaaaggtaaagagaaaaaagttgtcacaagatgaattgaatgataggagatactcgtcccaaaatataagagattttaggtggatcacatccacctaaaatctcttatattataggatggagggagtatgaaataaaacaatattactgtagatcaaatttcttagtactacaaaatatatatatttcctttgtttttcaagcttgctagctttccatttattgaacccacgttattattccatggtcacgtgttttgcagttagtcctaataagatccattatcataaaaaaaaaggtagctgaaaatggagtgtgcggcatgtactagggcgatcgagaggatatgcagccggcacacggcacggcaaacaagcagcgcgtcagccagagcgtggtatgatggacgggcggtgtgccggtgtggcgaggcagccagcaaaaccaaaccaaccgcacacgatcgcacgagacgactcgcccagccaccgatcgatcgcccatcggtgccgcgactttttttgtttctttccacgaggcgagagctccatctgcgctcgtcacatgtgccattgtgccaatgtcacacgattccctttagctatctcttcgtgagcccatatatacgtgtacaatacaatacgaaaatcacatccaaatgtgcagcaaaattgtaaatgacaaaaaaagaagaagcatcgacgacagagctaactagctatatatatagcctggaataatgcatttgcattgtctaaatcggcacacagtattttatttttctttttcaagtgaaatcaccgtcacgtttggctgtcccactgttctcctcgtgcctttctattttgttttcttttataaacatgtatggctatgcagggttcacttattcacatttttagtgtacgttaataaggcgtgtaaagataaaaagaatatgtccgatctttgcaaggtgttcatataaaggtaagatgttcgtgtatatattatatggatgaatgtatacgagttgtgagcgcactttttttttcttaagaagagaggaatatgaattcctaactacctctcacaagtagaatgcatgacaatcaggggtagaaacatcatattgtgtgtgtggctgagtcaatagtaatcaaggcggacgaaaaacgattgaaaattaacgaaagtgttaaaaatgggaacgtggtgagctttaggtgctatttagtatctttcgatgctataaaaagaaaaaaaaagtgaacttttgatgatatataaccaattttgcaaaaaaaaacctatgatttgagacaattataaggaatttagaaggaattcaataccttcattctaaagcatcatataggaatttatttcgatagaaatgtaatcctccaaaattcttttattcgaaaggagccttaactttcataagaaaattagatccaaactaaaattcagtgttgtttctaagataatacatggtaaataaaactaccatagataatacacggtgaataaaaactaccgtaatatagtaagtagtttatatatccatagtactcactccgtcacagaatgtaagcatttttaaaatattgtcaagtcatttttttaactatgactattaatagaaaaaaaatattaaaaggtcaatcatataaaattgatgttactatatttatcattaaacaaactacaataatatgcaactatttttatttaaacatcttagttttatagatgttgttggtcaaataacattacttatgatataatctcttgatttccatgttactcatgcacctaataacgttagttcactagccacatcatctttttagttttatctcatttcgtaagcttcgtgtgagacggtagttgagaggtgcactactctactactactccatgagtagtaatatagaccgaaaatatgcgcccaagagcaagtgacacatatcagtgatctgtgagccgtggtttgtacgtgcacacagagcaggatttgtacccgtcgcgagaccacgcagcgtctcactgacgcactgcgcgctagctagcgcgcgcacacgcgcaagcgcaatgccgcgcggtgggcgcgccagccaggtggggtgggggccaaacgagcagtgcatctgcatgtgtgctgctgtggtagcccagcccacgcggctctcgtctcgtgccgcgcccatggatcggcgaacaaaccaagcggacgcggccgccgccggagctgagcgagcccatcgttctccggcgatggcaggcaaaccatcggtacatgccgcgctttccgcgagacgcaaaagcttcccagctcgccgcccgcgcgcgtcccatcattctcgccacccccaatcgccctataaatggccgcgccgccatcgctggtagtccagcacctcgtcgacttcttccagcttccatagctagctagctcggctcgccatgggccacgccgtcgctcgccgcctcatcctcctcctcgtcttcctcccctgcttcttgctgccgctctccggcgcgcacgccttcccggcctcggcgctggaggcggaggctgtggcggcgcgccaccaccggctccgcattgcgctcaacgcgacggcggtgcacgtggggaaggcgctcgaggccctgtcgggcgccgccgtcgcgccggcctccgctgtgatgacaacgccgttctcggcgggctcctcctcctcctcgcccctcgccgccgccgcgcgcgacgactgcgcggagctgctcgaggactccctcgacctccttgccggcgccggtgagcccagtgccgcccacgacgacgcggtcacgtggctctccgccgcgctcaccaaccacgacacctgcgccgacagcctcaatgaggccggcatcccccacggcgcggacgccgcgccccaccttgccgccgcccgcgccatggtccgcgactgcctcacaatgtacgcggaggccgcgtcggcggccatggcaaccagcaacaaggacggcctcgccggcgtccccgtccggaacggcggcgggaagagcaagaagcagaggaagagagggagaagaagaagaagaagcctcttcccgaggtggctgtcggcgagggaccggaggctgctgctggtccccgcggcgccattggtggagagcgcggacatggtggtggcgaaggacgggacggggacgcaccggacgatctcggacgcggtgaaggcggcgccggagcgcagcgggcggcggacggtgatacacgtgaaggccgggcggtacgacgagaacgtgaaggtggggaggaagaagacgaacctggtgttcgtcggcgacggcaagggcgtcactgtcgtgtccgccggccgcagcgtcgccgacaacttcaccacgttccacaccgccaccttcggtatgtcatttgtcgccacgatttactcactccattgtcatttcatcgaacattttttttttaaaaaagataatgttatggtgtcaagaagaaacaattttgatctatcacgttctctgaaactaaacttttcattgctaccattagtgcatttttcttttgtactgttttcatatcacataagtttagaaaagaacgctgttgctccctccattccataaggcacaaccacttttcttatatgttcgataatataaggcatatatgcaagcatacaattaactatgacatcttctccattaaattattactttttaaattctgtactctcatcttatctaatcctattagatgcatgcattatatttattaggatgattcaaactacaagatgataataactatttcttggtctttggattaagagtggttgtgccttatattttagaatggagggagtaataattaaaaacaattatattttataaaagtatatttttttcactttttacttttcaactgacattgcatcccctgtcttcaccatagatagacctatgctgattttgcacaagaaattaagtgttacaaatagggacgatttcctagtttgtctaaataaactaattttacttttgcgctcaacgcaagaaggtagtagtaaaaactagctagaggcaagttattaaattgcaattattttagtgatatgagcagtgacgggttgcaatgagcttacaggaaaacacaattaattcattgctaccgaagttaaatactacaacactatgccaacaacagaagaaacttcactaatcacaataatgatctactccagcctgttgtgaatgtctgatgatggaaccatccaatttattttgcggtcattagttctattaaattggtggattctttcttttatatatttttttgctgggcaattgatcgatcgttattcctgctgttacttctgcaatctcctaacgcttctactgttccgcaatgaagaccacttcgagtaggattagctcgtagtattaggcacgtactaatagctgctgtagatgactgggtataaaagctggtaaatttcctgaaaagaaacggtagaaatggactactcgacctgcattcttgctgtgtttgcgtcattgcggtaacatggcgtagtgtagtgggtgggggacttaatcacttaactgaaccagaaatcggatagcctgcaggcaggcagcggtatggcgcgacatggcacgtcgcgagcactgctgaaatttgacaagaatttgttgcaaattagtaatctcgtactagtataagaaagcagcttaattaatttgtgtgaaatttgtggcagcggcgtcggggagcgggttcatgatgagggacatgacggtggagaactgggcggggccggagaggcaccaggcggtggcgctgcgcgtgagcgccgaccgcgccgccgtctaccggtgcagcatcatcggctaccaggacaccctctacgcccactccaaccgccacttctaccgcgactgcgacgtctacggcaccgtcgacttcgtcttcggcaacgccgccgccgtcctccagcgctgcaacctctggtcccgctcccctctccccggccagaagaacaccgtcaccgcccagaaccgccgcgatcccggccaatccaccggcctcgtcatccacgcctgccgcgtcgtcccctcgccgccgccgccgtcgacggcgccggccgtggcggcgccattggcgccgacgtacctggggaggccgtggaagctgtactcgagggtggtggtgatgatgtcgtacatcggcgggcacgtgccgccggaggggtggctggcgtggaacgcgacgttcgcgctcgacacgctctactacggggagtacatgaactacggccccggggccggggtcgccgggcgcgtggcgtggccgggccaccgcgtcatcaacgacagcgccgaggcggagcggttcacggtggcgcgcttcatctccggcgcgtcgtggctgccggccaccggcgtctccttcctctccggcctctcgctgtagctagctcaaccatatgctgcatgcgcatatatatatatacctgttgcgttggcatgtgcacgcacgtacgtacttgggattatattgatttgttgtagtagattcgaaatgggatggagcgatttgatttgcattcagaatttggaatttcggtttcaccgcggcgaattttgcggttacatacatcgcatcgttctaggcttctagcggtgtttgttacgttttcactgtaaggtgtcggtgtcggtgccgagcgatttgaatgaatgtgggggctggctcactgtgagctcttgtgcagtttggtgatgagaattcgagtgggtcaagtgacagcccatcgatagactcttgcggcgtaactttttcttcaaatttttaattttttcatcgcatcaagacttttctacaaataaactttcaacttttttctttaaactttcaattttagtcaaactttcaattttaacgtgaaactaaacacaccctcgaagctagcatatcaaatgcgcatgtactttggtctgtgagaccgtgacaagcactgcaatgactaaacattgattagttacctatgcaattattaaaatatataaatattgaatttaataaaataatttgttgtagtagatgttgctaaatgtttttttataaactcaatcaaatatttaatatagtttacctagcttacttacaaacaacccagcgaaaattcggttgtatcaagggtattcatctaatatatggaccaaagagagacttcgttaattaggaaaaatgtcatgtgatttgtaataatataaaacagagagagtacacaacagtaggtgcaaaacccatctcattctccaaacaacataagatgggtgatatgactatttcaacatttaaatgaggatagcccctaaaacattttgatttttaaacagatggtttgcatatcaaaatgtttagaacacaactaaaaccacttggcatgaaaaaaaaggccgagttctaaacttcaactccgacctacaattcgatatataggtttcttgttatcaactccgacctacaatccgagactattttaattaggaaaaaaggacatgttttctaaactgctaagcagttttttttaaaaatggaaaagcttttttctaaaaaatatcaaataaatccattttttcaaaatttataattagttaatacttccatcaaggagtaataaagtcagccaaaagtcaaaaatccgcgtggaaattgactcgtcacaagctggaccagacgaccgcttccccttctccctctcagctgcgcttcgcgggaacgccatggaagacaaggggacgcagccaccggagccagccgcggccgcggcgatctcgtcggtgctcgccaacgacgacctcctccgcgagatcctgctccgcctcggcctccccaccaccctcgtccgcgccgccctcgtctccacccgctggctccgcctcgcctccgacccggccttcctccgccgcttccgcgcgcgccacccgccgcgcctcctcggcttctaccacacggccagggcgcgcttccaggacgaggtcccggcgttcgtgccgctgccccagccgccggagctcgccgccgcgctccgcggcgcccgcctccgcctggcgcccggctcctccggctccggccccgacgcgcccgtcatcctgagctgccgcaacggccgcgtcctcgccgcggagttccctcccgatgggccacgggtcagcatcatcagcccgatgcaccccgcccgccacccaccggctctcccgctggtctacgaactccctcgccagccggggcagattctgcatgcctcgtgtatgctcctcttcccagatgtcggcagcgacgatccgtcctacactttcgtggaatttctacgcaaagatcaggagatgttggccaaggcagtttctgtaagggctgaaatttcggatctgaacagtgtccgtgaatcggcaactatagagattcaggaaagctgggaaaggagcataaggcgtgatgtgcttgtcaatggcaatctctatctgttgggagggaaggggcatgttcttgggttgaatttggcatccatgaggctattcttgttcagattgccagatggtgtgcagcagctacaccggatgggaaacattgagctgctacgcgcaggcgattccggcttatatctcatccatctgaaggggtttcagattcatgtttggttccgcgcctccgattccgacatcggtggtggcaactgggagctggttgataacatctgcttgggcgaatcgtttggtcagtttgcagagcccaattgggaatcaggggatgctctggttgcgctccatagggtggaggacaatgctgaggtgttcttgcgggtagaccgtgtgatcttccacatacatatcatgaacaggacggtaaacaaagtgtttgagatgtcaccagaggcttatagatattttgacatatttccattcatgatgctctggcctcccaccttcccacaacttaggaatgatcatgatcaagatcagtgatcctcgaaggcgcatttgtctggtgccttgcaagtatggtcctgaatttgtcttgtagatctctcactgctagaatctgcttatgttatgtatctctgtcttttaagatgaggtcgaagattaatgtactatgcatcaagaatatatattacctgatgctatctttgtctgctattctgctctctttgtgttaacctgatcgactgactgtacttgggtggtttagcacacggcgcccaacatgtagtaaattctcaagaattttatagcataatttccacgttttcgatgaactggtaccttcctcataattcccggtgttgctgtctgcatattccttgtgcaataactctgtaacctttgttgtttaggcaattctgaatgtttggtatcatgttcagaaccaatggctttaagctaagaagtaagaaactattttgtagcaaagttttagcatgttgattgcacatgttcaatcgatgtttaaagagatttctgacaaagaaaagagatagatttaaagggactaaatgtatagcacgtttttgaaataatactacatatgtgtactttacaggcttacagcaggagaggcatttcatttgacctgctgatcttgtgcagaatctgtacatgcctcatgtagctttgcaattgtcaaaaggtagtggttattgcctgtaattatcatctgacttttgatcaatacggcgccgggagcaaaaccaggcagtgtcagcttgctggatcaggatcgacactgctggatcaggatcctctgcagtcgactgcaccgcgcctttatcagtgacatgtgggcccatagatcatcaggcccatatgtcagtgacaaatgcacggtacagtgactgctgagaatctcaatcctagcttgctaggggagggattataattacttgtgactgttgttaacataattggactgggagatatctcccatctcgtcttgcttaatctgaatacgcggttctcttttgtataggttaatttaaacctgtaaggataaggcgaatagtgttgaaaaagtactactactatttgatttaatttcataaagctgtttgtatgtttcaaatcttccaaatgaaattgtggctcaccatggttagttttataatgttagttgtataatactaaaaatcctacagcataatgttcgcgtttttaa

SEQ ID NO: 59084 - DNA, 42300 bp, Oryza sativa
  unsure (1)..(42300): unsure at all n locations
attcctgcagccccggacacatatttgaagtattaaacgtagactaataacaaaacaaattacatattccgtctgtaaactgcaagacgaatttattaattaagcctaattaatctgttattagcaaatgtttaatatagcaccacattgtcaaatcatggagcaattaggcttaaaagattcgtctcgcaatttacacgcaatctgtgtaattagttattttttttatatttaatactccatatatgtgtctaaatattcgatgtgacatggtgaaaaattttagcatggatctaaacaggcccttagaccggtgttcctaatgacttaatgacttaatgttagataccctgttcagaacaagatgacattttgtttcgacaacttgacacttgcctctttttttctccaggacgagtagtatatgtacatctagatttttttgttccgatgttaaagctagatgtttgaaacctttttatagcaaaggtttaactcgatattaaaagagacaaaagaataatgcatggcgtgttgtccaaataatcctacgcgtgtgtggtttacagcaggagagcgtgggcgcctcctaaccaaaattcagcccaactattgaaaaaaaaaacctgaattaaagttagtatttgtatataagatatgtttccttttctctgattaatatatgtggtttttttagttactcctttattaaggataaatagatttatatatttagagttggacatagttattaaaaaatatatgtagaattaaatggtagaagtgatgagcttgaatgttggagtattattggttggaaaaaaatgttcgtggaaaaattaatatataaattttgaaggttaaaaattgttatatttgatatggatagagtaatgaagttgtagaaatgacattaagtagaaaaatattgttaaaccagcttagcttagctcaacctgagctccttactccaatacctcctcgatcgcatgcaaatggaagacgaggcgacgcgtccctcctctccgccaccggcggcttctgcggcctcgtcggtgctcgccgacgacgacctcctccgcgagatcctcctccgcctcgccttccccaccacgctcgtccgcgccgccctcgtctcctcccgctggctcggcctcgcctccgactcgtccttcctccgccgcttccgcgcccgcaacccgccccgcctcctcggcttctaccacaccgcgcgccgggacgagcagccggcgttcgtgccgcttccccagcccccggagctcgcccccgtgctccgccgcctcggcgggttcgcgctcggcggcgccgacgtctccgccgtggtcttcgactgccgcaacggccgcctcctcagggcggagttcccgcccccgcccgacgagctacgcttcggcgtcgtctccccgctgctgccccccgcgcggaagccgcccgatctgcccccgaacctgcactcgcagctccatcaggtacccaacgatgcccgtgtgctgcgcccgggctggatgctgctcccggaggaggaggaggacgacggcggcgacgatctctcctacacgctggtggttctgatacgaagaggccgtggattgttcgcgagagcagtgttggtgagaggtgaatcagacgaccagatccgcacctccgattcaatcgagctgccgaatcactactggccaaacaagaagatgaaccgtggattgctcttccatgggagcctctacatgctgggcagggagcatgttcttgggttgaatctggcgtcgatgagcttgttcttgatcaagctcccggatggtgtggagcagctggagcatatggggaaccttgagttgttgcgggacggcgattccggattatatcttgctcatctgaaggggtttcagattcatgtttggcatcgtgcgacagacggcggtgggaatggtggtgattgggagatggttgataccatgtctctgcatcaatcgtttggtcaagttgcgaggcccgattgggagtcgggggatccttcacttggggatgctcttgtttcacttcgtagagtcgaggataatgccgagctgttcttgacgatagaccgcgtgatcttccacatacatattgcgagcaggacagcgaacaaggttttcgagatggctccaaaggaagatattggttttgaaatctttcccttcatgatgatatggcctcccactttcccggctttgaactatgacgatgacgatgatcagtaattcagtatgaatgatcccagaggatttttctctagtgctttatgcgatgtctaaccgattctcaattcagcatgtagttatcttgctgtaacaatctaattgttactggtcttttaggagagtcaggcatcttatgtgatgttcctttgttatgctttaaaataagatttaagtatgagttaacctgatctacttcaaaaatattcttctgcttaacaaattgaattcaagcaatatttcaggtttaaatttcaccttttttccaggtatgctacagaggaattttgagctggtaattttgatagcctgttttggagattatttgcaaagtactgcttctgagtttttagtccaaaaactggaaacctggaatgtgtgaataactgtcattgacaatttaggattgaattatgttgtgagctttttgtagtatcagactttattctgttcgtacttaatactccctccatttcataatgtaagactttctagcattatctacattcatatagatgttaatgaatctatacaaatatatgtgtttaggttcattaatatgtatatgtatgtggacaatgctagaaagtcttacattatgaaatggaggaggtacaacattatgtagcatttatattgaatctcaatatctgattttgtgcatacgaaacaggaacaaagaagaaatcatatccttgtgtgttgtaccatgtgctgcttgttctgaactaggaattttcggatttcagagcaactctgtcatagcttgagttctaacactttcttttttaaaaaaaaggaatatttgctcggcttagcaacatatccaaatgaaaaacagggatatggcagatcatataaacaattgtgatgttgttggaaaatttggacttgtacccaccaagcataagtctagctatggctcgatagacactagcaccaggtgggcctacccagcatgttttatctagttttgttccaacttaaaattgagttgaatttgggtttcaggtcatagttgaagcagctcatgcatataattgaaagtggtaagtcacagctacgaaaagaaactgctgaattgataatgcttcagattctaacatggcaacaattgttttgttttgagcatggaacatccagaacctataatccttcggttttcattttgattcggcaaggcaactcatgagaataggaacatcaaaattactaaacgactgatgcctggggctctctagttcctggctgctgaggtagttccgctcgggaaattgctgtacgtacgacaaacttgttacgattttgatacgatccagtcatgcatgatacttgattgggccatagaaacattgtatcgtacactaatcgtaagatatttatcgttctgctcgatcggaaggatatatggagcataagccatcaacatggttaaaatttccatcaacgggttgtttgcttcaaagaaaatatatcttcctttcttgcagttcatggttacagtaacaaatctccaagatcaatgcatcaccagagttatcatgccaactaggctctgcttacgatagaagtaactaaggtcctgtttgtttcagcttatgattattataatctagattattaagccagattactataaactggattataataagctgacatagaataagctgtgagttgtttatttgtttggattattggaggtatggattattgggtttgaaaagctaaagtctataatgccctcagctatctgttcggttgatggcataggtgggtaatttttctcaattatgtaggagtagtgggtctttagccactcaataatttgaaaaaagctcacctagagcagcttattagattataataatctagcttatagattataataatctgctataataatttacttgtttgtttcagagttaaatcaaatatacaagcagatattgattttagtaaaggatacccatatattcataatccattaattcatcgaccataccatttttaagtccattaccacaaaatggaagaaacaaacacacatgataaatcaatccagcagcaagccagcagtagacaagaacttaagacacaaagcaccaaaaaccaaacctcctcttcaaggatcactgaaatggcctccatccttgatctactccagcactgggaagattggaggccaaaccatggtcagtggatggatcactggcagaacacctcctctcttcggtgacgccttgaaaatcttcttcaccatcctcgtcctgatatccatgtacagcacatcgccatcaacgcacaagaacatgaactcgcagtcgtcgccgaccttgataaccccaaccggaccaccaatgtccatctccccgccaaccttcgcgaggtgatcgaaccctcgacgaacaccaatgtcgtccaccaacacccaattgcccgctgtcatgccgtcgccgtcatcgtcgtcgccaccgcgacgccagagacgagcttgaaacccattgacatggatgaggttgacgccggcgtcgtttgaccggaacaggtcgaggtctccgtcctcctcgtggcgcactccgtcggggaggttgatgaaggaggtggccatggatgccaggtcgagcacaagaatggcgtgggactgcatgcccaggacgtatagcttgccttggacaagcagggcacggttccaggtcgtgtcgccgcggcaccgcgccgggagctcgaccggcgccgtggcgcggacgtcgtcgtcccaggcgcccgcgcgcaggacggacaccttggcgaagaactcccaccacacgcgccagtccacgcgcttgctgcgcaccagcgtcaccacggtgtaggactggccgtcgcagccgtcctcggggaggaggatgcagacgtcggtggcccggccgagcagcgtgtcgtcgtcgcccatggcggatacgggcggcgggcgcgcggcgagcgggaccggcgggaggacggcgagcgaccgcgacgcgtgcagcagcgggctgaccaccgcgagcgtgccgtcgccgcggtcgaacgggtcggagaggtccatcaggacgcggccgttgcggcagtcgtacacgggcagcggctcgccgccgccgatggagccgagcatggcgcccttcgcggcgcggcgcgcggcggcggcgagcccgcggggatgggggagaggctcgaacagcgagccccggcgtgcttggcgaagaggccgaggacgcggggcgggtggagggcgcggtagcggcggaggaaggccggggcggaggcgacgcggagccagcgcctgcagacggcggcggcgcggacgaggtcggtggggaaggcgaggcgcaggatgatctcgcggaggaggtcgtcgtcgtcgagcaccaccgagacggcggcggcgggcatggcagggtgcgttccctgaccttccatcttcttgggtgtgtgagtgggtttggagaatcgggagggacggaatgcatagaaggggaatcaatggaagcatgtaagctagtgtactggttccttgttttcttttccggtttccattttttttctttatggaaagggttcgaaaaatattactatggtacgtaagactgtaagagtatctatatctatatctatatctatattaatataaaaagataagtcgcctccctccaatcctattggtgtaatcattcggatcgatctctaccgtccatccgcaaatccggtgtaatctggtccgtccatccgcagatctctaatctgtaccgtccacccatctcgaccgcacgattttagcctcacctcgcgcgaagacgtcgcgaagactacgcgtctatgcctcaccctctccacgcgcggctcactcctcccgtcatgtactgccgccgccgcctcaatccaccgctacccccgccggagctgacttcttctccagccgccgccggagccgaggtcgtccccttccgccgccgccgcggcgcactccaccgctgccctcgccggatccgaggtcttccccagccaccgccggagacgtggtcttcccatccgccgcggccagccgtggccggagttgacgtcgtcccgagtcgccgccggagccgagtcgtccccagccaccaccggaaccgtggtcttccccatccgccgcagccgcaagaatcgctcattcaccccacacccgcacccacggccacgctgtgctctcctccacaaccatgtcgagcccacatctgccgtcgttgacgctgtgagcacgctgagccctctgccgcaaccacgccgcacattagagatttaattgagttttatgtttcggatgctccagctttctaccagaagtccagaacacacatacatcagcatgaagatgagatgattcaggtcattgaattgctttgcattcatgctatcatattttgatgtgtcatttaatcatgttcttcatatatttgtttttccaagaagggcagcaggtgacagttgttgatgcggccgtgtttggtggtgttcacagttcttgaactgcaggagtaatcggtttgctaacacagacctgatctcaaggtgctatgcagcttccagtgaatgtattgtcttactatgatctgcacatccacccgggcaactctttgcttcccaaatttgattgcttgtgttgcatatttttgccgatgtagaaatcatatgtttttaatgttgtatgtcctgacggtttggcaacaaatatatccccagtatctttttgagaactatcctcaatatctcacggtattatttcatttgcactctaaatgaagaatttaaaagaattataaatgcaattttcaatctgatttacctttgtacatgattcaagattcagtgcagcagctgtagtcttcctccccatatcagaaagaatgaatcttaatggtgaggtataatcctaacgttatacattatgctttcatttgctcacaataaaacttaaataatgttcaatataagttcacatattgttctaaaagttttgttttgcagattggtaacattcactcatatatgttgtcagttagctcatgtcctattgatgcaaattttgttgttctcctctctctgcttggcctcggctcactgacaaacacctcctgtaccttgcccattcctctacaacttttaattgcaattgaaagatttggaacaacagaagaggaagagagatttgtaactatctacaatgccatttgaggtaggttatgtactgttaaaagtgttttatccattcagttaactgataggtagtctactattttgtgagttttaagtgtcaagtgaatgtgtactgtacgatgtaatggcttggtaattattagtaatcagaattaggggaaggtaaatctcttctttttatcatagagcagcacaaatatgtaatcaattattggatactttttaccttctgtatattttctgcatgtttgatatgtactccaccgatgaatggctagacttaacactcagagggaggacagaggaagaataatatactgatatatagctatgcaccgtttatcaacctttagtttaatgcctcaacaaaatgaattatcgggttgataactgaaacatttctaataggtgccacaggttacttgattagggataattgttccccattttctgataactgccaaagggtttttaatggcttaaatacttccagttgacggctgctggatgattttatcctcactggctgctttccaaatttttttaccgtgtgtttaaaagggagttattaagttgtgctatattacactacaatagatataattctcaaactacattttttgtgtcatgtattggggaaaacacgtcaaagtttaagtgtgtttatatgtttaatgttacataatgtggggaatgtgcattgcacgtgcacggttactagtgtacgtaacaagctataaaccagctataaacgtattttaaagagataaaagaagagagataagagcaacggactacagatctgtagctagttgcagcacggactccaagatgtaatgtgtgtttgacaggtgggactaggtattaatagtatagtaagcaactattatatgatttggctattacattggctatagatgatttgtagctagtagatagctatactattaaacttgctctaaaagcaagttcaataacacaactcagtactggctgcaataggtagccatgtcacctatagtaaataatagagcccatgcatacaatagaaatatcttgtttactctaataccaatattctattattttttgtagggcccatcatcttcttcccgaaactcctagttggcgattgatcgccaggagcgatcggtttcccccctctcctccacgtggttttcttttttggcaccacattacttttctattttagtaaatttatgaacctaaagtttatacacctcaagtttacacatatacagtttacaaatccaaagtttataaatcaaaagtttatatatccgattcaaatttgaatttgaattcaaatattttttatatatagtatttctatacatctaaagtttatacacccaaagtttataagtcaaaagtttatatatccgattcaaatttgaatttgaattatatccgattcaaatttgaatttgaatttaaatattttttatatatagtatttctatacatctaaagtttatacacctaaatttatagacccaaagtttataagtcaaaagtttacatacccgattcaaatttcaatttgaattatatccgattcaaatttgaatttgaatttaaatattttttacatatagtatttctatacatataaaatttatacatataaaatttatacatctaaagtttatagacccaaagtttataagtcaaaagtttatatacacgattcaaatttgaatttgaattcaaatattagtttataaacccaaagtttataagtcaaaagtttacatacccgtttcaaatttaaatttaaattcaaatattttttatatatagtatttctatacataattttttctaactttatttttttatttttttaaaatttatagtatagtaggaagagaagaaggggaggagaggagaggtgtgtacagggggcatggggatcgatcgcccattagccacaccctcttcttccatctcttctttttcttcctcctttcctttcctttactctgacgatgaaggcaactctcaagcggccagtgaagacgggacctaggagcacgccagagcggggagagtgggggtggtgtcagcggtggccatggcgattgcgagggtgagggcgacggtcgcgggggacgcatggagggcggcggcagccgcgacggataaagggggagagggtcacagccttgcggctacgggcgacgggcaagagcagtggccacacgggaagagagcgagggcgagggcggcggccgcagcggatggagggggagagggcgcgaccttacggctaccggcaacaggcaagagtggctgccacacgggacggggcgagggtgagtgcagcgacgcgaacgatggcaggagcgctagccgcggggaacacggacggtggcggtggccatggcagatgcagcgggtgacggcggcggcagccacaacggatccaacgggcgacgagccgatgatggtggtcatagggggatgcagcccagggtggaggcctgggtggtcgaggtggcgacctggcggacgctgtcagagcctcggaggcttggatggacgagggcgtcggactgacggacgtcggggcaaatgcaggagacgttgctgaccgtggtgtaggggtgaaaacggtacggaaacggacggaaaccactgttcacaacaatgatattttcacaacaatgatattttcggcctgacaccatggtattcactattaagtggtttaaaaaaaggaatccaggctatctcagtcacaaaatttccggaaattccgagaaaatttccggaaagtttccgaccgattccgagttccgacagaaactgcccttataattttcgattccgtttcggagaaaatattttcgaattcgtttctgtttccgaaaaaattccgaccgacagattccgtttttgaaaatagatctggaatctggaaagtttacgtaccgttttcacccctactcatggggcttcgtctgtgatggacgtggcatcgaatatgccgttcctctgggagactcgagagtaaaattcgaccactgttgctaaaggactcttgctacagtaccatgcgatagttactgtagcagacttagatcactattccacaggaactctgttgtactgcagatgacctatcactctcgcgcctggtagcgtgggtgtgtcattcttggagtgcgtgtgtagtcgggcgattatatagttgcccgctcccagtccctcatcccttcattctctctgccaagtcatgctttgagagtctacatgttcttgttgtcatcagtcatataagctctactgtacactaaagggatcgtaatttagtccatgacgtttggcattatccaaaaaataccatattagcttaatatggacccataaaatatggtaatatgccacatagaaagagaaaggacgtgactacacagctagtggtagctagttccactccatctataagagacattatctacctatacttcaaatataattttctcttaaactactcatccgatctacgaaccgattgcaccgttgtgtttgtaacaattatatctttataacaagatctcacatgactatattctgatgaaaaattataaattacttttataatatatctaaattacttcttagatatgtaaaagtaaattcaatgaagcctaaaactaatttacatatattatagaagtaacttataacaaaaactaagtaactttaatgaatgtcttttttaattggaagtgactacatagctagtggtaactagtttgtactctattttgtatctcctttcaacttgaaaaaaacaatagtatcttcttttctcattctacatgaaaaacaaaaatgtaaggaaagaaactatcgatgattaaatagatttatagacagttacttttgaaccatgcaaaagttacttccaattaacattgaagttacttttaaaaattgttaaacttatgtgtgttgatctctgctgattaaatttaatttctagataaaatcatatttttattcctacaaatgatttacttataatgtcgtgacaaaattacttctgttttgttttaagttacttttataatattgtcgacggtaggtacccgtagaccggatatagagggtattggggtacgctggtacgaggatctacgtagtacgacatcaaggaaacaagagacaacgattatactggttcaggccccttaataggtaatagccctaatccagttgatatgggattatatggagagaaccacaaattacaaagggaataatggaactagatgataccgacgagatcgtagtcgagttgattcgactagatcacccatcgacttggctcctgtaggctccggcttcgtaggctgtggtcgttgtgttggctatgagattcgatgccttaggtcttcctggggggtcccttttatatcgcaggtcaggtggtctccaagtaggactcggagacatcggaccctgcacgatatagtgacgacccagtcctatatgggtaggaacctttccattggtggacttcgtgatagatttccttagcgtatagagagaatgtccgtacacgcgcagatgtaccatattgccgtatagcgtacatccaagggtagagggtataccttatccgtaaccctgacagtagcccccgacttcagcttaaatgaactcatgtaaccgatcgcgacttctgatgtcggagttgctgtcgttctcgactggtcgatcttggtgtgaggaccgtagagacaaggagtggtcgacaatgaaagggccttgatgtcgcctagagggggggggtgtgaataggcgttcctaaaatttacttcaaaacacaacggttaaaatcagggcccggaacttcctggcaaaaggtccggaacttcctggcagctttttctcacaagcagagaaagctgcccggaacttccggggttcttcctaggaacttccgggcagttgttaattgctatttcaagcacctcacaacaagtaaattaaatcacaaggaagcctaaaccatagagaggtacaacatgtctcaaacaagagtaatacacatgaaaatacacaagatagcacaagtgatcatacaatgggagacatgatagcacaactaggcaaataaggagataagcatcacaatcacaaagataaagagagtgagaggagacaaacgatttgtttcccgaagttcggattctccaccgagaatcctacgtctccgttgaggagctctaaagagctgggtcttgattaatcccttgcctcaccaagaaaaggcctaggaagaggtctccggtcttcaagccaacacccctaggtacttctctttggtttcaagtgaccactaagatccccaacttgaacaccaaaagaacaccacaagtaaggcttgctctaccaagacgacctcctaaacctcacctaggattacactcaccgagtattccgtttccttttggaggtggaataacgccctcacaaacttgcccgggtcaatccacaaccttgttagaaactcgcgggcgacacctaaccgtctaggaggtcaccctccaagagtaacaagctccaaatgacagcccaacgagataccccaagtgctcaagtcaacctagccttcaaaactgtttctaatcctcaccaccaccgtcaaaatcactctctcactcaagacatactcaagatttaggtggagcaagcaacatcacattgcgagaggatagaacaagctagggtacacaagaactaaagtggaatggccaaagggtgacctggggacgaaatccatatatataacggctaggtgacgtcatctagccattactcacaagtttgaactggaaacctaccaggaggttcggggtaaaagtgccaggaacttccggccagcacttaggaaaattttcaacctcacctcggcgccaggaagttccagacagaacctccgagtgggactctctgtcccgagtagagccattttcaaaaacagctcctaaaaatatttcaacacttggacaccactaagagcacttgtgttatctcagaaccacacttggaacccctcttaatagtatggtttttcctaaactcaaagcgaaaaagtaaactagtctaactcggctccgagttttctcgccgctttgttttggggggtctccaagcatcctagcccactcctaagcaacctgggactaatacaccactaagaatgttatcttcttgcttcaccttgagggttgtcaacatcaacgccatttcactattcggactattctcacctacactcattaagcatattagtcccaaatcaattatacctttgccttgatcaatacccactttggcttttgacttgatgttcattggagaaccacatcctcttgatcttcggcattccatcttgcggtcttctaataattgatacgaattactcatagcttcaaatggcctcccacggtccatcatgaccattatgacaaagccttcactcgcccttcaccaccggattcggtccatcggtgccaagcctcttgcttgcccttcaccctccgcatggtccattgtagccgagccttacttgcccttcaccgttttgccataaatagccacttcataccccgcatcatcaatgtcttcacttgctcctcatcaaggtataacgtcttcttctagcttcaatcttttaacttgatgccggaacttaacctaatctcaccaactcatggaaatagttagttccaacaatgggttgtcattaatcatcaaaacaatcaccacactcttaggatcatagatcttccaacctccccttacaagggcaactctagtgcatagatctttcaatctccccctttttggtgattgatgacaacactatcacaagaataggaatttaaagagaatactctagtatatgttaacttgagcatgaaacatatactagagggttagtttcatcaacatatgaaatgagtatgcactttcccctttatatctctttctctttatacttctccccctttggcatcaaacaccaaaagattaaatgagtgggtgggagcataaagaaaaagaaatcatatcaagtatataagaactacacaagtcctatacacttgaagggaaaaaggtttaacatacctttggtgttccaaagaggctacaacaagatgaaactctatcaaaagcgttagtttcaaaatagcaaagcacaaatagcctcgaggtacacacaagaagatatacaagaaaatcatgtgcaccaacaccaaataaagcaattgaactcatcaaaattccaatagaaagagttgggatccaaagagacaccaatccaaagcaagctctttttggtcttgtgcatatgagccacaccaattgatagaataataccaatcaaaagagataggcctagtttgtagtcacaattggtaagaacccatatgcacatatagcaaatacattgattagataaactcacttaatttggagcaaggtacaaaagcatgattcaaaaaatattttctctttaacacatacttctcccaaaactcactaaaaggagggcaaaaagtatgtcaggcatataatgctatagacaagtcatgtatgcccgaaagaaaagtctcataagccaagacccaataaatagtgacgatgaagagacatatcaagacttatgtagcatcacaacataggatgaactccttctaaatatgtgcatacaaaagagtgaaaagaaatctttatgcactttcacaaaagaaatgaaggaacaaaagaatccatcctatattatgaaattaaggttgcaaagaaaatccatagaagcaataatgaagtctaccttgggagtcgtccacttccgacataagactaaaagtataaactcaatttaaaccattagtcttccaaggtatagaataaactccccctcaaggtgtgcatataaggataaatttaatgcatacatatgcactttactcaaatgagaattggggaggagtttacactatattttgggtcaggaggcaaatatcaccaaaagaaataaatttaaggactagaattgtaaagcacactttcataaacctcacatttcaagatgatggtgcttaaccaatctcatccttcttcacccattccttcggttgtcataaatcaatctccccttgatctatcattacctcttttctctatttgaatcaatagaaaagagaaagcataaaaagcacacgagtttcacatataatgatccttttgatgtggaggaaaattggatcacttattcatgaaacctcataatatagactaaattctcccaaaagtaatgcacacatatggtggaaggcaaatttatgtgcattatttgacatttaaatcaagcaagggaatttaatctatattatgaaaggtagctagataaaatatacgatgaaaaggtaattgaattaccacttgtgaatagcatacttttgagaatgtttcacttcccatgagactaaacataaaatacacttaacaagaagttagtctcaaaaatacaaaacataggacatgctccccctaaatatgtgcatgcaagcatttgaattacttgatggaaatggttatgagtgaatttaaattgaagtccaaaaaccgcctcgcgcaacggacccagaaatttccggcggccatctctctcctttccttgcaattcgcaccgttggtagtgtgcctatttaaaggagttttgggaatccattttggagtccagttgttgcaaaaactttctagcctctgaacgctcttcgtcttctacgcttccacgcaaaccctaattcgctcgcctcggtttcttctcccgcgatctccaacggcgatggacctcgacaagtccacttccaccggtgcgtctttgaagaagttgcaggaggagggcgctcttcccggtcgcgggaccatggagagggaaccgggaggtactgaacctgaacccgtcctgggccgcatggttgcggttgaggattatattctctgtggttttcttcctccgccttctgagttttccttctcatcttgaacttctacggtctttttctgctccatctgaaccccaactccatagccttccttagcattttttatcatctttgtgaggcctacattggggtagagccgtttcttgacctcttccgtttttactacgagttgcgctggatggaatctaaaaaggtatccgggtgtgttggtttttgacttcgggatggcctgaagtcgcgatacatccctttccagtgcccctcttctcgtagcaaatggcgggcgaggttgtcgaaacaagatttcggcaatactaaaagggggtggctatcaagctagaaaagtggatgggtttagagacaaggaattttatacaggttcaggccttcttaatcaagaagtaataccctactcctatccggggattgatccaccgagtgtattattgatcgtatgatctgggtgaaaattgtgtccctaaaggcatccggacctctccttatataggggaagggatccgtattacaaagcacagcccatattcctaacggaataggcagttatagataaaatacaatcgtaaccgactaggatctcgggtattttcttgacatacaagtttagaatttaacccgagtccttttaaaaatattctatctatacatgacaccccatacccagtcggactatacatgccgtgtaggtatggggtatccataatctccacagaggtggttctatcttcagatagaagattcggatccagtcttcattgttcctgaggagcaaccagacaagattccgtcttggaccgccaaacccgccttgaccccatctctctagtatttggatctccgagtacgagtacgagtacgaggattgtcggggtatgaagtcgctgcggacttcattggtagacggatccagccgctccaggctcgagcccatccagcctttgactactctgggccagaggacgcgacccgggtttctcctcgaggtatttttcttgtattctgggtttctctcctttcatgcgcattcctcctgacttatcgaaatttggttcttgatctacaggtttgaacagcgcaattgtggagcaccgtgtttcccaggtgatgatcagtggtcccacgacagcgagcaacgcccccacccctctttgcgagaaagaggcggctgagcgcgaagccgcaatcaacgtgagtgtaatcaatgaccctttaccttttaactcttagatcgcatcatgacttcatgttgtgcaggcactctccctgactgacatcattgggccgctcgcggaccaccaggcggcggcttcgttgaaggagggcgttgcccaggaggcgtccgacgcggccattgccgctgctgctgccacgaccagcggcagcaaagttccgaggaaagggaggaagttttcctccgtgctcggcaaccgccggaagacgcccaccccatcggtaagcctttttggttatcgattacgtagtcggaaaatgtcaccctcatatcgtactcggtttacttaggccttggatgcgtctcccccgcctccacgacggcataggctggtgacactcggcgagaagtaagtggacgaaatttgaggcccttgacttgatcggattctggcgttttgttatgatgaccaacatgatcgtctttcgtagggcggcgcgggcgagggcggcgcaagatgggtctgggggaaactccagcgcatctcctgcagtggcctcgaccgatgtcgtggtcgcgcccaggagccgcgaagtgacgcccagcggccctgccagcgatcttgtgcccggtcgaggcccgcctgctgccgtcctcacatgggaggagctccaagtcgagatggggtgcatcctcgaggctggtgctcgcggcataagtcgcgagatcgtggaggcgagggcagcggcggcgtcgtcggcgaacgagcgcgccgacaaactggcgcgcgacttggcggaggtttgtgaggacctctagaaaatgagggaactggtagccggcaacgagcggcaacggtaggggcttgagcactttatgtcagagctcgagaacaacctgtcggagatccgtggctcgctgcaggttacctacactggtctgcaccagctcaccggggagtgcggtgtcatgatgtaagttcaagtgccttaatttggttttggtgattaatgacaaatctaactatatgagactaatcatttttatgagcctttctttgactagtctcatttggatatgaaagtaaaaatgatgagaggtatgtattaaacttcacatattctaacttggtctctcttgtggatccaaaatatagtatgagcttcctatttgatctttattgattatgtgcatatgcgttccttcatatccatatgtatgcacatcttgagggggagcttattctatattttgtttattataagatttctatcttgatttgaaatcatttttcatctcatctctctatattgtttatatcgggttattatccatcaccaaagagagaaaagattgaaagatcttggattaaacaatttgtgtaattgttactttggtgatagatgataaaccgatgtttatgggattaacctctcttttgcataagttgtctactaggttatttcctgataatgagatgtggaagatatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtatatgttttatgttggtctacatcattactacatatgccttctctatatgtataagataaacccccattggtcattctctaattatgcatacacttgtatctcttgtatatttatttgtatgcatatatttagggggagcaaatcctatacatttattgtgcatgttctagatccatgttgttcacctattatttatatcggatctttgcacttgagcttgcatacgagtatatgacacttgtgatgttaatgaatactcaacaaacatatccatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaagtacattgttatgttggcaagaatgaagtcaagcttgtgatgagaataaagtcttgacaaaggatggacaagacctcggcataaacatggttcaaccggatggtcacaagtgttgatctcggctcaagcttgaccctaagatggatggcgcaaggcaaaggtataatgtagctaagaatgttttcttagtcttttcccggtcttggtgtttggtgtagatcggatttgctagataggcgccgtactatcaagagggttctatgaagcgagcttgtggatgatcttgtgccatattagttcatatgcatgtaggtgcattttttgggcttgtctaaccaagtgtgattagttttctcaagtcctaaaccaagagagaagtggacatgtccaataggagtgagtgacatcttgtgggtatgtccggtggatatcctttggagtgtgagcccattatccttgacttaagttgtgtttcttggatggatttttcatgggttggatggccctttgaataagctttccatagagtccaagaacgccaaattccgagacccgagtcaagagatatcgtcgttttactaacggtcggttgagctgaaaagtgacctgcggtctgaccgtgggccttaggccggtctgaccgggtctgttagccggtctgaccggcgtggtaaggccggtctgaccggccccactagtctgttgcactggtctggtttttggtggcgatacagagccgccagagccgcaaccggtcagaccgagccgtggacggtctgaccggccactacactgcggtcagaccggccaggttgagtgggctcaatgattgccctgtaacggctagttttctagccgtagccgttacaaagtagtccggtctgaccagcctcacaacggcagtctgactggcagagcacaaagttggggatttcggttccaacggctagttttggtggttgggggtatatatacccactccccagcagcaagggtaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgcccggaagtacgaagatgtaccaagatctgaaggaaggatactggtggcccaacatgaagagagatgtggcggaatacgtagcactctgtgacgtgtgccaaaaggtgaaggctgagcatcagcgaccggcaggcttgctgcaaccccttaggattcccgagtggaaatgggatgagataagtatggattttattgttggattgcccaagaccgcaacaggatatgattccatttnnnnnnnnnnnnnnnnnnnnnnnnngacggcaagattcatccccgtcaagacaaactatagcagtgctaaactcgccgagttgtacatgaccaggatagtgtgtcttcatggtatacctaagaggattatatccgatcgaggcacacagtttacctcgcatttctgggaaaagtacatgaagccctaggaagttatcttgcttttagcacagcttatcatccacagacagatggccagacggagagaaccaaccaggtcctggaggacatgctgagagcttgtgcgttggattttagcaaagactgggagaggtgtttgccctacgccgagttctcctacaacaacagctttcaagcaagcctgaagatgtcccccaatgaagcattgtttggtcgacgatgccggacgccgctgatgtggtctaagacaggtgaacgggcggtatttggacctgacattatcaatgaggccgaagaaaaggttcgcttgatccgtgaccgtttaaaggtagcacaatcacgacaaaagagttatgccgacacccgaagaagaaacctagaatttaaggaaggagattacgtttatttaaaggtttctccgatgaggggaacaaaaaggtttaagattaagggaaaactagcaccaagatatgtgggaccctttcaaatcacggctagaagaggagaagtcgcatatcagttacagctaccagagaatatcgctgatgtgcacccagtcttccatgtgtcccaattaaagaaatgcttacgagtgccagaagaacaagctccgctggaagagattcacattagcaatgatctcacgtatccagaacacccgatccggatattgggtaaagcagaaaagaggactaggagcaaagtgtggcgtatgtacaaggtacaatggagtaatcacactgaggatgaagccacctgggaaagcgaagaattcttgaggacggagtacccgcatctattcgaaaactggtaagaaatctcgggacgagatttatttaaggggggtaggtttgtaacaccctgaaaattcgaccgacaaaaaaaaaatctaaactctaaaaatatgggccttcaaaaactttttaaataaattgcatcatgccaattttattcgacgattttattggattttgatttcagaattcatcgatcagaaataggggaaaattaattaggaattaaccctgaaattagatttggttaaagaaataaataaattataatttaaaataaagattatgtaaggataggaataaataaaatatcatcgcggccatatttgtattaattagatttaaatgcaatggaacaagaattaaccctaattaaaaattcaaataaattataccaataaaatatgagtaatattaatctagggtgaattcattagttgagataacagaaacattgagtaaacttcatttatgcaagatttagaaattatagaatcaaatttatatgggaaataaactaaaatcgggataaataggaaaaagacactgttcattgcactctaggtgttcgacgaggttccctagccccttccccttccctgccatgcgcacctcgcgccccgagccatcgccatcaccgcctgccgccgtgccgctgtcgcctgccgcgccccgcgccgctcggccgtcgccgtcgcgcctcgcgcctcgtaccgccgcgcgccatcgccgtcgctgccgcgtcgccgtcgccgttgttgtcgcgtcattgcgccccgcgccgcgccgcccgctgtcacgtcgccgctgccgcccgtcgcgtcgtcttgcgccccgtgccgccgctgccgtgctgtcgccgtcgccgtcgcgtcccgcctcacgccgcgagccaccgctgtcgccgtcgccgtcccatgaccacgcgccgagccccgcgcgccgccccgagccccgtcgcccctcccctctccttctccccctcttccctataaatactcccccctccatttcccccactccattttcctcttcctcccctctctccctccaccacgccgccgtcctcgtgccgtcgcgccaccgtccccgtgccgccgcgccgccgccctcgatgccgccgcgccgcaccgtgtgccgcgccgggtgtcgccgtcgccttgcgccaccgtcgtcgccaccgccgcgctgccgccgtcgtcgccgccgccgccgctggtgagccgtctttccccccccctcgcgtccaccaccgccgctgctcgggtggacaagagccgagagagagagaggaaaggagaggccggtagggaggaataagaaaagaaaagagaggaagagaaggaaaagaaagaaaggagccgggaggagagaaaagagagaaaaagagagaaaaagaaaagaaaagagagaaaagaggagagaaaaagaaaagaaaaaaaataaatagaaattagaggaagattagggaagtttagaaaatttaaaataattagaatttaattatggattaattatagtcgtagaattgcaaaatttaatataaattatggattattcttggcaatttctataagaaatcaattcgcggtaataatttagatgtagttaattactaaacaaatagatgaattcttatagattattatagattatttttgggtaatccctataagtaatcgattcacggtagaaattcggatttaattactagagattttagccgtgtgttacatttaatcattcagtcttagactaaattaaatcgtataatatttctagggtttcgtccgatatttagctcgcgatagaaattcctaacctattatatggatataatgctcgggtaaattaaattaaaaacttatgacaacaaaatatttatacccgcaaaatagtttaaatcgaaattgggtttgccgtagttcgcggatagtaaagttaataaaaaggaatcgactttcgcattcgactgtcatttggatttatttggattcttatttgaattctaaccgaattcaaatcaattttcgcacgtaactatagagcctgagggagttgcggatccaagcgaaggccaagacccgcaagactttgagcaaggcaagtcatcactattccttgaacatgttgatcccaattgcgaaattgttttgtttacaaataaaattgcatgcaatgatgaacatcctacttgtgattatgccatgccttgattattgattacccttagatctttgtaaccatgtttacgtatgagtccctagtcaactatgacaattgcttagaaatgctattctagaatcatgcatactcatatttatcaaatgctatatgtttgggcaattacctttgggaaggtaatggagatgcggcatgtggagacatgagcgccacattgccatgatgttgatgacatgatttgtgaaaggagaaataaaattacacaactgttttcgactggggcggacggaggatttgggtggtatctggaaaaggctagtaccgtccccggtcaattaaggaccgagccatgaagttaagcatgaaacgaccctcgtacaaccgcacttctcgtatgggtatagacctagcggagtagatagccgagcggaagcagtatccctgcatagatggttcacccctgagtgaggcaggtgcgctacggtgggacagccattgaggtagggccgagaggcgtgccctacatcggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgtggagtgcgggtaaagtgtacatccactgcagtgtgagtaaaccaaatctattcgaatagccgtgctcgcagttattgagcaccgggacatgtattgcacttggctagactctaaattcttaacctgtgtgggatgggatattgcatgatgatttttatgctgctggagccacttcctgagaggagggaaggtggacatcctcagaaaaccatgacgactcaatggcgggaagctatccttgaaatcacaatggatggtggacagaaccgtcgttgtttaatgtgaacactggtattaaaacttgatcagtctatgctaggtcttaggtttgtgaaaagaattacaaaactggcttagcgcaaaagagccatagccatcctttggaatacccctttcatatgcattgttgctgtggtggcttgctgagtacggttggtactcacccttgcaaatataaaattaatcagaagcgggagatgaagcttcggaggatccctatgcctactaccaggagggagatgaagacgatggcgctcagtaggtgttagtacggtcgttgcctgtggcaatggcatgccgctgcctgaattccgctgccttatctatttctgcttttggatgtattccggaccgctcggtccgatgatttaagacaatgcctgcgggcttctgatgtaataattagcactagactctcgtgtatgtacttttggtatttcagctatgaactcgtgtgtaccagactacttgatccagggaaatggtactgtttacacgaatgattcctgttataaaaacgggggtccacagagctggtatcagagccatacgactgtaggaaaagaccaaaaggcgctccaccccttttctaagttggccaagggagaaattcccatttagtaatactttcaaaaataaaaacgctatgtttacaaaactcggaacgattttcatcttactcttaactattttcttcacaaaacaagttttactcttagctgactttgggtttttcttaaagattagaaggcagatcaggattcacccgccacctgggagatgggcgtaccccgctcagagggatacgtcattgagctacaccggctgatgaggcgtctgcgataccccagatttccgatttaccgagtgagacagtgtggatctgtttaggaggctcgggtcgaggttcacacacgagtttcgtcagagttagactacagctttccgacacgccaccgtcgcgacttgccggagaccgcgatgcaggatgcagcccgggaggccttcctccgacttagctctatccaccgagctgagttggcgagtactgagtttgctcaccacccatttcgagaggagggcaactccgtctgcacagttcaggacacaccttgctgctacaacccgatagtgacccgactgtcacgatgggctgaggctgcggacgacttctacgaggaggccctattggagatcgacgatcagtagagacgtgtaggggagttagagactgaggtgaccgacctcacagcgcagcagcttcagttggaggaggagcaccaggcctggggcagtgagatagactcactgaaggcacagctccaggtccacggcgaccagttccagcagttatctgaccagtacaacgatcgccgcgggatgatggatactcttgaggagtagctaagagagagtcaggagcacgtcagccagctggaggagcagcttcgagcagccacgatcagcaccacaggggcttctacttccacagcagtagggcgtgaccgctacttcttcctcaccccgccgtacccaccaacgttccacgctcttctgggtgaggctagtatgctagctaccgagtcagcaccttacctagtggacccgacagtgacacagccacctgccccggagattgtgcgcactccactgatccctacaccttctccgcagttgggttccagtttggagactccgatccaggtcgactccgagacagaggggaccgacaccgagccagagatcgagccagacatcactgatcctttagaggatgagacccctgttccccgcatcaccttccttggaggtcctcgcaccctcagcactgctcgcaagagcacacgacctccgggcaagaggcccaagccagatccagaggccactacttctgagccgtggggactcaggtttgcgcgtgccagcgaccaccctctacctgccccaggatcctgcggatggctggaggactagattgacagactccttgcagcttcgatctcgtatcagatggtttttggatagcatgcgagacacacccccctcttacctagattgacgagtagattgatgattagtttgatgtatcttttgcatgaaccttatttggactgcgtatgtatgcagtcgattgcatcatgatttatgtaccatttgtgaaactctgtgatgttatttatgatatctattgttgttgtgttataaatgagtttattccaccatgcttgcaaaacaaagttcacaccaaaataacccccttaatgggatagaaccataagagctagttagaaaattaggatacttattccatcaacctacacagatggcaagccgacgtcgggcgtcaaccagcaatgaagaaactgagacacctgacctaaccaccctggccggagttatggtcacccaaacccaacttctgcaagccattgcaaataaccaaggcaaccgcggtggatcaagctttggagagtttgtgaggaccaagccacccacatttgccacagctgaagaacctatggatgctgaagattggttaaggatcattgagaagaagctaactcttgttcgagtacgtgaggccgataaagtgatctttgtggcaaaccaattggaaggaccagccggagactggtgggacacatacaaaggagcctgagaagaagatgctggagaaccaagctgggaggaatttaccacaggccggttaccattcagaaccgcgctcctgcaccgaatcaggccgccactggatcagtaaggccaggaagctgtttcaactgtggagagtacgggcatttcgccaacaaatgcccccatccaaacaagacacctatttgcaccggagctaatgcaacgactattcacggaactactacccctgctgctggacgaggtctattcaggactccatagactaacaggaccgctaccggatttggacgcggacaagtgaaccacgttcgagctgaagaggcccaggaggaccaaggcgtactgatgggtatgttttcactcaacttcactccagttaaagttctcttcgattcaggagcatcgcattcatttatatctctgaaagcaagtcaacaacacaatttaaccagagttaaactaaggcaaccaatgttagtacattcacctgggggtgaaatagccgtggacacagcttgcattgacgtacctattcgccttagggatgtggtgtttccctccaaccttatggttttgataccacaaactcttgatgtcattttgagaatggattggttagcaaagcatagaggagtaattgactgtagacgtagagaagttaccctgaccacaccctggggatcggatatgagagcaaccatggatcaagatcctaggctaaccgaacgtgcctaggatcgtacgctggaaggtatttcctgcggttatcagtccaaacggcattttaacgtagcagaatacaccgagcggcatgataaatgctgtcttctcctcatcctcttttaccatgctgatttggtggtagctagagtaagcgtcaaggaagcttaatagctcacaaccagctgttgagtccactagttggtctattcgagggaggaagtgatccttggggcacgccttgttgaggtcggtgaagtcgacgcacatcctccacttcccgttggccttccgcaccatgactaggttggctagccactctggatggagtatctctctgatgaaaccagcattgagaagcttgtcgagctcttctcgtatggcctgtttccgatctggtgcaaatctccgcagtttttgttttactggcttggcgttgggtcgcaccatgattttgtgctcaatcacctccctggggacccccggcatgtcggacggttgccaagaaaatacgtccgcattgtcgcggaggaaggtgatgagcgcgagttcctatttctcgttcagtgatgccccgatcttgactgtcttgtcggggttggcactggagagtggaacaattttgattgcgccatctggtttcggcgtcttagttgttttgctcactttcttgggtggctcggctgtggccggtgggctgggcgtgtgctcgaccatgtcgaggttccgcttgtcgcattggaccgccagctttgtgttcccttgaatagtgattgttcccttcggcccgggcatcttgagtacctgatacgcgtagtgagatgcggccatgaacttcgcgagtgcggttcttccgatgatggcattgtatgctgtgtcaaactcagcaacatcaaatgttatctgctctgttcggaagttgctcgcttggctgaaagtcacaggaagcgtgatcttgcccaatggtttggacgaagactggggagtgattccatgaaaaggttgatcggttggtgtcaactcgcttcgaggaatccccattgcgtccaaggtgctggcgaagagaaagttgatggaactgccgccatcgatgaggactcgcgctaccttgatattccgaatagtgggttcgaccacgatcggatatcgtcctgggataacagcagccttggggtggtcctcatctgagaactcgatcttctgttcagaccacttcatcttgggtgtaaccccttgccatgtcgaacaaacctcgcgctccacttttttgtattctcgctttgaagagtacgctgtggaacctccgaagatgtgcgagacatgaagatcgaaatctgggtacgccgagtccgagtcctgagtggttgcctctgcggccttctcgactacacgtgctcgtttgcccttctccaaagctagttgcttttctagcgactttttgaagatgaggcactcctccggagaatgtctgtctgacttgtgtatggggcatcatattctcttcgtatcactgccttgtgggtctgggtgtttgggagggtgctcgtattcagacgcgaggacttccgcttgagctttccttttcctactcttgccgcttttcttcttgcttggctcaggtgcgtccttggctggcttcttctctccccccgcctttggcttgtcgttcttgcgtctcagtgcgtcgtccacatgagcgcatcaatcgacgacctcgaacaaccttcgagtagttgtgattcgccttgttgccaactcctgggtagtgtagcgatctctgacaccggttttgaaagcgcgaatcacaaaggcgtcggtaatatcagggatcgtatttctgcactcattaaagagccgaacgtagtccctcaaagatttccccggattctgtgttaacgcgtgtaaatcgtcttcgatcgcatggcgcttgtaagttccttggaagttagcgacgaattgctgccacaaatttgcccatgaagaaatcgagtagggcgggaggtgcatcagccacgaacgcgcaaaacctttcaacgccattggcaaatagtttgctaacgcgttgtcgtctgctccagcagcgtatagtaccgtggagtagacctggaggaattcttttgggtcagtactcccatcgtacttctctattgcctcgggtcagaatttctcgggccaccggacatcacatagagaacggttgaaagctctacacccggcgctaggggcggtgggttgtcggcgatcgtgtgtcctccgtggatgtctatcggatgacgaggatgaagatgatgacgatgatgacgatggttcactcggctccggtgtgcgattccgagggcgacgttcaggttctcgagaattctatcgtcgtccaccattgttgtcctggcaccgatccccattataatcaccgtcatgttgacgtcctcgaccagcatcgtccggtgtccactgttcgcgatcgtcgcggtcgtggtggatgtgacgattatggtggtgttggtcttcgttcgagcggcctcctcgctcttcgttcttatgacgacgtgaagagacacaatgttgggaacgattctcgttatctcgcgcgcgttgtgcttctcggcggccattcagatggtcgcggagatcgccggtgccgcgaggtggaggggtagctcgtctaggcgacgtccgttgctccggtggttcgccgtcggcaccgccaaccgtcagatgttctggttgtgctctggtagcgacctcctcgaacgcgttactgagattggctactgattcccgtagtcgttctgtccatcatgggagatcatcgttaagtacggggtcatagggagcttctctcagtattgcgttgacggtgccgaggtgttgggccggcgtgaccgcttggttctccgcatctgcgttagcgtgcgcagacgtgctagtcccaccgatggtaaacacgtcgcgtcgtttactggaagatgacgagccatagtcttcgagcaagtgtaggactgatggctcgtggggatcgatgtcgattactccaacgaatcgatccgaggtcaacgtcgctccttgttccttgtctgcatccttaagagagattcctgactgctggaccttaggaagcgatgttttcatggcgcggagaaagaccttgcagcttgagaagtcatgattcttcgtcttgtgaataggacaatagacatcacgagttggagaagtacgctggattccacgctccttgcaagcatgaatttcagcttgtacgttgagaaaaacccagcaagcttgcaagttgtgcttcctggatttgtggataggacaccagggctttgttacctcgggagttgtccttgtcggctcacagttcttgtcggaaggacaaggtttggccgcactaggaaccttctcgggctcgtatgacgtcgatgttctgttctccgctacggcgggaggatccttcgacacgggatcgtccggggttatagccacggcgttctcgtttccggtcattgatggaccagccgagattggtaccgtggtgtaaaccgggaagacaattttgccgacttgagtccacaccagcattgttgaagtagggactccttggatggggccggtgttgacgccgttgtcgacgaagcttgatgtcatagtagtacaaccttgagcaccaagttcccctacctggcgcgccactgtcgacggcgggtacccgtagaccggatatagagggtattggggtacgctggtacgagcatctacgtagtacgacatcaaggaaacaagagacaacgattatactggttcaggccccttaataggtaatagccctaatccagttgatatgggattatatggagagaaccacaaattataaagggaataatggaactcgatgataccgacgagatcgtagtcgagttgattcgactagatcacccgacgacttggctcctgtaggctccggcttcgtaggctgtggtcgttgtgttggctatgagattcgatgccttaggtcttcccgggggtccctattatatcgcaggtcatgtggtctccaagtaggactcggagacatcgtaccctgcacgatatagtgacgacccagtcctatacgggtaggaacctttccattggtggacttcgtgatggatttccttagtgtatacagagaacgtccgtacacgcgcagatgtaccatattgtcgtatagcgtacatccaagggtagagggtataccttatccgtaactctgacaaatatatgtaaattacttttagactctattaaatttacttttatatgtctaagaagtaatttagtcaactctaaaagtaacttttatatatatatgtatatatatatatatatatatatatatatatatatatatatatatatgagataagagtaacttacatatataataaaagtaatttataaatataaatattttttcatcgtaatataatcacgtaagattttgttgtgaagatttaattgtaacgaacacaatggtgtaatcggattgtagatcggataagtaatttgagagaaaactttatttgaagaggaaagggacgtacatgtatattaaaaaaaatgcatgcatgtagtaccatgtagtagctggacttctccacgtttctccgtatttagacgtcactagttaaggcaaaatcaagaggcctctccaaatagattttacgaaagagaaagtgtaacaccctaaatattcagttaaagatcagtaaaatttccaacttttgcatcattctaggatcttgttgcttgagttatgtggaacttcaccttaaaacggaactataaataattaaataccaaaacctaccgaggaatgtaaatgaactaatttacaaatatcaaataaagcacagagaaatcaaacaccaatttttttctatataatccaattatgatgtaataaaagtccgggaatcaaataccaatttaattcgctaatcacaaggtcatacgttatacacaaacacaagcaatatattgacgaattataaaaggggagataattcaaatacaacaaatatagttcaattataatttaagaattcgatttcactctagtccaagcaaagggctaaggaagatcaataaaaaaaatcaaattatttatacaactataatcagactacacattaacaaatccatattaaaccctaaatataagtctgattcccatacttgggcttaaaccatcacacgttaaaaggaactccaaatgggcctcaaggctcagctacttgagctcggcttgttgcaaactcgttttctgctgggctctcgactggaaatcgagccgaatgaaatccctcttcttcctacttgtaacgcttgcgagcttcaccgagccgagctcgaccaagctgggctaagttcgtgttgcggcttggcacatcccagccgtccgatcgagccacccctcccttacaaaaccccacccaggccactaggtttcgcctcttctacctcttctcccacctgcgccgccgccactcactcccaaaccctaaccccggaggagagggaggagcagccatggccgtgggcaagaacaagaggatctccaagggcaggaagggcagcaagaagaagacgtaagctgcttgcgcgcgggcggtgtgggcgccacacctctcgtcctctctgagctgcttgttcttgcttggggtttttgggggattctgatttgggacttcttctctttttctctctccgtgtgggtgcagcgtcgatcccttttccaagaaggattggtacgacatcaaggcgccgaccgtgttctccgtccgcaacatcggcaagaccctcgtctccaggacccaggggaccaaggttcgttcgttcgttccccattcgcgcccgtcaacctcaatccgcgatctgatccatgctttcattttgtatcactgtctgtgagtacatgtgcggaatctatctgtttggatctgcgtggctgcgtcattctatatctgagtaggctaagggattaatgttggcgttgatgtagttattgtgattgtgatgtcttgatgcatttttatgttttggctagaagtttgtttcgttaatgcaaatgtgggagttctggcaagatttcttctgtgctgtacttgttctactctcctagatttttatggctgatacatggaatgtttcatttcatttgatgaacactaatcatatatataagttcttgaggtgattgattcttgctgagatgtacttggagtaacctttttgctgcctttaatgtttgctgcctttaatgcgtcatacatcaaatgcttgatttcagtaacactatcatgtgttctcactaattagatattttagtctgatgtttaaatacccaagatatttctttgtgtaatcttcctaaggttatctgaattttttacagcactatgtctgttgctgattattattcatgaaattattttctagattgcatctgagggtctcaagcatcgtgtctttgaagtctccttggcggatcttcagaatgacgaggatcaggcttacaggaaggttagacttcgtgctgaggatgttcaggggaggaatgtcctcacgaatttctgggtaagaatgagcattgattgttcattaatccttttgtgttgtatctgtgatcccttttgtcctatgtagtctaaaccaatacatattttctctagggcatgagttttaccacggacaaacttaggtccttggtcaagaaatggcaaacattgattgaagcccatgtggatgttaagaccacagataactacatgctccgcctgttttgcattggtttcaccaagcgccgcccaaatcaggtgaagcgtacctgttacgctcaggctagccagatccggcaggtaaaagttttgtcatacttttttgcatgttctgtactaggtaagttcttgttttttgagatgaggtatgttcttgttgtttactttatttttgtccactgtttgaagatccgccggaagatggttgagatcatggccaaccaggcatcaacatgtgacttgaaagaactggtttcaaaattcatccctgaagtcattggaaaggagatcgagaagtcaacttcaagtatattccctctccaaaatgtgttcatccgcaaggtgaagatcttgaaggcaccgaagtttgatcttgggaagttgatggaggtgaggaaccttattctcatgcctagctagatgcctttagtgctcctggttattcttctgagaaatgtattagcatggttattggctttggaatcttattagaaaatctatctagtatatttgctatgtgttggaatcaactatgtttactaactcccctgctataacctggctgccctaaaatacttagttcaggattttgctttgacttgaatactaacttttagtgtaagatgttgcaataccgagttttaacaatatattttagggtttatgacattatgcatttagataatttttcctgataaaaaattcctaggcaattttgtgctcttaggcagccaatattagctcaaatcttatattagggcttgccttctgtaaatagtgctgtactgtagtgttgatttggaagcaagacttactcaagtattaggggggctaaatgacctggccggagttcttttttttactgtcacagaatgtagcaagtaaatttaaacatgatatggcgtccaagtacaaaacatgtttgttaacagcctcaaataacgttgaaggcagccaacacaaattggcctcagtatgctgcctcttgatgtcctcagtagtgccagatgttttttttccactcctagttcctgtgtgtacgtaactttactagccaaacacctgtgcttttctgtggattaaatctaattaatagtgaggtttttgggacaatttcattcctgtagatgttgttacagatgaaatatgataaaatcatggatagtttggatagttggtacaaaacatgatggagtaggtgggaaataaaaataatactgtacttggtggcaccattgcccttgtttaaaaggagtatagattctgagaaaatgtggtctttattggttttacaggtacacggtgactacaaggaagatgtcggtatgaagctggacaggcctgctgagactgacgaggcggtggcaggggaggttgcagcagctgagtagagatggtgttgctagttgctttaccttttaggagatttgggctgttactaaattatggatgatcaaaacttaatgtcagttccgatacccttttttgtctgccgagttggtttctctgattaaaaccatggaaaattgtgagactgatttcatggccagctcattttgaatgcagttgaatgattagtactatatgatagtataatactactggttagatcattgctatgcatttgatcatgatctgctcagcttgcgcattggcaatggtatacacctggtgaattacattctggaatgcggtggtttggaccatttttttgggcccgttggaaagctgggattcggatgggctgaaattaagatggtgcaataatctcggtaccgcgagatggactggcctgttgagttactgttcaagccaaccgtgagggtgacggcgtggatagctttcggtcgctcgttcgtgcattgctttctccacctgttcttgcggagtccctcatctttctcctccgaacactaaagcaaccgttggtcacggaggcgaatcgagatctgcatcggctcctgcttgtcctgagcggcgtgcaagcggtagaccatgcgctcgacgtcgatggctcattgggcaggagggttgccaggcacatacactccatcaaaaaaaaaaaaaaaactcaacctataacagaatgtgacccctcctagaataatgaacaatccccttctaggttaaatttttttagacggagggagtaggggagaagcacttagatcgaatattagcgcattggaggtggagaaaaaacgagaggcacagtcgcagcaagcatcggcgcggcgtcgattccaccgacagtgcatcagcctctccagcgcgcgtctgctgctctggtgagttctcgtgccgaatagggccggagattcacgtcccatccggcatccaaggaggcgccattgccaaaattggtggagagggggacttgaactcatagctatattaagccatcttgtggatccggccatggcatccaaaggcgtgaaacggaagcttcatctctagcactccaccaccgagcccttgatatcctctccacagttgccatttacttcggcaaaacggcgagaggtggctttagatctgaaatcctctcagggttcatccaagtctctgcaatccgacgccagctacactgccacagctgaagacgacatccaggccgtagcgcgagcactcatcatcatcgctgcaaagttccatgaagctatcttgcagctggtccgccgcctcactccggccagagttgcatcttcactcgattgggacttgctcgactcgtagcaccaagggcagtagtaatgcaaactacccatttgaagaacctaaaactgccacatagactaaagatactgtgtccaaattttggttccccacagtgcaaatggcctcatgggtgacttcgatttttcgttttagctcctaccacttttgattttagccctcatatttttctcaatttagaaagaagtacaaattttacaatgaacaccttacagtggaggaaataatacaaatctcaaccccacccaggcacccaccaccactgcacaatcctctccattttctccacccaccaaccttggcgagtttaccagcgatgccgctgcctccgtcctctcctcacctcggcgacgaactctgccgctggcggcctctccccactccccccacctcggcgacaaactccgccaccgcgggcctctctcctatccctatcggggcctctccactcccggacgccgctcaagcccactcgcacggggacgcggcggtggttgaggaagccgaggcggtggtggacccaccggcgaatcgacgacgacgaggtcggtggagccaagcagagggatgacgtataggggaataatcgggaaaattgagagtagtagcacgcgacatgggagaggggaccactcacagtttctttttgggcctgaggaaaccggatccttggtaggagatgcaaacctttgcaaagatacgggtcccaccaggccaccacctttttttttatccacgtcagagtttggcctagatggaaaacgataactcgccacgtaggtgcactgtaaaggccctaagaaaggtaaagcacaagttctagcttttattttcaacctacttgcttgcttgacttgggttgttagatggctggcggtcacacccattggacgtaggcggagctgaaagcattcctggatagctgcatggaagaaattgagggctgcatcatcacctccagctgccccaaagctcaaggatacatgaatctgcagaacaagatgtacgagaagggtcatgaacaagcagtagctgaagaacttatgggaccactgtcgccaccgtttccaaacatggacctagctggaatgaatggccaccgatctggggcaagatccctacactggctccatccaagtaaactctgaatggtgggagcagatggaagggttatgtatagtttaactttgcaatttttccattttgcgcatgccatgcaatttttcctaaagttcatgacactagagattacatgtagcaaatttgaaaacatagatgcttcacacaccaccatcagtggatcaatagagccatatagagtaggagctttaacaaacataggcctccagatgaatgacattacagaccagatgtagcatagttcaaaacataggcctctacatgcatgattcatacataggtctatagatgtatgatttactgtcatacatatatttggaatgttaatcctaaagtatttcgaatgacagattacttgttccatgcctagcgatatgtcaaactatatttatgattaattatgccatgttatcagcaatatgttcatatgttcattgtcatgcgtgtagtcttactgaatttaaaacaacctagtatgatatgttcatgccatgtgtacaccatatttgataattaaatttcaatatctttagaatacttctatatataccaagataattatgagctcaaagtatagattacaaaatttgacatttgtatctgaaaattacattgaaacttgtagcagaatttcatgcatatataggtttatagatatactctagatgccagtgtatcaaaactttatacataggtgtatagatgtatgattaactatcatacatatatttggaatgttgatcccaaagtacatgacattacagaccacttgttctatgcctagatatgtcaaactacatttatgattaattatgccatgttattaacaatatattatgttcatgccatgtgtacaccatatttgtcacaagtgtagtccttaatttaaaacagcctaatatgatctgttcatgccatgtgtacaccacatttgataattaaatatgtgtgttcttttaaatgcttgtgtatataccaagataattttgagctgaatgtatacatcacaaacctagacatttgtttctgaaaaacacaatgaaacttgtaagtgtgtagttcactcaaaaaaacacagaaaaatatgaacttttcatgccatgtgtagttcacaactgatattacatctgcagattgtgtgcaatgtttttgtacatagaatgataagtatgagctcaatgtatggattacaaaaaatgatatttttttctgcaaattaaattgaatgttgaatgttttctgatctgtctagggtactgaattaaagtttacatgttctgatctctctactatgatcttttcatgccatgtgtagatgacaagagcacatttaatttgaacatgtctgcaatgtttctgtatttatcatgataacaatgagcagcatgcataggttgcaaaataatccaaggcgatcagccatgacatgttgtaattaaaatctgacctgttagtgccatgtgttgaggattactgataattgaacttgcacatgtttgaattattctgtattaagcaagagatttaggagctgaagttattgtttgcaaagttggcatgtgttacatatctaaaacaatatttccagcaacaacgtgatcaaaccacataactgaattgtgtgttgtatttgcagcaaaactttaatttatcttagatgtaatgacaacaataaataaaacttatcttttaagtaccaacttgctgcatctacaatttatgaacgcatatttgtgcacttattttaactactcagttgtattgtggtagaaggtgatatgcttccgttttttttttcttaacttcaacacatggttgctgccatgtgtacactaactgcactacatgtattttcacttgctactgttatatactttgttataacaaatgtgtgcctatgtgtatttgattccagattctactgttttgaacatgcttacatgtttacatgtgctgccatttctatatcctgccatctgtacatgcatacaagtggttattttctgattaaaccaactatgtgctgtaatttgtgtagcttagaagaggagcgcgtgtattcagaaatgcaccgctcagattcaacgctgagcatcatgttgtttacagaggaagaactgtgctgctaaaccgctccggtgtgcctaggtccaagccggcacagtcacaggtgtcctaggaggctaagatcctcgatgttgaggacctcatgcagatggcactacttatgcatctccagagccttcttcaatgaggaggcgcggtaaaggaaaaaaggatcgtaacccctgtcagtgtctctagtggcagcggcaagcatatttgcggtgactccactggagatgctctgaataggttggctgacctaagggtgcagtccaatgagagcaaagaaagaagggaggaacagaggcaagccaaaagtgctagagcttgcatggagctactgaaggctgatggcatcaccaagaaggttcctctgtaccacatggcactgaagctgtttcgtgatgggtatttgcatgagttcttcattgatgattgcatcacaccaaaggaaggtgtgtacttcatccactcgcactaccaggtagaaactatgtttgctccaccaccaacatgctcaggtggtgctaatggatttggaggctggtttgatggtggaggtggatttgggcctagaggttatgatggtacggttggagcagatggtgcagcaatgttaaaatgttttaacattttttaaggcagtgattatcgtactggtgcca

SEQ ID NO: 59085 - DNA, 17824 bp, Oryza sativa
ctaatcggtataaccttcacggaacaattgagatatagcctagggaagcacttggaatattcctatacaacatggcaggtggctattctaatcggtcgacaaataataggatggtccattcacgatctactgtgtcaaagtatttccatagagtgcttaatgttgtctatgcaattacaattgacataaataagcatgtagatcctaactttgctagagtggataaccgtgtcatgcaagatgaggccttccagccatttgctagtgcggcaggttcagtggatgggacacattcctgttattgtggcatttgatgattccattcaacacggaatcgtcaccatgtcaaatctaggaatgttcttgttgttattggatgggacaatcgtgtcatatttatagatgcgggataaccaggatctatgcacgactaaagggtgctcatagaagtagtacgaggctatccctacatatttccaaggtttccatggggttcgcaacacttttatttttttaatgaaacaagttaatgccatataggggtattaactgaatattttatttgtgcaagcaaatatctccttgtgggctcgggttatgccagttggtatggattcctacctccatacccgcatgttcgataccacttggatgattttgagggttcagaagcaacactaccgcatggaaaggaagagacttttaactacattcactcctttttgtgtaacacaatggaaagagctttggagttatcaagagttagtggagaattcttagagaaataccttactttcctgggcagaacgatcagacaaatatcacacactgtacgtttgctctccacaacttcaagcttgacagttcagacccgcatttcatgacacaaaacctgttatacaatgggtaccccaacatcccagaggctccacccctatgtgtttggtatgacgcacctaacagcgaggaagtgatgaatacaatccgtaaagccattgcagatgaagtgtataatggataggtggcaatgagtctgcaccttcaaaaataagtaacatatccatgagtgtcatggatatgtatcctatatgtatttgtgtgttgctacaagactctattctcgtctatgtataattatttgtgtgcacgtactaatgattaatcattttgtcttccctttaatcatctcaaatcaatttgtcttccctatgtgtttaactagaagatactccgcacgttgctgtggaaattagttgcattagaagaatgtttgcctaggcaacaaagcttgtagtaagttgattctatggaggaaaactctcatacaaagtaatacttgcgttagggcaaccatatcacatacaaagagccatgctgggtcatggtacatatgattgagcatagaaccataagcattaaactttatagttgagaagaaaaaaaaagctacatcatatcaaacatggataaatacgacaacagaaaagagtgaatccctggaaggaaacatataacttgtaagactaaggctagaaagaacatggtgaaatgtttaggcgtaggcgtctatctcaagaggacttgtatttacatgcctagcaatatgagatagagagaatccattatatgtcactgactttgtcatacgtctacgattaatttgccactgactttatcacgttctacaatatgctatcaacttttgcttaacttctacgatttaccatcgttgtccggttagtctccgttagtactgcacaaatttatcaaaatgaccaaaatacccctaggataaaaaccttcaaaatctggataagaattctgaaatgttagattttaagttttttttaccaaattttggatgttttgcaatcttgtgttcataatatgatattttgataattttatctaaattttagaagtttttgtcgtaggggtattttggtcatttggacaaaattgtacagtgctaacggaggctaactagacggtgatggtaaatcgtagaagttaaacaaaagttgatgacatattgtagaacgtgacaaagtcagtggtaaattgtagacatgtgacaaagtcagtggcatataatggattctctcgatgagataaaccatcttaaaaaaatctgataaaaaaagcacatgatcgaacaaagttcggaagatgtacatgtttctaccttcatagattagcatataagatatctccatgcctccatgctaggaatcttgcgctgcatgcatcacttgctccattgcaggtactagctctttagttccatgcatggctatactattttaccaagtgaagccatgaacacgattagacgaaaataacattagcactgccgtttaaggactgaggccaagaaatattttacccccaattttttttccaatttaggcagcccataaccgatgtcacgtgctccctctctttgttgctattatgctctaccgcactctgttcttggtatgctataaccgatcatcaggagggaggggatgtgaggagtagtagatcagcacaaggtcagctacgatactagttctcaagctcgagttcaagcacatgatggtagcgctgaagttgctggtgctcgagctcgaggaaggggcagcacggcagtgcttcagccttcagctcgggacgggagtagcagtgtttccataattcacttgcataaaaatatccaccaactcttgtgaaaatgattagtaataatcactaacaccaagtttgatgttttctttcatttgcttttatgtagggattgatggttagatttggtacctaattaccgtcaatagctttgcaaatacgtatgacgaaataagatctgcaacattagaaattaaagtttgtatcggtgtgttatttatgatattctatcttactataaagtcaatacctactaacttttaaaactcaacatgcaagtatgccacatcatcatccaccagcaattattttaaatattattttaaaatggagccaacattttggtttgaaccaagagaataaaacatttgttatgcaaagcataagaggcgacctagagcttttctctgcctcagtgacgagcgacttgcccaccatgtaaagctctctgcaacccataacttggtcatatcactacaacataaacgaaaacgaagatagtattataggtgtcagaaagtctataactaacacctatttttggctcgagcacatgcccatgggccgtttagaagatctaatacctatgtgacgatataggtaccgtttattaataaaatttggcacctataatattatcactttatctgtactagtttgttttaaataaacaagcatcctagaccgttaagctgagccaatagaccgagtctctccgtccttatcctctccctatcttctcctccccttgtgcgcgtgctctctctcccgactcgaccctaaactcatgagtggaggcggcagcatgcgcgtcccacgtgcgcatgctcccgtgactcctgacgctccccccccccaccccacgcgcacttaccctccgtgcaggccactggcaccgtggcgcggtgttcgccggaggcggtgaggggtagggaggaggtagagaaggggaaggggatggggaaggggaagcggatattgccactggtacgggtctgctgcgggggccatcaataagatccgggtaccttgccatgtacagcatgtacaacatgtagggcacccccttcccctacgttggggtgacgtgagggcgctgtctcgagctcaatgaccgctagatctgggtaccttgccatgctccccttccctttccatgtcacgtcacctatccgtttgatgacgagaggttctgtttttggttgaatttgtgatttagcatgtgcaacagtttatttttctttttaaaaaaatgtgattaagcttgtacagaaagtttagcatgtacagaagtttgttttttttttcgatttgtaatctggggcaacggggagtgactcaaagcatcggattcgaccgaatcgagcctcttctcttttttttttttgcgtcgtgtgtgcctcaatttttttttttttttttgcatcgtgtgcacctcaaaggttatagttgcaccaatgacctaggatcatcagtgccttctccgtgctgccggctggaaaatccggtccctagctaatgtggaatttccaattgacacccgtcaaactttctgtcgtagaatatgctggcgaggcactctgaagcggaattagaagcttgaattctagaagcatgctaaaaaattcaaaagaacatctatagtttcataatttcacaataactaacagaattattgcaacacgatatttttacataaattcaagattccatagtcttgggattctgtagttttaacaattttagtttagaatttgttccatggatacaatggcggagccacatgggcagctgcccgggcttcaacgcacacagcagtagattaggacttgatttatgtgattatttaccatccagccacatacaacagtaggaagtacttaattaccgtacttaagcaaaccagcaaagcaaatgcttaaaaaatcacaatcacgttcatagtaaatgttttttgaagtagtatgaaattgtgtacatttgttatctatttttagctttgcggagtttcaagaaaattcttcgatccaccactgcgtggatacttgcaataaaaccataaccaacgtttagagcaatctaaaacttataaacttatagtgagaaaaaaaaatacaacaaatttaaagtagaataatattattcttaaagaagacacatagatatacatctcacatatttaagatatataataaaaagtttgagaaacatatgcctgcttatgtggacgggcttttcttctcttcctagtttatcaaactagggcgatgtcaaatattattcagatgcctggcttctttacacagctgttggatatagatatatagataagtaattttacagtctttataaaaatatcacgaggtatcattttttctattataattttgttataattttggtagatagacagctcgcactgggccacttatcttatggcttcgttcggtggacggagcgagctatttatttgctcctggttcatcgcctcatcggagcctggactgcgggcgcactacgcgacggaggcggtactgcagccacctgcggccggccgtcccaacctgcatatgccaatcgccaaagaaaacgccgttagatcttggggtttgcatcgccttggcagtgtcgtctaaagcggcacatgcatatatagcagggagtatactactcccttttaaatatttgacaccgttaactttttagtatgtgtttgatcatttagcttattcaaaaaatttaagtaattatttattcttttcatatcatttgattcattgttaaatatactttcatgtacacatatagttttacatatttcacaaacttttttaaataagacgaacggttaaacatgtgctaaaaagttaacggtgtcaaatattttgaaacggagggagtaagttccattcagcacgttgtatccacgggcggcgagctccctgtgctcctgagccagcgcgcaccagtggcagaagagatgggtgaggcagtccggcaggggcgattccggcaagccatactgcgccctgagctttccgcggtaccaccccgcgtacgcccaccacacgccgaaataagcggcaatgaggtagatgaagcagatacagcaccactctaattggtgaggagaccaaaaggaaattgacaagagagaaaacatgcatatcggtaagcaaatgtaaaaaatcttcacatacatatctgtaaccggatataataataagcgtgaaaatgcaaaattttgaaactgaataccgataattaattaaccacctgatcagcggatattaattcgatctaaattcagtttgatggtttctttaattttatatctgaatccaaacgctcttctgttttatcggtaaccggtccaaagcaaagcactttggatggggctatgggagaggagatgacccctacctgtgaagccttgatcgacgatttcaccgatgcaggaaatcgacaaccaagggaaccaagcactcaaacaaactgccaacaggtcgagaaattaagccatgaaacggaaaaaacattgcattgtaccaccaaaccagaaaaatccagtcagtcgtagctttgcatacatgattcgcagccgtctccgaagcagtcgcagaggctagtctgccaaccctgatgggcaggtaccattctaggcttgatgaccacgtccacattctcgacgtcgacctgcgtgttcatggcgttgctgtggatcttacctgcatcgttggaaattggaaactagcggtaaatcaattttgcatctggaattaccgagtgcgtgtaatggacgtacaatcgcgcgccttgaccacttacctgggatgaaaaaggtccgaaaacatcccaattgttttcttggaaacgaaaacggtaaattcgaaaataaaaacagtataataatatcggaaaccaaaaacagaacaatatgaacgaaaatgcattggtatcgacaaaaatcaataacaaatatctaaaatcacacattttatttcgcataaccatataatataagaaaattaattcaaggatacactatgcaaattacaaattgtctcccttttaactttgcactcatatatttggttgaggagttgatgggcttctaaattatgggtcaaataaagaaatagataataaatattggtgtatttagaaatacggtaatctatctatctatctattatattattaaaatagctttgaaaggaggcaccacgttcgctgtgggggttagaaattcccacattaatcggagaaaaaaaaaagaaaaggagagtccaggtagaaatacaatctaaaaataactgaatttcggaattaaaaataagcaatattgaaagaagtttccatataaaaactcaatacgagattaatcaaaattataaataaaagtaaaataaaatcacaaattagaaaaggaaaggagagtctaagtagaaatacaatttaaaaatagctgaaattcggaattaaaaataagcaatattggaagaagtttccatataagaacccaatacgagattaatcaaaatttgaaataaaaataaaataaaatccaaattagaaaaggaaacgagagtccaagtaggaatacaatttaaaaatagctgaaattcggaattaaaaataaggaatattaaaagaagagtccatctaataacccaatacgagattaattaaaattcggaataaaaataaaaataaatatgaaattagcaaaagaaaataaagaagagttcaagtagttagctgaaattcgtaattaaaaagaagcaatattgaaagaaaaatccatataagaacccaatacaagattaattaaaatttcgaataaaaatataataatatccaaaattagaaaatttaaaacagagttcaagtaggaatacaattttgaaacaaataaaattcaaaataaaaaataaaaacattaaaagaacacaatacaatattaactaattttttagaaaaaataaattctgaaattagaaaaaaaagatttatattaggaataaaatttataaataactaaaatttgtgataaaaataaagactattgaaagaaaagaccatctaaaacacatgacgaaataaattaagtaacatggctataaagtagtagagttggtggtggttaatacggcatataaaaattattaataaaacaccaaatagaatcctaatgacgattaaaaggagggacatcaggtatgccgtgaagtaaacaagtaaagcggttgccgggacttctagaaagtataaagaaagaaaaccacattgataatcattttcgatttttaaaatctcaatgacaataaaaaggagaagcaacgagcggggtgtataagagtatagttgcagagcctccgacggttgacgggacttctagaaaataaaaaatgaattgtaatgatagttatgttcgatttttagaatcacaatgacaataaagagtaggcggcggacgggctgcagaggggcatagtggcatcgtttgatgagacttctaaaaattataaaaaataaaactacaagtccaatttttaaagatttagaaattctaaaaagtaaaaaaaaccaatgataatcatgttctattttaaatctcaatgacaataaagaaggcaataaagaagggaggcagcgagcgagccgtagaggagtacaatggcaaaaccgctgatggtttggcgggacttttggaaagtaaaaataaacccaaactataattatgttacccggaaatttaagctattttaaaaattaaaaattaagtggcatatatcactaattaattagttaactagcaaaattgttggaaataagaataagccactcaaaatttatgaaattcacattcgtcgaagttaaacaaacaaacaatgtccaatatacaaccacaatataatagtgataattggaaatatagtacaaacaaacgccactgtaaacagtcagcatatacatacacttacactaataatacaatacatcatatatttgaatatacggttgcacaggacatgcatagcttgacccttttatgcacaaaaggtaatatgtaaataaatattgccgtcagacccatacacgaagtggtgtatattcaaccattcaccgagatacctagatcggctaataccgtctggcaccctcccttaagttgggttcgtcatccggctccggctaattaacactaagaagtcacacatctcatataaagaagtaacctcaccaaagggacctcaattcaccagcagtactaattttccaccaatcacatagctgcacatagaaggactcacacaaggccacaaaggtagtagcacaacctcatcacctctcagtcaagcagtcaaagcatggctacagccatgcccatttgctcaatgatgcatgcatatgagccccaagcacttggtgaggagtgagcagatcaggggaggaggagagcaatagggagcgaggagggaatagccaaagtcccaaaatccacaaatcagcggaatgcaagattctgcccaatccatttcaagaaccaatccctcaatcccaatagttagtagccaaattagttctcagccaaatactcataccatctctatgtcggctaggaaggggagaagaaaaattggctagacaaggagatgatctatcaaggaggagaagagaccaacacattggcgaggacgaacacgggagcacaaccatggaggaacttgtcccttagacaaaggtgagcccctcaaatcttgccattcttgccacctcatagagcagccatggcacgaggcactattttcctgcactttcacatcactattagtggcatcacatccatttggtagcatgagagagagagagggacacacacagagagagaaagcagacgctgttggtagggcttggaccatgggaggaagaggagaaatcgggagggggagaaaaggggatttgcagtgagctagcttggggtgtgtagtggtggtggctggcgtcgacctccgtgggcgccggggtggcagcgccatgggtggtgctgtagatggaagggaggagcagagttggggaagaagaaagccattagcagcagcaacagccaagaaaatggaagaaggggatgagtaactagatgcagcttgttgtatgtgcgagagagagagagagagagagagagagacataagtgaggagagcaggaataagggttaaattgcttagtgcacactagttgtctacactaacattaagcttagcaaaactctgtcaataaatctgtaaatcaagtctagtttaaatcaagtaactaatatatatactcaatacaaattaatggaatgctagaaattgtacatcaggctagaattttaggtgcactgtaatatagatagataagccaattatattcttcaagtttgaaagttaattgaaaatcaatgtatacaataaaatgcagggaaaaggctagagtcagaaattgggtcatttgatagtaccggctacagaaactcaggcaagtctctcttttgatcatgttggtagatgataattctatttcaacttaaaaatctatttcataaaaatatttctcctagtattgcatcaaaaagtattttctagaatataatgaaatgaacgatgatgatatgattgacaagccgatgatgatggagatcatcaggatactagtatggtgggtagggggagctcagggatgagatgattgatgatgatggcaggtcagggctctccctacatacggtgtataaatataaggactaatcaccccctcactcgtatcaaagaaccgtatataccgtgtcgaccatagattcgtcttaagacgggctggacctggtaccttatcaagtttattatactccacatgggtacgtagtagtaggatgggagatgatataaaccccatgaatgccgatgaagtgcattccaggcgcatatagtagcgcggtggtgtggagggctgataggctcaacacaaacgtggagtgtagtaagttgaagtaggggaaaagttctgtactcttagcatggtgccgcatctagtgaagtgcgacagtcaaacatgttaagagtagctatgggtacagtgatacaagcctgcgcagtgctaaattaaatcgtgattcacgactatctcctggatgggagtctacggggagttgctacaaactctattcaatgttatgagtgtactctagatggagtagagatgaccttaatgctcctagggatgaattaaaggtagttctaactatttctctgttgcgatctctgatggtggattattatttggcaaaataatggttgttaaataataatctatgttctcacacttttatcactaaagataaaagtgtggggcgtcacagttcgatttttaaaatctcaatgacaataaaagagaagagatagtggacaggctgtataggagtataatggcaacgtttgacgggacatctagaaattataaaaacgaaacccaacgtgacaataaactctaaaaactataaaatctaatttttaaatgttccaagatgaatgaatagaaatagtgatagatcgagcaagcaaataaagaagatgacataaggggtagcaattggtgtgatttttaaaactatataattagaaacacgaggatgataaggtttggtctttcaaagtcttaacaatgagatagctatttaataaattttaagtaaaatcatacttaaaaaaatgatttttttggctagccgcgcaattgcgtggaccacccagctagttatcataatataaaacagtaatttagaagcccgaaccatctgagcacaaaagccctcctgactctctttttttctctccctagcgtcccctctggccctctccatacctagctcaccctgggagccctaactctaatatatggttggaattccgtttcacgtattagcccttacgggaattgaattaaccgatgattcttattcttgacaaaatgttcacatggggaagcaagctctgaaatactactgccttcatcccattttaatcatcccctaatatttttaaggccttttcaaaataatcatcatcttcgtttatttgtgcaaattaagagtactaaatgtgtatcattggaatgtgttacttgcaaccaaacaagattaatttatattatatttaaaccattagcaatccataagacacgaagcgatggaacacttaatccatgagaggattaattttaagaatgatgaatattttgctgttattgttcttagcgcctttagttaggggatgattaaactaggatggagggagtagcctgctgaccaaactgtccattttttacgggtcctagctagagtggatcatggtgaattgattcctccttcggcgtgtttggagcagtgcagtgaaaatgttgcttcacacaggaatcagggcaaccatatatttttatatatttttggcacgacaatatattgatatcacctaccctttttctggcagctttaaattgatgacagttttggcatttcacaatcgaacttccaaaatttctggagtgtaaaactctggaatggattctattcttttttatatactccctccggtttcattttaattaacgttttggacaagaacacggtctacaaaatatatctttgacctttatttttctattataatatatataataaataaatatatgtttacttttattatggtgttttgaaagacaaatttatatatattgttctagttcctttaaactaaatatttttaaaattattgatggtcaaagttataaagtttgacttcaaccttatctaaaacgtcaattaatatgaaatcggagggagtaatataaaatatcctcgtggacattcatggcaagtatattgcaggaggcatggacgccaccaatcacagttaaatactagtatctaaaattgcgcaggttttgacacaacttttttaaagaggcatggtttagttttcaatttttttttcccaaaaacgtcacctcgaatctttggatatatgtatggagcattaaatatagataaaaataaaaactaatcacacactttgcatggaaatcacgagacgaatcttttgagcctaattaatccatgattagccataagtaccacagtgacccacatgtgctaatgtcggcttaattaggctcaaaagatttgtctcgcggttttcaggcgagttatgaaattagttttttcattcgtgtccgaaaactccttccaacatccagtcaaacatccgatgtgacaactaaaaaaattctttttgcgaactaaacacacctagaatttaagaattttagcgacaccaaagatttcctgttggcttccaacttttgagaatgtgctaaagggggcatattcgcaggtataaatgtgcagtagggcacgtgaaaaaacaaacaatatcaagaaattatattatatatgtatcacgcactttttttcgttttaaaatattgctgcctttgtatatcaaattaggccgctatatttaggccggagcaagtaactaatttgcttgaaatgaaataatattagaaactagctagtgcaattgcacggacaaattttaccagttacgtgtatatattacagacgaacttacataaggatcagtgtatagcaaggtataccttagaatccagggcaccactacctcaagctaccccggctttgtgagttgtgacgcgcagatcgctgggctgcgttagcgcattggaagcttcttaaatagtaagagcaggcgtagacttgtcagttgagtcaactaagagccataataatattgatattgctataccaacgaccaacaatccgttggtccatccgtaggtgacgcatcccattttatcaaacattaaaaaaaaggtgaagtttctatcattgatgctactctgtacggagtacgatgaacagagtaccttacttttacaattaataagtctgttagcgacgtggaagtggtggcaaccacacatgaaacaacccgctcttaaatgatactccttgcgcttttttaattagtatttttattgttattagatggtgtagtaaacataagatcgatttttaagtcatatgaaaaaggaataggaatactgaagagtatgtcaggcgatggactgacgattctagggcgacgcggcggcgctccctgtcgccggcgaatctccggcggagatcacggtgtgagcgcgggaattcctcaggtcacacccttgggagacaggaagggagcggcgcgggagcctagtgagaagctcatggtgagcctgctactgtagggggtggacacgtatctaaagcaccgtactaaaaaattatctacattcaactaaccatctcaatattatgtagaaatctaaacatatatagagtagagaaggctgaagctaataagctatatataaaaagtttctgttttcgaaaagttttcaaatttatctccggaaagtttctgaccgattccggttttcgaccgatagtagcctcaccgtattcatttccgattttgaaaaaaaaaatctgaattcatttccatttctaaaaatttccgataaaattctgactgacactttccgtttcaaaaacctctcaggaaataggaaactttatgaaccattttcatacctagttacaccatcagaaattaatcttggctagttacatgcatacggttgcatgcgtgcagcgcattcagcgattcccatttactcccacttattgtatgatggtcatttagaaaaaacctcaaaatcttagtggacggtcaaattggggtagagggactactatatttctttcgttttgcttgtgcacttgtcaatcacgaagggatgaagccagggggcgggaggaggcctagcctcccccaacacaactgcttagagcctcatcggttggcctaataacacaaagcaaaagctaaagtttgaattttaaaacttgaatttaaagttgatttcaacttattttcaacgtaaatttctttatagcattggcttttaccttgctacgaacaaatatataaaagctttatatataaattaacttgtatttctttttttttttgcggggaaagaagaaatatattactctcttaaaatgtcctcacgcactaaacgtaagataaaattacaacttccttccaaccaaaccccagagacagagtcaactttggccctgttagctaacaggtgactaacactattctggcttctatggatcttactgactagaattctcctagtcccggctagcaagcgtttagcctcatgaacaatgttagccaattccgaccgatccctttccccatcatttaacagttgcactacagacatgcaatctgtttcaactagaattgggagcagggtccaatggagaactagattcagaccttctacacaggcacgcagttctgattcgagagcacctgtgcatctgttcagcggtttacaggacgcgaagattgtattcccactgctatcccgtaaaaccataccaattcctcccttacatagggcagcatcaaaggatccatcaacattgagtttcatccaaccaacctgaggtttcacctaatgcaatacgggattcggaactcgatgatcatcagaagctctgtctcttaccctgccagtgacagacaaactcgctacagacttccctttttccacatctttcagcggtgattccttgatctggaaaagcgtggctatgtaactttcaacaaatcttttcgaaacttccagcggaggggctgctttatcatgggtgatttcattgcgaacatgccaattccgccatagcgtcattaagaacatctcgtgctcatgggcagggagttgctccagcatgtcaaatagccactcattaccgaaacgagatttttccacatcaagagagatgttgcctgcattgaacatggctgacagcaagttcctcgcgtgtgggcacctgcagagggcgtgagcagtatcccccttctcctgattacaaatgattcaggtatctgtcgactccaaatttcgtacctttttgttgacaatggttggtaaacagtttgaggcagcttttcaggcaaagacctttatcttctgtggcatcttacactttcagattgagtcccaggctttgtgtgtacccactacagatgagcttgacgaatcttcagtgtttgccagcttacaagcaaggctgtaggcactccgcactgagaaccggcctgtcttatctgggtgccaagccaaaaaatcttcttccaaatgaggagacagacagatagttgggatgatctcagcgtctataccaaggaagcatctattgatctctgtaatattccaagagccatcttggtctatcaaatcagacacccattttagccaacaattacctctcaaagaaataggtcttcttgagtgatcacgtggaatccagggatctctccacacgcagatagacttcccattaccaactctccatatgatcccttttttcaataactccagcccacgaacaatagcacgccaagtcgggaaaatgttgcaactgaaggtagtatcaattagggatccttgggggaaatacttcgccttcagaactcttgcatagaggatatcagggaattctataagacgccaagcttgacgggcaagaagggcttggttaaacagcctatagattctgaagcctaaaccaccacatctttttggttttattaaacagttttcttaataagccgttttggcttattagaaaatataggcaaccaataaggctcttaggctgtgttcgggagtgagggttgggaacctcactcctggcatataaaacggagcagcatttaatgcgcgattaattaagtattaactaatttttttaaaaaatagatctatatgatttttttaagcaactttcgtgtagaaactttttgcaaaaaaacacaccatttaatagtttgaaaagtgcgcgcgcagaaaacgaggaagaggggttgggaacttcctataccgaacgcagccttaaactacaacccaaccaaatagagatcctctaacttacttttctctaacttgtgtcactgatatgtgtgccctctatccagttggcccatgtcagtgactcaaagtcagagcaagtcataggattctgccgatgcatgcacagcttagctaacagcatcacatcgtgtgccatgctgaatttccagcttcttatgtttatcgtgtaggattaattagtcactaaccaaaagaagcacaagccatgccattcttttttccttttccttgtataatactacattttattaatatctcataatcataatcatgtcgttagatggctaccatctcaaatttctaaatattccttaatacttgcaagatagatagtttgttaatcattttatcaaaatcgatatagatgaaagcctatttatctagacttttatctcggtcgatattttcaccgcttatgatatatttgctcaacattcttatcatgctaaatttcataaataaataagtatatgcagtataacttcctgcctatgttttttgttgtaatatgtttttcatgttaatacgatgcatcattacctaaagaaaacattgaaatttgcatataatctatctattatatactaaaagtccattaaacttcctacaaacgctctaaggctgccatgtggtatcctataaatgctcttaagtccccatgtgtcactctaaaaaattagtaaaatctgaccattgatttttatttaaattggtgggcccattaattttcatatttagatctatcttcacaagaaaaataactccgtccggacgtgagcctccgcgcgcacgtacgtgcgattcctccaaccaaccgttcctctcctttttttaaatccccatataatttaaattaaatacctttttatgggcctaaaaagcccatcaacctactagatctagccaacttcctatattctcacctaataaataaatagttcaatcaacatcatataaatatttctaaacacatgtccaaattcgctgttctcgcatcatgccacatcctattttaagttcaggttttatggga

SEQ ID NO: 59086 - DNA, 2433 bp, Oryza sativa
gtcatgaagcgaggcttctaattgttcccctgaggaaagctgatctgagctacctttctatttcggtccattttgttgcgttgctcttcctgacggatagccttgtccacgagcttctcaaagtcatcatagactccggagatcagctggttggtcaatttatcatcgagaccaaacaaaaacttctcctgcttctcggcatcggtgcgcacatccttaggagcgtagcgcgcaaggcggttgaactcatgcaagtactctgtaactatcctggtttcttgatgcagtgcgcggaactctcttttcttttgtgccataatcccctcaggaatttgtgccttcctgaagctttgacaaaactctgcccaagtaacctccgttgaatctggacgggtcaccacgtagttatcccaccaagcagaagcgggaccttgcaactgatgtgtagcaaaagcaaccttctcttggtcattgcattgcagaaggttcagcttcttctcaatcgcacggagccagtcgttggcctacattgggttggtggtgcttgagaaagtgggtggctggatatgatgaaagtctaacagtttggacaggtgtgatgatggaggaccagactgctggttctgctgcgcctgctgcaacatctgatggtaatgttgctgcatctgttgtatcatcattgtcatcatctgagtgaccgttgggttctcgggcggtggagatgaactgctgtcagatgcaccactgatatgagctccatcggtctgctcttcgctgcccctagcgtcattggaggcacggggatcattccctgtcttcaccatctggacgaggataggtagaaataagagaaaggaagaaaacagatggcttggaaactaatctttcttatagatttaagtgcaattaatttaatcttgattaaaaaactaaaaagaaagcaaacaactcctaattaaggcagtcataccactaacacatgatatcgaccgccgactaacccacaagcaacaaacctaaacacagaaactagcaagcagccaaaactaagaaaatgttaaggataaaggcggcgactctgaagcttggagcagcgcttgcgatcagagaacaggtctgacatctaaagaggacagagggataggaaccaacacatgctcaaaaccaaattaaataaagcaacaaatgactcaaataactcgccgagcatgatgatttttatgcgtggaacatttttcatgaacccagacaaagatactaatgcaactgactaaacgataaattaatgcacaaaatagatgcgtagctataatatacacataaaaatgcccatcgaatctagacacgacttagtgcatatcacctaacaaattcccgactgaaggccaaataaattccaaataaagttttgctagaaccctagactgcctctagccgagaaatacgattaaatagcgatcaagatttttcccacaaatcaaaagagcaaaccccaaaattataccgaaacaaatccaagtgcaaaaggcatgtgcaaatgaaaaggtttaagaggactcttagggtttccagttggcttgtcctacggtcaaggtcggctctgataccaactaagaatttctaagctgaatgtgtattaaacccctgtccaggaccagccagggtacacaaacgacaattattgacatacagatccacgtcttacaaaaatataaaagattacaaatgcagcggaaaaaagaggaaaaaaacgagctaagcctgaagacttgacttctacagtgggcgactccattccacaggcatccttgacggtagcgacgaaaccaacttctttgtgacatcttcaactgagaaggacttcaactctggtgtgggggaaaagagagcaagaccgagtggcgaaggctgtcttgggaatatcctcttcccgaattctcaactgatgatagcctgatcgcaggtctatattggaaaacaccttagctccttttagctgatcaaacagatcatcaattcttggcaacggatatttgttctgattgtgacctcattaagggcgcgataatcaacgcacatcctcttggtcttgtctttcttttccacaaagataaccggagcaccccaaggtgaagtactcggtcggatgtaccctttctgcagctgttcgtcaacctgctttttgacttctgctagctcattagctgccattctgtacggcctcttgtagattggagcagttccgggtgccagatcaatctggaactcgatttctctcttcggtggcattgtagtgaggccttctgggaacacctcaggatactcttgtactataggtatatcctccaacttcttgggatttttttccgctatttctgtctgatcctcaataacagcctgattcagactcgctacggacttctgtgacactgg

SEQ ID NO: 59087 - DNA, 746 bp, Oryza sativa
taatggaaagactaatttattttgtcatgtatttttgtttctgcaggatagctgcagccatccgagccaaatctatcaaggcttcgaagctggcacatttcgctttaactgttacgatgtcagtagcagcttatatggtcactctaaaaatcattgcaaacctcaaaaagaaaaaaaacattgccaaacctgccgatgctgcaaatcctgaaatgaaggttctattttccatgcagccacgatatttctttttttttttttggtaaggatgactccccataagggaattgggactctgtaataaggtggtctctggatatgctttgtttcattactaataactgagcggtgcatgcgtgtatacctaataagtgactctgtaataaggtggtgtttggcagctatgattttttttaagaaaaaaatcatactcctctgtccaaagagactgcatattataagctctgcagtaaaaaagtttagttatattttgtgtacgtccgatgtggctgcatattatgaatctcttttggtcacccctacaagagaattacaaaagtcagtactccctcgtccctccgtcctaaaatataaaaacttttagcctctataatttgttcctaaatataataacatcttcaccaacatatccttctcaaccaatcacaaccctccaccattcaatttccctaccttcacttctcaaccaatcacaatcttccactatttaattctacctactttgt

SEQ ID NO: 59088 - DNA, 3598 bp, Oryza sativa
tacaataaaataaatgatatttatataacttttttgaataagatgaatggtcaaacgttatgcaaaaagtcaacggtgtcatacattttgaaatggagggagtatatgccaccacacttgtcagtttggtcaagcacagaggattctatgctaagcctgcatttatttcagctgaatttggagccttgatacgtgaatattgatttgtttatgtgagcctgtgaggctcgctcagggatacatgattttttctgagtctctttaaccaagtcacagtagcaactcaggaagttgttcatctagagttaacatacaaatgaaatcaatggtcaatccaaaatccatatatgaatatcatatttaatctttaatttggattttgttgagccttgtggggctgttggcatgaagattataagttggcaccattttagttagttcactgcttaaaggctgagccaatacaaggtagcttagtgtaacagccgtacataacttttctcaatatctcaaatctgctttatttgtttcaaactacaatgatgagcatatgagtgcattgctaagactttgatttgtctgtgcctggacaaaacatttcttttcgttgcttcaattttcttcttgcatccttagtagtactaatttatattgcttcattatccatacacttattctgttcactgttcacaagcagatggttgtattgaagattcaagttgcagaagatttttggcttgtggagctaagggatatgacgtgacgagttgagctactgggtttctgtctctggttctcgagagctattctgtgaacggttgtttatgtgattagatggtagtatccctttaatctatgagttagcaatggagctgatgacagtttaattaactcctgtatctatgatggcatttggctttaattaggaggtgtgcctaattaagggggttctataactttgggatatgcgtgatgctgatattgacccgaaatcccgtaatcctgcttattttgttgcccggtttattcgacctgcaaccgtttcgttttgttgtaatgctccaacatgatctcagtctcgtacaattctgtgcaactaagtcatgcttattcatgaagtgaaaaatatttcatttcattacagagagtgaagaatttcagtttccggatgcatgatttgcacgctacgactacgatcatcttgatcaacctgtacggttctccaaatttgattcggcaatcgacttgcaatgcagatagctctgaaccatcatccctcatttatctctttagggttaagtcttatttacccccttcaactatcatgaaagtaaaaaataccctcatcaactctaatactagataaatagctttggccgatgtccaaagtgtgagcttggtgttgtcttgcttgtttaggcggtgcctccaacgatgtcgcgatcgccatggagtcggagttgctaggtcgctgggcggcaagctcggcaacgatgacacgtgccttgtaatatcaaacttgtatgccacttcttcagcatctcaacatcgacgttcgctcttggattccgccgttgtttctttggtagtttggctagtgttgtttggtgcttcgtgtgttgtgtggttgtaccagttgcggtggaggaacttggcgagtctctacttgtcgagaggttgttttatttttctgtaacccgtctgggtttttactccagcgagaggttgttttatttttccgtaacccgtctgggtttttactcatgtttaattgaaatataattgatagttgtcctgccggtttagtttcaaggacgtgactagacagacagtggtagctgatttgtctaaatcaactaccactctatctaagaaggacacaatccacttatactttaaatacaattttctcttaaactactcatccgatctatgatccgattgcactgttgtattcgtaacaattaaatctttataacaagatcttacatgattatattttcatgaaaaattataaattacttttatcatatatctaaattacttttagatttcactaaattacttcttagacatataaaagtaaattcaataaagtctagaagtaatttacatatattatagaagtaacttataaaaaaaagtaactttaatgaatgccttttttcatcgtacgagaagtcatatttttatccctacaacgaatttagttactttcattttgttttaagttacttttataatataatatatgtaaattacttttagactttattgagtttacttttatatgtttaagaagtaatttagttaaatctaaaagtaacttctatatatgataaatgtaacttacgtatataataaaagtaatttacaaatataaatattttttcatcataatataatcatgtaagatcttgttgtgaagatttaattgtaacaaacataatggtgtaatcggattgtagatcggataagtaatttgagagaaaattttgtttgaagaggaaaaatgacatgcatgtctattaaaaaaatgcatgcatgtagtacgatgtagtaaactccacgtcttctccatattcaggtatcaccggttaacgcaaaaatgagaggcctctccgaatagattttacgtttcaaaaactattcgatccggatagagaaaccccccttcctcccatttaccggcggttttgggctaattatagagattaatctcctaatgaggactgaggagacgggcccagcctgtcacgtgaggagcacacgatggagttagctactgcatgtagaggccatgtcactctgtaattggcccaaaatggttcaagagattagtttaatagtatagccaactatcagctctaaatcatttatagtcaacctaatagtcattcatataagagcacccgcaatggtaaagtaatgtgctctctataaaacatgtacatctcagcaatatactcgattaatagtaaaccaccttaatagtatgtctacattggtatttatagctctctcatgcattgcctcgtttttctctatagactatctctaagttagtagatagctttgctctctctcttcatttaatacctttcaagtaggaaaatatgctgacatggatttcttgtagagagtatatagataaccattgtgggtgccctaatagttaattacaaatatatactatatcattaataactggtcccatatatcatatacacatagtgttctagagttcgtgctgcagctggctacaaatctatagcccctgtcggctattttttttttcatcctctgcgaaccgtctcaccggaaggaagctcagcgccatgctcaccggaaagaagcagtcgtgccgtccggtgcctcctgcaccctagtgttagggatttgggctctagaggatggggaatttgagggaaagagagacgagaggagggaattatttaattttttgctatgtcatccgtcggagtgtcatgtgagataactctggaacaaaactggctataaatgggaatgagggggttgtgtgtccggactgaatagttatggtgaaaatgctcgatcggtcgactgggggaggggg

SEQ ID NO: 59089 - DNA, 2250 bp, Oryza sativa
aaaagatgtttcacctagtgtacttataatgtctcactatgtatagatctaatgttgcagtgaattaaaatattcttttgcaacaaatcacccacatattttagaaaccctttattaagggaattcgtttcatttttttgttccacccaaaatatttcatctagtgtactcataatgtttcactatgtatagatccaatgttgcagtgaactgaaatattcttttacaacaaatcacccatatattttggaaactctctattacgggaattcgtttcattttttgttccacaaaaaatgtttcgccttatataatgtttcactatgtatggatcaaatgttgcagttaactgaaacattctttcgctatttgctgaaacctgtttttatataaggcgaaacaacgcccgatttaaacgattgaaacattttcgatctacttagtgaaataattccgatatacctggtggaacatcgtgcaacatttaaaaaatatcaataataagctaaacttttttcgtcggaatatatccatgggtggttttgttttgaagatttaattgcaacaaacttaatggtgcaatcggatcatgatttggataaataattttaaagaaaaattagtttaaagtggttttgcacatatgggtggcgctgatgtcagcgcccgctttttggagatttgtatcgggcgaccgatccctagtcatcccctagttacggggtgtgacttgtttggaattagagttgaggaggctaaatcatattttcgttatagttggaggggggggggggtcaatcggacttgagccttatttctttatgcttagctctctgttaatattcaaatttcgatggatttaagtttgagtgtattcttcaaccgtttttgttatagacgtcgaattatttttttagcctgattagtcgaatttatggctggttgatctacatcaagatttttcttttgcagggaaaatagactttattaaatcacacgggacctattacaatcgtttttgataaattatgagttctcaatatttcaaaagcccatctcagcacaaatcttgacaaacaaagctagaagggactattactcagatttgagtgggtttgagtacaattctgctttgcggttatcgaaagggacaattacttatttgactctattttagagtctaaatatcaatttggccctacttcttttaatttgcttatttgactccgcatttgtaaaacgaagttaccgtttggtcctatttccatttcgctgttaggatttcatttagaaaaaaaagaaacaaaaattcaaatcatattcaaactgaccaaaaatacgcttgaggactctaccctatccattcaatccctaaattttattactacttcagaaacaggcacatgatttatgcaatttgctacactgattgtttttgaaagatctaacctaacagaaattattaggacaagctatatgcgagatatattgatggaatgatgggtcataaaccggagaacttaattactgaactttggaagccatagtcaacgtgggcccatatttgaagtgactttaaaaaggagacaacagtgcattaccccagttaatttattttggaaaaaatacaaattaccccccgaactatcgcgcctgtccgaattacccccatgaaccacaaaaccggacattcttcacccccaactatgcaaaccggacgaattaccctcctcgaaccaattcagagcggttttgtccaacgtggcgcacatgtggcaatccggtcagcctttttttaataaaaaattgtaggacccacctgtcatactcttctttcccctctctctttattctctcactctctctcgctcttttctctctcgccgctcacgcagcgcgcacgtgaggacggtcggcgaggacggcgcggggacgggcggtcggcatgggcggtcggcgacggaggaggcatcgagcgcggcggtgacaaggcgaggcagcggtggaggcagcgagcgcggggaggcaagcggcggggtagggcagtggaggaggcgagcggcggcgggagctcgcgctgctcaaggcgaggcgaggcggcggtggaggcagcgagcgcggggaggctagcggcggggcagagtgatggggcaaggcagtggaggcggcacaaggcggcgggagctcgcgttgctcgaggcgaggtggcggtggaggaggaggcgagtggcggcggggggctgcaggaat

SEQ ID NO: 59090 - DNA, 2932 bp, Oryza sativa
agagcgagatagagagataatagagagagaggaagaagagtatggcaggcgggtcctgcattttttattaaaaaaacgctaactggattgccacgtgtgcgccacgttggacaaaacctctctgaattggttcgaggggggtaattcgtccggtttgcatagttggggggtgaagaatgtccgtttttatggttcatggggtaattcggacgaccgcgatagttcgggggatagggggtggggggttattcatactttttccatttatttttaacggcagtcttttgtctatttggcaccttgttaggatcgttcaaaaacttgtcacgtcacaattcgagatttcgatagcaaaggacacatgtacgtttttttagaagccttataaaaaattgttataaataacacaataagatggtgaatatattagtagtagcatttttgtctatggtgaagttctggagtagtgctttctgaaagataaacacatttgcaaacacatcatcgcctatgcgtcagcattgcaattttcttagtcagtacacacgtaaatgcaaaccaatgagcaaatgtaataatatatgaatgttccattgcacattccgaatacacaactgatcatgttgcaacaagttaccaagaaagaatatttaaatttaagccaaaaatttagtttcggtgatatatttggcccctctttcatctacatagtttaatactctgatcccttggtgtattctgatacaagtttcgaaaataacgatgaattgtcttccagaagttttgctggcgagtcatcctctgcgattttacctgtttacaacaacatggaattaaaacgggagaaccaagctattaaccgttggctactaattaaacacaaagcacatgactaaccattgtccagaagaatgaccttctcactatcaagaacagatgcgatcctatgtgctattgtaatcactgtgcattcgaaaaattgttgcttcagggttttctgaatcaaattgtcagttattggatccactgaagaagttgcttcatccaaaaccaagatctttcgcttctttagaactacccttcccaaacaaacaagctggcgctgacctgcactccagttgttgccattttctgtaactatatttcatattaaaatatcagttatgacttatgagtttgacactgtggagcaatgcattatagctttctgatatagatataaaacctgcagagtcaagcttgagctcattctttctaacttcatcgccaagatgacaagagttcaatgcctggataacacaacaaatataagttatgcattagtttgacaggtgcacattgaagaattaaaatgtcagtaaattaaaattaaaagacctcccaaatttgttcatcgctgtactcctccaaagggtcaatgttatttcgtagggtcccctcaaacatcacaggatcttgtggaatgatactcaatcttgtccgtaggtcgtgtagtccaatggtgcagatatcaaggccgtctatcaacacttgcccaatagatggctcgacaatacggaatagcgcttgaatcaaggttgacttgccactgccagttcttccaacgatgccggtcttcaaccctccgggtaaagtgcaagtaaggcctttcaaaacaaaaggcaattgtgttgcataccttacctgcatcacatacaaagcacttagaggaaaaaataacacttcaccagaaatttctgcattaggtgttgtatgttttccatgttaagaaagaagatatagtgttgtgagggtatttccacagtggtatgctggaagtcgtacaaaatagtatattatgaaagaggattgcaactctacagtactagaaaaaaaatctgcatgccaatttttgtggaataacttcgatataaaattaatttaataacacactgtttttctcagaaaatattatgaatagaaatgttgagagttctaatcaataattgacatagctccgacattgttagaagtgaacttatataacaacatagagttcaagagacaaacatggaggttgcgaagctcaatttcaccatttgtcggccactggcagtttggtctactttttgatattgtaaggagttgttcagaaggaataaacatgtattgaaaaattctttcaacggatatcattctattttccaaactacagagcactgcaatagcccacccttgcaacatgttcagacttaatccataagtgactgcaagaccagctgtctctgtgagaatacaataaaaataaaaataatagttagcaaggatggtaatacacataaagaactaatttgatcggaccaatcaaattaaagcccactgtacttacttgggtcaattagagcagctggcaaggtgaccagaagtaccaaggcaaatgcgaagataaaggatgaaagaatgtccaagcgaaagcacaaccattccattgaagcagaattatataaacttggtctagataaattatccatgaaatgactgacataattgataaactgtctttccttgccaaagcatctaataatatttgatccagctactgattcagcaaaatgttgcatcagcggagctctgcaaactccagtcaacctctgcaactccctagcaccatctatgtaatattgctgaagggaaggaattatggtgattaaaaataaaaacaaaacatgagtcgtattgaaaccaataatgccataggacatagttataattttgaaatatgattacaattattattggttaatagcatattttaagactaaaagtttgattgttcagaagaacatcggaaatgcacaagttctcctatatacagtagcatcaacctagaaattttattgggaacatttttgccaagaaaagaatcacatcatatatgtacctcatgttttta

SEQ ID NO: 59091 - DNA, 6724 bp, Oryza sativa
tgatcactagaagcctgcaattttgtttcaactttcatgattaattgaatatgaataaaaattctaatggtattccaaggagataacttcaattttctcattaaaataaagatggtgaaggtaaattacttactctgttcaagattcgaccgctaggagtggagtcaaagaaagacattgaagcctggaatatgcatcgatgcatcttatcaaatagcatcattgcagtcttacatccagccatgacaagaagatgggatcttatgaaaatgaataacgagctcacaaaagctaacgcaacatatacaagtaccattttcaagctattgactggaggattcacatctttggatattggagcagcccaagccatccaaaaattgcttccaatttgaagaacttgaaaaattatctgagcgagcaaaataagcggcacaagtgctccaccatatgccattgtaatatatttccaatagacagaaatcccaacccgccctttctccctttcttcttcttgtaccaactgaccattttgaacaatcccttctgctccttcattttcatccttttgcttatcttgtctgaaaagcatacttccactgtcaccaggaataagactactttcgggattgccacttgagtgttctaaactttctagagtagaaatgtcatccttatgggaaaatactaattttgtgaactcttctccagaattaagtatttcagcgtaattcccaacttgtattatttgtccatctttcatgacctggaacaacgaaatgaattgacaaggtaaaacgattgttgcgagtagaataaataagtagatttgatagttgttggaagctcaccatgatagcatcggctgatggcaaaaattcgacatggtgggtaacatacactacagtttttgaagctaagagtccaagtaagcactcctgaaaaatacaaggtcgtgttgaataactttcatacagtagatatactcttgaaccctgaatattgttcaagaacaggctacctaaaaactgtttagctgaaacatacaaaagatctgattaagacattaggtttctgtccacacaataaactatgcaaagagataaactgctattacttattttggaagttgggaaatgaaaaatcaaacaaaacaaacatgttctattcgtctaaggatttgataacggcactagcactgacaactgaagaaggttaaaaaaaaaccccctaaattgactgggagaaaatggcgttgaaatcatatgatgtaaatatatattttgtagtattagaagtcttaagtaccaacaataagttattagtttaagcattcagtgatgatttacacacatatagaaataggatttaaagatttgttttgaaaaataccttgaacaagtgcaacccagtatgagcatcaacagcactgaagggatcatcaaacagaaagatatctgcatcttgatacaaagcacgtgcaatttgtatcctttgcttttgtccgccacttaggttaatgcctctctctcctataattgtctgatcacctaatggtaatatttccaagtcctttttaagacagcatgcttcaaggaccttttcatacctttccctatgcagttttgtgccaaaaagtatgttatgttcaattgtcccactctgtatccatggcgattggctaacataggcaatcctaccacatgtttgaacatctcctgataacctcggtatctcaccgagtatgcatgacaacaaacttgattttccagatccaacagttccacagatagcaaccctcattccttgtcgaatacggaagttcaaatttcggagagtaggaacctcagaagatgtgttccaagagaactgaccgttcctcacctcaatcgatacatcagttgtacctcttggaagtttagttacaacatcgctcgatagttcctcgaggtgcataaaagagcatatcctgtcaagtgatacttttgtctggatgatcacagagactgtgtctgggatactattgattggtccttgtagctgcctaaacgttgctagagcagacaatactttccctgtttctaatggaatgcctagaagcaaacaagttccaaaggtgaccatagcaataaaagcaggagctccaaagaagacagatataagcatagctgaggtgtatacatctttctttagccaatgcatctcctccttcctcaactccatgatcttcgacaagaagaccatttcccatccttgaagcttgagaatgcgcatgttccgcagcatctcagacatagccctcattctagcatccttggcatccatcattttctcttggtaattttgctggatcctccctataggtagatttgctaacattgtcaaaacagtggcagcaagggctgcaaatgctgccaaaccaagagtggagtataggatcagcattgctagaataacctgcacaggaaacaaccaaagctcatgcatggacgaattgaaacccgcgacacgcaccgcatcaacgctcacggcattgatgatctctccacttgaaatgctttccctggactgatttgagagggagagacccttttggtaaatgatggcgacaagagctgagcgcacccgcacaccaagttgttgcgatctgaagagcaaatgccttgatgagaggcctttgatgaactgcgcaacaacaaaactcaacaccaaaatgtagccttctttagcggtccgtggacttcgattcaggtaatcaacaaagtactcaatcaggtatggaccaacatatgaagagacagtacggagtaaggcacaaactgcagtgaagaggattaatttccaggttgtaagaacaagagctttgaccagcttaattgttgtaacaccggtgtacttccctgaaccagaaactgagatgagcttcgcctcaaagttagggaggatgccttgaacactgtcattatcatccaaagttggcacatcatcaagatctagtgctttcctccttccaagatcaagtaacggccccatccaagaaaaagtgataacactaaagaatccagcatctgtgaaagctgctctactgcctgtggccttagacgaggaagaagctgcacggtccaatagtggctgatccatgataaactaataactcctgaacatagaacaacaaactttagcaagttacaactgattatttatgagaaagaaaagtataaaagtgttaacgtaaaaatgataatttaagtctgttcatggacattaataggattacagaaagtatagctaatttaaaggaaacaaacataactgtgagtgttaaagccatatgttgcatgaaaaacatccggatgaatccgcacgataccacagaattccattgtcacacatggtcaagatgatatcacaaatctccaagtaaacaaaatcgagacctagattacataaatagcatatgtaatatgtatgtaatctaatatgtgctaaacttcctagaagtaaaaaaaaaagaggatgtaccgaacttttaaatttagcaattgagtttttttttaaaagtatccgatctcaccatgcccatctcagcattgaagcacagacttaataaaaatagcaaaattagtgcaacagactgaaaatgagaatatatattacgcattactccttgcatacctcaaaaagaaagaaaaaaaaagcacgcatgtggaataggatggtgtcagccacaaatcgaaatctgtgcgaaatttttgtaaattaaccagatactggctattcggtgggagagatggaggagaagagaagttggcgatctcgagccctccggcaaagaggcggtggtggcggcggcgatcacggagagcctataaatgaatgcggcggtgagggtcttgagcccaccagcggggctagcgcaacggtgccgagccgaccgaagaggagcacggacgtgccgctggtggctggggcaagccgccgccgccgctgccgccacggccatccgggtgtctgcgtggtttttctcagtgatcagaagttggaaagaagccgcgtctcactgaaaaatttgataatttaacgcttttttccgttgcccaaattaatttaattgacgtttgtaaagatcgccgccacggccatccgggtgtctgcgtggtttttctcggtgatcagaagttggaaagaagccacgtctcactgaaaaatttgataatttaacgcttttttccgttgcccaaattttaaggagtgttaaattatcaaatatctccgtctcgctcgactcacgtgaccaaaggagacggaaattacctatgcttgcggtacgtgggttttttctaatttctcaaaatcttataaaacacatttgtttgttatagatttgggtggcgagtttattaacgacttaaaagtaattcctatcacaattatgaaaaaaaagctgttatagaacttatttgcaaatctgaaccccggttttcttcacagttcacacgctgtacgaccgtagcattatcaatgtcatgcctaaaggttattttaaaattgagtaaatttggagtttatttcaaacaaaacaataaaaatgttagttaagttcaaattagtgcggattacggatttcacatatgtaacgcttgaaaccaatatcataatccccgcttgttagtaacggttcccttcttccccttaccatctattttcctccatgtcataggcaactaactaaatatcttcaacgaatgttcacttgctctcgttctaggggtgggggtgggtgggcatgagttgcgcaggcagccgccctcctattcaaccggcggtgatttggagaactggtccggtatttcacgaggctcaaaatagtttgtaaggggtaaaaaacaatattaaaattcggggattcgtgaattaagagcaggtttattagtgtagtaagctaccagcgatagtatttgtccgtgtctgatatagccatcaagagagaagctcatgcgatgaactagctgtttcgctagctaaatggaaataaacaaacatttaattcatgcatgcacaaccaaattggcatgatcaaaactaaccaccatccttgtagctatgtgtgttgcctgtgctctagcgtgttagatagggagaaaaacagaaatacatgcaaactagatcgtggagatatgtcggaggcccaccaaatacgtaggtatcacccatatcagctgcaagcgagcagtagaggctcgtttcttacactatcgcccggtgacagatctagcgtccgctttttctctttcttcttttctccctcacccacataggatttcgctaatgtggaataacgtatagcctactgactcaaccttattatatatacctgctctaagaagtgtaagtcgccatcttcctcctcgtacatcgtaattcgttgtaaagaaaccacctcaacaaaaacaaacacgtgtgtttccatccaaaactcatcccaccagtaaaaccagatggatgaaactcaagccttgcaaattttccttctaatccctttgcaaagtaagggtatagcgctagtaaaatttagaagttgagttaagtaatatggactattttttttgaaaaatgaaataaaattaagatcgttctcgaatcgggtatacatggatgaatacaaaggaaaagaaaaaaaaggaccaatgtgaagaatcaaaatagagatgacaaagtctgcaggcatatacttacctgctagcttcttcgttatgcctaaaagcctaacaaatcgatcagaagatcggccgctccccttctcaacgccggctgctgcctgctatgcgccgtgccaaggccagccgtcttccacggggtttcgtagcagaaggggttcatatgtactgcactcctgtatttgtgtggggatttttttattacagtacaaagtacagatttgtttaggctaatccaatagaggtaataatcatatagaaggaaaccattgtattcgtacccttcttatgtggagaattaatgccccttttatttgacacctacagctacacaaaagtatgattagtcaattaatgaaatataatcgtacctgccatatattgaaatccaaatttacagccgtgggcctatttggcaagtttagagaatattgcgagtttatagaagggaaatagtagtgtggctgcattcggcatgtttggcgatggagaggactgatagttttgagaggaaattaattaatagtaagattagaatttgatttttaagtctagcatgttttgcgatgaagaggatggaaagttttgatgggaaattgattaatactaagactagaatttgactttcaaatcctagtatagcatgtttggtacaagtggtgcgaagtgatggaaattactactccgtcccataatataacaaactagtaccgaataggacactttatagtataacgaatccggacatgcttcctgtccagattcgttgtactatgaagtgtcacatctggtcggagggagtatcttcctagtttctctataaaagtttggttagtcccttcggatacaagaatgaatatatatgtctagattcatcaacatctatatgaacgtagatccaatcccacaaccgaaaaaaagtacaatttcctataaagcgaaaaacaaaaaaaatccataaaaaataaaaaaaatctagaaaacatctagaaaggatttatatttgt

SEQ ID NO: 59092 - DNA, 2163 bp, Oryza sativa
aattatcatactattttttgtgaagtatagctactattcttgataacatattatatggaaataatattagaaaataaacatattgtaattgttatttagaaaagagtgcacagtggctctattttgtgtagacttgaccatgcgagtcagtgtaggatttgattggttgtaagaatgagattaaaataatatttaagattatatgcatgttgtcacatgaataatccaattattttaggtaaaccaaacatcggtaaggttgccatcatcgaggttgggccattacatttaagatgttctaattttctaattttctgattgtcatcaatatggttatgtatgaaaaagtatattatcattaggttttttcatccgttgcaaccacaggtatgtttgctagtatatataaagaaactcagtcggacgtccatggtagagtgaaatgtggaaatcaactaaaacaggggagaaagaaatagagttggtttcaactttcaagaaaagaaaagaaatagaaaaatacacacaacaagggaaagacgagttaaaagaactgggacttttcctcacaaaaataaaagaagaaatcgattgggacttaggggtttagagttagcagtgatctctacgatcgatctgttgcattgccacctcgctcgtgctcttactttaatctgttgcattaacacgattgattctcaaactttggtttcaagaaagaaaaggactcaaattcacattgggttctatatataggccttgtttagttaattagttccctaatttttttttctaaaaaacatcacatcgaatatttagacacatgcatggagcactaaatatagattaaaataaaactaattgcacagttaggggggaaatcgcgagatgaatcttttgagcctaattagtccatattagccataagtgctacagtaacccatatgtgctaatgacagattaattaggctcaaatgattcgtctcgcggtttccaggcgagttatgaaattagtattgtcattcgtgtccgaaaaccccttccgacatccggtcaagcatccgatgtgacacccaaaaattttcttttcgcgaactaaacagacccataatttgtcacgcccagaaattcactagtaatttccgaactaatttgcgcataaaattcttgtccaggaatcaaccgaggtacacaaactgacaatttaatatacatattcatcaaaagaactaaagcgataaatacttactgaagaggcacttagtcctcacaacgaagaaatctgcagcggaaaaataaaaataaaatctggcaaagcttcggctccactcccacagcagctcaactggggtataagctaagcatcttctccttctggatcatttttcttcaactgagatttgattgattattgcaaggtgagtacatggaatactccgcaagccacacagcaaatatgcaagtgcacacggataccaaaggatggcataatataggctcatttgcaaaagcagcatttagcaaacatttaggagtagtaaataagtagagtaattaatcatcaatattaatcaacactgaatagcacacccatgctgcaggcccaaccaaacctgaacaaccaaccccggtcgtacagatcaaacctctaaaccaggaatttaccattccaaaccaggagtcaaattaattatcacattattatcattaatgagtagtgtgggactaatcacgaaaaacattgctcaacccacccataaccgcgggcatggctattcaaatagttttactctggccagaggtgtacaaatttacccacaagacataactccacaatatgtcaccatatcaccatgtgcccatgctgaacatgccaccatttgtgtagttgtgacaagacccctcgcatagctcaactcaaagcagcgcacctttcctggatcataatcaccccctctacaaccagaggcgtggactccccagcgacccccacggacttctcgccgcttcacagtctagcgccccacaatgagccttgctatacaaagtgtccagccgttgcccattctggcttgtgattagtacggttaatgtctcacaacagtagcttgcgaaccggtccttaattgtcatgagcatgaccttcaaaaccatgtgctcaca

SEQ ID NO: 59093 - DNA, 12830 bp, Oryza sativa
ccatcattaagtaatagtgaaacattaatcatcccaatagtatgctagtgtttctaagcatgactaagcaattattctaatatatagtcgaaccaatatataaagtccaactagtcaaattataacccaaggtatcaaagaatagggtaatcaatgcaaattggccataacaaatgaataggttcacaccacccggtgacatttaaaaataaatgcatagttgaaataaatagagaatttaaatataggagcaacatgctcaaatgattgtgtttaggatctgtgtgacttgccttgcaataatcggtcttcaattagtcttcttgaacacttctgacgcactcacgaaccttcacaacgacggaaatgacaagctaacatttataacggagaaaaaactaataaaaaccaaataaacagtactaaaaagtaaacaaacatgtagatcatgattttagatgaatttagagacttgaacggcctcattccgacttcatatgaattagttatgaattttacaaaattaattccaattaaacctattaaagaaaacactattccaaattgattaaacaatttacaaacgatttatactgagattaaagattaaaacatcctccgaaaattattggaactaatttagtggatgatatatagtaaaaagaactaatatgccattgaaaagggataacatgatttatattgactttggatggctgagattaatcttgaccgagtcgaccaagatcggatggtttggattgatctggcaagctggcctcacgagataccgactcaacgagtcaattctacgtgacacgggatcaccgaaatgattaaccgaaaccggcggctctgaacggctctaaactaaaggacgactcaacatggacgaacgaacgaagcacggggaacacctcgttcgaacgaacgagcaaacgactcaacaatggttgcggctaaaccgatgagctagacacgattcacggtaaaaccctggtacgacaaacgataggccggtagaaacctagggatgcacctacggctttgcaactcggctaacggactacgggaagcaaacaaaccacgatgacgatgacgtgggatagaggcggcgttgcacaatttggagcaacgactaagcagcgacagtgacacggtttagcagcggcacgactgcgtcaacgacttggcaaggcgcggcagcagcaacgactcaacaatgacttagcaagatggctaccgagctacggcaacgcggcagcgacacaacgcagcagaagtggctcggtcgctgcggtagcgggacgacatcgacttttggcacgcacgagcagcagctacacagctgtggcagggagcggtacaacggcggctaggcggctagcgcagcggcaatgctaagccaacagctaagcgcggcacggcgggggctactcaacgacacaaacaagagattaaaacctaaactgagggaacacagatagaaacctcaccaaaccaagcgatcggagagggagagacggcgatgactacccggcggcaacacacggagacgacgatgacgctagacatacagcggattagattagattggattaataccctaggaaaaaaacctaaatcggtgaacggcatgggagcggtggttgcaggcgaaccacggcacaataatgcaaacgagggcaccgggagaaagagaaggcgacggcgattcttaccaacacttatgcgacgacgaacagtgaaggagatggccggcgacggactccaaagggcggcgaggttcgggtccacggcagcgacgattttccggcgacgagcagcggcaacggatggatggacgggcttctccccggctgcgacgctgtgggtggcgacggcaaagcttggcgacgacggaaggagcagtagggcctcgccggagatcaaaacgcgacggcgaacttcgggttgacggcgacgatggagctccggtgggtttcggctacggggaaggggtggacggggtggagcttgaccttgcggagccgagagaggcgacggcgtaggtcgtcgacggctgaggcggctgctaggggcggctggagcggctgccggcggtggacggagaagacgaacgcggcgacggcgctacaagcgacggcggagagagggagaggtggcggccgaaagaggagagggagggaactctatttatagccatgggagagagatatcgatcctacaacgagagaatcgaagccgggattttctagagtttggtttggagagataaactcgaaaacgaatccaaattcgcatcgaattcaaagggataaaaccggatttttgggggaagagatagaggaggataagggggatattttgcctcaactaattttggaaatacacgagagaggaggccggagttggagggggaaggcggcggcaatggcggcatcgggctctgtctccggccggctggaggttaggggcgactactgtagcagagggaaggaaaacagactttcagctgggcttcttttactcagcccgattgaaggagggacatgaaatggacttcggagaagggatagaaccagccgaaaggaagagagaatggaccgagaactaaaagtgaacttttctagtttcggcccggaaaggaaaagggtgtttttttattactttcccaattaaattaatcactgaaatgatctctaaattgttaaaaatacttccggtgctctaataattccaagaaaaattattaaaatacttgaacactataagtatttaaaaaaattataagaagaccatttaatgattaatttaatatgcgaatcattgctgaactgctctttgtattattaaaattagtaattgagctctgaaaaattcgagaaaattgcagagcgtatatttaattatggagaatttaataaaaattaaatgcagccatgatttatatttaggaaattttatttctcacatttaacttcacttgtaaattaatgaacatttaacataaattctaataataatttattaaataatttataaatcataaaacaaaaatcaggatgtgacataattgtacaatctcggattaattaattaatttagggatttgctagacaactgccggctagacaatcaaaaaaaaactcaaaagcttttaaaacgcacaatataagtaagaagataaccatataaaattgtaagaccaaactaaacttagtttcggagtcattaaattaacaaattaaatggctaaaaactttgttcttgagtttttatttttttttcttaactattttgttaatattatatctaataattgaagtcgattttaattaatcttgtaattttgtaggtttactaataacactttagcagtgttcaaaatacataatctatatattagctatacagaaatgtccggttttgagcttagaacatatccccctgatgagaaatgtgtaagaaacatcaggaatacatgttgtatctgacatgaaagagcaacaaagaaaataaaaagaaaaatatgtgattatctgctatatatcctcctggttatgcatggttttagttctgttccaaagagtgatgttgaacccccaccaaagaacaatcttcccaattcccacaaatgacagcagcattcgtacttagacatccaaccaaaccactcaaactcattctcaagcaatgcaactaaataaatgaaaatttaaaataccatattattttgccatggtttattaaatataaattagaaaaattctaaaccgttacgagtcattcatgttaaaatgcattttcaatcgtgtgctataaattactccctccatctacaaaagttagacatatttcacatttgagtttttccaaataaattgtttctatttgtagtctttattcacttaaggctttatttagttccaaactttttcatcaaacttttaacttttccattatatcaaaactttcctactcacatcaacttctaacttttttattcaaactttcaattttaatcaaacttctaattttggtgcggaactaaagcccaagaatctcagttactacctgttagctcggtacgacaccatttaagaatctcatcagacatctgcagcattttaatttgttgggggtgctaatgagctttcaagatggaagaaaaattgaaggggaaaaaaaagaacgcatctggcatactggatgctcaaaatcggtggaaggctgcacaacgtttgtactgcccaaattagcagcgagcagagccaatgaaaatctgtaaatcccccacagtaataaaggacatggaaatccccaaatcagctgcagcgagaggctctggcgccgtcctcgtcatctccacactactcctcgagtagtccatctgcacatgaacagcttggtggataggcagatcggacggtcgtccacgggtgatgaacgaacagtgtaacagttttactaatttgttgacaattagtaaaaatctattcgattttcaacttttttgggttcaaatttcctgaaaacttagaatttcagtctgccgattcttttaggactctgacatcttcatccttcctcagaagttagcaacaggcatgggattgcaacagtaattagaatagcttccttcactgttcttcgaaaaaaaaaagaaaaagaaaaaaaggagtcgaggacgagaagagagcacaccatcagttttattttattaagatagcagcgagagatgcatcaagcatcaatcatgaaaggtagagtagctacgatcaggtgtttgtaggaaatactctcaattggctagccacagaacatagccctgcggcatgtagtggcagatggcgtcgccacggcttgccttgaggagctcgaagtacgcactgtcccaggtggtggtgttgacgtggcacacggcgacggcagtggcgccgcccaggcccacgtcggcgacggcgtggaggtcgaccctcagcgccaccgcgtcggctggccggtggcagtagtacacctcgtatagatatggcatagggtggcacgccaccacggcgtcgccgccgatccgggcgacgccgtcggccgctaccacgtacctgcggggctccctcccgtgcacgagcgtggtgaccgcgcgcggcgcgctggtgcccagcgccgaggcggcgaagtcgagcaccgcctcgcgggaggtggcgcagcaggcgcgtggctcctcgccgccgccgccggcggccgtcagctcgctgcaggcgcggagggtgtcggcgacctgcgccgccttgtcggatccagggaggatgccgaacatggcgaggatggcgtccatggcgcggaggtcgaacggcacggcgtcgcccttgtccttgtagatgaaccttggcgccgccgcggccacgccgtggtcgccgtgcggcagcgccagcttcgtgccttccggcaagacggcgccaggatgcaacttcttcattaagaagagcatcccgcgctggatatgtatgcctgcagctgcatgaattcaaatatatattccatgaaaggttcgctgaaatgagtacaaaatctacctatatgttcttacctggatgagccagagaagacaaggcagccggtggagtaggaggcgcaacactacgtggattccagtcgactgggtaagcagcatcagtgaattgggccttgttaccatcttgttaacacaacagagtgatgggatcaatttgattgcattgctagtcaatgaaaatagcacatgcatatagcataaaacgactataatatatactacttactagaatgttgagcaaagatgcccggtgctttaggaggtgcaacactacgtggactccattttaccgagtaagcagaatcagtgaattcggccttctcaccatcttgtgaattatgtaataacagaattaattacagggtcaattttgtttatggtttaattaactactagtactagagaataccaatccaattgatgtagcataaaacagtacttacttggagaagcagggaaggtggctggttgtttaggaggcccatcagcacgtggactccacttgactgggtaagcagcatcaatgaagggagcattgccatcttgtcgatcatgtaacagaattaggggtgaatataattggactaaattactagtactagtaaatgggattaaaaacccactatgtataatattcgaggtagaacaaccctgcaatacttagagcatctccaatagcttctccaaatcgaactctccaaacacccatatagccaactctccatctgatttagctagtcaaactagatgctctctccaacagactctctattaatcctctccaaaataacaatggacccacacgtcagcctctactcctcttcttcttttctctcccccttccttctttcccctttcttttcttcccattcccttccctgatgccgacggcggccgcgcgtggtggctcgatgatgcggggaggcgggaggcgagacaatgtcgacctcccctcgagctgccagatctacaagggggcggcggcggagctcggcggcgacgtctcgcgacaatgaccttgacgacgacctggggagacgacgaccttgacgatgctcggggcggagctcggcggcagtggcggcgacggctcgcgacgacgacctcgacgacaacccggggcgacgatgacctcgacgatgctcggggcggagctcggcggcggcggcggtgacggctcgcgacgacgacgacccggggcgacgacaacccggggcgacgacgacctcgacgatgctcggggcggagctcggcggcggcggcggtgacggctcgcgacgacgacgacccggggcgacgacgacctcgacgacgacccagggcgacgacaacctcgacgacgacccggggcgacgacgacctcgacgatgctcggggcggagctcagcggcagtggcggcaacggctcgcgacggatctagaggagggcgacggcgagggcggcggctcgcgatgacctcgacggtggctccctaccgccgccgctgctcgccatcgatttttggcaagcggcggtggtagggatttcagcggcaaagggggagagagagcgagcggatgcaaagaaagagaatagggaataggtggggcccacagatggctagtgagtttggctggccaaatttggctactgaggggaaggatttggccagccaaatggcttggcaagttgaatagagaggctattggagtactttttttttcaagaattgacaaaatttaacttggagagtcttttgaagaggctattggagttgctcttactcggtagatgatgagcaacgaccagcgatggcgtggacggatcctgatctggtttccacttcgccgggtatgcagcatcagcgaattgcccttctccatcttgttatgtcacagaaacacgggttacttaaatgaattgctactgaaaacgacaaatacagcgtagaaatgacaatcaaacattctcactcggcttttctcaagaaaaagaaaattcttactcgtcggcagagtaggagaagccatcttgttattttgtaacagattaatggagtcaatttaattgatgtactacactgaaatgcagatatatagcacttaaacgacgcctgtctgatgatacttactcagttgatcaacacagttattacttaattactagaaaatcggcgtgcttattggcatgcttgcttaagttagcccgtaattttgtgtgtgtggagtatttgtatactgcttaattagaggttatttagaacgtgagaatttttaaagcaaataatccggtacttaaaaagttctatcagcatcatacctttaaagtacccttttagtgtgtttttagatttttttttgtggaatactgaggaaaaaacactgcatcatactaatatacgctaacaaattgatgaaggttgtatattagatgaatagaaaagtgtgttttatgaatatttcatctcacttttataaattcaaaagttttgcctataagctgttaaaaccatataattagaaggaaaatatgttcatgatgtttacacttgctactaattgttttatcttttctagaaatataagataaaaacaaagccaagttatatgtttccaaatctaacctaacgcaaattgtacttatttggattatttctcaatgacttttccaaagcaataaattggtataataagaaaaaatattgcatttttatattttgatttctttatactgcacattcctttttatatatttttattatttatttttttttcttttaaaataatattatataggatgctgataacatggcctatgtacttgccttgattttcactttaatctacagtaaccgtatctgttgttgaggaaatatgaatcataaaaatgacatcaatattgaacgtcgattattattaatttttccaatgtatcacaagttcccaacatataaatatgactaaatatgctaatagctttgtggctgagttttttttttaaactcatggatagctggtactgcagctggttcaggcgttcagttgcacatgcgtgtgagtgcgaatatgcagccggctcaaccggtcagcccgcattctcttgtgtatttgtgcacgcactgccatgggccaaggaccaaaggcggtaagcccattgggctcatttcatggactctgactaggatgccacgctagctatatataggtgcaaaaagttgttgaaaacaaaacttgcactattgacataataagtactgtgattaaatcatatatatttttttataataactctaagatataataattagattaaacggttaagaagtttgtttgtaataagcttttggtacgcgtacgtgccgagtgtttacacgagcggagtaataataataataataataataagcagcacctgctggagtatcatgtccgtggccgacgaacgacacctgcaggttggtgatcttgttgttcgtcctcgccgcctgcgagctgtcgtcgacgtaccggccggcctccttctccaactccgatgtcatcttcgtcgtcgggaagcgggccaagagactgcgcggggcccgggccgtcgccgcgtgcgcgcggcagcagccggcggagagcgccgccgccagcaagagacaggggaggaaggacgacgacgacgacgacgccgccgccgcccggaggctgaagcggcggcgagctgcggcgcactcgttgcccttgcccaccatggtctcgccaccaccagcttcctctagctaaacacacgtactgtgatcaactctttggaaacgaaattgaaggaaagaaagctagctagctaaacgcttgctgctgctgctgctgcgtttggagcgcgcggctatttataggaccgtgagcggcgagccaggcagccagagatcgatcgatcgagccagctacacattatattacacacacgcgtgttgcgtatacgtgcatgcttgcgcagttgcactgcttccgccttgtgaggcagctgatcaggtgagggactcggtcggtctctggttctggctgggtacgtctcgccgtgcaacagagctgcaccgtacgcacttacatatcctcatgcgtgcacgcgtacacgttttcatgctctctacctagctatgttgccatacaaaagtgacgcgacctgcatgtcagtaattaatgatatatatcaagtgagcgacgacaaatgggtttttgaaactgaaaatccagaaaccacatgttatgtcaggctatatatatacataaacgacaaattcccaaccgctatgctatatatacgtgtactcaaatactttatttaattttattactagccttttaaccaagtcagtcattattactgccatgtgtatatatatgcaacacattttgtgctcctattgtactttctcatctcacatctttatatgaatgaagggaaatggtagtttttaggtgactgagatttggtgttcacctgctccctacccattggattgaaatccaacgtttagagaattgtcttcaaccacttctcggcgatggcaacagtgatgaagagatcctcgccgatccctttatctttctcatcgccagagacatccgattgcggtacatgacctacggattagagttagggttttggggctagggttgggggaagccgtggggttttgggaagaaaggagcggtttctcccaggattagggagatggccttctggggtggcctgatcgacgatgagcggcgaggcggcggaggcgctgctggagacgcggagttagaggcacgcaggtgggtagggttggtggcaggggtgagggatgtcatggggtttggaggatgtggtcatcggcagtgaacccgatagcaccacgccgccgccagaagattagagaggaagagagaggtggccggtctagagggggctcgccggcaccgttgatggcttctggctagctagtgagccatggggcgaagtgcggtggcagtggaggcctcagtgctcagtaagaaagcaaggcgtggcgatttgtcctgagtctcatgtgcgtgcatgcgaactagaaaagagaagaatcgttaagggagagataatgagtatgcacaaatcttgatgcgatcctagtcgtccaaaaaagtgactgaaatttttcggatttttcatcagttacattaaagctagacaagaccttatataaatatgttataaagtatacttgtagcatatcttatgtgttactatgatattggattttcccctgtaactcacctgtttatgttttactgggatatatatatgtaatatgctacagtagacatgccctgtagttatgacctcactttatgttgccatacaaaaatgactcgacatgcatgtgaactaatcaagtgagctacaaatggtatttgaaaactgtccatcaagaaaccacatgttatgtcatgctatatctatacatctatgacaaattcccaaccgctacacatttctaaagcaacaaaatgctatatatacgtactcaaatactttacttatttttgttagtaatcttttttaaccaagatagtaactttcttcaattcaaaaattgaaaatcagattggggaaagctgtatataatactctcctaccgctttactctagtactctcctaccgcttgtacactataatagtgaagcgcagcagcagagaagtagccagtattaatgatactactcaaatgtaaatataaaaattatagggactcaattagaaaagtacaaacccaaaaattaaaatcatataaaaatggaatgctctcgaccggtaggttccgtttttgcacacagatctttaatccggcacatcaattttttttcaccaagatatatgagatatcacgatatagattgaaaccgagaggagtgtcctgggatctcggactcaaaccgatgccgaaaggagtggtgtgttttattttccgtttttaaggaggaatccactagaacggataccctcatctcaattgggcggtaagccccatctcaatcgggcatggcggccgtcacaggctagaagtcactgatgtgaagagttatctcaatcgggaaaatggccgtcacggatgattctatctcaatcgggccctaagtaaagcccgtcaccgatagctttgacccagacgaccagtcaaactatagcctgtcacagatgaactatctcaatcgggccacaactagcgcctgtcacagatgaccctgatctgtgacgggcattacctatagcccgtcacagatgagtcatctgtgacgggcattaacccgtcacagatgagtcatatgtgacgggcgttaactatagcctaagttaatgcccgtcacagatgagtataattaaaaaataaataaattttattttttggctagccctcactcgtgtgcacccacgcgagaagttcaaacttaatgttaaagttctttaaagattggcttccgaaaaagtagttgtaacatgttggtatgagtattctattaatcctattatgccctaggccaggatgtcaaattggggttattaaatgatttcaaatggaaaagtcaccaaaaccaaagttgtagaactcatcgaggtgcaaaatttttattttgatcatttctccatttgactctatttaaacaatttgaaatttgaaattcaaagtttgaaaagttcaaatagaattttagatcagcgaacgacttcaactgaaaaagtcatcaataacaaagttgtataactcatcaaaatatataacttttattttggtcatttttctatataacattttttgaaccgtttgaatttgaatttgaaaatatgacaacttcaaacaacattttcaaatactaaatgatatcaactgaaaaagtcatcaaaaacaaagttaaataactcatcaagatctacaacttttattttggtcatttcttcatatgacaaagtgataataacattgttcacaaaattgacatatctcttatctggttttataaactataacacatatatgtaaaatttgtgaataatattactaacattttatcggatgaagaaataacaaaaataaaagttttagatcttgatgagttattcaactttgttgttgatgacattttcaattgaaatcatttagtatttgaaaaatgttgtttgaagttgtcatatttttaaattcaaattcaaactattcaaaaaaaaatgttatattgaaaaatgaccaaactaaaagttgtaaatcttgataagttatacaa

SEQ ID NO: 59094 - DNA, 5908 bp, Oryza sativa
atatcgattgagcatcaacaccttttcaatccttgggaccaatgtttctcattcaactcaatgaaattattggtctcaatgatctggttgtcaacctctacatgttgatcaaccaatcgcgcatataaaaggaagtggatgagtattaaccaatatcacaagtgtcatgtactcaaatgtaaagatcccaattaaatgcaagtgaaaaacttggatcaaatatgtcacgcccagaaattcactagtaatttccaaactaatttgtgcataaaatcctcgtccaggaatcagccgaggtacacaaactgacaatttaatatacaaatccatcataataataatgttacatacttacaaaagaaaaggaaaatagcagcggaattaacggtctagcgatggcttcagctccactcccacaggcagctcaactggagtataagccaaacatcttctccttctggatcctttttcttcaactgaggtttgatgattattgcaagaatgagcatatgacatactcaacaagccacacagcaaatatgcaaatgcacaaggataccaaaggatggcataatataggttcatttgcgaaagcagcattaagcaaacatttagaagtaaatcagtagagtaattaatcatcaattttaatcgacactgaacagcaccccaatgctgcacaggcccaaccaaacctgaacagccaaccccggtcgtacagatcaaacctccaaaccaggaattatccattccaaaccaggagtcaaattaattatcacattattaacattaatgagtaatgtgggactaatcacgaaaaacattgctcaactcacccataaccgcggacacggctattcgaatagttttactttgatcagaggtgtaccactgtacccacaagacgcaatcccacaacatgtcaccatgcgccttagcaccaccacggtacctcggaaaggaactgtgacaatacccctcgcacaacacaactcaccacagtgcaccgttcctggatcataatctccccctcaaaaccaaaggcaatggactccccagcgacccccatggacttctcgccgcttcacagtctggtgccccgtaatgaatcatgctatacaaaaggtaaagccgttgctcacactggcttgtggttggcacggtaaatgtttcacaacagtagctcgcgaaccggtccttaattgtcatgagcacgaccttcaaaaccatgtgctcacaacccaccttaatccagttttaattaccaattaatttacataacataacacgattaaccatcgtgagctaccattaaatataaccgtaattaataataatataatatgatttatatttaatcccctttaattagctaatgtttaagcatgactaagcaaacatacatatggcatttagctgaaccaatccaatatataaggtccaagctaatcaaattataacccataggaaaataaagtcatgttcggccattatttaattgggaaaggctcatcacccgatgacattcgaaaataatgcataagttgaaataaatcattagctttaaacgggttcaacatgttcaaagggttgtttgggatctgggtgacttgccttgagcttccgcaaacacttccgaaccttcctcaacgaaaacgctctcctccggaacgacggaaactaaagcaaatgaacaaaatcaacaaaacagtacaaaaacaatcataaacagtacatgtggatatttttaacatgtagatcttgattttagaaaaacttagcaacttgaaccactcgaatcggagctacgatgaattagttatgaatttccgaagttttaaactatttgcatctattaaaaaaactaaaaagaaaaggttatgacgtcatgctgacgtcatcaatgtcgactcgtcatcggcgacgacctcgccggcgctaggggactcggccggacttttggagggcacctacgcgtagaggagaacaacgcgatctcaccggtactaaccaatgcgacgaacgaccacggatggcgaccggcgacgagcttgtgcggcggcggcggttcggtggacggcggcggcggctctccggcgaccggtggcgacggcgaagggcggcggagcttcccctcttccacgcgcacccgacggcggcgtgaggaggcggcggcgacggctaaaacgacggcgcgaggcggctgttcgccggccggcgacggcggcggtttgggtggcgcggcggcggcactacgaggcacgagagagctcgggagatggggcaaacgaaagagggcgactaggggatgctatttataggcttggattgaagagatcggactccaaccgagaggatttgagccggaaaaaccgagggttagttggagagataaactcaaaaacgaattcgattccaggcacaggacggctggctcaggcttctgtccaagcttgaagatgaacagtgcccagggaagcaaactagactttcggctgggcttctacttccaaggactgattaaaggagggacacaaagcagacttcgggaaagagagggaaaggactgcaagctgagaggagactaggccgagagtgagaggactttccctaattcggcccgaaaaggaaaaggtgaattttaattacttttccaattaaattaatcactgaaatgatctttgaattgttaaaaatacttccaatgctcaaataatttcaagaaaaatcctgaaaatacttggacactcaaagtacttaacaaaattataatcagaccatttaatgattaatttaatatgtggataattactgaattgttctttgtatgattaaaattaagagttgagctccaaaaaatccgagaaaattccagagagtataattaaccatggagaatttaataaaaattaaatacatccatgctttatatttaggaaattttattttccacaattaacttcacttgtaaattaatgaacatttaatataaattctaataataatttattaaataatttataaatcctaagacgaaaatcaggatgtgacaaaatacatgcataactaaggtataggatttacccccctaaatgtatgcatacaatttttttgtgtgtgaagaaaaagtatgcataactagagataaaacatcgtgagcttaccctatacaagaatagaaggtatttatcatatgtagacattaaggtagaagcataccttcatcatctccatattctcaatgtgaagagactaaacaagatatggctcaacaaaacattagtctcaaatccatatgtcaatcacatgaaaatattatatatgaatatatcaatatgtgcatagagagaaagatgtgatttaggtcaatgcatttcatccttgtgatttaggtccacgaacaattaacatttctatttcaactcatatgaagtccgggaatcacctatcacaaacttcactttcatatccacatgacactaggcaaagaatgcttataaaaaaattagtctcatataattggatttatcattaatcaccaaaaccaaattaatagcacttgaactttcaaaagggaagaggttttgccttacatattgatagagcagagttgagggctgagcctcagaaaaaaaatatgtacaggacatggtcaaagagagctaatgttgaaaaaaccttgaatcttatggcttcattcatagagataactagaaagaaccttgaatccataatagagttgttgaaagactcacacatgttgttatcagcggagtcacaatttgacactagctggaagaatgccctgctccaatgctcaggtgtggtggtcatcatgtccttggctccttgaggggtgtcttgtgctagctttgctctattatagttgaaaagctccctacaagatgactttgcacagttttagatttttttctgaagcttctggtcagtgtccttttttctccagtttgcatatatttgccttgcacacatcctatgttctactctagtgataagctcagccactgcctttatgagtccctacaagacaggtaattcaaaatatttattacaacttaggacccattgcacattttgttaaaagataaatagttaaaaagcataccttttactggtcagaaattatcacccatccttcacctccatcatttatattgagatcttttttagctacccaagaaaccaataccatgaatcatatatttctttctccactgatgcccatgcaatgggatacatctaattattagcatctcttccaatagcacatattagctcgccattacaagcacccttgaagaaacaaccatctagcccaattactctcctacaaccagcaagaaacccttttctgcaagcatcaaagcatacataaaacctctcaaatactttcttgtcaagtatatctggattaagggtcacaactacaatactcccagggttgctccttaacaactccaattgataatcatacactcttgagactctcccctagttttatccaatgcttcttgtagcactaaggctttggcccgcttgcactttgaaatgggcacatcaacaagcatgtcctttagaactgacttcttaatatgttccactttccatgtcggattatccttgataacatcaaaatatttatttactatgatcctggatgtttttttttgaagtgaaagcggcaaaagatttgccggatatatttaggagattagaaagccaagtttacaaagttgagattacaaatatttcttaaaacaaccaactctagcaatgagtacaggactttctcccttcatggaggtttgaaaaccatatcctgctcctgtatgtcgtcgaggatgagtgatattgttctttgtagacttggggcttgggaattgatttttttttccgttttgttgcaaccaaacatgccaccatgtctttaacaggattccgatccttgacctggtttggcttttaaggccagtggaccctagagaacacatccactgttagtggtggaaatgttaggattgggaataatccctttttcagcggcaattcttgcccatacctgcttgatgaagttgcattggcaaaacagatggtctgtatcttcaaaagcttctctgcataaagtacagatccagtcgcattcccagtgtctaattagcaggttttctgctgtaagagccttttgatgaagaatgagccttccaatttaggttgaaaatatgatcaatcaccgaacccatgaattggaagcggcaggcgcttttaccgagaagattcatgaggcatttcttgtccaagatatttcatcatgatgttgatcagaaagagttatttgattgaggagggatcccaattgcactaattcatggatggtttctatattagtgatctgtctaaaagaatgtagccaggtgttgtctatcatttatgtttccaccttcctattctttatttttgccaatttgaagaggttgggagcaagatctttcgggcacaaacctggtaaccaattgtctttccaaaaaagagttttttttgccatctcctactgtgatttttgtgcatgcctggaagagttgtacatctcgcatattgcaaggcatctccatcagctcccaaggtctgcttgtatcaaacagccacaaccatcgtagcctaagcgtagatgtgaatttttccatttcgagaattcccagccctcccatgatgatcctggatgtgactagcttgttatctctcctaggtggacaacaatgctcattattaaaagtggccacttggaaccatttagacctacttgtctttgacacatatattagccatttacatcctggtcaatagcaggttgccctaaccttgtccctttcatcctttgggaatagaatat

SEQ ID NO: 59095 - DNA, 20085 bp, Oryza sativa
  unsure (1)..(20085): unsure at all n locations
taaatttccaccatagtgaaacctgaccggaagaaaatccgatggatccattcttgcaaaaataagaaacaaaaataatcctaactcttgatgatattaaatgacaacaactagcaagatcatacgctatatattatctgaggcttctagcctcggttagtcttaaaaaaaccaaagcaagatctacacccatagagcaaatttatgtgtcctttggtaccaacgtatgagctaatttttgtgttcataagccctaaatcctaaaatcatcaagacgataaaattaccgagaaattcacagagagtgatgagaattttactgcctacaacatagcactatcaaaatttcacagaaaaaatacataacccaccactaaaagaccttgtagaattagccctaatccttgaagagataacctgattgggaaaaaaaacatagaaacaggttgtggagactcacctttacctcaccctgcaatccaatcaaatggatctactccctgtcatcagcaggttgttcgcctaggagagagagagagagaggaggttccaaggagaacgaggagagaaccgctcatatttttattcaccccatcccccacacgcctgtcgatccactgtgccaggctggtcgagcgtgtcccgccagcggggcaaaaccagagtgcaaaaccactgtatggtattaattaaactgtatcaacaagattagggggttaaatagctggtttattaggtgagggggttaagtaatcacctggtaataggttggggggttatgttgacttaggctgtgttctttggtgagggttgggaaccctccccatggaaaacggagcgatggattagtgcatgataaattaagtattagctaaaaaaaactttaaaaataggttagtatgattttttaaagtaactttcctatagaaaacttttcaaaaattacaccgtttagcagtttaggaagcgtgcatatggaaaaggagggagtagaggttgggaacaaggaggaacggatgcagccttattccttttataaatatacacttagacaaacaaatatatctttttcttagcgcaagtgatctaggtgagatccgcgccaaagaaactagaaccaataacctatttatagaacaaattttatgaaaaaggttgaaatgtaaatactttttcttacaatagaccattaccgcaaaagagacttgcgctaagggcatgttgtagtaaaatatatttatattttaatccttttttaaaaaatattctacaaataggtacttatgtttcagtttttttgacaccgactcccttaacgtcagtgatttagctgccacagaaggcgacggtgttggtgccagtgcttgatgctaagacattgaaccttggcgctaacaactctagttggagaaaaatggtccattgctaaaataagtattttctagagatctatttgcaaaataagattttaaaaaggggtaaaatgtagaaaatccagacttgttacgctttgttacgctaggagccaaaggaaaagacaagcatgggaggccaaagcatgatctgtgacccaacgaccaagttggatggtcaatgcagccgggcaagaaatatggaaaagaagatttggaaaacatacttgaaactcacttgcagctgaattgttcttttgatgaaggcgaagcaactcgaatttcaacgcagacatggtcacaagtcagaacagaagcacatgtatggagcaggtcaactttacctactcggaatcttccaagtaggactatagcgacccaacagcaacgatatctttcatttctaatcattatctcatctaaatcgaaaagtctaagaacaaaagttcaaactgccgtctaacctcatcgagctcttcctcctgttcgagcgcagggcgatcgatcgagttgggaaacttcgaatcaatcgagagcgtcgccctatcgatccagtcagcgacgacaggggactggactaggcgattcacccacgatcgatccaccgggtgacgagtgagtctcatcctctccgagcttatcttctttgtcagtaccatccagtatccacccagggaggaggacaagatcttgatccatggagttggcgacgggtgcactgccaagcgtcatcgccaagctaggtgatctgctcgtcggcgagtacaatctgcagaaggcggtaaagggggagatcaggttcctccaatccgagctcgagagcatgcagggcgccctcgccaaggtctccgccacgccggccgaccagcttgatccccaggacaagatctgggccagggatctcagagagctctccttcgacatcgaggacaccatcgacgcgttcgtcgtgcgcgacatcggcaacgacaacggggacggtgaggccaaaccacggggcatcagcaagctaatcgatagaagtgtcggcctattcaggaaggccaaggctcgccatgggatcgcctctgagatcatggacatcaagagccgcgtcgtcgaggttcacgagcgtcgccgcaggtatgagatcaacattggtgctggtggtggtgataagactgctacaattgaccctcgtttattcacgcggtacacggatgagaaagagcttgttggcatcggtgagacgagagatgagctgatcaatattctgacggaagagaatggagtgtccatgcagcgagcaggcaaggtggtttccattgttggattcggggggattgggaaaaacaactctcgctaatgtagtatatgaaaagattagatcactgttcgattgttgtgctttcgtatcagtgtctcaaactcctgacttgaagaaattgttcatggacatcatttatcaacttgacaaggagaaatataaagatctcaatgaaaaaccattggatttggatgaggtgcagctcatcaatgaactcagagaattccttcaacagaaaaggtatatatggaagcacattccttccaccaatctgtacatatatatgatgttttttctcagcaactaataatttgctagtatgccatccatttcgtaatacttcctccgtttcacaatgtaagtcattctagcatttctcatattcatattgatattaatgaatctagacatatatatttatctagattcattaacaccaatatgaatgtggaaaatgttagaatgacttacattgtgaaacggaggaagtactaattagcagtctacatactgttaattgttgagaatgttcatcatgtccgggttaaataaaaaaaaactacaactgcttataagcctttttacatcgttattgagtcggaattaaatagctatgtccaaatcttcttttcttgagtgaataatttatctctgttttggcaaagattcacaatagctagactagttttgcctacgaacttgctaatctacctggccccagtatttgaacttcccgttctaatttcattagtttttttcctaattaaggacttaatctatatgcaggtatttcattgttatggatgacatatgggatatctcaatatggaaaatgattaaatgtgctttgcctgataatgatgttggatacaaaatcattacaacaacacgtatttctgaggttgctgaaaaagctggtggtgtttacaagttgaaacatctttctttaaataactctcgacgattactatatggaagaatatttggtaactgtgaagacacggaaaaatatcctgatgaggagttggctgaagtatccgagagaatactaaagaaatgtgcaggtgttccattagctatcattacaatggctagtctgctggcttgtaaagcaagaaataagatggagtggtacaaggtgtacaactcggttggtactggtctcgagaatagtctggatgttaagaatatgagaaagatcttgtcatttagctattatgatctgccaccccatttgagaacttacttattatatttaagtgtgtttccggaagattacaaaatcgaaaaagatcgtttgatatggatgtgggtagctgaaggctttatccagtgtgggaaacaagggaggagcctatttgaactcggagagagttacttcaatgaccttgtaaatagaaatatgatccaacccatatatgatatgtatactgacatggtatctgagtgtcgcgtacacgatatggtcctcgatcttatctgctcattgtcaagtgaggaaaactttgttactatattaaatggtagggatcaaggatctctgtcatacacgattcggaggttgtccctccaaaatggcaatgaagatcatgctatgacttcagcaactcggagcttgcagcaagcaaggacagctcttgtctttccatctgccactgatctagtacctgtccttaggagcttctgagttttacgtgtactggatttacaaggttgtgatctttcacaaggttacagccttaagtatgttgggaatttatttcacttgaggtatctaggactacgtgacacagatattcgggaggccccagaagaaataggaaacatacagtttctacaaactttggacctgagggcaaaccctatttgtgacttgccactgaatattgtgaagctcagacatttgacgtccctatgcttcgacgggtttgcgagggtgccagatgggattggaagcctaacaaggcttgaacatctagcatatgtgttgatcgattgtgctactgtgggcattctagaagagctgggcaacctaacggagctgagggtgctgtgcatcatcttctgggacggatggaacgacaaactggtgggtctcctacacaagttgcagaagatccagcgtctctccatcgacgtctgcatgaacaatgttcgaaagaacatgggtggtttggacgcctgggtcgcccctcggcatctcgtcgcactggatacagagaagatctgctggttctcgtcgctgccggcgtggatgacgaatccgtcgcatgtcccaaacctccgctcgctatccatcgccgtgagggagatccggcaggccgacgttgagaccctcgggaggctgcctgctctccgcgatctgcagctgcaggtggaccacgaggagctcggaatccgcggggtggtgttggtgattggatcagctggctcgttcgcgtgcctggtgtgctgtgggttgtggggattcgttgggccggcggtgttccggcgaggagcaatgccgaggctcagaacgcttcgctcccggttctccgtgcgggaggcgatcgccgtcgccggtgccggcgacgatggtctcgacttgggactggggagcttgccatcgctccaggaggtcaatgtctcgttggattgtgaaggcgccagcgaggaggaggtgaacgaattgaaggctgcgctgaggcgtgccaccaagatccacccgaatcatccaagcattagcattgacggaggtacatgtgatgcttgctaagcttgctcctaattgattcttgtcgatcttttgccctttcttattctgacgttaattaattgatatttcagatggccaagtttcagatgacgagcgcgaatagatggtagagtatagtactagcatcgatctaattatgcagatcgccaaatgctgttgctatccatctaaatcggccaagatcgcaatatacaattgtcctctcctcgatcgccggagaccgctgtcgtcaaccgcctcactgagtagccaatatgcagtgccgcggtgtttcaggaagtgcatgcatcagtgcatggcaatcactcctacaaatctcttgtgcatttaacctgctggacgattgatacggaagccattatattgtttatgataattttattcctctctaatcaatggttcgtattgttccacatctcaattctataacatacctcgttaacgtaataaaatttctcataaagaaatagtgcggtcacaccgcaaatggtactgtcgcgcgtcgctgcagtatatttaaatagaggttagcatgcagctacgcctcctgttcctcgtctcaacattcaccaccagttattaaaattttgtttcttgccccccaccggcaagcacaaatctcatccgaaatttttggttctttttcttttttgaatttagtcaaagtttatttaaattcattaaaaaaatttcaaattttcaaataatttcggccaagaaatttctaaaattttggttctttcaagaccaacaccccccacaaccacccctccccccggcgccaaaaacctaatttcgagattgcaaaccctgttcaccaatcaccacactaacagaaaaagaagaagaagatacatacctcatatcaatatatcatacatggcacatcggctgtgcgctcggcatggtggcggtgttccatgcggcgccgcaccgcgtggaggccaaacacgtcgaccacagcgtgctcccgagcgtgcccaaggcttggtgccccaagccgctcatggtggtggcccccgccaacgccgggacctacccggtcgccatcttcctccacggctgcaacatggtgaacagctggtacgagcagtggcggaagcaggattaaaataaagataggacggagaatctatggatacaagcggacggacaagcagatttttttagcccgtttatctcacttctagttcattttttattctaaattttgcactaccatgtaagaaatgaactagtaaacaggtttttatacgggtaacgggactacccacttgtatctctagcggagatggtcgtttcataagaatagctaaacacactaaatatcatatttatactataatcacatagaaatatagtgtaaccaataaattaagggaaacaaaaacattttaaaataaattaataatctgtgtcatatatgattcattatacaacaaaagataatagttgacgtgttaagccctgtttggttccatgggctaatgtttagccctcaaggatccaaacaggtgggctaattttgagctaatgtgaattagcccccctcaaaacattagcccctccaaggggtgctaatggggctaattttgtgtggggaccatcaaaaagcagctctctctctccttctctctcctctctttctactctctctccaccttttagccttgaattagcctatcgatccaaacataccaccctaggctaatgttgagcctaccaattcatgactaaacatgagctcccaacattagctctgggctaatcttccaaacagggccttaatttgcaaatattagacaactcataaagccaagtggttcaccgttcagacttgatggaagtaatcaattgattagtgattagggctgtcaaccaggcagccagaacagtaggactacatcctgcatgagccaccgagccaggaggaatggagtgagcggcgttgcggcgccgcgacgggaccgtttcggctagtgcgcgggagcgcgcctactccctatagggctagcacctaccggcatgctggcgtcgctgcgtcggcgcttggtcgactcggtgtctcggtgaaggctgaagggggaagccgcgaaggcgaattgatggtgtggcgccgatccaggtcgaaagaaatgaggcgtcgctcgcgtgcggcttatgcgatcggcggttagactggtcactagcgcttcggctgctcattttgggcccaatgttgatagagccaaggagggtggggggtggggcggtgcgggccgtagctgggtcggccgtccaaccctgcccaatgggtggatccgcccctaggtacgagggcctcctgtcgcatgtcgcctcccacggcttcatcgccgtcatgccgtagctctacggcatcgcgctcgacttgaacgatgccaccaggaaggttgcatgctgggccgccgacgagcggcagggcctcgcctacgtcctcggcagcgtcctcaacctccccggcgtcaagcccgacctctccaggctggccctcgtcgcttgaccttcaagccatggtccctccacccggggatgccggtgacggtggggcggagcccaatgggccaggggggtgctcaagaacccggcccaaaattctaaatagcttattacccctatattctccaccatatagacagtccccagtccaaaccagggaacccccctccccccaaagatccaaaactctggcccaaaactataactctaccaggcccaactgagaggaggatacgagaattcgctcgtgtttcccatagatcgatagcgcgcggcagaggtagggctgggcggcgacgggaatcaaggcgccagggcggcaccgtttcgagttcgacgtttcctcttccaaaaatcaaaaatcgctattgtttctcacctctcgttctatggatgtgacgccgtcttcccgttctgcccagcccactgcggcacagcactgcgccaatccggccgtgccggcgtgcccgagccagacaccggcggccagctgcctagcctgagccctgcccggttggtggctgccctgccctgccagcctgcccttacagccttggcgccttgctgttgccgaccagcccaagcagtgagtgaagcagaagcagcccaactccaagtctccaacgccggccggccggtaagtcttgcgtggttgcaccctgccgctcccttcttttaattttgcaagtctaccaatgattaggttattgtttgttgtttgcagtcaacggaggggattaccggagtagaacggttgcaagtgattgtgcttctatgaaaaatcacagccgttaaccaacacttaagctctgttcgggagtgagggttgaaccctcactctctggaacacaaaacgaagcagcgtttagcacgtgattaattaagttttagctaattttttttaaaaatggattaatatgattttttaaatgaactttcatatataaacttttttgaaaaaaacacaccgtttagcagtttgaaaagcatgcgcgcgaaagatgaggaggaggtgttgggaactacccctaacgaacgcagccttagagtacgtgagcgctttctctcaactttcatatttaatttgttgtatcaatataaagcttgaaaatttttatttgatctctaaaaggtttctatggagaaatttcttaaaagaaaagtaatggattgtaccaacaatgtgaagagttcatcccttcgactagatgatgccaagagacgatcgaatatcatccaggcttaagaaaagaaattgatgattatcatcccaaccaaagagacaaggtaaaaagaaagtacttagagaatgggtcttgccaacctcgtgatcttgtacttcccatatcagttatttccaacaaagatggaaaattcaatccggcatggttttatggtacgcattttttaaattttttccatgcactttcttgttgtatattgccttcaattagacagatgatgcttatatgtactgggtacgtaactatttagtataatatcgttctagaactatgcatgtcagtattttacataaagaaagttagagcaaggtcaatagtgtcgcccgctaatggctgcaaaaatgaccacatcagcatagacattgctaagagctaatgtatacaataagcaggtttacatggactattatccaattttttaatctttagctagcttcctcatccaattttttaatcttgttgctgtcgtttcgtctcgccattcctacatcacaccagctcgcgtggaccccacaattgcatgccccagtcaaagctagcctagtgttgctgcacttgcgttgggatgtgtgtgtagccggtgataatttaatccccgactcatgctctctcgtgtccagctcattgacaaatccgatgtggcagttttatcgtcggctaaactagcttattgaacttgctcttaggaaccccctcatatttctctagctccgcccctgacggtgatggtcatcgcattactataaaatattaaataggtatcggcacatatgtgttgaaagtattaccaccgacatctataccccttttccatctctacggtctaaaaacacaaaaaaatcggcaccggcctaggcccgaggcacgtcggcggcccgccatgcgcgccggcgggcgtgaaccattgcgagttctacgacgagtgcgcgccgccgcgataccactttgtgctgcgggacaacggccacctggacatgctggacgacggcgtgccgtacgccatcaacaactgcatgtgcatgaggaacctcggggacaccaaggaggtggccaggaggaccatcggtggcctcatggtggccttcctcagggacgcgctggaggaccaacacgacgacctcaagctcgtgctcaaagttggcgttaacccgggcctcgcgccagcggtcatcaagccggttgcttacgatttggcttgaaatcacgctcgcggtgattaattaattatcgctcattaattaccgttagtaattaatcactttcgcgtgtaatcccataaatcctaaatgtatttataaagcacatcctcgttaagtatagttaataatgtttgttctctattctcttatggtatcacatcacattaattatttttagtctccagatggttcatcacacatcatcttaattatttttagtctctggatggttcatcaggagtgataattgactatctatctattatatactaaaagtccattaaacttcctacaaacgctctcaaaccgccacgtggcatcatacaaacgctccaaagccaaacttcctacaaacgctctcaaaccgccacgtggcatcctacaaacgctcctaagctgtcacatggcattctaataaataataatagaaattcttagaaattctaagaaaaaaaacaaaacatctggccattggccatctgttttcatttaaatcggtggacccattatttcaaaccggcagatttatctaaaatatctttccacatccacctccctctcctcccacacgtaactctttccctttgtacgtagtgacgtaccgtgcaaaaaaaggttataaatgtacgtgcagcccatatatatctcctccttctctctacaccctattttatagctagaaatttaacacaaacatggtaagttaaatggtcataatttaatttagaattaaacttataacttaagatcaataaaatccaaaatattctaaaaaaataaaagctaaacatcgaaccattgatttacgcatgtacgggtgaattattatttttaaccattatattagattagatcatatcagattaaagtaattaatccatctcctaatctcatccttatttgcaagagggaaaaataaatatataacaattgattttcgcatgtacaagtgaattattattttgaaccattagattagattagatcaaatcatattaaaataattaatccctctctcctaatctaatgtgtatttgtaagagagaaaaataaatatatgctattcatctggagaaaatatatgtatgtatatatgcacgtacaggagagggaaaaaaaacatgcatatatacgtacataagaaaaactattgaccatgttttcctaatccttaaattagaggtcagtctaccctctgttgtggctcctttctctccagtttatttgctagggtattctatgttaactatattttaataaaaaagagaccgtatatttcttctgacataaaacgaacgctaaaacagtcagatttcatagtacaattaaaaggagatcactatggttacgaccaaacaaaatgcaacataatttattaatatgatgatgtaaacttaaacaaaattaacttggttaaaaatacaaaacaatatttaaattttgaaaaaaacgaatgattaaaattacactccagtataatataaaatacaccctaattactgtgtagtactctataattataaattataaatgtaaatgcacattgagattttgctaattattacccctctctttctgcactttgacagtcgcgtggatgcctagcatctaacgtttctactggtcatgtactggtagtagtagaggttggagtagtagcaatagctcagttagagcaggtacaatagcatgctataagccagctgcaaatatattttaaggagataaatcaggagagagaagagcagcaggctacagatttatagccagctgtagtacggactccaagacacagtgtgtctatgacaggtgtgactaggtattaatagtgtagtatgtaactattgtatgaatgagctattagattggcgatagatgaattaaagctagtagttggctatactattaaacttgctcttaagaacgcagttagtgtcactttttacatctctccacattctaccacatcgctaaatgctatagcacgaatctcaacattaaaattaaatttcactttaaggcacctttctattactgatattttgctttgtaccaacctttaaccaatacttttactttgcataacatatttttaccactgtgattctttggaccaacctcaacgcttctatccatctacatcatacatcaaaaatatggtattacatataactgtgacagttaattgatcattagaagccaacataaccgagatcattaatacgtaccctgtccaaaataaaaatattggtttaagggtagtctaaaataagactttcgtaataaaatatggcccaaagtgaaattcatgacatatatatagcaattctgattaaaaagttatcacatggaacaatattctaaccctttttatgtctttcttatctaaataatcttaacaattactccattctttttaagaacgtactgatagtggatattatattcatttacaacccacttttttctatagaaaattgataaatatgttaactatcttttgaataaaaaaatattaaatgaaaccacattctatcaatcttcatgttattataaattgtcttaacaatcagcacaaataaacatgataacatatattgttccattatatattaccccacgaacatgcatagatgaattagatcaataatgaaaaaaaaatatcaaaactcatattcatatgttcatgaacaattacttctcaagatcaactctacatattttcagaagagataattatatatgataaaatttagtggaccaattaacgccataaacaagtgtcactctatttcataaatggactcaaaactaaaaaaaaattcacttccatcttatctatgtgtcatcccttgaagggcgctaagcatggataacgtagtatactctgcttctgtagaaatggcgggggcatgcatatgactgagtaaaggtgaccctggtgagaggctactattcgcaataaagttcaactagcctacttatcgatgcaattctttagctgataatgaattaagcgttaaaattatgctccacactgattttgaggagcacggctatgttgataaaggacacatgtttcaaggcataagagaagaaagccttggtggctactgtcggcttcacccattagaggggcatttatatctaatgttaaatgttttatcccatgaattggtaggagcaatacttcaaaatatttatacatatatttaaacacaagtgaggcatgaacaattaggtatgaagtacagatgatctttttgttgtattaatgacatattaagtttgttttcttggatggatgtaatcccatctattaaaaaggcacacaacttataatacaacgataataaatagtggtgacaggcgagtatacatatatctgggacatagttatttctgtttgaaaatgaaagatactattgtcatttagtatatcaaaatttgtggtctagatatttattttcatataattataaggtgatctacggtccttataattaatcaatatggcgagatgggatttctttagcattatttttataaataataaataagcggttcttataattaatatagtgaaatacaactttttttaacaatcttttatatataagttgcccgcgcatctgtgcgggcttccttcctagtttgggaaacaatcatagctagattgttggatgacactttggggaaagaaaaataaaaaagcaaaggcaacctagaaggattaatattttttttacacatcagcacctctatatactaattaaggatgaacttctgcaaaaacgattaactcacatgtaaaactacaacccaagccaaagtttgtactactgtacatattgagttttctgagattttctcaataggaacaaagaaatatgaaattaatatggaattgagccttaaaaaatagcaaaacttcatgagaatttcaagaaatttgggagatctcactcaaatatttgttgtcaatggacccatgtaaattacaattagcacgctcattgttataaaatttccttacgttcataaagtgttgcagaagcttaaatggtcattctgtattaaatcaccatgttgcacatgagcaaaatttaaaagacgactatcctagagagagagagagagagtaacaattacaaaaatgaagtaatgtgtaatttgattggattactaccctgaccctgttatggcttgatcattcatcgcccaatcagtggatcggtatatgcacttgctctaagcttgctggaaacaacaaaaagaaaagagcacttatattacaaaaatgaatgtggagtaaatcaaacggaaagggaacctaatgttgttcatgaacacgcagaagccttcgtatcttgtgctcttcccataggtggagaccaaatgttggctaaatcagccggctgttgtcgcataggaaagcggcttcgacttgtgagaggcttatgcaagtgagggaatcaaattggctcagtgactcagtgtagacggtgcaggaaaacgggcagtgttgcacacttatataggaggaattgagagttataaagagaatcaatgagatttatcatgacaccagataatggcagtttctggtttacaattgttgaagaggaaacaaaccatgatggagacgattagcatggtttgcatgaggaattgcaaaagacttatcaaaagagtaaattgaattaactatggtgtctttcccaattcatggcagaaggccgacgggaagatgatggggttcgactggactgaaacatccaattgggccttgttttcatatatggaaaaagtacaccgaaggtccctcaacttggcaacgggataaaaatcatccttgaaccacaaaaccagatatgctgggtcccttaactatataaaaccggttaacaggggctcttcgacggttttgatcccggttttgatctacgtggcggctgagtcagcgtgggaccacatgggccccacatatcagctggccacgtcatcaccctctccctatctcctctctctctcactctactgttatcttctggcgactaggcaagccggccggaggcgacggcgcagggcggcccaaggggcacctcttcaaccgggcaccgtcgccgctggggaaggagccgtcgccgcaccagaatggtggccagagcaggcgaagcggcgacggtggcgggcgagcacggttgcggagaggcggcgtcggcgggcgagagcggtgcggcgtcgacgggctggaacggtgcgacgtcggcagacgagagcggtggcggcggagggagcgtgcctgctcattggcggcgtcatgggcgcgcagctcccggatctcgtcctcccacctctccaccctctcctctccttgtggatcctgtacacgccaaattcacaaacaaaccagattgcatcgattgattatgctgctcgtcatcaagcaaccaaccaaaccaattattttattagcgggtgtgtgtgtccatggccatggctatggatggtggtcttacgagcagaggcggtcctcgaagtcggcggcgaggttcttgaacagcgcatgccccgcctccagcatctccgacacctgcattggcattgcaatctcatcgatcgatgaaaatcagaatgacaaatagcgaaattaatgaatggagagaggtggacctggcgagtgaaggcgtcgatggcgaggaggattcgctgcacgtgctcctccgtctccgccgacgccgccaccacctcctcctcctcgccgacggccatgtcgtcctccgtctccgtcatgggcccggtggtgatgttgacgacgaccccggaggaggccgccactccccctcccgcgctcccctggctcaccatctcctcctctccctgtcctccgttgctctgcacgcatccatccattcatcccaaaactcagatcagattgagccatcaaattttcgacccaaatcaaaaatcaaatgcgcctcaacaactgaactgattgagacagtagatgaaatggaacaagtcgatcagaacggaatcgcgtggccttggttccatcaaagcaacgaacgcagctgacgaccgaatccaatcccccacaacgaacgcagctgcctggactcgcgggccacgaccgcggccgcctctgccccatcgattcccgggtgcgctcgccgccaacacctcacccgccgccaaccacgaccgcgcggccagccagccccgcgtgagcgccgcatccacgaccgcctgccgctggtctcccgccggtccgccgcctgcgccaccccttccccatgccggagagtgagatcggggagggcgagcccgccaccgtgttcgcccgccgccgccctccccttctcccgtgctgcatcgtcggccgtaggagagaagagtgtgtgtgagagagaaacagcagaaaagggagaggagggaaaagagatactgacatatggggcccacgtgggtcccacgctgactcagccgccacgtagatcaaaaccgggatcaaaaccgccgaaggacctctggtgattggttttgtatagttaaaaggaccccgtatatctggttttgctgtttaaggatgtttttgtatcctgttgacaagttgagggacctttggtgtactttttccttcatatataggcctggtagtgaaatgaagatctaacggtggaataagttcatctgaggtgccttaacttgtcaacggatccaattttcgtccttcaactagaaaaccagatacaacgggtctctcaattatcaaaaccagtgcagatgaagtccctcggcagtttggaagacggttttggctgacgtgacgcctaagtggctaatttgactcggtctccatttgacgtggcatcgacgtggcgcttacgtggcaattcgattcggtaaaaacaataaaccccgtgggacccgtttcacacacaaattaataaaaaaatggtggggcccacatgtcattctcacccgttctcttcttcctcctctctacccatctcccctctcttcccctctcctctctctaggcgcgccgagagggagaagcgcggcggctgccggtcggcggggagaagggcggggcacgacaaaaatcgatcggggaggccagccggcggggagaagcgcagggggcgacagccgggccgctgatgccagaggagctgtgcgcggcggcagacgggagatgggagaggagggagcggcggccggagctgcgggccgtcgtcagactgcgggtagacgatcacggcgctggcggggtgcctgacgtacatcacgccggggagccccaaggcgagaccggccaaggactgctgtgccggcgtgaagagcacgctgggtagcccggccgccgtcgcctgcctctgcggcgcgctcggcctggacttcggcatcaagatcaactacacccgtgtcgccgccctccctgccgcctgcggcggcaacttctccgccctgagcaagtgcaacagtcagtacaaccaactcactccgatttgtttcttcgtctctgtttttcttcaaaaattttttcgctttgttcttctttttgggtgactatggttagtaaaccttttacatttccctttatatagtagtacctagttatagatcaattttatagtttgtctatgtatataattcgatctctttttccttggcagagaaatttcccggcgcctctcctacgggaggtaaagcaaaatcctgaatccttgtctgattgttcttgtcgatctgatttgaattttgatgtaaatgatcaaataaaggattcaatgcctaattatcctcagtttggatcccactaactgaaatttgtccccgagcaccgtcgcagcctgacctcgtaccacgccgccgccgccgctgccgctctcgccaccggtggcagcgcctccatcagcggctgcacccccgccaccctcctcctcccccaacgacaccgccgcgcacaccaccccccaccctcctcctcctcctcccccgtagcgacgaggcggaggacacggacgacgatgccgtggtggcggcggcgcgaggcgagggcttcgcggaggcaagcgagagctccctgatgactactttgctccgccggcgccggcaacacgcctcgcggagctcgaggaggaccacgcccgggacgcgctcgcggcggaggcaggttcccagcggcggcgtgttgctggaagaagggaggaggaaggatgagaaagaagagaaaggagagaggggatagagagaagaggaagaagtgaggatgacatgtggggccccaccaatttttatttcctgtgtagctgacatgtgggtcccatggttttatttattttttgggatcaaattaccacataagcgctacgtcaatgccatgtgggacaatgacctagtcaaaggagccacgtatgcggccacatcagccaaaaccggatacaatactgtctaggaccttatttgcacggttttgtaagttgagggatgcgttgtatctggttttgcgctcaagggatgaatttcgaactcggcgaaaaatcgagggacctcaagtgaacttattcctctaacggttgatctttgtggcacaatgttgatccaatgactgaaataacatggtgacgtggctcactgtgaggcttgctttatagcaattaatgcatgctagtgggtaccacaccaaactcatgcgagaattgtggagggggtctccaacgcggagcatgcgcgcatcgcgcgtgggggcttggctcaagcattgctctttgtaggtcgagtataggtgaccaaatggaccgcacaaaggcatgccagcccaggcacgacttcaccacagttggcccaaacacggcacgtcggcgtgtggaccgtgcctgcaaggtccgtttggcatagcccaggcagaccagcccacctttttttttcaccgtagttttcctttttttttacccctgttattcctgtttttcccaaattttccatatgcttttccgatccccccagaaaaaaaatctcatgtgttttttctattttccctatttttcgtcatttttaacaactttttttttccatattattctttttctcccttcttttttcccttttctcccttctgcatttttaacaagatccattaaaaaaaagagtaaattttagaaaactataactttagtgacaaactattagtttgctgtaacattagcggtatattttagtttactacaacaatagcgtggaaaattatcaaaaaactgcaacttttacgttatatgctgctacagttgtcacctatatgtactgtagtagcatataatgtaaaagttatagttttatgataatttctcacgctattattgcaacaaacttaaacatgtcgctaatgttacagcaaactgatagttttgtcactaaagttgcagttttctaaaatttactcttaaaaaaaccatctcgaacctacttctcccatcctccccgaataccaaatataagaagctccgaccccttccacttctttaattttctttctcttggaaagcaaaggaaatatagggataatatttcatgnnnnnnnnnnnnnnnnnnnnnnnnnnnnnnnnnnnnnnnnnnnnnnnnnnnnnnnnnnnnnnnnnnnnnn

SEQ ID NO: 59096 - DNA, 928 bp, Oryza sativa
ttgttggatttttcatttcccaacttccaaaatcagtaatagcagtttatctcactgcatagtttattgtgtggacataaacctaatgtcttaatcagatcttttgtatgtttcagctaaacagtttttaggtagcttgttcttgaacaatatttagggttcaagagtatatctactgtatgaaagttattcatcacgaccttgtatttttcaggagtgcttgcttggactcttagcttcaaaaactgtagtgtatgttacccaccatgtcgaatttttgccatcagccaatgctatcatggtgagcttccaacaactatcaaatctacttatttattctactcgcaacaatcgttttaccatgtcaattcatttccctgttctaggtcatgaaagatggacaaattatacaagttgggaattacgctaaaatacttaattctggagaagagttcacaaaattagtattttcccataaggatgccatttctactctagaaagtttagaacactcaagtggcaatcccaaaagtagtcttattcctggtgacagtggaagtacgcttttcagataagcaaaaggatgataatcaaggagcagaagaagggattgttcaaaatggtcagttggtacaagaagaagagagggagaaagggcgggttgggatttccgtctattggaaatatattacaatggtatatggtggagcacttgtgccgcttattttgctcgctcagataatttttcaagttcttcaaattggaagcaatttttggatggcttgtgctgctccaatatccaaagatgtgaatcctccggtcaatagcttgaaaatggtacttgtatatgttgtgttagcttttgtgagctcgttattcatcttcataagatcccatcttcttgtcatggctggatgcaagactgcaa

SEQ ID NO: 59097 - DNA, 895 bp, Oryza sativa
aaaaaaactaaaagtgggataagcgggacaaaaaaggccgcttgcccgccccgcttgcatctatatccagaagttcaccatagacaagaatgctactaatataggttatataagattcatagacgcatcaattttttttataagactagtcaagtacccgtgctttgctatggaaatctaaaattgtgaggtcacatgtttttgaacgatcctaacaagctaccaacatacaaaagtctgctgttgaaaataaattaactgggctaatgaactattgtctcctttgttaagtcacttttttttactatggcttccaaagttcattcagtaatctaacaatttctgctatgctagatctttgaaaacaatcagtgcagcgaattgcataaatcatctactcctacctgtttctcaaataatgataaagtttatgagttctcaatatatagaaaagatgcccgtgcgttgcaacgggtaacgacttttttcagtgttatattaagagctgagtaataaattaaaatattgggatcactatacactatgattgaaaaagttaataaaaatcataacattgggatcgctataattataattaaaaaaattaatgaaaatatttcctgggttttcggtcgaaagccttccttccttttcagccctatgctagtgcgctacctccctccatttgatctgcttctcttcgaccctaccatcttcaacttcccgaatatgactaccatcttcaacctcccgaagataatcctgtgtccgtgcccgtacatttgccgaatcaaatcgccccatcaaatctagccgaatctttctagatcagccaaaattggtcgagggtttttatccactcgatctactctttccgttttccccaaaatcagag

SEQ ID NO: 59098 - DNA, 4990 bp, Oryza sativa
  unsure (1)..(4990): unsure at all n locations
tgcacgattatactcatagtagattagtagattaggggattggattacacgattcaatcagaagggttattgatgccattggcaaaagagtattgtagttgtcgcaaacacgtgatattaggtggttttttttttgccccttatttgggttaagatattggtaccttgaagctgcctcttgatgaggcatcatgggcaatgtgtctgatgtgtggcgagggatttttttcccctttggatatggctcacatgagtgctgactatttacaaaaagcaaaaggaaaagaggcaaagaactacctttcccttcagagagtaaacaaaattaatttggaataaagatatgacattctctttctctttctctttttcaatccctaccgtgtctaagggtcagatacccatgttgtaccaaaaaaggattaagtacacaaacagctgctgcaaaacttcttcacaacttcttctatttccaattgtgaatatctcttgataacaatggaagaaataatggttaattttttcaagcaattcttttcttttgtctccaaagattcaaatcacattgctaactttgtgatgccatgccaaattccattgtaatatttaaacaccaaattcacactcatgtttactgcatttggtctagaagaaatacacaacagctagtataagagaatacctaaatgtggtcccattcttttttggaaaatgacgaataaagcaacatatttaaacaagactcgtataatatgtttgctaactctctttatggtttcttgtctactgccaaatactatatttatttccaattttccactgtagtgttctgaccactgtctccttttttttttcttgcagggagtaagagtttcttctttgcatgagagggtacttctagaaggatgcataggttaattttctaagattttttttttcagcctatgtttcatgatggcatgaaacagtggagttgctgtaagcaaaaaagccatgattttagcctatttttggctattcctgggtaaggatccctctctagtatttccttttcacagcatgcacccacaacataagtcaactatgtgctatcaacctgaacattaccatctgggctggcctgttgtgtattttagcaaaaccaagcatgaatgcatgaatcgtatgctgtactgctgtgtaggtgcaaaactggaaagcacacaactgagaaaccaatcacaaaagcagttcctactaaaccatcaaaggcagttccagtccagacttcgaagcagagtgtgggagctgacacttgctcaaggtgccgtcaaggtttcttttgctctgaccatggtgagtttctgtctataagcataatgcttggatacaactgattgatcccctatttgggtgtaacagctgattgtttcgttattattttaacgactgacatccctatgcatttttatgtgttgatagaataaatcgtaacttttaatttaacagattatgcactgctattttttcaggatcacaacccaaggcacaaataccaaccgctaccagtgatactaacatggtacctgttgagaagcctgcagttccaccaccaaagaaaaaaattgatctgaatgagcctagggtttgtaagaacaaaggatgtggtaaaacctacaaggagaaggataatcatgatgaagcatgcgattaccatccaggacctgcagtttttcgcgacaggattagaggggtatgtttttggttcaaacttattgttgttttgctctattccttgatttttgccatcactgactctgacatctttttaaaaatttttgcagtggaaatgttgtgatattcatgtcaaggaatttgatgaatttatggagatccctccgtgcacaaagggttggcacaatgctgatgccgcatgaattttcaccatgccccatcttggaataagaaccctattagcataaggttctcttgtatctcgtagtgcataaggtgcaatttttatggagaattttacttggagttggggagtgtggcaaagataccgagaataggctgttttaccgtgctctgtgtgactgctgcaaaagtgtgcgtggtgtttcattttttgtctgaaacggggacttgaaattgtgtgtggagacttcggtctcgttcgttggctcgttgccaattcttcatagttagaaaatcaaatgctccatctaaatgctatcctgcagacttttggtaacacccatctttctgtttatatgagaaataacatgatttcgttatcatatcaaacacttccttttccatccctacgcaacaaaattgggtattaggtagtgtcttcgtttctcaacattttgtgctactaaagttgataacaatacttaactttgacatcaaccatacacttcttttccatcattcccaactgatttggcgctgccaaagctttgcccaaccttcaacggtacttttacatggcatcaaattaaatcaaccctatcaaattttctgtggcatcaaattgatccaattctgtccgatttaatgcatacaagtttttaaaactaaactatggattgtgacaccgcaagaatcaatgtgttgctgtccaattccagtactctgggcgctcgagtcgaaggacaccactgtttgatgtgatgaagtgcactaaggctctgttctttttggttgagttgggacccatccctccggtacgtaaaacgaatcagtccattagcacgtgattaattaattatttgctaatttttttttcaaaaatggatcaatataatttttttaagcaactttcgtatataaactttttgcaaaaaacacaccgtttagcagtttgaaaagcgtgcgcgcggaaaatgagatgggggagttgggaactccaggaaacgaacagagcctaagtgtaacaacatctcgaccaacttacctactccatccgtcttaatagaagtgtaatataatatactccctccgtttcacaatgtaagtcattctagcatttcccacatttatattggtgctggtagtatatgtgatatatcctaggactataaatctggattattgtctatccacgttcgtagttttaggatatgtcacatcctactactactattttttttccaaacaacagtattctctctctatattggttgtcggttgttctctcctcaccctatcacagctgctgcagcttcctcatgcaccaaatgttggattcatcgttgttgagatatggagggttgtggcactcaacctgcggcggcgggagctgcctccactgatcatcgtggccacaaactcctcgcagcgggtgaggcgtgggagttgcggcgacgctggagaagaggtggcgtgacgcgtgactgagtgtggggtggtgtgggaaagagttagctgaatcgctcaatcacatgagcggatagaagatagagatcatacgcccaaattcagggaatacgagggaatgaactgaggacgcctcataataggggatggtatagttgctagagcacactttttcgccaaattctgtaaatttagagataggggattgtataagattctgggtagaggtgctggtcgtgtttagctccatttcaatttttttaaaagtatacggacacatttgaagtattaaacgtatactaataacaaaacaaattacaaatttcgcctgtaaactgcgagacgaatctttttaagcctaattaatctgtcattagcaaatatttactgtagcgccacattgtcaaaaatcatggcgtaattaggcacaaaagattcgtctcacaatttacatgcaaactgtgcaattgttttttcgtttacatttaatgctccatgcatgcgtccaaatatttgatgtgatgaaaaaattcgaagtttgaaggaaactaaacacaaccgttgtaatagcaaacagtgaactccgcagactaccactataatttccaactgtgccatcaatatttctagttatacattgagcaaacaagacctcatacaacctcgtttgcatttatttggcatttttgacttgtgcttacctcctcgtttgcatttatttggcactgacttttaccgttttaactttgactattttttaaatggttagaccaaaatgaatacatgatgcaactggtatataatgtgacatatttttaagaacttgtatttttttctaaaaaaagaaagataaacattgtcaaatggtatgaatgttgtcattttttaaaaataaaattaacaactatttgaatagtgtttgaacaaataaagggacatttcctcgaaagcttacaacgatttccccacattttgttgcactttaaaatttgccggaagaaagaaaagttcactcttgagcttctggaagcctggaactggtgccatatcttctgctccctccgttttaaaatgtttgacaccgttgactttttagcacgtgtttgaccattcgtcttattcaaaaaaattaagtaattatttattcctttcatatcatctgatttattgttaaatatactttcatgtacacatatagttttacatatttcacaaatttttttaataagacgaacggtcaaacatgtgctaaaaagttaacggtgtcaaacattttgaaacggagggagtattattgtcttattggtagatgtttacataatcatacagtaacagtaacatagataataactataagtaggtaagtaagattattattgcaaacccgaacataagagtagcacaagcagaagcagtaggcgacgccgaccagtacattcaggggatgccgatgattggcaggaaagggaagaagtagatgagcggaaggcccgggccggtatcctttctagtggtatccaatatgcatgtagtgaagggcatgtgagaataaactatttacgcatnnnnnnnnnnnnnnnnnnnnnnnnnnnnnnnnnnnnnnnnnnnnnnnnnnnnnnnnnnnnnn

SEQ ID NO: 59099 - DNA, 4369 bp, Oryza sativa
  unsure (1)..(4369): unsure at all n locations
cattgatgattgaatatctctcaagaacctaaatgcaattttagtaatggagtgaaatgcaaaatcctttaaatgtagtatgttgcatttgtcttggtggaaaccggtccaaatttcaatattttccggcttgttgaaaacacaaaccgcttggttttcggtctagttcaaaaattttcaaactgaattttaagttttgacatgatttatcttgatttcattttctttttgttatcaactgtttttacaaaatccaaagataccactcgtgagaggttttgatccaatatcaaaattgcgaatcccaactcccggagtggaatgaaatcatgcatcaataattccatcaaggtgctaaaggtgtgcattgtgctttcctataaatcattttttttgaacgaattataaatcattttttcaatcgatcactaatgtaccggaagtgttctcacctagacgctcaaaggcaactcgtcaccaagaaagccatcagagttaaacatgtagtcattccaagagagacggagtataacaaatatagtacctcatctgtctcaaaaaagaaattttacatggatgtgatagtatttgctagtactaggaagtgttatatcccttcaaaatctctcatactccctccgtttctaaatatttgataccgttgactttttagcacgtgtttgaccattcgtctcattcaaaacaattcagtaattatttattcctttcatatcatctgatttattgttaaatatactttcatgtacacatatagttttacatatttcacaaatttttttaataagacgaacggtcaaacatgtgctaaaaagttaacggtgtcaaacattttgaaacggagggagtattattgtcttattggtagatgtttacataatcatacagtaacagtaacatagataataactataagtaggtaagtaagattattattgcaaacccgaacataagagtagcacaagcagaagcagtaggcgacgccgaccagtacattcaggggatgccgatgattggcaggaaagggaagaagtagatgagcggaaggcccgggccggcgtagggcggaggggtggcgcgcccggcgcgcggcgtcgccctgcgcgcccgcggcggcgcggggctctggacgttaccggtggctgccgccgtcgacgacgctagggcgccgccgccgcacctcgtgaagacggcgaggctgcacgccagcgcgtacgagccgtgcttctcccggccgcccgcggcgaccacgggcgcgacggcgagcccccccggcgcgcagagctgctcggcgccgccgaggaccctcgccgcgcaccgcgggtggctccgccaactgtcgacgtcgtctccgccggccgccggcacggccacgtcgaagcccccgcgctcgtccgtctgcgccgcccgcagctgtccaacgccgccatcgccgccgccgcatctcaccgccaccaccacacctgcagccaccgcgcgcgacgtcacgatcgaccatgtctgcccggtgcgcgcgtgaccgcgtgttactacattacataccggagaggtcgtggcccggggcgcagtcgaggcaggcgacgtagccgcggagcgtgccggcgccgcgcaccccggcctcgccgtgcgcgacggcggcggcggcggcgagggcgagggcgacgacgaccgcgaggcgaggagccatgacgagtgtagtactggttgttgcacttgcaccgttgcacgcgcgcggctatacgtgtctacgtgctacggtttgtgtgtgtgtgtgtgtgcgcctttttgtagtacgaggatacgcgcgatcgagcattgagtacgcgcacgcaggggcagatgggcagatcgccgggccttaacgccggccgccaccatggctcgcgcaccggctctggacgcaaacgtacccgaaaaggaggtccttttgccgttgcagggatgtacttcccgaaaaggagggcaccgattgctgtaaacgggccggcccagagttggcaagaccgagctcggtgggatcaaagggaggacgggatatgtatggttttagtatggaataagtccactttgactcccttaaaaatgacccgaatctaatccgtgactctcaaccgtaaaaccggataggatgactctccgaactattcaaaccagtacaatttgactccctcagtggttttggagggtggttttgctgatgtggcgttgacgtggcgatgttgacttgatctgtgttgttgatgtggcgcttatatggcattaaaataaaaaattatatggactccattcgtcattcacatgaaaaaaaattgcgacgccaacatgtcatcctctatctatcctccttcccccccccctctctctctccctcctctgtatgtttctcttccaccagattcggtgcggaatctggagcgccaacgncggcggcagggtgagggccggcgcggagaaaggaacttgagcgggttgagcggcggcgacggcagagagccaaaggagagccggtggagtggcgacggccacagcttgccggagaaggcgggggcgtccggccggtggcctcccccacgatggtgccgcgccaggctaggacgaacgagagggctaatgcagacggcgaggcctgagacgctgccggccccagccgtgcctcccggtctgcaccggcagggggtgccgcctctgtttctttctgctcggagaacatgcatgtgcacagcgttgcctagcagatgcaagtgcagcgccggtgtggggtagcaatgcgcggccgccatggaatccagtcgaattttggcaggaccagcagctgtaggacgaatccgtcctaccagcgtggtccacccgagtcctgcagatcttgaggtcatggactggtctgatttttttctttctggtcactgtttgcaaggtcttgaggtcgtggacaatagctacttcatcaccgaggacaacgtcggcatgctgaagctcgccaaggaggccaacagcatcttggttcgtcgatcagcgcattgactcatgttaccaattcgcctatgaaaattgctaacatctaaccgtgacatccttttgattaattggtacaagaagtttgactgccgtatgccgcgccggagacagtgggttgcacagtggtgcactcaaacggccataccgcggcggccatgtccacgagcggattgatgaacaagatgaccgggcgcatcggcgactcgccgttgatcgggttgggagaaggcaaggccatcatatgctccacgctggcgcgcgacgccgccgccgttatggagtacaggggcgtcgggctgcatgaggccatcgactactgcgtcaaggaacggctagacgaggttcatcgggctcatcgcggtgtccagcaccggcgaggtggcgcacgggttcaactgcaccggcatgttcagcgggtgcggctgcaggagaaaagagagagaagggagagagagggggaggaggaagggttggagagagaaaggatgacatgtgggtcccacaatatattttgtgtgtaaatgacagacgggtcccacaaaatatttttaattgtaatgccacataagctccacgtgggatgaagaccaggtcaacaccgccacgtcagcaaaaccgacatccaaaaccgctaagggagtcaaattgcactagtttgaataattcagggagtcatgctatccggttttacggttgagagtcacggattagattcagatcacttttaaggaagtcaaagtgaacttttttccttttagtatcacatcgggtgttgaactgttgacagccgaggaggggcaaatggcggatataaaagggggttggagagcattgttgcaactcatatctttcttggtcctttggataagatcaagtgtagtactccctccatattcataaaggaagtcgtttaggacagcgatacggtgtccaaaacacatttttgacttcttatttctataataatatttattgaaaagtgatatatgtatacttttatgaaagtatttttcaagaaaaatctatacatatagtttttacattttcaaactcaacaacttgagagttattcatgatttatattcccaaggtttgacttaaacattgtcctaaatgacttcctttataagtatggagggagtatatgttatcagtttataatactattatctggcatgtggactatgtgcgcccactttgatattaaatttattttttttgggaggattcactgtagtggcttgcaactaggaggaccctcgtgtgttgtttgggcattgcattgctgccaatcttagagcaacccaaccaaaatgaagtaaattttgttaaactg

SEQ ID NO: 59100 - DNA, 1873 bp, Oryza sativa
  unsure (1)..(1873): unsure at all n locations
actactacacagtagtaacaacctcggatctgctgggatcgacaactttagtaatcatatcgtagtcgatggattcaaatctacgtgttctcttaaggggtttggaacccttttcctcagtatgcaaaccaagtgttaaattaatgcatgatacaaaacaaagtgttaaattaacacatgattaattaagttttagtaaagaaaaacttgaaaataaattaatatgatttttttaaaaataacatttgtatatattttttaaaaaacataccgttcaacgttttagaaaacgtgcaagtaaaaaaatgatgcaataaaagtttgtataaggctatgttcgtttgtatcggttgggaacgctctcttccggcgtggaaaatagagcggttcattgacacgtaattaattaagtactagctggaaaaaacttgaataatggattgatatgattttttaaagcaactttcatattgttgatgcgaaaaacacacactggcctaggagatttgcttagctccagtacaggtccaaaatcttgccttgagattcgcgagcgtaccagttgatttgatcctgcaatcaacaagaaataaagacgaaagaaaccacggttaaatccgtaaacgatagccgattggccagtcgccgatgacatatcatttattttcaagccgatgtcatatgtgaatcgatcggtagtggtaaataagcaggataagactaaatctactcgatcggctgtagatattaacgctatataatctttctgttgatgtatatttaaaccaagtgattgggatagatcggtcgccatactgagacagtataaatcacttagatcgaagtatgcattaacataaaggttataaacgcttatagcatagctgatcaggtagatctagcatgtatcggctagtactccgatactactctatgttaagatgttaaaacagatagaatatatcacacagaagcctaatatactttattgcaataagatcttaatataaagggcatacttagcatatcaattaagcatgtaaaacataagactaagtcaggtaagatcggttgaaaccccgatactatctctctcaatgatcataaaacaagccagatattcataattaataaatacaancttaacagatcgaactcaaccgnnatgcagcatcaagcataaagacaagtatgagatctaaacagaatgatgaaaatctacaagagatggtagatacaagatacaatctagattaataacaaaatataactctaccgattattccctaatgataagaaccagccgataacaagctatatagtgcacactaacatagattgcaacagatatatgataactcgactgattacagaaatagggttaaagtatcataaagatggaagcattaaccccgataacgtaagccgccataacaagttttacctttagttgaagatcgaatcgatgcagctcaactcaaaagtaagaactcgtcgaaataaacgaaagtaaaaagggtggcgatgtgccgagattgtattgaacgattgttgtttgattacatgggttcgggtcatatttataccagagatacaaaatatgtccttgccggacacgacacttatctctaacaaactctaagatatcataagtcttttgcccaaacatatctctaaggaaattacataaaatatcctaattaatagatacaactgcctaaaccgagagctttatctccatcatggcaatccctgtaaagcactttgaacaattctagaaacggccttgaaaccatcttcatcggaatcgattgcattacctctatcggctgtatcttttatcctctgtcgggtaccgagctcgaattcgccc

SEQ ID NO: 59101 - DNA, 1697 bp, Oryza sativa
  unsure (1)..(1697): unsure at all n locations
atcagatggcaatgatcttggctttggtagaagccctcgggagagccagtaacttggtaagagactcgcacatgcacgcatcgttcaggacatcctcgtcgtccctgaccaccttcagttcctctaaggtgggtgaccatctcaggagcagtccaacgagatcaatttcgtgttccagccccacgaaatcgttaatcgtcaccgtcacgaggtgatgcaaggtaggctcttcaatctccgcctgatcattatcccatattggctgataccaaaattcttcatcgctgtagaagctctgtagaagttgaagcaactagtcagtgcaaccacacggaaaaacagccgacggagggaaaatagtgccaagttaactgcagaagagtgcagggaagcatacccgtatctcaagttctctgaacttagaggcattccgaaatattgaacaagcacccaagactctgtccagacccaagagcacttctcaatacaaatcttccttagacgatcaaacacgcctgggagttctgccaacaagcacccttctgatagatactgccaccagaataaaaccaatgaattaccaatataattcaaccagcgtgttagttaaataacacaaaactattagtatgttactgtcaagaatgagccacttatagtaagttcttcgatactagttaggctgacaaaagcttgcttcagatagtttttcttgtcacccacaactgcatcagattgttctgcttctgttttgccgagtgtaagatacaacagattaggagcatgcagatgcaagtcttcaaaatccccttgaacctctaaaagctgtagtgtctgagcttgaatacggagacaactgataccctcaaatatttcagacgcaacatattcagccaggggcacgaggagatcagcttatatatatctctatctgtcaaggagaaatatttcagattcaagacagttagctgcttgaaaccttcaaactcctgaggcaagccaatggtgcatctttttataacaagtgtttctattctagttaggctgacaaaagcttgcttcagatagtttttccagttgaccgcttcttccgtttttgcgggtgaaatatacgcactggacagattgggtgaattcagatgaaagtctttaaagttccctttaacctctaaaacctgtagtgccggagcttgaatacggagacaactgatgccctcaaaatatttcaaacgcaatgtattcagcaagtggcatgaggagatcagattatttatgtcactgtctgttgaggagaaatatttcagattcagaactgttagccgcttgaaaccttcaaactcctgaggcaagcggatgatgcatctttttaagtgatttatactgtctcggcatggcgaccgatctatcccaatcacttgatttaagtatatatcgatacaaggagtatatattgttaatatctacagccgatcgagtagatttagttccttcttatttactcatggttgccgatcgatacatatatgacatcggctcaaagataaatgatatgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59102 - DNA, 705 bp, Oryza sativa
agcaagcaatacacgcatgcagctcaagaaggcaaaaacaaatggcggcagcgaacattcagtcattggaccttacaaaaacagagcaccgtaagctattacggtgacctcagctcaaacggcgattactcaaatggggaagggaatacatgtgcaacctctcaaacatgttgtttattcatgagtacagcacaagccatgttatgcatacagcatgcaaagccaaccagcaaccagagattgtaacaactaacaagcccacgcaatgcgagctgctaccatcaccacgtgtccacagaccagcacagaaacaagctgccctgctgcttgttttgcggccgtcccagcaattgacagattaataggagcccataatattagtgcaccatataaataacattatgattttagccagaaggcatcagggcataagctttgatgaaattttacagaaagcatcgcatttttttaattaatgaaaagaataaacctaaaccacagacagggaaacaattcacaatgtcagattgcttctcatgtatcacacagaataaagtttcaattccaatacttcatatgttggcttctctccagtagcggtagaagtacaagagggaagagaatctcaaaccaaaaatgatctcctgggtgctgtgcaatggcttcaaaattggggtataccacccaaagaaaaggctcaacttt

SEQ ID NO: 59103 - DNA, 813 bp, Oryza sativa
  unsure (1)..(813): unsure at all n locations
ctgtagtccacgtgtagccagcgcggggagaagtttggccagccagttagtcaggtgttggagtgtatttttgatccaaaattgccaaaatttaacttgaagagtgggataaggaggctgcctggacatgcagaacccgtagtccacgtgcctgtcgtattccttcgctgccatgcacgtcgtctatggtgttgcaccgataccccactcacgggcgagtacaacatccaactgtgaagtccaaggcgacatccgcagcagtggcggacggcggtacgacactatttcaaccccattatttcgcttattcatatgcttatccaaatcgcttattagaaaataaaaaaatatttgtgactaaaatttttatattcgtatccttatatactcaaaagcaaatgttgtaaagtaaactacgataaaaaaatcaaattcaaaattaaattctaaaattaaaattttggtttataaatataagtataagccaaacaatgatgccctttgcctgtctggcttggcaacgcctagaggtacaagtgtgagtgagtccccttgctctgcttcttagaggtggggatcacaagtgtacgagcagaatagtgtactacctctattctaaaatgtactaatataggattaggaatatgaacattataggatgtgtgtaatctaattctcggtttctacattttgaaacggagagagtaaagttttctatgggcccattccgacagatctgnnnnnnnnnnnnnnnnnnnnnnnnnnnnnnnnnnnnnnnnnnnnnnnnnnnnnnnnnnnnnnnnnnnnnnnnnn

SEQ ID NO: 59104 - DNA, 2167 bp, Oryza sativa
ataacgacttcctaccaacttaattaatttctcttaacatgcatacgggggctatgtacttatacaaattgaccttgatacttttaaagcaatcttttttggagataaataaatgttcttaagaaagatgatcataacatccaaattacacatatgatctatgaagtcattaataaattagagaaaaaaaattaagtgacataattttttaatcataaatgtactcatctagcattatagacaacaagttgaaaataaaggtgcagtcagttgaacatcataccgataagcatgtgaattgcacctaggaatcttaacaatgaaactttgaggtggtcttagaaatatatcaagtcacttccatataggaattaaagaccatgtccttatttttaattttaattttgtggtaaaacttactaacattgtaaatcatgagtcctgatgtagaacaatatataaaagtgtatttttttatcagacacttcagtatagcgataattccctaaaaatactacgaccatgtcttcaatatgtcgagagaaaattcaacacattttcctttacaccatgccataaatgcatttaattttcgacccaaattgcaaagatctcagcatttcaatggtgattcatagaatggaaatctcaaaaaaaggacatgaaatatattgacaattgctaaaatgttgctggatttaaaacccattataaataggaaaaataaaatgtttaacgaagactgtctagacgaaaatatataaaacttaaaataaaaaaatgttattattggatttcttttggggttgtgagatattcttctgggagtcaaaataccctaaattttctcataggaaccgcctccattgtttcaacatattttttttctcataaattcaaaactgcatgatcttaagtaattttattttagaatttatatgttgcaagtgtaattataagaaaataagtagcattcaaagcacaataaataagcttaattttagtttagaatatagtaaaaatattttaataaaaaatcagccacacataaatattgataataaaatttcactcatattatatgaggtgcccgcacatgtgcgtgggctatctttctagtttttcctaataagtagtagtaaatatgaagagaatgcaaaaggtattaactagagataatagagttagcatcagaatagatatatattttttagatatagtgaggacattacagcatttttcacaggaaacagtttagttcccttaaacatcctctaaggaggcctaaacagttgaatatcaaatgctagcagcaacaatttactagtccctgccagaaaataattagcaagatcagtatgctcactgttcttctaaatctgcacaaaagttacgcataaaaacaaaaggtttgactaatctgaccagtgacgacattgataaaccctgctccatcgatctgcagaaaggcttgcggtaacataggcgtcggcggcaggccattcaagagtggtggccggcagaggcttgaggagccataaagattataaaaaggagtactctctccgtcttataatataaaggattttgagtttttgcttgtattatttgaccactcgtcttattcaaaaaaattttagaattattatttatttttttgacttactttattatctaaagtactttaagcacaacttttcgttttttatatttacataaattttttaataagacgagtggtcaaacaatctaaacaacgactcaaaattgagtggtcaaacaatctaaaaaaacttaaaatcccttatattatgggacggagggagtacttaataagcacagcatgtagcaaacggcgagaagaagataattaagcaagtctccatcgatcttacgcagcggcaaaattaacctaaaagctttagtttattgttgcgaggcctatccggttgtcgggcctgccaagtgcaatgctagctttcaaactaatcctcttagctggatatgtatcattcgctaatctgacaaatgaaacagcaggagcacagctgcgttattatatggaaggccgacctggctcggcaagggatatcccctctcgatcgctcgtcggctatctgtcatatcacgcacgaaattgcggctgcaaatgctactttacgctctg

SEQ ID NO: 59105 - DNA, 1567 bp, Oryza sativa
aggggaagccaagaggaggtacgacgagttcgtgaggaggaagaggggcaggaaggagtccaaggccaggcgagaggtgctcgtcgacctctgctgctccgccgtcagcgccgtcgccgtcatcagcttcctcgccgccgtcgtgctccggtagcttagcaagcagagtctttcccaaccaagaccgataaaaccaaaaaacctgtttttgctcttttaccgagagaaaattttgctctgtaaatatcactgtatcgagataaaatgtgttttttttcacatttggtaaccaagcagtgcaacatattcctttcgttcaaaaagaattaacatgtgatcccttctaaaacaatttattagaggggtcatttttcctcataggttaatttttttggccgggtcacttccacttctaggttttttttttttttataaagagagtaaacatacgtacagtagataccctactgtgttgcataattgcatcagatccgtcttgccaagaaacaccatgttcctctacactattggagctaaaaattcaggcatttcaacagaagaccttagccatgatagtgtcagcaataaaatcgtgaggtctacataccgatcgccgaggggggccgggctgaaggatattgcaatctgtcatggccaaatggctggcaaaagtccataaactgataaaaacatgcatttcggggtccataccgagacgtactcgtcgcgatcgctacatgacagtcaactgggcaccatccttatccgagatggtgctatcgtttgcatgtatatttgtgaacgaaaaataatttgtgaatgaaatttttatatacgtgttgttagcgatttaaaagcaaagattaaaaaataaattacgagaaaaaaaaacctcaaaatcaacactaaattttaggttgaaaatttaaattttggcttataatgtccgcaatgcagtgggtgtctgttgtactatggtgttcggtacctcttcaagtaccaaagaagaaatacgttgcatatatttttcttttccaatcatataaagatgtacatgcgcatcgcactcgctcaaggataaagagtaggaatgcaaactgatcggatttaaacggattattatcattgtatatttgattagaaaaatcaggtgttaggtacggcatgagcgaacttggtctagaaacatatcaaattatcggataatatgtgcatgtgcagataacataacaagtaaaatacgcaacaaattagcatcaactaaggaagccaattaggcttaggctcctaaactcatgaaaaaaatcacttaatagcatttgtatgagttatcatggtgtatggtctagccatatgatgtggtgaaatgggccaaaatataagattatatttatcttaatatttcctccgtttcacaatgtaagtcattttagcatttcccacattcataatgatgttaatgaatctgacatatatatctatctagatccattaacatcaatataaatgtgggaaatgctagaatgacttacattgtgaaatggagaaagtagtattttatctcatt

SEQ ID NO: 59106 - DNA, 1575 bp, Oryza sativa
ataaataagatgatggcatcttttttgtctattagagtaatcttttttctattagaaatatgttatcagataatgatatgatttatgagatgaatctatactactttaaaagaccccaactgtagaggtgaattgtgcattttccaccaaccatcacaactgtcatatgcgtcccccaaacaataaggtaggtgaaattttgtaccttctctaatcccaagccatcaatcaagggaaatttattttcaaatgatgacaaatatggactaaagatttaattaattgggaatattttattttaatttttgagctttaaggtgtacgggatgttctctttttttaatttattctcgttgcagtgcatgggcattcaacttgtcaatataatttgttatttttagttcttattgcaatgtacgggtattcaactagtcaatataatttgtgataaaatctagacactaatatatagaaatatttaatttttgtatttggtcaaatataaacatagcgggtacttagataactgtttgtggtactcatcatgatcaggtagttcatttaactaaacaacttgccaaaaacattttcacatgcggttacttaagtgatccacagttgaaaagtgtttgtacatgtagtttcttttaggtgagccacccgtgcaaacttgttctcgagggatgttattttaacgaaactgcccgtgaaaaggtttctccatggacagttgactttttgcatgtgtaactagtcgatttccataggcccttgactgtagacgacccaaaaacaacactataaatgggtcatcagccacctgcataagtgttttctataccagcattaccttgccatcgttagtcttgggcttcctataacctcacataacatggaatgccttactatcagcgtcctagatatgggataccctatgtatgtgtagttacctcgtagggaccaccgcataccaagttatttaaggaaaaaaaaacctcatacatgtggataaaatctgaagtagataaggtaagagtcctagttaagggcaaaaattcagagtcctatttgggtccaattaataccactcggatcatatccatacatacctacctagttctacttggacaagggagcagccgaagatataaatagcaggccttaggtagggataagaacatgcctgagagatttcaactagagacaaaacaatacaagacacctccgatctcaccatgtaaacacccaaagaagttgacaacaactagccgcctatcaccatactagattgatatacatatataatggcaacaacagatccggccaataggtgtagggctattgtccgtaatagggggccgaacctgtatagaaatccatgtattccttactctctttacaacttcgtttgcatcctcagacgagccaatccatatgacctaaaaatatatcatgtaagtacatatcctatgatcacggtataacccatcaacacttaccatatattattttgttctagctagcccatagatataccatagtactcacgacttgccctagcttgtacagctctta

SEQ ID NO: 59107 - DNA, 813 bp, Oryza sativa
gtgaaacgaggaggagagcgcgcccaaggcagggataaaaggataaaaggcggggactttgcatcattcctttgccgactgctcacccgcacacacgctccataagccctaacactctcgccactccacagtactccacacaccaagcccctcgtcgtttcaccgccggtcgtcatggcccaagacgctggcgacgctgtgcttccggcatcgcgcatcacggcagataggcaccttagtcttccccgcaagattatgccggaaggcgccgccgtgagggcgggggaatcgcagccgcggccgcggtacccggagtgatccgtacaccttctgtccttcgccatggcggggttgatcccaccattctccaggttcttccatgaggttttggatttctacgagatccatgccctgcatctcgcacccaactccgtgatgacgctggccatctttgcgcatctgtgcgagatgttcgtcggggtgcggccgacgatgcgactgttccagtccttcttcgtcccgcagctgctgcaaggtgcggtggtggggggatgctacttccagccccggccaggcacggcggggcaatacatcgagagtcatctccgcaagaagtgggaggactggaagaaggactggttctacaccgcgctgccgaaccacccgcaacttcggctcaccggccgccccgaacgatccgccgcatggctggcggtttcggaactaggcgaggagtacgacgcagtgcgggatcacttcaggggcttgcgaagccagggcctcacgggggcgatggtcttcggcgattacttc

SEQ ID NO: 59108 - DNA, 3429 bp, Oryza sativa
aaatgtttgcaaacaactcgtgatacaaacaattgtttacaaacaactcgtgatacaatcaattaattgtacaagaagagtgtaaaattaccctggtctttcgatatctggagacacgaatacaaactccaatcatcctcagcaacaagcaatcaaatatcgtgcagcgtgcaacatcggccaagaacaggagatcgatgtcagggacgatctggccggtatatcgcagatggcgagtgatgatttaataatagcaattaattaaagtcgccatcatatatatccgcggcaaattaattaggcgccattcataagcggcttcttcatttcccacgctttcagatgtgaaatcttaatatccgcctccccattgttgaagacgtaaagatgggccttgtcacctatcgccatcgacgggtaaactctcgacaggatgcaggtcttgcccccggcgccgaagctctcaaccaccgaacggtcaatctgaaacgaagtcacaaacaatgatgcatatataagactaatcatggtcacagtcaataaagcattggtaagttatatacgagaggcactaataaaaaacgtggttaattaagctcgtagtatatgtgtgtactataccaagcttctcaaggagatcttcccggacgagatgtcggtgtcgacgaacccggcaaaagttggcttgtagagatccgggctaagagaagacctgctcaataaaaaaaggacagtaattaatcaacttcagagctttggatttagcattttaagttgtctactgtgtttgggtaattgcgaaaatgtgacaggagacgtatttgatagtgctgtgataaagggtgtgtgattccaactctaagatcatgtatttcttctctcattttttttttgaaaacgtggcagacattgatcagtgcatgcaggatgggtatatgcatgtgtgctgcttgcattgtaccgagacatcacaaggtagtagtatagatttggctggtagtggtatcgtacttggtagggtcggtgcacatgaggacgacgggcttggcgccgtgcccggccggcttgaagacgcggaagaagacggcggttttctcctccaggccggcggaggccagcacccacagcccgaacaccacgccgcccctcacgtccgcgcccttcgcgccgcacagcctctccgcgtcgtcgccgaacgccgggtccaacgcctccgccttctccagcccggacacctccaagctcacctccacgtcagcctgatcgacacacaaatatcaaagcaaaacttgtaagcgtcagcgtcacacctagaaggcgaatatgcgatgcgttgcaggttcctctccggccaaccggatgcgtccacgccgttgaaggtgaaacgggcgggagcggaagctgacgccgaccgagcggaaaaatcgccggtccggcgacttcgcgatcttcgcgtgcacgagcaggaattgggcacgcgatgatcgctgcccatacggaattggaccggagcgagcttagctagtactccgtataactaggaagctcctgcacatggggcccttgacggcagcaatatatatggccaatattctagtctcattttcttgtggatggaaatttcaagttactggtttttgattttgtagtgtagcaacctggtaggttccgaggcccgtgacttggaaatgttccccgggcttcaccaccttgtcaaagacgctgaccgatttgcccctcagcgtctccagctcctcgattggccactgcagaagctgcttcccgctcgggtccagccatacctttcttgggatcgcctgccaacgacacaagccaagccatcaatctccaaatcaattctaattaaacctctagtccctccaatttttcttttacgtttggttagctcttgaaattaagataactaataacatcaaacatttgtggaggtaggtagtacaagaaattaggattgcaaaattgtaactatgatttacatggatgccggcccagcccttcgccttgtcgtaggtgacgctgtcggactcgttagcccacccaagcaggatgcggcggtgcttcaccgggtcgaagaaggtctttgatgcgtagaagttgccgtagtcatagcggagccggtggtagtcgccagcagggttgtccggcacataccgctccgtcaccttgttgtagatgcccaccgtgtagtagtcataacgggtgagatcgaggctgtcttgagcacgtacttgctgctcggcacagatgtgtcgaggccagcctggagacctggtgcttgcaacggaaagaagtctgggcactcccacatcccagtgagcgccgaatggagtgggtgcttggcccgaacccatgtcttgaagtcccggctccggtagaggtaggcaaggccgaggcgagcccccttcaggccaccaacgagcatccgccaatgaccgtcggcgtaccaggccgttgtcggatcgcggaattgcgttgcgttcataccaggctccggcgtggccaccgggttgtaggccggcttgacccactcacgaaggagcgggtctgacgcattcttgggaaatgcgatattctgcacctggtagttgatgttggggcggtcgatcccagtgtagaggatcgccggcgtgccatcgggaaggatggtggcagagccagaccaacaaccgtactggtcggaggggatgtcgggcttgattgccggctcaagggctatccagttgatgaggtcctgtgataccgagtgagcccacacgatattgccccacacagctcccttggggttgtactggtagaataggtggtaccatcccttgtaatacagtggccctgttcaatgttctcaacttatcaactcaaaagctcaaaacatttttcatgtataactggggcggatcccccaatttttttttggggtgggggtgggggttgggggggggagcccatagtacacatgttaattagatctattcttgtgtacaggtacaacttattgcttatcaacttatcactttttatatggtttctttactgttttacaaaaatgagttgtttaaattaaagtttattgtgaaattgattatgtcttgtcatgtctaaattcgtataatcaaattgagattcacttccagacagtgatacgccaaaggaatccgttgattgatcccattgtcaaattttaagaccaaacttcgaaagcttgaccagcttaaatttttctgcctactgcaagaggccgttgtatatacgcattcgccttgcagcatgtgcgtgccggcatgcaccattttaatgttaaactgtcctttctcttagctccttctaaaaaattggtctttaatcttcccatatttaaaaaacacatgcacacaagcgttgctgttcattatactctcaacatcatagatc

SEQ ID NO: 59109 - DNA, 1018 bp, Oryza sativa
gcatcaattaggtatcaatcaagagttattagcttaatgctcaaaaacaaagctggtgtattattattcgggtacttgctgaactgcaagtcttcaccgttgtcggatactgtgataacttaaaagcctgcagcttgacttttctgatggagaagaaaacaactgcaggactacctaactaacatagccaatataaagttgataactcagcaagctgtaatttttttgtccaccagaaatcaccagcggttatgtagattaacacgagattaaaccactaaccacagaagctgttttaattttttaccaaggtgcaaagtactacttgcatactccctccgtttcagattactaagtttatagacaaatataataatatttacattacaaaattagttttattaaattaataattaaatatatttttaaataaatttatcttggctttaaaatattattattattttctataaatttgatcaaatttgaagcagttagattttgaccaaagccaaaacatcttataaactgaaacggagggagtacatcagctaaaattcagagccatgtattgctttgttcgtctatggcatgatattttcttgtactagttatgtaataaagctaagctatagctaatactgaagataagaagaaaccaaaacaaaccaagctttgaagagaagatgtcgaagaaaccaagacaaagaggaactgaagaacatccaaaagttcagagaagctagctgagcacaatctttgcttaccgttgatccagttcatcgggggctggaagtggtatcctgtcctgagcagggggctgacaatggaggccggcaccgagctcggcgcctgctcggcctcgaggctccggtggacgacatgggacgcgccggcgagctgcaggaggagcagcagcagccatggcgcgagcgccaagagccgagtccccattgttttgtactagacaggccggccagggagggggagaagacgaggggcagaaagggatgtgcgg

SEQ ID NO: 59110 - DNA, 1664 bp, Oryza sativa
tatggccctacagccttgaggcaagtgtgtgatttcccaagtgtcattagagaggatagagtccatctcactttgcactgcttccttccagtatgcagcttcagcagatgcaaatgcttctgacagagtactgggcacatcattgacaaggtatatgataaaatcttcaccaaacattttctcagttcgtgatctcttgctcctccttaaattaagggaatcatctgacaaaatgctaattctaggttcaacagaaataggttcagaacttggagattttaccttcagtggaaatgtatcttcgaaaaaggtcgcgtcacatgattccatcacagtattttcacgaacttctgtagtttcagatttaactaccaggaaacgataagctggactgttctgtgcatatcctatgaacacgcaatcgacggtcttaggtccgagctttctcttcttgacaacaggtatatttaccttggcaaggcacccccacactttcagaaaattcagatttggtttctgcctttccatagttcatatggagtaacttctgttccttttgcaggaacacgattcagcacaaagcatgctgtgtacagagcttcaccccacatattgtttggaagacctgaattgctgagcattgcattcactaaatcagtgagagtacgattcttcctttcaactaccccatttgattggggtgaatacggaggggtggtttcatggatgattccatgttcttgatgaaacttagagaattcaattgataagtattctcctcctctgtcagacctcaaaattttaattttcaaatcaagctgattctcagcctctgctttaaaaattttgaaatgctcaaaagcttcatcttttgttcttaagagataaacatagcagtacttagagcaatcatcaataaaagtaatgaaataccgtctacctcctttagtcaaaattccattcatctcacatatatcagagtgcactaattcaagcatagagctgtctctatcaacagatttaaaaggtttacgaggttgtttagcttgcacacagatttcacactttatacctcgtgtgtcatgcttgggaattaaatctagtgacatcatacgagatatagatttgtaattaacatgacaaagacgattatgccacaaagaattatcagtacgagcagaatgagatgaaacagcgaaagctttattattatcactaaaacttgaacaaggcagcaacaaagatagtctaattaggccattatctaaatagcctttcccaacaaaagaacctctaatagttattacaactttattactctcgaagacaagcttatggcctgacttcattaacagacttccactaatcaaatttgctttcgctgctggtacgaagagcacattgtgtagggtcagaacttttcttgaagaaagcttcaaatccactcaaccactacccagcaccctagacttgctctcaagacgagtcacagaacggcctccttgctgttcctgaaaagtggagaacaaagatcgatcaaaacacacatgaacagttgctctagtgtcaacccaccaatctgcaggttgacacttatcaaatttttgagacatgttcgaaacgcaccttgcaacttcagcttcgtcaataaccatattgacctt

SEQ ID NO: 59111 - DNA, 2511 bp, Oryza sativa
aatcttttgagcctaattacgccatgatttgataatgtgatgctatagtaaacatttgccaatgacggattgattaagcttaataaattcgtctcgcagtttacaggcggaatttgtaatttgttttgttattagtctacatttaatacttcaaatgtgtatccgtatacttcaaataaattttagcacacgaactatcacacagcctgcgtttgtattgtgttttaaaagaaaacgatatgagaaagcaaaccacagcaagacaagagcccaagacatcttgagaaaagctaaaggaataagtctattttacgtccccatacctttgatcgaatcatctccttgaaacgcaaaaccggtataatacctcctccatctttgaaaatggactaggcacagttttcaaagataaaggaatcaagatagactttttttgagaataaatcaagatagactcaattgcaaaactaaaaggaaaagacgtaccctagcatatactgggccgcgttacgacaaggagcccaaaggccgaagcccatatgcccccagctgaacactacttatataaagcgaattgctccagcagccgtcccttgagctagggttttatcgccgccgccgccgcttctccactctcccctgcccccgtcgccgtcgccaccgccgccgccatggtatgtttcctgtgacacacactatctctctctgctctcctcatgttaggccgaatgatgcgttgcgatgaccatggtgctgcgtttgcggttgacagtccgggaggaagaagacacgggagcccaaggaggagaacgtcaccctcggcccgaccgtgcgcgagggcgagtacgtcttcggcgtcgcccacatcttcgcctccttcaacgacaccttcatcgtcagatcccgccctccctctcctccccccctttcccgttcgattggtcgattgggattttttttttttgcttacccctgtgcgattttggttgcgttgcagcatgtcaccgatctgtccgggagggagacgctcgtccgcatcactggtaaaatcctcccctcctaagccccttccccgtttatctcgctctctatgccgatgtgatgcattaggggttgcttattgtctgaaatggtggagacaatttgtgtttttgagttcatgtcgcgatgttttttttttgctcatttgttaagcacggcccttaagatcgcctccctttcgtcacgtgggagcgtttcgagtcatagctgtgctaaagtaacaatgagggacctcggagtttttctttggtccttccctcttcctgttttgttctaggtatctccatctcagcttgtgtatcccttggtgtggctcggacttttatcagtcgcaattttgtgctgattgcctgagctgttcaccctgggaagcctcggtgaattgaatggagatgtctatattatgggagtggacatggtttatttttcttcaagaatgtatttttatttgcccacgctctgtgtgtatatataacttattaccgcattttctgttagacgtaattattgtaggatgttgtgaatatatcagttgagattggtaaaaagttcatgatagcaatcaggcagtttcacagttaatttaaattatcgtgtagtcattagaaaatagttgtttttgttttcagagaaatggtctcatttttgtctttactgtggatgttgctgtcattttctttataaacttgaattatttctgtggttatctttgttaaccggttgtgcgacggacttaagttaaatgggtgaaatcacaacttaattttacatgcttaagattaatatcagattgaccatttaatataatttatatattcattctagatgtgtcttttgtaggctgttatcattttctttgttataacaatgttcagttgttttaatatgttaattgtttgttgtcaaggtggcatgaaggttaaagctgatcgcgacgaatcttccccttatgctgctatgcttgcttcacaggatgttgctcaaagatgcaaggtatccccctactttggtcaagataatactgttgtttgtcagttaatgattaatgccttgtatccattttgtaggagcttggaataactgctttgcatatcaagctccgtgctactggtggtaacaagacaaaaacccctggtcctggtgctcagtccgcacttagagcacttgctcgatctggcatgaagattggtcgtattggtaagcatacaaacatttatttttctgcatgatgcttgctgatatatttgttggatgatggttggtttatttgtttattctgtttgaactgttggcctgttctgttctaatattattggacagcatgaagtctgcaccaggaggagcacttcaatgttaaaattttattgaaacaaatcctgcatgtaaaatatcaacgtataagcattgcttagtttataacttgtttcaatgctatatcaacaaataaataatatatagtttaaccactct

SEQ ID NO: 59112 - DNA, 1332 bp, Oryza sativa
aagcaatctttggccgcgtgattggaattaggatgatgcagacattgggagttcatgattttgtcaaaagtgttgagcgcgaacgttgtcgggaggatactcttattttccaagagcataatttggcaatgcctttccttgctttttatgtcattctgttcgtattttccttgataataggaaggcaatgaacacttcttttgtatttactcgaatggaaatttacagaagaaacatctgtacttgcatctgttcttttgtggcctagttgaactctatttcgaatgtatgctgtttcattgtaattttcagctgatgacgtcttgtcaattttctgtcatacagaggatgttactccagtgccgactgatagcacacgcagaaagggtggtagaaggggtaggaggctgtaatcttcatgcggcctcaaaccgacaacactctgctctcctagatgttaccgtctgcattggactattttgtttctgtgcttttcattcggtggattatttaaaccagttttgaactctgtttctgcatcaattcatgctgtcctcaatgtaaccaacgttatctgcttcgaccggtgaacatactcctgttggattacttgagcatatgccactacaggccggacactgctttcgttgtttattcgggagagcatggcaaacttgggagatgaaaacctggaaaatggtgcgaggataatgggcataactgtaaaatagtgcgttttgtacgaaaactttatatatgaaagttgttttaaaatttcaggttaatccatttttcaagtttgtaataattaaaacttaataatcttcatcttaaggacattcaaacaccatcaatatgtgcattgtccggtttatcacaatatactcacaacgtaccttgctttcataagaaagaaatggtactcccttaaactcccttaaacgtttgactgttcggtttattcaaaaatcacataatatgtgatcacataatatgtgcattgcctggtttatcagaacatacttagaacataccttgttttcatgaaaaagaaatagtactccaaagcatgaaagaaatagtactcccttgaatgtttgattatctgttttatttaaaatttttgtgtaaatataaaagtatttatgtcatactgaaacaatatttgatgataaattacgtcataataaaataaattataattatataatttttttaatgagacgaatggtcaaatattggttaaaaaataaatggcattaaaatacaatactgagggagtatattgcgaatattgtcacacagttcatcctgatcctgtaggagtaatgg

SEQ ID NO: 59113 - DNA, 3398 bp, Oryza sativa
ttgtgcatagttctgaaggaaaatatacttgaccctgcagatgtcattgcacattgggcggtcagttcacatgtgcgtcaaagatatcttgaacatcttttccagaggtttggaaattgcacagtgaggctgaaagatggatatggatttgcggtctttgattctaatgatgatgcagctcgagccatgcgggcactgcaggggaaatttgtttgtggggagcgcattactgttaattggtcaaaacagcagcccagattttctaaggatttcagaagttcaagaaacattgagtcatctcaccagagggcacccagagtcagagatggtaatattaggttcagggattctttagctcagaagaatcaccctgcaagtcatgatcagggtcacagtcctgatgttgcaccagaacagaaatcatctgatggtgcattggaaaagaaatctgatgaaaagaaatctgatggtgatgttgaggatttgaaggatgtgagggaaactgttggtcaagatccagtggagatgaagaggaatgaagatgttacaagtgatgcaaatgtaattgaacatgatagatgggaggaaactggaaaagggaatcctggtagagatgatgatgattttgaccgttatgaaccttatcatggctatgccaggcaagaagaaagagcaggggttgtcaaagcaagttctcaggagacttatcatcatagattttcttcacagaagtcgaaagagtatcctgctggccatactgctcatgattgcccccagaaaacagatggaggattcgaagcatggagagatgcattgagtaggcaagaaaggctgagaagatttgggtctccctcaaggaggcaaccagatactcgtgattgctctaagaaaacagatgacagattcgaagcatggagagatgcattgagtaggcaagaaaaaggtatggtgaggctgaaaagatttgggtctccctcgaggaagcggacagaagaatttcgtgttgataaggtggtagaaacacatcgtatggtacaagatggcaggaaacaattttctgataggactagccacgctcacagattgagtaatgtttctagagaggacaaaaggcatacccgttgcagtgaaagtataccacagacccccaaggagtcacgcaagagaagcagatctaaaagatcccgtgggtcatccctctcttctgacaggagtacctcacattcaacatctaaatgttctcgttcaagagcacattccccatctcattctgcacattctagttcaaaatcatttcagccaactcagcctgaaggtttaagatcaatggcagtatcaaatgtcagtccattgctggtgtctggttcaccacaacacaacttaccatccacagcggaaaacaagaactcagattttctggtgaattctcctttggagggcaatttagattccaaaacaacaactggactcaagcatacacgtggttaccagcaagatatcaaagattcaagattgagtggagagtctccagttattccactcaggttgaaaatccaaaggaatggtgaattgcctgtatctggtaaagatgcttatctggatggttacacagagaccaacttgaataataacttggtttatgatgacaatgttgctgatggtgtgcaagttcagaagaccaattctgaggacgcttcatcagtgaagtcaagcaaggatattctggtgaaaagtgagaggagcaactctttgaagctaacaacaaatgaagtggtctctgctcttaagcacaatggaatggaagcacgtggtacagatttattgaaccaacctgtagagaagtactttggtgctgcacgcctatggccatgggaagtcatttattatcggaagcttaaaaagggtccaatttctacagagaactacgctaagcgacttgagcagaacaaagaatatagtattgtagatcggtatgtcagaagcagcagtggttggtgggagtgccactagaatgccagactggtggtatagatagatgcagttgaggctttgcgtgtatgctgctgcaggtacattttgaggatgacaaggtttgccttctaatcagtccattcctagagctccatgagtgtaagcagacccttaactatgagaattattaagtattaggttctttcattagtataattttgttgagtaagggtttgcacaattgcacctaagtagcttattctgccaccaatattatgctgttgcatggtcagtatgttttaagttgtaatgtttcaacgactcgccccagtgaggtacttggatggccaacaggtaagcaaagatgcttattttatacatgattttttggggaaaagaaacaagcctcttgtttagcagttatatagaggaaaggttctctctgtagtttatgatttccttagtactccctccctctggtttcataattcttgacattttggacaatgatatggtctccaaaatatatctttaactatgttttctctattataatatatacaataaataagtatatttttacttttattatagtacttataagacaaatctatatatgttgttttagtgtctttaaacttaatattttagaagttattgatagtcaaagttataaaagtttgatcttaaccttatcctaaacaccaagacttatgaaaccggagggagtatgactacaattatttttgtaatcaacaacttccataccccgctaatcgagctgaaatattacagtgatgccacttcgtgatagatttcatatgcaagatgtgctcccccggcttacaagcttttggataggaccaagaaattcttcgcatgtttgagtcgtcactgttatttttgtgtagctgaattggagtaggtgattgaagctttgctaactggattacctgttacttttatgtagctaccctatgaggattatgccattctggctggacacatgaactccataatatcagtacctttatttgagtcagtttttggtcttttaatgtgacttgtcgctgatgtctcatcgtcgtatcctgatatttatattgctctgatcttcttggggattccatctagacttttgcatgcgtctggctttatatttctccaaacggtgtgatagccagttgtccatgacgacagaacataaatttgggttcttgcatatcaaacgctttatttttccccgatctgcatcgaatgccaaatcaccatcatgttgggtagatgttgaatcggatgttttccttcttttcgtctcctttcacgaggagattggtatgtggtgctaattgcaattctcccagttatttagctcctcctgcaagctgctgcagcggttttggccttgctgctctttctggcgtcaa

SEQ ID NO: 59114 - DNA, 1111 bp, Oryza sativa
tttatatgcatgttacttaatttatctcgtcatgtgttttagatggtcttttatttcaataatatttatttttatcaaaaattttagttatttataaattgtattcctaattgaaatcttatttttctttttctaatttcagaatttttttttaaaaaaattagttattaccgtattgtgttcttttaatgtttttattttttattttcaatttcagttgtttcaaaattgtattcctacttgaactctcttttaaattttctaattttggatattattttattttttatcctaaattttaattaatctcgtattgggttcttatatggattcttctttaaatattgcttatttttaattccgaatttcagctaattttaaattatattcctacttgaactcttcttttattttcttttgctaatttcggatttatttatttttattccaaatttttattaatctcatattgagttcttatatgcactcttcttttaatattccttattaatctcatattttttttattaatctcatactgtgtctatatgaattattcttctaatatttcttattttttattcctaatttcagttgtttgtaaaatttatttttacttgaactcttatatttgatttttctagtttctaaatctattttattttttattacggatttcaattaatctttaattgtgttctatatgaactcttctttcattttttattgtgttatttcaaaatcaaataaaaatccgtgcacatgccatcatgcttttctggttgctgacgtgtgcatcacccaaatacggctcactgtgcagccgcacggcttgacccgctgcttcggatttccatcgctcgccgttagcatctatcttcatattaacaaaaacgcatccaaattacggttctacagtggttcgttgcccgctgctttatttatatatgtatattatagcctaattcatctctaactttggttaattggtttaggaaatcggacaaaactcttttgagtccgtttgcatataaaggtcctagctagagattgattctaattctacacgcgtactgtactccgtatctcttaattaacatgccaagtttat

SEQ ID NO: 59115 - DNA, 1251 bp, Oryza sativa
taatcagcatgatagtttaatagcacaaaattaataatatgttaccgtcaaggaagggccatttatagaaagttctatactagttaggctgacaaaagcttccttgggataatttttcttgtcacccgcaacagcatcacattgttctgtttctgttttgtcgagtgtaagatacaacagattaggtgcatgcagatgcaagtcttcgaaattcccttgaacctctaaatgctgcagtgccggagcttgaatacggagacaactgataccctcaaaatatttcaaatgcagtgttttcagccatgggcatgaggagatcagatttgctatgtcagcgtctgttgagtatatatatttcagattcaagacagatagccgcttgaaaccttcaaacgtctgaggcaacgcaaccatacatcttttcataacaagtgcttctattccagttaggctcacaaaagcttgcatcatatagtttttactcctgtctgcaacttttgttttgttgagtgtaacatacacattggacaggttaggtgcatgcagatgaaagtcttcaaaggaccctttaacctctaaaacctgtactgcctgagcttgaattcggagacgattgatacccttaaaatatttcaaacgcaatgtattcagccgagggcatgaggagatcagattatttatgtcactgtctgttgaggagaaatatttcagattcagaacagttagctgcttaaaaccttcaaactgccgaggcaagctgatgatgcatctttctatccgtagatattccaaatcactgatagagaagaggcacgatggaatcttataataattcccacaggaaaactcgattgtgatggaacttggttttttccttgacagcatgtgcatccacctatcatatgcattaaggtaactcctcaaacatcaaattgaaaacgaaactagaggtccatttgtggagcaacagtgacagatctaccagtgtagtaaatttggaccgtaatgtgcctgagatgcgatacgtatcgaacagaataagttgccacattcctccaagcacttgataggatgctggctctaatagcatctacgacattcaacttcgagaggatggcgacttttagctctggaggtaggctgctgagtctatctaaactctcagctgattgtgattccacctttgcctttttagcacaatgcatcgctccagaaatcagattgaagtgacctagcaatttccgaagagct

SEQ ID NO: 59116 - DNA, 713 bp, Oryza sativa
cagggtacatacccccgtccgggggaggaggcggacctacatgctgtgcagcggaaggacgacgagtccctccgctcatacatacaacgcttctacaggtccacaacactattccgtgcatcccggcccacgcggtcgtttatgcatttcggaacggcgtgtggcacaaccgcatgctagagaagatcgcctccaaggagcctaagaccaccgccgagctcttcgagctagcggacaaggtggctcggaaggaggaggcgtgggcttggaattcccccagcactggtgcggcggctgcggctgcccccgagactgcccctcgctccaagcggcgggacatgaggggcaagcggaaaccggcccgctctgatgacgagggccacgtccttgcggctgatgggtcttcgcgggccccgcgcaacgaaaaggccaccggtggcaagccgagctccaccgccccctccggtgagggtcgatcggcggacaagtggtgctcagtgcacaatacttatcggcacagtctcgccgactgccgctcggtcatgaacttggccgagcggtttcggaaagccgatgaggagaagcggcagagtcgacgggagggcaaagcccccgcgacccccaccaatgatcggcgagaggagtccaagaagaaggcccccgccgacgatggtgatgacagcgaggatctggaattccagatacctaaggga

SEQ ID NO: 59117 - DNA, 2128 bp, Oryza sativa
aatcagctgaaagcttacctcacctcccccccatcctagtagccccagggccagaggaaccgttgctgctctacttggctgcgaccccccacgcggtgagtgccgcccttgtagttgaacgcgatgagggtgacccgcattgcgaacccggctatgggaagggaccaggggcccccttgactggtgatggcctatcggagcttagaactaacaacttggatccgactaagataatgtaccaatccctggatcagtaaatattgatacatacaatataactggttcttcattgcatatgttaaagttttacaatactaagggttttacaataataggtactcacctagctaattaatacacagcggaagtttctatacattctgactaggaaggtataacctttaaggattctctaagttatcggggtcatcgtagtaatagtcataagggtccttctcttgacccaaatctgaaaaaggggttataagagtaaggatgagtattcacaatactcagcaagttatcatggaaatatgttatgcattgacatatattagggttctttacaaaaagcagtactagacaatctggaagagttatagcaagaatttataaaacatatagactttagatttctaaccagggtaccatatgagtcccggtactcaactccatgagtacggctattcgaatagtttcaaaaatattctactgcagcagatgtacgctttacccgcagtccacgacttgctgataatcatcggctttagtcatggcccattattaagtcattaaaaattatggcacctgttccatgaacttatatcctcatatgctctgaacgtattgttaacagcaacaagaggagttctggcgttcccgagatatttaaggggaactgatcgtatgacaccacatcatctcgatcagggtttagaaatataccatatagtttatactcgagtatcacaaaccatttacctgtacatggtaatggttaaagttgcccttcgcggctatagttgcctcctgtgcgaggacttaaaaataagaaccactatacagaggtgccatattgctaattaacataataactaggtttgtccccattctagaaattgcggtcatacccgttcattcgacataagtaccttggtaaacttatatcgatcgagacagtactagccacccgggagtcaaccaaatcttacgtactgtcccaatctaagtataaggtattttaaccagattgtaagcaaagtaagcaatactaaattatatgggtttctatgattatactatgcatggaaaatagtatattgaatataaggctataaattaataatttataaaatataggcttaaatgatcaaaaggtatatggtaacttgccttgctcgatgtcttgagattgattgatattatctattgagtcagaagaatcctcaagacctagggttagacatatatagaattgaaattctaaaggtgttcagataaatccccgagatatgacaaatagagcggataaaatagaatgccaacatagcaaaaaggggctcaaaagatagagaatgattttagaagaatattggtccgagtttcactggaattggatctatattttaaaagatatgggcttctaaagtttgagaatcaaataaatgtgaaatggcactgtgtgcgggtcccacctgtcagtctctctctcttctcttcttctacctccggccgatccccaaaagcggctggcggcgctagggttgacgattacagcggtgatggagggggaaagtggttcggccgaggaggggagggagctagggttctccggcgacggcgagcgacggcagagggattaatttgatatgtgaatggcctatcggctagggcggcggtggcatgtttagaccgtgatggtgatcaagatgatatgagttagacatggctagaggaggggttctagagcatttacgaggtacctagatgaattccggcagcttgccaacctttggcaaggcgtggattaattcggctggcgacgtgttggcgccaatccgggcgcgacgcgcggcggcggcgagggtgaaaacggccgactcgggggtgaatggtttgaattgtgaga

SEQ ID NO: 59118 - DNA, 1038 bp, Oryza sativa
ggatgacttcgtcgtagaatggacaccggtggatgaccctcttccgtccgatttccctccctccccggagacggtggagacccgagcgccgacattcgcgccgggcactgggttatgcacttcgacggctccctcaaccttcgtggtgtgggggctggagtcacgctaacttcgccaaccagggatgtcctcaagtacgtcgttcggctcgatttccgagccacgagcaatatggcagagtacgaaggactcctcgcggggttgagggcggcggccggaatgggcatccgccgcctcctagtcctaggtgattcctagttggtcgtgaatcaggactctaaggagtaccagtgcaccgacccgcaaatggatgcatacgtccgtgaagtacgacgtatggaacgccacttcgacggactcgagctccagcacgtgccccgacgcgacgatgcaatcgctgatgagttgtcgcatatcatgtcggcgcgagccccactccctccggggaccttcaggaaaggctcgtgcagccgtcggcacatttggaccccccgagggaccccggcgccacgacctccgccccgagccccgacagcctgcgggcctcggggcccgaggggatcgaccccaacccccctcgtcacgtcgcctggatgactgacatccgggcatatctcgacaataatactcttcctgaggatcgtgcagaagctgagaagcttgcgcgtatctctaagcggtacgtgctcgtagaagggaccctcaaccgacgggccgccaacgggatactcttgaagtgtatttctcgggaacagggcgtcgagctcattgctgacgctcatgaggatgagtgtggggacattccgcctcacgcacattagtcggtaaagccttccgacaaggtttttactggccgaccgcgttgcaagacgcccaggaatgggtccgacgattcaaggcgtgccagttccacgctaagcaaacccaccagttggcccaagccttacaggtcatcccgctctcttgggctttcgcagt

SEQ ID NO: 59119 - DNA, 2416 bp, Oryza sativa
atgagtatattgcgtttagggccaccttttattatcaaagtttcattttggaccaccctttaacacattttttcactttgggctaggttactttacctttctttcactttggaccaccccataaactttttaggaatatataaatgacttttccaattttaaacacatcagcaacccgtaacccagtaatcttttccaacttacacatgcaattctttacaatattatagagtagatgtaactaaagaaaataattttgggtggtccaaagtgcaccaaaggtaatcttacctagtccaaagtaaaaatatgagctagaagatagcgtaaagtgaaactttggtaacaaaagatggaccaaagtgcaattaactcatattttattaacgaccaaaaaataatttatgagtaaaatttttatatgtgtcgtttgcgacttaaaattcaaagtttttacaggtgttgtttctttgtaagccaaacgatgagcctccataattgcacatcgatgcagccttgttgcgatatacatgaacaccctcttaatttattgcagacagccctcaaccataactacgtacacggatcatcacggtcgaaaatatggcctgctcgtctgcgaagatctatagtccttgcagtgaaaaatcggttttagtattgtttgtccagcgcgataatcaagcaagcctagctaaatgctgattgacaaatcctgagaacaaatctcctagtaatgtataaattatgtagcctgttgctcttctcgtaactcaaatctctagtaatgtataaaaacaaatctgtaacctgttgctcttctctcttctaatttatcttcttaggccatcagcaatgggtgccttcgacccgtcccctcgcaaacggccatcaacttttgcatctgagccgtgccccaggcgagacgcgcgttttctcccagagggacacgcccctcggcgacttttggcagagcaaccaggcaaggagccatgttgtgcgcgtcgttgcttgtggacaccgctccccacacccatattccctttccacccttgccagagctggaggcggcgctggcgaagtggacggcgacgagcagaggcggggaagagagggggaaagagcggatctagcgccggcgaggtggatggcgatgagtgacgggagggagaaagtgggagagagagagagaggcgagcggcggggcggcgacggcacggccgtgccccgcttgctgtggccgtcggccccctcacgccgccgtccggggtcgccgccgccgcatccggggtcactgccgccgcctccggggtcgccgccaccaccttccatgggaaagagcggcgggagagagaaagggagagagaggcggcgacgacgggcgacggcgagatccgcccacgacgcgccggatctaccgcctccgaggtcgccgccgccacctccgggtagccgccgcatctcccgggggacgaacccctcggcgacctcatccatctccgtcttggcctcctccgcgcggcgccgagagagaggcaagtggcggtggtggcggctggggagggcgaggagggaggtggcgccggcgctcgcgggagagagagggaggggggaggacggcgatgtcgccgagcggagggagtgatgccggcgaagaaaaaagaagaggagaggaaagagcggaagaaaaagtggagagagagaggggggagaagagaggggtagtataggaaaacatctaatgtgggtttttttgttaggacacccattgtgggcttgagtaccttcatctagttgcttcagattttgaggaactcatctaagggtgtctattattgcgagctaagttcctctacgagtgtcctcagttagtgaggacactctaggagtggctcacattgtggatgcccttaaattatgtttacagctgacttatagttgtacccgctttgagaagtcaaacctcctagtaatgcataagagctagccaactaccggcttcaattcatctataaccaatctaatagctcattgcctataagtatatactacatcactaatatatggtcctacatcttatacacacaaaacgtattaaagtttgtactgcagctggctataaatttatagcccgtttttcttttcttcttcatatgtgcttacagctgacttatagcctgctattgtactcgctctaaatgcaagacatcgaatccatacaggtcatacacacgcatgcacacgcgcgcacggttgacttttttctaggttccgtgcagtgtgtttgcgtcgcgtcgtccatgcacatgtggcctaattacttcggcatttaagagacacgcacacaagaacgaaagttactgcagccgtagaccattagatgagatctgattgattagattaatattgcgatgaa

SEQ ID NO: 59120 - DNA, 2096 bp, Oryza sativa
taagctaccagcataccaccacaagcccacgactatacatcctcatcttttctcttatgcttatcactcaaaatttatattttcaactttaaatttaaatttggagttgatttggaggattttttaatcaaagttttttttagactttgcttttagattgctaagaacacgtatgtaaaagttttattcacagattatttttcgtttgtaaattattccatcaataagccaaatgaccggggcgagaggctccttgctgacacgtggaggctgctgggctggccaaggtggccgacaacgttggcgtttgcatcgccggtgacgggaaggccgccttgcccgatgcccagcgacaagcgccattggaggcaagggataataaccgtcgcgaaacatatcaatcatttgtataaccattttttttaaaaaggtaaagctgaaaacgaaaacgatgttgagaatatcggaaaacaggaaacggactatacagacggaagcatgtcgatatcgatcggaagctgataataaatatcgaaaacactaaactataaactcatatgacaaaataaattgaaggttatactaatactctcatatttagagtgacttgaatataagaagttggcgtgagaataccaaacaggcatctggctgacaggagtagtacacactgtaaacagcaaaggccctgttgctataaatattgtagtatatgaaaaatttaaagtcaaaaattaatttttaagattttgttaagtttaactacgtcttaataagtgagacagagggagtagtacatttgccctcctggggtcctggtgcctgcagataccatagcactgaattccaccgtgtatggaatattttcctgaggataatgttgtgtacaaagtcttcctccgtctacaaatgcatcccctgcatttaacatctaatgaagaaacaacattaggtggaaatgcccgtataccatcgcttaaattcacattttgccaaaaaagagatcactggtgtgcccacatatgaacgaacacatcagtgctattttggcaaactgtgaagtcggtcataacatgtgaggatgtgccctcgagaaattgtgttactattacactatatcacacagatttaaaatctgcatgtgcacgaccattcacaattacagtaatcagtaacatgagcgtctccacaccacccccccccccccaaacacccccaaagagttacatagagaatcaggctcccatcggatagcctattcagccaaagaaaaagccaaattttgaattttcaaacttaattttgatattgattttgagatatttttaacgtagtttctttttcagcattagctttttaagtcaccgagaacacatatataaaagttttacctacaaattcatttttattctctaataagccgttttggcttattacgaaaaaagccaaacgatgaggctctcaccagtcctgcaacagtaccacccattcaacaattaacaagcagtttcaatacagtttaccctttaataaaacaatagaaaaaacatattttatgaacaaagcaacataatgcttacattgtaaacacatatgtaaattataactgaatagacatgtgttctaaaaaaaataactgaatagacatacaaaggtctacttatgagtaaagaaaatgaatttaatcctgttaaaccaatgttcttttaatcgacaaagccttgtcctttgctttgactatatcactattctatacagactaacactacatcatttctaggagaaatgactaccggtacgatctggaatcgcacatcccactggattgttatacatggttcgtcggcttctcgccttatcaatcatccatcatctgctgcctttggatctcaccaatatatgatgtcaaagaagatccagaagaattggccgtcctattattgacacggcattgcagcaattgttgctgaagattctggatgtgctcattcaatagccgaatcatcttttcttgagataagattatctgcaagaaagtttaactcagccagcgcagcaattttgtgaatttgcaaaataaaaataacttgtctcta

SEQ ID NO: 59121 - DNA, 1958 bp, Oryza sativa
cgatcgggcggtagccggccgggaggcaggcaggcaggccagcgcccgcggcgccgcgattcgtgcgctgcgttgtggccttgtgggtgagcgaactgtttccttcgaggtgagagcagtacatccgcccaaatatgaaaaacaaatttggattggaacgaaacgtcgtctagtacaacgaatctccatacgtacaaacgaacactcatccttataaatacacagttacactttacctctgtaagtatattcgaaagattggatcggcgtatcttgagattgacgaaatcaccacagacgtcttgctgtcgataggtacatctcctatcactaaaaaaaatagccgtaaatgagagcacacatatcgtgtctagcacataaaatctgggtggactgattcgaccacaaggaacctaaccatgttaaaatttgataagacaacaaactaatggcttgttcactttgctaccattttcaacattaccaagttttggcattgccaaattttggtaaggttggcattgccaaattttggtaaggttatcaaaattttggcaaggttgtcaaattttgacaagatttcatatgtacttactgaaatttggcaataaattaaatatagccactttttggtaactttgccaaaaaaaaaaaggtatggttgaaaatagtagcaaagtgaaccagccgtaaacatgctattgtcgatacaaacttactaaattttggtaattctggaactttccactcttagggtatgtttggggggagtttctagcagctacagcttcttctagaatcttcagttgctagaagctcccccaaacaatccagctttttatccaaattctaagaatgtaaaatttagaaaataaactagaagctagaagctgagtttcccagcttctccagattctcaccggctagcttcttctcaaaatcttaagctactccaaaaagacccttaaatgttttaccaaacttttgtaagaacacaaactaaacattctcattcacatcttaccttattaaagattgataatgtcaaataaatagcattatcaaaatataattgttttttaataaagtgggtgtggagattatggataccccatacctacacggcatgtataggccgactgggcgtggggtgccatgtatagatagaatatctttagagagattcgggttaaattctaaacttgtatgtcaaggaaatacccgagatcctagtcggttacgattgtattttatgctgtcactacttattccgttaaggatatggactgtattttgtaatacggatcccatctcccatataaggaggggtccgggtgccttgaggggcacgattttcttcagatcatacgatcaataatcactcggcggatcaatccccggataggagtagggtattacttcttgattaagaaggcctgaacctgtataaaattccatgtctctaaacccatccacttttccagcttgatagccacccccttttagtattgccgaaatcttgtttcgacagttggcacgccaggtaggggtagcgtcaagttcttcgccgactagtgagatgggtttcgtttccggcatcaacgacttcgtcttccctcctgggcaggcgtcccggttcggcagcctcgacttcatcaccaacgacttcggcaagatttctctcctcgactcggattcgaaccagtcgggaagaggccagatctccgccccgttcggtatcccgaactcggccgaggtctaccccaagatcatctccaccgagttggcttcaaaccactcggacaagatccaatctacttcaacacgacccgatcaagatgatggggcctattcgccaatcctgatgaaactccccgatgatttggctgctgtcttcaccacaagggcatcttctcctcgcaagcctgggcggaatccggcttcagccccggcccagc

SEQ ID NO: 59122 - DNA, 3097 bp, Oryza sativa
gaattatttgcctgtggccctagcggattctgcccggtcctgacttcacgggttacttcgtggcacaatcggatcatgggcggaacttcgcgaccacttcattgccaactttcagggtacctttgaacgccctggtacacaatttgatctctacaacgtcattcagaagtctggagaatccctttgagattacatccgacgcttttccgagcaacgcaacaagatctccgacatcaccgacgacgtcatcatcgccgccttcaccaagggcattcgccacgatgacctagtcgacaagtttgggcgcaagcctcccaggacggtcaagcagatgttcgaaaaagccaatgagtatgccaaagccgaagatgccattaccgcgtccaagcattcgggcaccacttggaagccgaagaaagatatgccaactacaggggggagtggaagtaccaatcacaaggatcgcaagcgtaagcctaaggaacttgtggcaactactacaccatcctcccgacaacgttcgcgctcaacacttttgacaaaatcatgaactcccaatgtctgcatcatcctaattccaatcacgcggccaaagattgcttcgtctacaaacagtttgcagaacaatacgccaagaacacatgcaaaacttctgacggagatcaaagcacgtcaaagaaaaaggatgatgaagatgatgccccgactggttttcaagaccaccgcaaggaactcaaccacatcttaggcggacccctggcattatgaatccaagagaaagcaaaagttgaccgaacgggagatcaacgttgttcagcccgacacgccccaatatcttcggtggtcagagacaacgattaagtttgaccgctcggatcatcctgaccgagtggtccacccggggcggtacccctggtactagacccagtggttcgcaacgtcaagcttcgcagatccctcatcgatggtggcagtgcactcaacatcctttttgccaagactctggatgacatgcagatccctcggacagaattaaagccgagtaacgcgccctttcacggagtcatcccggggctatctgctacaccacttggccagatcactcttccggttactttcggcactcgggagaacttccgtacaaagaacatttgttttgaggtcgctgattttgagacagcatatcatgccatactcagatgcccgacgttagccaagttcatggcagtcccgcacaatacctacataatgatgaagatgcctagtcctcgaggagtcatatccctgcggagtgacatcaagcaagccgtcacatgcgacaaggaaagctgcgagatggcccagacccgcgagatcactctcgcccgagaagaaatccgactggctgcgtccacatcaagcgaaggagaagtgcctgcaaccaagatgtcaaagagcggagaaagcgacgccaagaccaagaagatccccctagatccctctgatcctactaagactgctgtaatagacgctgagttagattgtaaataggaaagcgcgctcatcacctttcttcaaaataataaaaatatttttgcgtggaaaccatctgatatgcctggtattcctagagaggtgattgagcactctttacatgttaaagaagacgctaaaccaatcaagcaacggctccgtcgtttcgcacaggataggaaggatgcgatcaaggaggaattgaccaagctgttaacagcaagcttcatcaaggaagtccttcatgccgactggctggccaacccagtcctggttcagaagaagacgggacaatggcgcatgtgcgtcgattataccgacctcaacaagtcttgtcctaaagatccctttgggttgcctcgcattgaacaggtagttgactcaacggccggctgcaagctactcagttttttggattgctactcaggatatcatcagatccgactaaaggaatccgactgcttgaagacttcattcgtcacgcccttcggggcctactgctacatcaccataccttttggattgaagaacgcaggagcaacttatcaacgcatgatccagagatgtttttcaactcagatcggccgcaaagttgaagcttacgtggatgacgtagtcatcaagaccaagcagaaggatgatttgattatggatctagaagagacctttgcgagcatccgtgctttcaggatgaaattaaaccctgaaaagtgcatcttcggagtaccataagggaagttgcttagatttatggtgtcctatagaggcatacaagctaacccggagaaaatcaacgccatcctcaacatgaaaccgccgagctcccagaaagatgttcaaaagttaactggttgcatggcggtgctcagccggttcgtctcacgactcggcgagcgggggatgccttttttcaagctgttaaagaaaactgacaatttccagtgcggacccgaagcacaaaaagcctttgaagacttcaaaacacttctcactactccaccagttttagcttcaccacatccgcaagagccgctgttgttatacgtgtcggcaacttcccaggttgtaagcacagtcctggtggctgagcgtgaagaagaaggccatgttcaaaaagtccaacgaccaatctacttcgttagcgaggttttggctgactccaagacaagataccctcaggttcaaaagctactatatggcgttttaattaccgtcaggaaattatctcactacttccaaggtcactcggtcacggtggtcacatcgttcccactaggggatatacttcataatcgcgaagcaaatgggcggatcgcaaagtgggccttagagttgatgtctttggatatatccttcaagccacaaacttcgatcaagtcccaagctttagccgactttgtcgccgagtggaccgagtgccaagaagacacgcctgcagagaagatggagtattggactatgcattttgacgggtcaaagaggatttcaggcactggagcgggagttgttctaatctccctgactggagagaggctgagttatgtattgtggatacatttttctacgtctcacaacgtggcagaat

SEQ ID NO: 59123 - DNA, 2771 bp, Oryza sativa
gtggcagaatacgaggcgcttcttcacggactaaggattgcaatctctttgggaattcggcgtttgatagttcgtggagattctcagttgattgttagtcaagttatgaaagagtggtcctaccttgattgtcacgactggaaataacccaacgggcgttccttacgtgcgtgtattattccttgtcccaggaggcaaggtacaccaaaagttgatacaatacagagtttaacaagcggaagcgtaaatagttaatttattacatgggcggcgaaggcccagcacacatgaagacaaacgaaaaacaacggaagactagggcgatgaccacaggcgcttgacggcaggcacgagctagacaccaaagccttcatcttccaggaactcctcttctgggtttgggaaaaattgagcaagactgagtacagccaccgtaatcaacaagacgcacccacaagtgcagaataaatgcaagggggtacaagggagttatattatagggggttagggtttgcagtaaacagcattaaaagacacttagttgctcaaagttacttttaaaaacacgatcctagagctatacaatattattaaataaggtcgtgaacccatacgaacctgccttacccaagccctacgatgattcagaccgaactggcaacccgaccctgggtcccagcttgtcccaagccaacccaggccaaccattccacattttagttgttaagcaggtttttaagaatttaaaacactaacttgggtacattgctaggcttgcctataaccgagggcgcggctattcgaataggttatactctaatcagaggtgtacatccttacccacaagacacatcttcctcacgtgtaaccacgtgccacataccaccacggtatacggacaaaagacgtgacatagttcccaacccatcatagccatagacaagagtaccgacccagccccacctacggccggaacctccgggacaggtaggcaggactgagcccctagcagcaggacaccagccctgtgccatgacatctcgactaccgggccacagctcgtgtagccttcatttgtcctagagatgtccatcgacccccgacttcgtccatctccatccgtgtacttttgtttataaccagactgagccacaaactaagccttacccactagacatgtggaagcacggtagtgctttgcaacagaggcccgaagaccggtccttatgtgggcgaggtgctactatcaaaaccatgcaccccgagcccaacctaaaaccattttgatggttttgaatagagggggaggtgtgaatccaattccacaataatctaaccattccacaatgtccaagtgatatgaatattcccaaagtctagagttataaaaccacctaatgttgcctaattaaacagcgaagcatctacctaaattcatactagtggtaccatgaatagagtacccactagttggggttttgtttattctagggtgaacaaggtaataataacaataacaataataataaggtcataacaaaggtaaataggcatggctaaataaaacagtgataacgcgagaatttaaataaagcgataatgcattaatttaaatcaaaataattttataaactgggattcaatatgttcaaggatgatgtgacttgccttgctcgctttcccaaacgtcggcttcaacctccacgtatagcggatcttccggagctgcagcgtctacacgaccaatggaaaggaaaaagtcttttactctaataaactccatataacaagcaggaacaaagcacaaaaatgggttcttgacttcttgaggaaaaattagagacttgaacggtccaattccgagttcaaatggccaagttatggccatttgaagtttatatgctctttaagtgaatatttgcgaatttcttcatttaaattttaatttaaaatggatttattgcgtcagccgaggggagggggcgcgtggaccgggtccacgggagtggggcccacgcggcagcctcacggtccacggtggaccgggcacacccgggctcacaccggccggcgccgtgggccccacgcgtcagccgcacccgagggcgcgggtggctgacggctgggccccacgtggcggccacgacggtgcagccggcgggaggcggcgcccgcgcccctatggttgccggcggcggccataggcacggcggagcggcggccgagagaggggaagggaagggggaaaagaggcggcggtccacggctcaccccgagtcgacggcgacgacaaaggaggcggccggagcggaggaaggcggcggcgcggctcgggtggatggggacgacggcgctctggcggtcggcgagctcggcgaggtggtggacggggtcggcggcgatgcggagaagccgaagaaggcgacgccgaggcgggagacggtcccggcgagcggagagggccggccggaggtcgtcggcgacggaggagagagagggcgacggcgcgagctcgattccggcgggaagacggtgcggcaagtggcggaaacgggtgagggaggcgcggggagggtttaaatagggttgggagggagagagggcggccggcgggggaggaaaccggcgcgggaggtccggccgccatcaatggcgccggcgagatttgcgggagcaaatccgtccgtttgaatgcgagaaagagagggagaaatgggggtaaagggggaggggatcacggggaataattccccccacttaattgctcgcgg

SEQ ID NO: 59124 - DNA, 1696 bp, Oryza sativa
gattcggcccatccgaggggagagagattttagggtttttctttttataaaaaccttttcaactttgtttatttcttaataattattatttgtgctctgaaaattccactaaaatttatttacacattttaggcttttagaaattatacaaaaatcctccaagccttatttgacttttaactttgcacattttattttttggaggctttcacaaggattttaattattctaggcataattttaaaggatatattttagggtcgttttaggacgtgacattgatgataacatgaccgcttaccggcaggaggtgcgcaagttggaagataaattcgatggacttgagctcacccatgttcttcgacacaataatgaggcagccgacatattggctaatttttgttcaaaacgggaagtagccccttctgacatgtttgttgaacatctctacgagccaaccgtaccaaggaaagaaacaatcgaggccgcggacactcaagacgtaagcgtgattgaagccaactggagagagcccctcataagatttttgacaaatcaagaacttcctcaagataaagatgaagccgagcggatctccaggcaatgcagactttatgtcattcatgagactgagctgtacaagagaagtccatcgggaatcctgcaacgctgtgtttctttggaggaaggaagacaattgctaaaggatatacattcaggtatctgtggcaatcacgctgccgcacgaaccattgttggaaaggattaccggcaaggttttttctggcctacagccgtgtccgacgctgacaaaattgtgcgaacatgtgagggttgtcaatttttcgcccgacaaactcatctaccagctcaggagttgcaaaccatcccgttgtcttggccgtttgcggtttggggcctcgacatggtcggcccgtttaaaaaggcagtcggtggttatacttatctctttgtggctattgacaaattttccaagtggattgaagccaaactggtcatcacaatcacggcaaacaaggctagagatttcttcatcaacattatgcaccagtttggggtatccaacaggatcattactgataacggcactcaattcacgggcggagtatttaaagatttctgtgaggacttcggcaacaaaatttgttatgcctccgtagcgcaccccatgagtaatggacaagtcgaacgtgccaatggcatggtacttcaaggaataaaagcgcgagtttttgaccgactgcatccctatgccggcaagtgggtagaatagctgccatccgtactttggtctttgcgcaccactcccagtcgggctacgggccagtcgccgtttttcctagtctatggagcggaagcgatgttgccaagtgaggtagaatttgaatctctacgatttcgtaacttcagcgaggagcgctacggagaagaccgagtagatgatctcaaccgactggaagaagcccgtgaagcagccttaattcagtcggctcggtacttacaagggatgcgccgttatcacaatcgcaatgttcgatctcgatcttttttagtcggcgacttggttctgagaaaaattcaaactacacgggatcggcacaaattgtctcccttgtgggaagggccgttcataatttctgaagtcactcggccaggttcttaccgactcaagcgt

SEQ ID NO: 59125 - DNA, 1347 bp, Oryza sativa
  unsure (1)..(1347): unsure at all n locations
gttatcacaatcgcaatgttcgatctcgatcttttttagtcggcgacttggttctgagaaaaattcaaactacacgggatcggcacaaattgtctcccttgtgggaagggccgttcataatttctgaagtcactcggccaggttcttaccgactcaagcgtgaagacggtactcatatcgacaactcttggaatattgaacatcttcatcgtttttatgcttaggcattacttctgtattttcctctttgactgttaacatcaagttgtcccttgagttatcagtcgggggctactataataataatggagtgtgatttttatcaattcaatttgcttacttgatttatcattgccttgtttgattttttggctcagtcaatgaagactgaaagtttttaaaaacttttgcgggttctaggctcaataaggtttgacaaaaacttttaagaaatcaggagctgagtttaaatcatcaagcatagcataaattcatcagtattgcacaaattgtgcctccatcatcatcattaatatcatcaaaatacaacatcaattagactcagttctttcatcatcagaattaccagacccagttggcttaaggtcgttgtcctagaatctctcaaccacatcagcggctatcttgtcagtggccttttgcgcatcactaataaggtcaagggcggcctcgtcacttgtcccgtcagcaaagccgtcaacagcatcaatatcaatcttcgggtacaagtacatggtcatcgccagcgctaggcctgctcccatactcccagcttctttgatgttcttaaaatatgtatctagagcagctctcagcttgtcgaagatctcgatagcatcaagtgaactcggatcgttgttattgaaaaacattgcctggacgagtggcgtagcggcattggtgacttcatctctggctccttcaagcttcttaattttattaactaagacgtcgaatttggcctgggatttgatcttgcggtctacacgagtaagtttacatcaatgactaggtgtgaagatgagagtggtttttgaagtgttagttaccagtaccttcgacatctttcagagccgagtccctttgttttgccaattcggccttgtctttctccagagcttggatgcgcttttccagctcggatatcttggcagcttgcactgtattgcttcttgttggttgatatcacaaggatagcagtataaataagtcagacaaagacggtatttaccttttgacgaactgctcagctcaaagttggaatcttggagnnnnnnnnnnnnnnnnnnnnnnnnnnnnnnnnnnnnnnnnnnnnnnnnnnnnnnn

SEQ ID NO: 59126 - DNA, 1056 bp, Oryza sativa
  unsure (1)..(1056): unsure at all n locations
gtcggacagaacaacacatcctaactgtcgctatcatcccacagaccaccctcgttctgcaattgcttcacggacacgtgtagctacttcaatagcatcgtttaggggagggtagctccagctatttgaaatctacaaggaaaagaagaatgatatagccacccagaattgtggatatacaagtacatccttgtgaacctcaagaaaatctaaaaaaaaagggtacttgaaaaaccactagttatcaggtgtagttacttgagcataagttgtcttgttgatttacatcttttcattagcatatctactaatattttctgaattgtgagttaatctacactgtccatgtgccataaacttccacttaccatctacaccaactattccacaaaaacaaaaatatgtcagcagtggtcaggaactcaggatagctcagttggtaaagcagaaagttcatgtgccacattgacatagttttactgtatttttatgcgagccttgtcattaaagattgtcagagtgacaacaatagtatttcccacacaacgataattgatggcaacaacaacaataattgacataattctactatatgcacaaatgaattcacaatgcattagattttattcaagtaaatgcagcaaatgcagaaaagaaaagaatttaataactaggatcaaaatcaatgaagcatgaggattaagaaaaatcaaggtgccaaaataattaaagtaaaaccttcaagggataaggttcagagtttataaagatattaaaatagtgaatgattagtactacagcttagctttcagaaaacggacaaatggtacatgcttaagttatgcactattctattaggcaagtagccaagtaggcagtataaatcaaaacaaattatcattgacaggattgatagacttacatcttccaatccagtgaaaggacggacaactcctcgctcccgtagagtcttgtgaaaagcaaaaaacttccatttacaatactcagtcccaatgannnnnnnnnnnnnnnnnnnnnnnnnnnnnnnnnnnnnnn

SEQ ID NO: 59127 - DNA, 1512 bp, Oryza sativa
acccataaaaaaggtaggagcttgctggaaattacgtgaattttaatatcagcttaccctgtgctacaagcctcacttaacatacttatagaatcagctgttacaacaaaagcatcagcccatgcaagatgccccatgtgcgggttaggttctgcaaaaataaaatcaacttgttacaacttacaaatgtaacaacatgcataataaatatattacatcatgaataacttagtgttatatttcatctaccttccccatcccaaatatagatcttaggatgaccagcgaactctttcgatataatatcagagacctgtcagcagataattaaacttaaatgccaagttctttaacgatattataacagaaaaaccagaataccaatcgtcctacctttcgcggtgttctcctggaaaatgaaactctcacactcccacagctgtctagaacattatacgtagaagctatgagctgcctggcaaggtcgacaccatacttacaattccctaatcattgacaaataacaaaagtcaatattggatctgggcatgaaaatcaataatgggacacatacaaaactgtaacaaaataagcttaagataaaaaggattaaaagccaacagaaattctgttagctctctgtaagttagacatgcaaaagcatatccaagagtcccaaggcagttgactagtcgataatacttctgaaaggtgtacagagaaggatataaaagatcatagcatcgaaatgctttgctcattataagattcgctatatgtttatagtcctcacatactatatacgaaattctgaccctgagttgatttgtatcataggctctcatgggttttaggaggaaagctgaaggctaatacagatatctaaacaacaacatcaaatgtggggttctcaatccacagtccacaggtagcatggagtaatggcacatcactagttctgcacccccaaagatctagggggaggggcaaagaatgcaacttcaggacataaaaaaggtcggccttttactcttgatgattctagcttctatggtatctttatgatgcatcacattagttaaaacaatttcataatgttccagggacaatggcgttgcaaggaacttttccttgctacgataaataagagatgatatccccttagagatcatcatattgagtaaagaaatcaattgagatatcctaaaaatgatgaatctcctgttactgaaagaaataacaggtgtatcttctatgcaactgactagccacatctaacagtaacacatcgacatatcatttcttattttttgtgtgtgcactcaggtgcgcataggtttctccatgagaaatcatcagagtgcaaccatttgaattgtggctagatttattcttgcaaactcaaagcaggactacgtatccaaatacagaaacaatggaatgtgcaacgtgagaaagatagggagatctacttgtgggtcctccaatgttgacgattagcaatggcttagg

SEQ ID NO: 59128 - DNA, 2154 bp, Oryza sativa
cccctcgaccaccggcgcaagcctcgtgttgcggaagaactgcctcagcacttgggcgatgagcttgtggagcgagacggggaggaagtgcagccactcgttgatccctccctgcggcctcgtcacacgctgcaagccaaaaaaaaaaacagagcaattcgttcaaaaaacggagagagagaaaaaatcaacagtagagcaggaacaactgcactggggtgagagagagagagaggggggaaactgacgtagagggtcaggtggtcggcgaggccgagggcgcggacgaggccgaggcactggttctcggcgccgggggagccgttgccgatgacgacggcgcggcggacgacgacggtggcggcggcggcgccggtgaagatctcgggcgtctccatgccgccgacgccggggggctccggcagccggatcggcctcatcggcctagggttcgccggccgcaggccgatcccccacgaaccaagccaccggatgctccggcgaggatctccttctcctccacttcgatgaggaggattcgctcgtggtcggggtaggattggaaggttcgataattcgatgtgttgcgagatgtttggggggtttggtgtcgattcggcggccacagcggttgcgtgtttctgtagggttctcgagtttcaggcagttgctgtcacccactctctcgaattctccagttttactgtactactacttcccagggtcaaaaatatttacagtaccgtttaacacaaaatttcgtcaaaacttttaaaattcaactaacaactaattctatgaaattctagcaactaattctatgttaaaacaaaagttaagtttaagatattaccatcgtactcttataaacaaacctatgtatattatttgttttggttttaaactatgcttttgagaaattataatggtcggaattttaaaggttttatcaaaccataaagtacaagatattcttttttaccggagagaacaataccaattttcatagaaatatttgaggcgtacggtagtgaattctcattgtgcatgatttaacattagtcataggcataggcatttttagataaatgggtatttcagggcattgtatcacctacccctgagcatggcccgtggacagtgctcgggtcacattcgccccaccccccacccccctaaaaaaaaccaccaccacgcggtcctcaggggcggtactatggacacttctgtcacctgccctagtatcccgggttagagcctctccaaaagactctctatttagctctccaagttaaaatttagccaatacatgaaaaaaaacaagcttcaacagactctccatccagatagctaaattgctccttcggctagccaaatgtagccagcctcctccactggccaaagatgggtccgaccaccactcccagcaccatacttcctctctctcccatccacccaccactccaccagcaagctgcaagcaggggtgaaccgagggcgtcgttgatgtctggtccacagtctgccacggcagtcatcgtcattgccgccgcgccacggtcacgcatgagccgttgccgccgcagggagccgtcaccgccgccactgcctcccacttggcacgcgcgggaagacgtcgccgccgccgccacctgggagccgtcgccgccacgaggcggtcgaggatggatcgatgggccgatgcgggagaagagaaggaggaagagaaagagaaagaggaagaagaagaagaagaagaagaagaagaagaagaagaagaagaagaagaagaagaagaagaagaagaagaagaagaagaagggaatggaggctgacaagtgggtccctttatgattttggagatgtaaatagagagtctgtttgagcgaacacctagtttgactacccaaattagttgaagagttggccatataggtatttggaaagtctaatttggagatacgattggagatgctcttagaagcaacaaatcaacacagtcaaaccttgcatttaattgggcgtctgggtctagctgaggcttgttgagtctgggggtggtggaatggtagtgatgagctcccttcgctctgggtcctagacggtcacacaactggcctagaccagagtcggatctgcgatggtctcttattt

SEQ ID NO: 59129 - DNA, 759 bp, Oryza sativa
aaccctggtgaactttctgttgccaattcaagaatcttgatgtctctctcaataaatcgtactatttagcgataaatcgcaaatgatatcgtaacggctgagaagtcaaaagaacgaattgctgcaatcattaattatatatgatcaatcaagcaatgtgtactaagattctacaaaatcacaaaacgaatcaagatttgatcacaacaatcttgtaacccaaaaaattttattgcgatacaaactacacgtcgatcacttgatgaggttggttatggccgtgcagatgatcgacatctgcacggagcaccagctacgctgcaccagcggcgacgggacggcggccttggcgaaggcatcgtcgcactggcgcgcgagggggatggcctctcccaccttctccttccccgcagcgtagctttgcgcgttgatacagtcgtatccttcggcgaacacaaaggacatctcgttgtacagctcctggcaccgcgcaagcaacggcttcgccttggcaccggtgcctggcttggctacaagtcccttgatgtcgaagaccgtgtcttccgcgttggagatgcccaaactagccgcgatcaaggctaggccccgtgtgtccgcgtctgggctgaggtggtggttgctcagcttggacacacagaacttgtagctgatgcggctgtcgatgccggccgcggccttgcatgttccttgcacgtccgcgtgtgcggcgccactcaacgtaagggggtaccgagctcg

SEQ ID NO: 59130 - DNA, 1998 bp, Oryza sativa
tggtggctgtggctggtccatttgagtggagggtgatcgatcgatcgagctcgcgaagactgaggagaacagcgtgtgcaggtcggtcgggattgtgctgtggcatggatatgcatttttcatgcactatatattgcacttggtgatgatacgatcgaagtggacggatcaaaggacagctcgatcgggatttgtgttgtggcaagcagtggcaatggatgcatatttttttcatgcgcttggtgatgatacgatatgaattaagtggagcaaataatggatatggacttgtgcaagtctgaggctctgatgacggtctgaactatcaattcagtgcagaggtgcaggtgtgatgtgaggcttttctgaaggttttgccttcttctagcacgttttgtcttgttgttgtattgattttttggtgatttggatttttgatacgatttgggagcaattggaccggcatgcacttccgttatagtggttgtagtttggtgattgatctggattcttcttttgcagtgaaaaccccaacagaattgtgcatctatgtttgcgttttggagttgagtataagtaaaaatttcctccatccctaaatataagggattttggttggatgtacatcctaatacaacgaatacttcctagcaaatacttcctccatctctaaatgtttcatgtccaaatttattgtattagaatatgtcatattcaactaaaaatctttatatttagggacgaagggagtacgaagtaaactattggtttacttactgacttactgatagtgttgcaaaattgacagtggtaagtgtacgtgaatgcacgtgtttgtactatatttaaaaaaaagaatttgaaattagtaattacgactatatttgtccatatataaatagcttctaaattgcatatgatccatgaaaatatttttgttattttttattattatcattttaatgtttttaaattcagaattaatataataaatttgcaattgtcatggaatcttaatttatttttcttcattaaatagttccaaaactataacatgataaataggaagtaatcgtaggctcggaattagataatttattaatcctaaattcaatataataaacaccttaatgtagtctttgagtctcaatttcagcatttatttaatttaatttgaattgttgaatacaaagctgcaactcaacttagattctcaattacgacaatttatgatttcataattctggaacacaaattaattaatataagtcgtactctttcttgaatataggtcttacggttggggaatatttgggttcaatattcgcttaattagaactatatgtcgtaacacacccaatatgttatataccttaccgaatgcaccaatactacgctaagtaaaaaaatggggtcaatgttggagtcgtgactatagtacttcgcacgatatgaggatcgttggtaccagtgtatatgcgagattgaagtaaaaagatggaggcaaggatttttatacaggttctggcccttgtttgacaggtaatagccctacttctgttggtcgaagccggtgttgctctttattcatccgaattacacaaatacaatgatttggataacctatctaattgtcatcgacttggcggcatggataaccaactcgtagtcgacgacagagtagtcttcctccccgaatatgaactcgttgagatcagagatggcgctagatccctcttgccggctttcgtaggcaccggattgggtttgtctaggctaatctctgatgtcgatatctggcggtgtatcttggcttgtgtatatgttgtggcttgtggcttgtttatttgtctcctctcctcctagggggcttgtatttatatccatagatgttctcttgtccaagtaaaattaggaagatcaatatgtatacaatctaagtagtacttgttgttttcatgtagaattattcttgtcatttcttattcggaactcctt

SEQ ID NO: 59131 - DNA, 1409 bp, Oryza sativa
ggcgaattcgagctcggtacccaattaatagaatacttatatcaacaagttacaacttcttttccggaagccgatttccaaagaactccagagttaagcatgcttggtctggagcaatttgggatggaatttttctcgggtgcgcacgagtgaggacaaagtgctatgaaagctgtcagatataagcgggcgcctgagagaggcgggacgggacgttacagacgtgggacagaacatacattaaccttttttagttaattatgcaagcaaaattcaaattcaaggcagctttggcacaattaatatttgggtcgaagtgaacacaagcagtgacaaaggcgccactggccagctagcccggataaacgtccggattcacgggcaaaaactctattaaattttaatattggttaattaattgatactgaaatttctatagcaaatactagttatattgaaatttgctcggccctaaaaatctttttctccaccactaaagtttaagctagggaaagtaatttacttaattatgttcagcacctagcaaattaattatagaaactatatatacatatcattaagaagaaattttacggtctttaatgttgtatcggaagtactaatacatgatttttaccgtaattttgacaaattgaccttttgggaaaatttatttcaagaatagactataccaaaaacttatttaaaaaatagaccgtcagctcaacgccataaagattggcgctgaggtataacgctttaacgctatacatattggtgctgatatctcatccgaggtggcaaaaatttaccagattgtaggtgttgacgtttgatgtcacgattctggtatttgcatagtatggggatcgatggtactaggatatatgcgagattgtaataaaagagatggggacgaggatttttatacaggttcgggcccctgaattgtcaggtaataaccctactcctattggccgaagccggtcgttgctcttattcaccataatcacaccagtacaatatttggggtagtctatctaactgttgtcgacatagcgaactgaagtgttgactcgtagtcgacaacagggtagccttcctcctcgaatccacatccggcgagatcaaagacagcgctatgtctctcctgacagtatccgtagacactataggggactagccatgcttatctctgaagtcgatatccggcgtcttgtcttgccgcatgttggcttgtaagttaatcttgtgtcttgatctattattccgtgtcccctctcctcctaggggaccttgtatttatacccataggtgtccccttgtccaagtagaactaaggaaaccaatatggatacaatccgagtagtcctcgtcgttttcatgtaaaactctatttatccttcctt

SEQ ID NO: 59132 - DNA, 1176 bp, Oryza sativa
atccttcatcatgattcaagttttatatttgacacggatatttatatttacagctaactcaagatatgcctggcccaatttttcaactaactcaagatatgttcggcccaatatttcagttatgctcatagtggtagggtgagtgtgcacgtgttaggagagtttattgtttttaaaaaacaaaaataaagcgagtaccctcccaacaaacatgcagccatcttggaagttaggtccagacaaattagtcttctccttcgaaatattttttgcttcttcttaattactactccctccgtctcaaaaaaagacaaaacctggtttccgtgcccaacgtttgaccgtccgtcttatttgaaaaaattatgaaaaaaaataaaaagacaagtcacgcataaaatattaatcatgttttatcatctaacaacaatgaaaatacgaattataaaaaaattcatataagacggacagtcaaagttggacacggaaacccagggtttgcctttttttttgggacggagggagtagttcggtccagacaatgtaaaatatatttcactaatatatgacgctagagaatcaaatggcatgatatacaatatcatttactccctccgtcccaaaataagtgcagttttagcactgttcatgttcaacgtttgaccgttcgtcttatttgaaaaaagattatgattatgattagtatttttattgttattaaatgataaaacatgaatagtactttatgtgtgactaatttttttaatatttttaataaatttttcaaataagacggatggtcaaagtgctaaacacggatatctatggctgcatttattttgggacggaggtagtagatatgatgatgtactatcttcacgtaaaaaatcagctccagggtgtactttagaacgggcataattgcagagtaagatacatacaagtggctgatattgggatcaggataatataaacgtgcaaataattgtcatgttgaattaatatatatcaacggcccttccaatattgttccttttttgtcataatcaaatttggacggatactgatcagaaactgcttagatataaatatcaattagttaacgtatcagtcaagcaaaactggtttatttaacgcatatgaacaggaatctctctcgaaaggggtaccgagctc

SEQ ID NO: 59133 - DNA, 1155 bp, Oryza sativa
ggacataacgtgagcatagcatgtataatattacagattagaatataaccgtttgtggactgtccatatgctgaaaacatactccagtatccacttaaaacatttccttcttgctgccttgtatagatagagagtccattgcaaaaacatggaggaagactcagcaaaggtgaagaatactgtggcacgtgttatggtgctgaggaggtatgcacaatcttttctaatgggaatgtattttgtttatacctcttattatttcagctttctgaacttaccttgttctttgttacattctaactccggatggctttctggacttcagtcggatgaacaatgctgtaattcttgtgaagaagttagggaagcatataagaagaaaggatgggcccttacaaatcctgatctgattgaccaggtatattagttattttggcatggtttacctagatatatccattgtttagatttccgttgagttctcttgggcttagtttaagtttggaaaatatatgtatggcaaataatgttgaagattgcaagataattaatatagtctatatagaggtagtatctcttaagaagccactattactggaagtccctgagaaatgattttattcctcagtcccatatctgccttgtttctctccactaaccaattagaacaacaaaaatggcctactcctgacgtagtggcataccgtatagttagatgcctgttgcgcgtatactctagcctttcatactagtatacttgtgtctagtgacaagctagtgtggcacacctctctttcatgcttttgctttgcaaggcagggctcatttatgagtgaaaagagtgaggcgacgtcatttctcctactatttactggaacttccgccctactgatttgttttccttgggcatgacagtgcaccagagaagattttgtggaaagagttaaaactcaacaaggtgaaggttgtaatgtacatggctttttagatgtcagcaaagttgcagggaacttacactttgctccaggcaaaggattttatgagtcaaatataaatgtgcctgagctgtcggcacttgagcatggtttcaacgtaagtaggtccaataaatgttccttttccttaaaagtgtttttattcagtggttctgatatg

SEQ ID NO: 59134 - DNA, 1432 bp, Oryza sativa
ttggtctgtgtgccaagatgaaatatgactatcaaaagtagatggagggagtattaaatactccttccatttcatattataagtcgctttgactttttcctttgtcaaacttttttaaagtttgaccaagtttgtagaaaaatatagcaacatttccaacacaaaagcaaacatattatcaaaatatattcaatgttacatttaataaactaatttggtgttgtagatgctgctacattttcctataaacttggtcagatgtaaagaagtttgattaggaaaaaagtcaaagcgatttataatatggaacggagggagtatcaagtttcttgggtgccaagcatgagatgtacccccctccatccttatttagatgatgttttagggtattggttttgtttttgaatagctttttatgttttgtaggtattatgttcccaaattacccctaataaaagtagtaggtatattgctccaatgaactcatttatttctaaccactagcatatttcgtctagagcttggcttggctgtaacacgaccactagcacaatcctgttcagccacgcaccatgtctacttgtgatgaaattgaacaagctggactagcatagtaatgtggacagctcagtagaaataaagtatattaattaggggtaagacagtctcaagtaacacaattgaacatcaccctagcctgtgtgtttggcccaagatgacaagtaattcaatggagggagtagcaaacttgacttgaatccacatttcacgtcaaagttgcctgaattcgtatagcggtttcaactatatttacaacttaccgttatccactataaggtcagtactgagacaattatgccaaaaccagattgatcaatacataagagggaagataaacccctagttgtcgtttgctctatcatgcatgcatgccgccatccaaagtcatcctgctcgtttcacccattgcaacagacaacaaggagggcaggcagaccagggaagttcagaaacctaccggagtgtcagaaacgggcaggcagcattttgatgcagctctccaccagaaatactcacctcacaaatgttcgcggtaaagcaaccgatctaacacgcatccaggatcatgcatcaatggtattgtaatgtgctaccttttggtgttgaaaaaaggctaccttttcaagcattcccaactcatagcagccttattttgacatgaagcctgatgcttaaacatcaagttgggattataggcgagtaaccccccctaccgcggaacagataacctcgaacaaacccaaactacagcacgattcgacaacacaattaactgaaatacgaaatgaactgatggacaaaccctaggattggagccccccaacaccaaactaaaccaccatgattcgaacccaacacgccaaacccaaaa

SEQ ID NO: 59135 - DNA, 3032 bp, Oryza sativa
tatctatttcttaaagtacttgtcacctgtgctgtgtcctaaatactaagtataatcataggattttcgtttctcatgatccaaccatctaagaattatagttcactttcattcatcgtaatttaaccactaaaatataaattggttatcaaagatgagacggtaatgatcaacgctcacagattatttgagaacgggggcagtatataactatctatatcaagtataaaggttgagcaaacagcaaggagtgtggttcgtcataaatcaggagcaaacaatatgtgacagcgatcgagctgcatagtacaacattcttttcttgaggtggttctacgttgaaatgaaactgacgagctgcctcaagtctgttacacaatgtagtgatatggttatagatgatcgatcggtctagcatcgagtaatggagatatgattctagagcatcatgatcggcggtttctagtctgcgtccatctcctcgagcgctgcctgggcggctgccttcgcctgctccacgaggtcgtctggaacctgtattgacagcccggtaacagagttcatatttcacatgataagggaggttctatttatcaagggagaaggcatgtttatcccttgtatataccttctcatgctggcgctttgattcatcgcatacccagctcagctccagttcaaagtctttgtctttagcttcgtcatgcactccatagattctgcattggtacaaagaaaggtcacaggcgagaaaaagaatgcagatcttcattagcttggtcaacatttccttgtagaagttatttacgtttttctgatttgttcacatggtagatggtctattatgagtcatgcatgactcatgagtcatgagtaccaacagtcccactgacaagacaaatctatagcacaacaatttatgctcagaaaaaaatctcaaagctacatattattgtcaatctgtagtgcaatgcaaccaaaactggtgctcatagatcatggtacagtgattattcatgtgaacaaagtaccttctgtacttaaatcatccaatagatttttatttgttctagaggggaaaattgcattagctgctggtagtcgacaaataagtgcatagcaaattttaaggcatccatgacagtatgaaacaaactttcacttgtgagctctaagagggaatttgcagattatagtaaaaggttcaggacatacatctttgcaacctcaacaatgccttctctgcatgtaagctcagaaagattcagtttctctatctccctgtacaacatttaatagatgtatcagaattacaaaccattgttcatgagtcatgacaaatagacagccaacatattcaaaagctgaatcatcttttcttgaaccatcataaacacatctgatgattgccaacccattccttgataagcattaaaactacgaaaaagctaatatatggttcatcaaattataatctagagtttgggtcagttttcccttggcagtcattcaacaaccaacaccaattctagaatatctgtgatatattaatgaggctattgtctagttaatatatcaaaaaggtgacagaagtgcaagaagtgccaatgccaaaataagcatataagaaacaaagattagatcaacatcttccaccattgaagatggaatactacttaaggactactatatatgcaagatgtgaagagataacttgatgtatatagtaaaaatacaaaagaatatgctaagttctaaagataattatggatcatcaaatttaacaagtgatgaataagccaccactatttgcgtcctagtaatatgcaacaaaaaagaagttgggcactaatgcagaaatcatacaataaatagtactccctccgtttcacaatgtaagtcattctagcatttcccacattcatattgatgctaatgaatctagacatatatatctatctagattcattagcattaatatgaatgtgggaaatgcaagaatgatttacattgtgaaacagaggaagtatcaaaaccctaatagcttacgtttttgcagcctgtcttcctttccccagggcagcaccgaagtatttctgtcaaattcgattcagaaagtcattcttccacattaaagagtgcttcccaaagaaataatgcacatgatactaagcaagaaatacggtatctatcataaaagtgcaaatatgttcattacatgagtggatgagcccagccactaccataagatggtcaagttggtctttcagttgtaacaaataaaggtatgatagaagtgctacagtgtattagggtaaaaaatttacataggagagccccgaaggttcgatcatgtagagttgtggcccatccctatcataacctccaagaataactccacagccaaaaggcctgacacaagaggagtataaattgcatcaaacatcttaaccagggattgtattgaagaaaaatgttgaccgtcttacctgagccaccagtagagggtacataaatgtacatagctagctacacgatcagccaattcctttacaggcatgggttctccatacaccctggtgcagtacagcgttaggcaaaacacctaaaagaatgtagctatggggaaaaattcaagaattctcacttttcataactggctgcctctgactttgccctagagactatctgcctaccatccgcagctaaaccagcaacagcctgaaaatgagaacgtaagaagccaaaacaatttgaacaacaatgacaaaacagaacaaaagaaaagaaaaggaacactttacaaaatccaagctttatcacatatatccattattacaaagtgacaatgtcaaaaagaaagtgacaataccaaaaagaaaaaaaaaagtactgccagaaaaatgaaattacgctggaagctgctgggaaatttcagagctaaataatttgttgtgattggttgctcatctgaagaaacaaagaggtggaaaacaaattaccaagccagagtgtcggtgcacagagtggag

SEQ ID NO: 59136 - DNA, 3335 bp, Oryza sativa
tgttacggaagggcctctggatcacacgataagtggtgtactaaacctcataacataagtacataacatcctaagtgaagatttgagttattgatttacaactgaagctgactgcccaaaccttttaacaaatccctttgtccggtactttgtaacgaggattaactgttaatggcagtaaaacaaggacgaatcctacaaattgacaagaaggggcttttttgctgccaattcagatatcgatttgcgccttagtcctgtcatccccgaatcgtaagatttaaactaaaacaaggccgctaagagccgagacacgcgggaagcaatgcaagcaatccacccaatatgagtacggaacagctgcgcagcaatccacaaaccagaaggcggcggcggcggcggcggcggcggagcgcctcgatcccacccgcaacgccatgaaccctcgcgcctcggctaactaactaggaacgaagataccggcaagtattcgggctccccaatctacgcaacgccgtgccggtgccgcccgcgcgcgaggcgacaatgcgcccgccgcctagatcccccggccgcgccctcgacgtacggaagaggaaacgcggggggacctgcaagcctaacacgggggagaggaagcgggcggcgcttaccgatgcctgcggggggtgagggggggcgtcgccggcggcggcggcggcggcggggcgtctcgtcgaggattccggcggcttcggcttgtggcgcaagaaggtggggggagtgtgtcgtcttggcttgggggagaagagagaggaggagacgagtcgtggtgcggtttaagttgggaggagggaggcggcccgcgtctgactcgaaccgggactcgactcgacgcgatcacgcgacggaggcaggaaggtgggccgggccgtgggctggcgttcagttgggccggagaggtgaggctgggctttttgttcctgggctggatttggaatagagtgttgcctgtacaaacattttttttttgaaccagttgccttgtatactacctccgttgcaaaataagtgtattcgtgggtatccgtagccaatgtttggccgtctgtcttatttgaaaaatttatgaacaagttaaaaagaattagccacacataaagtattattcatattttattatctaataacaataaaaatactaatcacaaaaaaaattaaataagacgaacggtcgaacgttatacatgagcagtgcaaaactgcatttattttgagacggtgggagtataaattacaaacttagtactaacagatacttccttcatttcgcaatataagttattctagcatttttcacgttcatattgatgttaatgaatctagatagatgtatatgtctagattcattaacatcaatacgaatgtgggaaatgctagaatgacttacattgtgaaatagagaaagtagattagaatagcgggtctaagaaaacagtttctctcagatgcatatggaccaaataatccgtggcgataattcagtgttcagataattcgctgtaattatactcgctcgaaacactcaatatttctcaactacaaggcagagtttacactttcacttcaacagctagctcccttcggtgatgtacaattgaacatcgccatttcttccttgctaattcatctcctcattgcgtcaatacgcagatccgtctcccctcttcagcgtcaccaacttaattaacaccacgaatcacaagcagtaattcacaaactttaattactctgcaaatgcgtatgttcatatgctgaatcagtcacgagaagccgtcccggcgatcctgctcctccgcctccttgttcgccgtctgcacggccttgaaccacaagaatccctgcaaaaaaattttaaaacaagcaatcaaaatccatggaaaatttggattcatgtcctcgcaatggagattggcaatgagaggatgcgtacggaggtgggtatcccggtgaagacgaagaaccctaggagcggcgcgtacagggcgctgtcggggctcaccacgccgaacaccggccgctggttcgcgtactcgaagatggacccgatctgcgcgccatggttagggtttgggattcgagaggaggaggaggaggagaggagttgaaggggtggagaggcgtacggcggcgatggcggtgatggcggaggcgagaaggtaggcgaagaaggggagctcgacggcgccgggctcctgctggcccccgccgccgccgccctcgcgtgcccacggcggcggctcgtcggagcccgggcgcgcccacgaggggacctgctcgtccgcctcccccgacgacttcgccgacccctccgtcgccgccacggccaccagtccgcccctcctcctcttctcgacgacctccacaaccgacgcgaggcgggctcgaggagggcgccccaggatcaggcggaggcaccgcgagctgcacgcggacacggccgccgccatggctggctgggttggcgagctcgccgtggcgcgcgcggtggaaacgaaccgtggaatggataggacgcgggtggcgtgcgcgcggcgcggggttcctcacttcccatcacctcacctttttgggctgggccgaattcaacagtgtcagtgtgtcacataacatatggccatatgtttttgtttctttattttcttttttttttggacaaaaacaccctagaacattttatatctgacttgtattatgtaaaacaagaggtagtacagaacatactatgtctaaaaagaatattaaaaccaaattaaaaccacatccaatatatttccacatccctatcgatcttgtcgccggtggaagagaagaataggcagagatctgaacaaaatatgaagaatcattgcaccgtggctttttaagatcacagtaatcatccgacctgaaggatgagtccgtggaaccgttgaaaagacatcggtaagttcatgcctcgatctcgaactagatttgctcccacgtaaccacaagtccacaactcttacaagccctttactaatgctagatagaccagcagtgaagtagagagagggagagagagcgtgcgtgccaaagaactgttattctaaagaatgttgtcttcatctccatatgtgtaacaatgacacacaagacacatagccaatcactatttatatatggaagatacagtcgagacaagatatgaacgatgaacaaaactaaaaaaaacataaccacataaattctcatttgccttgaacaatgaacactttgcgaattgcaatttgcaacccagaaggttcactatttcatccggatatcgtgtgatt

SEQ ID NO: 59137 - DNA, 1528 bp, Oryza sativa
ccgttagagatgaatcaaatattattatacttcctccgttgcaaaatgttacaatctaaaatgagtcaagacaatgaatcttaggatggatcaaattccatactttagctccctttgaattgaagggaaattggagggataacaaaggaattgaaaccctacactattcatgcattttattcgtagaaactagaaaaggaaaaacgtagggaactttcctatttctacgattgtagaggaaaaacataggaaagttaacatccactctaacctcttggaaaactttccttgagtctatctctcttatctgattcatgcgtttttcctgtggtccaatcaaatggttattcttgtgttttgcaatcatctgttttacacttgtattcctatcagaatcctgtgtttttcttattcccccgttttttcaatcatggattcaaggggcctaaaattgcaacattttggtacggaggcagtacattacaaacttaataaatataaggaatatagaacaactatataaaacattaaacaatggtaatgtagaagtacttttaggaaagtcacacttttgtgccacgcgcgcatgattcataagttgaaagtgcatcactagtttatgtcaaatttcaaacagagtccaccaaaattcgcaaagtttcataaaactgtcactcttctggactcatttcaaacccaaaacaagattcgcttgaatcatatcgcatatacttcttcacatccattaccaaggttgattaaccacatggatatctttcgcaaacaaattaagcatagaaaaacaaaacaaaacaaaacagctagtagtattactgctacttgttgttcatcaacaccttgacgaactccttgtactcgacgcggccctcgccggcgggatccgccttgcgcaccatctcgtcggcctcctcctccgtcagccggtcgccgtgggacaccatcgcctgccggagctgctccgccgggatcaccccgctccgcgcgtcgtcgaacacgtccaagcacgccgcgagctccttctccgtcgccccgcgcctcatcttgcgcgccgccaccgacaggaacgccgcgaagtcgatgtctccgccgcctccgccgccgccgccgctggcggtggcgtccgccaggaaccgccgcgcctcggcctcgtcgacgttctggcccagcgaccgcagcgccgtcacgagctcgccggcggcgatgcgacctgcggatgacgaggacgatcagtggcaggttggatgacggggaaactaatcttggtggcggcttaccgtcctcgtcgctgtcgaacaggtcgaagatttctcggcactcgtccacctgttcttgggtcagcttggccgccatggatgagagagagagatcaagaatttcgcctaattgctgtgtcaaagcgtcagctggtagcaaattggaatggaagatttctggaggaattgaaaagaagcaaaggcgtttctttttgacaggtcaaaagagaattaaaaacaaattcatttgatta

SEQ ID NO: 59138 - DNA, 2353 bp, Oryza sativa
gcccagataggactcggtacctaaaagataaaaaataatactctcttcgtcccataatataagagattttgagttttttgtttgcactgtttgaacactcgtcttattaaaaaaaattagaattattatttttttttgacttactttattattcaaagtactttaaacataacttttcgttttttatatttgcataaattttttatataagatgagtggtcaaacactataagcaaaaactcaaaatcccttatattatgggacggatgagtatctatgaaatagaatctaaataagaagagtcaatttaaaggtgtgacaaatcattgaaacaatgttgaacacagactagagctaccacctctgttcaaaaagacataaaaatttcactaattttatgcttatcacctgaagtgggaagtggtagctagtgacggatctaggcatattttgtagggtaggccgactccacggctttttttaaagcatcctacaaaccttgattttcatgtataaattaacaaaatatagtgaaataatcacacttaaatacaaactaactaataattgatcttacaggattggattaaatttctgtttccgtcactggtggtagtaaaagccaagagccaacaaaccaaaccggtagtcctgaatcctgatccagcttagctcaacagcctggacccgtaccagtacaccacttgtatccatgagtgattgtgctcgagcatgtactgagattccagcaatgaaaagcattcgctgtcagggtctacttttcgttgcttcgtttggttccagcctactacctccctcaaaaaaaacaaaaaaaaaaactctaaacagattacgtgtagattcataatactataatgttgtcacatagcattccagatttgcttttatgggacaaaagaagcagacatgaaggcttgacagtggctatcagtacttgactagtcctgatcaaaggaaagctaacactacacattcagttcgtatgcatcatatatgcaccttggcatactaatttgtgaatgcctcgaaacataggagcacaaaatatagttgcgataattttgcagacatcagctaaaattcaaccaggatcaccgatcatcaaaacatggtcacatgggtagcctcaggatgcgggggatggctgcaaccattcaattcagcacgcaacagggaagtaaagatgatgatagaaaggaaccaggcaatgcatatctgcacaacgatccaagaaaaatgatgaaaccccaacaaatcctatgctccggcaggcgcaagataagcatcacaatcaaaagaaaccaggcatctgatgttgtttcgcatgactagaccacctaacccgatcgctactcaacattaccaccagcaaagataggtacttaaaaggaacatcacaaagtacagctttgttgtaggccctgacagttttagttcacttcagacagaacttatttaatgggaaccctcctcacttggccatcatgaccttaacgaactcctcgtagttgatctggccatcgccatcgacgtcagcctcacggatcatctcgtcgacttcctcgtcggtcagcttctcaccaaggttggtcatgacgtggcggagctcagcagccgagatgaaaccgttctggtccttgtcaaacacacggaaggcctccttgagctcctcctcagagtcggtatccttcatcttcttcgccatcaggttcaggaactctgggaagtcaatggtcccattgccatcagcatcaacctcgttgatcatgtcctgcagctccgcctcagttgggttctgaccaagggaccgcatcacggttccaagctccttagtagtgatgcaacctgcacaatgtattcagagatcagcacaagagagtactaaatggaacatgcgattatctcgttcaacgcttataaaattaacacaacatggtcctttagtgctgcaatattgtaatattgttttatgtccacaaagtacaattttaagaccaagaaatcaaagttgtcctgagtcctgacaacagagtacatacacatcacaaaaccaccatcagtatcgttatcactttcagccaatttatgaacctatttcacagaatgatagtgctagatagaatcattgaacatataatacaaatcacagaccactatatgctacagtccagatgagaatcatgaaacgataagaatgtgatgcctaggtttaacagccacttaggtagcttcccgccaccgcactagcatacgatcaactcataaacctacatcaataattattgtgtacactagatgtggcacaaatcacaaaccagcccagcttgcatct

SEQ ID NO: 59139 - DNA, 1737 bp, Oryza sativa
atccctctcttgactcattttctcatagagttcaggcttctaaaacatcatgctacaacaacagcttattaaagaaacaaagagagaaattaaaaaaaaagttgattgctttgatcagcatcaaacaacaagacctcctgcatttcacttatgtacattgtcagttaccatgagtttaaccaccattctttgttcgcttcgccgtggatgaccttcgcagcggcttgtacagcacgaagcttacatacttggattgaaaccggtgagtgactccaagagcaagcagcgactgcgatccccatcctttctcgatatacaggtggttgaggacaacatgctttggcttcagagtttgttcttcagagttatcagtatcaccaagaacagacattacaagctgaggtggcagtataggtggctccttggcaaactcctcatcacctgggagctggagatcatagctgtgttcaggcgacggaggagagtcgaatcctgccacgctgcccaggctttctgggatataatcctattcaaaacaaagatgtcttcagataaaaccaagagggaaatgcacatttttttttgcctttgcggttttaggttctctcaattttgattgctaaaatcaataattagcatattcttactgacatggacatcgaggaggttggcaacctgccctccctcatcagccacatgaggtagttcagggacatatttcggttccccatcgacgatgatcctgtaatggtatacccctgatggcagaactagcaatatggtatggtctttcccagacttctctaacaccctcctgacaataaaatgccggatttgtattttagcatcttatttctgaaatgtggaaacaatctgaacatgaaatttcattgttaaatagcatgtaccttgatgtccagttatcccatgatccttccacaaacacctcatttcctccttgactccatgagatcaaagttggaattcccttctcctggggatggttattggtggattcatccgattcatttatccatgaattgttgaaaacaggagaaaattcagtaggtatatgcagtggggctactggaacctgcaatgtgcacttgcctgtcagttcaagcaggactagcaataatactcaaacatgtgagttattctcactcccaaataaatacagattagcaacattcttaatatgaaagatggcaaaaggtaatagttgccaacttgttatggcacagttatagcaaactgaagcatgagctcatgacatatctcttccaatattacaggaactgaaacagttaatgatgtattgatgtgtaacattccataggtcaaaatgaaattgatgagaaagtgtgtgaagactggacgctgacttcattctacagggaaaagggagagcagttttaactgggactaaagactctaagagtaatatataataactgaagttgtacaaacatttgtaattagacagatcaaaatactagaatatattcctcatatgtaactgaagtattccctgttaaattacttgcaactcatcatctcactaacatgttggtccagggctcacgtgagatatcagtggcaaataagggaacatggagtctttcaaactttcaacgctaaaaataaagaaattgcccaaatgcagaacaacacagttttcaggattatgaactagtattactccaagaaccagccatttgacctttgtgaattgta

SEQ ID NO: 59140 - DNA, 2440 bp, Oryza sativa
tattgcggtgaagtttttttatatagcaacaaggagtcaagaacacactctttgagaatatcggaaagagatacaagttgcggattagttatagatctgtaagctttagccctcagcttcagcttctgctacccactaaccctacagttgaaggcttgaagcaaagtgagctgccatttcaagtttatcaacactggatggatcttgctgaattctgatgagtgaaagaagtgaagaggattcatagaaaattcacccccttttgtgtgtgtgcgcacaaccaagctcgcaaatcgcaaccagtgctaatgctaaattgccaagctaatcaaacaatctcgacaaaaaacaagaactcgacatcatcgagcgagactaatttagcaaggcacaatcgaggaggaaacactcttttacggttttaccacgcaaaagccaccaagaacatcaaatcaaaaggaagtaaaaattaataaaaattaatcaccacatctcacctgcggcgtgaagacgtagggcaccgggggaggcagctcccgcatcacggcgtccggcggcataagcggcggcggagcccgggccgctgcccccgccgagccagccactccggcggcggcccccgccgccacgtgacagttctcctccccttccttgccgctcgcgttccccataccccgccgccaggatccctcgccgaccccaacccacagctactcgcctactccagtactcctcccacctccaccaatcaaaccaagcaagcaagcagcccaactcccaccggcagcagcagcagcagcagctcaaaccagacacgacgagaatgcggacggcggagggaggagggcccccactctcgcgctcctcgccgacgtggtcgccgcgaatctcgcctcagccgccggccgcttcgccggaggcaggggaggaggaggaggaggcgatataagaggcagtttggcacgtgggtcacgtgactcgcacgccgcgccacgcccgcacgctcgcggcgccggctttaatttccggcggatttcccccgccgttggatcggccaagtttatttttcacacatatcccacccgttgcaataagcgacaaaagaactagaatactttcacgttattaaattgtagttgtaattattttctactttaaacactccccagatatttatattcctaccaaaatgcttgtattttaggatggggagtagaaataaagttatttcgagattaacatgagaggtgaaaaatggagctatcctttaattcgttgtcctaggattagcatcttcttctagattgagtgtttttacggatgaagtaattagtagtctggattaggatgatgcttttagttggtgtgtttgcggggatagctattcaatttagtcaaaatttttggctttgcgatgagaatattatttttcaaagatttggatagagacagcgagaaaacaatactagtactaccttatagatgtgggaatttcgcatttcagcagtactacttctggatagggcctgcttttctctgatttgttgcagtccttccgagagaggtcatgtactactactatttaccctatttatcagctcactcatataataattaacttttccctataaatatatggtacacatgtctgtctcacagattttcttggttcctatatctaaaccggctgtaaacttacagcccgcttctcatctctcttctctcctctctcatccacctcagcattcaggcttcttatagccctctattatacttgctctaagcacagtgaatgatgacattcatgatttttctttttctcttttaaaaaaaagaacagcttttaatcaacttaagtcttagttcgttctgattgtattttaagtcttaagatgtagattgtattttggtttttgttagcatgttttaaattattaaacgatatgtttcgtacaaaagttttctatatagaagtttctctaaaatatcaaataaaggtatcttttgagtttgtaataattgaaacttaattaattatatgttattggttttcttattttatatgctcttaattttgtccaactataggttacaagtggacattaagccatcaccgttaatacttggaggtgtaaactttagtagagttgaactagtatgcttaataaatgacacgaccgaaaataatatggatgctctaaatatgaagccgggaaagaatatcgtaataaatatcatggagagattttgtgaaggacctactcggaaggcttataattggtccaatttcggtgtaaattattcatgtaattttctttactaaactcaaaagtctgcttgattgaccgtgcatgcctagatcagtccaggattatacacttcagtcattgtttcgtttatttatactcttatccgaatcacatgttatcaaataaaaagc

SEQ ID NO: 59141 - DNA, 703 bp, Oryza sativa
ctttaaattaaataactttaccaatggatgaactacaaatattaatatccccgtacctcccctccatgtaaaggtcaccaaacatacttgtgatgcaaaaactattaaagaacaacacttttataaatggtttcaagagatatatattttgagagcaaaagaaaaaaaaatgaactacaaggtaaacttacatcagcagccatccgagaccacttattccccattttgcgatgaagattaataattttattctcttcttccttgctgaaagcccccttctttaggttaggcctcagatggttcatccaccgaagacggcaactcttgccacacctcaagaggccagtgttcttctgcacaagcttccagttcctttcaccatgcttcttgatgtacttctctaagatggagtcctcccaagatgtccatggacctttcttcaacagcagggctacggtgctccttctgcaatctttatctttatcaacaaatgactcgtcatcgctattgctcatataccagtgtgtcctgtcagaatcaggatcgctgtcgctctcgtgcatcctgtcacaaacacgagttgaactatcaaaaataaaacagaaatatgtgtacatgaaaatgttaggtcagtggccacggctagcagagattaacaaatttatacccatataaaacttttacaaaaatgggctgcaggaat

SEQ ID NO: 59142 - DNA, 2155 bp, Oryza sativa
cttaaatcttgagggacgtctcccctggctgccaatgctgaagctttcatgccttgtgaagaacatgtcctggtggggtattgcgacatgttcatgtagatcactttcatctgattgctcaaaaggatgatcaaacggattcctccatgtatgcagaacggatggagctgagccaggaaattctgtctcatcagaacaagaaagaatatcagatgggtttctcttgcaaaccttatcattatcgatgtctaagttactgtcaggatcaaatactatgttcttccttgatcttctcttaaccatcaagatctctaacctacgatgcctttccacctcagagtacccaagatccatgacattcttatcatcatctacggttccaagaaatgcaggatcagtgctgacattcttgtcatcgtttttgttggccttgctcttgtcagattcataattattatctctcacagttctagaatcctgaagggacatgtggttgtccgagtcatcattttggatgggatcaggatggggggaatcagcactggaaagagggtcaatctcgtccaggacagaagcaatgcgtgttctaggagtaccaggagtggtaccctctgtctgatcatgatcaaaacctggtgaaccatcatggcagccaactctaccaaatggtgaatccaaagatgagtctaatggactgtccacagcagcattgataggctctaccttaatatcagaaagcttcttcctgcgacgaacagaaaaggcacggccccatttacaggtaccagccggtttatcttctgaatctactttcatctcatcactctgtgaatctgttgatcctctatcatgacttatcttgcccaccatctcaacaacttcgatagcatgttctctggaagaattcaagccatctttgatttcaccgtcatttaagctcgccgtgttctcttttgccgaaaatcccttgtttgcttccaaatggatattcctggacaaatctgcatacttgggatccgaaacctcggcgacagatttccgttcttccttgatctcagcaacgtttgtgctgccatggcttatcagcacaccaaggataagagcggcacatatgattacaggagagtgggacagaaggaaagcgaagaaacccggcgaagatctgaatagcaggtagagcagcaggaccgggaagaggagaacccagttttcagaagcatatctgtagctcatcctgattgaacacctcaagatcgtccttatacatggcgtaccatgatctgcctcgacacccatggccttgtcctctatcaacttgacagcacaaatctagcaaagaaacaaacgaaaaaggcaatagttcagccaaaataaggatctactagcaatgaatgaagcaaagagagaaaatgttccgtccataattctgaaactctcatgctaaataattccatgctatatatactacagaattacaagagatcaattcaggtagtgcagtagtggtaagcaatagctgaaatcgaaaacttgaagaacaaagatgcaatccgtataatcttaaatctcctagaaccaaaaagcgagttcagcagcagcatcctgatcatcaccatctctgctacgacattacaactgcgactgatcgatggcgcacgaaagaaagattgtttaccttcaggcggcagccggcgatccgacggcgagatcttggtccctgaggcttctttccttcagcgcgccgggaagcaatcggcaatggcggccgtcgtcgtcgtcggatcgaaggcaaaggtcgcagcaaggagagagagagagcacgaggagacgagctcaagaaagcgagacaagaaagaggcaggcaagcagcacggtggtgggggcaggtggtgggtgggcccggctggtcagcgtcggctggcactgtaccaacaccgtgacgtcgtcgtcgccctcgtcgtcgtcggtccggctggacgccggtggcggtggcacgtgtgcgcacgccggcggtgggcccgccgccggttcacgcgaggccaggtttggcgcggcgcgggagcgttttcccgcgtgttttggtctctcgtcgtgtgggtggggtggggtgggtgagatctggattccgtttgcttttttctgaattctgatctct

SEQ ID NO: 59143 - DNA, 3556 bp, Oryza sativa
attcctgcagccccgctttttttggtttctttggaataatgggcatgtggtgaaccagtcatgagtaaatgtgcttgggacaaagtctcaaaggggataattcaatccatttgtcccagacagcacatttggttggggaaagacgaatctttatataatatggagtactccagatctgattagctaagggtgctaccatgaagaaacttaaaaagtgtgtgcttctagaggctcataccacatatgtaaatatcatttcattcattttcatctagcaaaaaaacacccaatgcacctctttcctgtgcatacaaaaactcggcacaccgaaagaaggcaagaatcacaataaaagaacacaaagaaaccctatttttacatgtgtatgaacaccatctctacatcgcaaagactccaagaatacagttaccgcagaatagatcaactgtatacatactcatccgattgtatgatcctaataagctcttgcagattatcaaatacgcgccttccagagctctcagctccaatgtagttcaaaagctgctctgtatcctaaccacccagcaaggaaatgatcataataacgatcttagtttatggggaaaatagattaaacaaacattacaacaaataagcagccagaataaaacattaagggggaaaacataccttgtgcaacaagtagattgcataggatgccttagtggggtcatcttcttgacattccacgaaaagggggtaaactgtcagttttgggtcggtcatgttgatacatgtacgctctgctgaagcaatggatgctgtttcagctgaaggcaaacaatcactcacataagatcgcgatcctccaaagtgcaaagggtatcggaggggaacatgaagataggaggctatgagcaaaattgcctacaaaaaaatataaaaaaattggcaactggtaactctataacccttgagaaaaaaacaagcagtgatccagtatgtgcatgcaggaagatgaatttgaacatctgccatcattccttccttacaaatgttcaacactgtaatgaccacaaattttgaaaagcatgcattggcttattaattttgtgtttcaaaaagaatagaaggatgtatcttaaggccatctacaatgttaattgtgttaattgcctaatttgagcatgaaaatgagcatagctaggttggagcatccatgctatcaagtaatctttttaagggcaatgctacatcaagtaactgacattgatgttttatagtacaggacaggagtgctgtgaagacttacatgcgctgcatatcccagaacagctgcggaccgctgaagatccttctcacatatatcattttgttttcttctttgcttaccaatttgccaacccaaaaatgtcaaagcatgtatttgtggtagtttgataacattgagtagatgtgttccattctcttctggaagtgttccattttcttccgaaagagacctatgtgctcctgaaagtgttttgtagtttaacagaacgaattaggaaagaaattttctgccactgttcatcaatcctcggtagaaaaatgtgcactatctgacaggttaaccggtgtaattcttatgtcactgatatgctgtatgcaataatgcaatgtagtatgcctatgtttaaacatttttaagcagtacactccaaactctccttgtttgcagacaacaatatctccaaacagaatagcatgtggaacaccttcgccaacttagacatagacgatgcacgccataacgatgagggcagagcaataagtacagagatgggtagattcaacattaactcaaggagtgattcagtgaacacacatgtatataaacacacctggaaaataacaatagatacaacatccagaagatatcttggtctcttgtagtctttaccaatctaccggaaaagaagccattgaataaaagggcatggcaaaccaacctatgatatattcctagagcataaacctaaggcatcactctgctggttagcaatgtttaaagctccatacttctcatcagaataaacatacatatgtattagaaccatgcatatccttggagtgtcattgttcaagacatgagattattggattctcaccattagtattggaattgaggtttcgcccatgcggcagatcatggaataccttcacagggtacaatgcagcaacctggccaatcatactctgctgcctcatccttaacagcctctgcaaatccccaagccgcgccttctctccagacaacgcttctttcgcatcctgcaatcaacatcgaaaaatctccctgtaaacgcaggaacaggaacacacataggtactctcaattctcaatgcacgcggcatttgtgtcgattacctgcagccgccggctcgcggcggcgacggcgccggagaggcgcagcacgcggtcgatctgcgcctggagctgctccctgcggcggtcgacgccccgggccgcgtccctcctggcgaccagcaactcccccacccgcgcccgccggagctccacccgcgcccgcatctcgtccagcgccgcgccctgccgccgcgactcctccctcacctgcacacacaccgaatcaaatggccgaccgatcagccccccactcacgccaatccacacgccgccctagcaaagcaatcgggcgcgggcacgcaacgcgcgcacggcgcacctggagcgcggcgtggaggcggcgggcgaggcacgcgcgggcctcgtcggcggccacgagcctccccccgaggctgccgacgcgggcgagctccgacgacggtgggcccgccccggccgcgtcggggctcatcgcggccgcgggccacccgcggcggcggcggcggcggccatggaatggtatcgaaatggaatcgaatcgaatctgcgtgaagcgggatgcgttgcgggggagcggaagcaaagaggagagcggggtgggtggggtgatgacgtggcgcggcgcttacgcaaggggagggtgcgggttttggttttggagttggttcgtctggtcgattcgctttcacagagtttcagcgagtccgcgacgacgtcaaggctagtgacgttttcaaagccacgatgactccggcgagacagtgatgccactacctcctcaaaataaatctatttagcatctattttatagataccaatacaaaggaaaaagatctataagtctataacaatcttcctttatcaaatcccaatataattatttctcattttatctactcgtaatataattattctctaattttacaaattctgatgcaatgattgctttaaaaatgaacttattttgagacaaatggaaagagctactggtgaacttaatgtggaacggaggaagtaggtttcatcagttaattatgtttctcaaacagttaaacgatataattttttaatgataattttctatatataaaagttactttaaatataaatttatgtttcaattttaaaataattaaaacttaattaaacatctgacaatatgtcacacgagggggctgcaggaat

SEQ ID NO: 59144 - DNA, 4343 bp, Oryza sativa
tcaatggcacaacattgcaacatgtgccagcaaaatcttttgaattcgacagtttaacacacacaatagcagatgaaattcaacatagcacgcatggtaatttcgacatgaagaaaagtaaaggagtacggcaatatccaaactggaaatcctaataagagagatagcaacgactggctcgttcacgagcttcatggaataaaattcttggtttcatgatgagtttatccaagagagcagcaactcatgacaatctggcgtcagttacctggaattgcaagaacaaatatttttagaaaaaggatgatttcaaccataagcaagttctatgaaacataacatgccatcacaagttcacctttagtatccaacttgttttccaaaaacaattcatttgtgtcttcgaatatggatagattagtatcattcaaatagaaatatgatgtgaaatcatcttgaagaggtggagcatctccttcatattgtggcactaccagctcattagaggcagccatggagttatgtgcttcaaaaagatatcaacaaatcaacagctaaattactatataagtaaaagatgaaataagtaaactatacgaaccgaaagaaagttcaaagttatgaagctcttccgacgatactggactattgtgtgtgtaaaaatcaagatcttgttcccgatatcccttgcataaagggagttctgaagaatctgccataccttcacatggcatattaatagtaggactcaaactccctccagaaagctcttctttcatcaccacatagttcaatacatcagtatcatttagtaattcttctgattgatcatttaataaagcaaagtttgttaggtgcatcgcataagcccttgagtaaacgaactggttgtttggatcaaattggattaaagggagctccatctgcaaagcatcagttgtggacaaagcagagagattgccatttgaaataccatggttggcaaagatagaggctgcaaaagatggcatggtcttatcattagagttagtcacaaagtgatacgaagtcaataccaaaagcttatgtgtagagtggtttaggggatagctcacctgatggaaatatgtcattgttcgttgttttcaacacaggaagtggaatctcatattttgctacaacttctatttggtttctttgatcttctatggagtcataatcttttgatgcaagtctcctatcaagtatattactgatggaagcatctgaaaactggggtgcagaatacatactagtagtatcttctagatgattattggtcagcttctccctaacgttggggtcagcagactcatgttgatcttcattcaaagcatcgttgcatacattagcaggatacaaaggcgaacgattgttcttgcatttctttattcgagtgttccagtagttctttatttcattatcagtacgccctggcaactgagaacatgtggtcaagttaataacaatgataatagatagaacaatgcatataacagtaacaatgttctaaaacaacaactaagatagttatatgcataaagctagaccccaagtttcactttaacttttagcttgtcccacggctccttattttcagtagaactaaaccaggccgatgattgcaagtgcaatgaaaagatactagcagtttactttaaatagcaacccctaagccatacaagcaaaaataggctacatttctaagataatttcaaggatgggactttgacaatatttatatctgctgattagggttgatctgatttgtgatgataatcatattttaggataaacttgtaatgcaaaaactaccaaatattaattgaaataaatgaaatggataacatttgtttagttgaagaaaataacttcaccaacatttgaactacaaatattaataatacccatacctccatgtaaaggttgcaaaacatatttgtaatgcaactggaaaaaaaaactacccaactttaaattaaataactttaccaatggatgaactacaaatattaatatccccgtacctcccctccatgtaaaggtcaccaaacatacttgtgatgcaaaaactattaaagaacaacacttttataaatggtttcaagagatatatattttgagagcaaaagaaaaaaaaatgaactacaaggtaaacttacatcagcagccatccgagaccacttattccccattttgcgatgaagattaataattttattctcttcttccttgctgaaagcccccttctttaggttaggcctcagatggttcatccaccgaagacggcaactcttgccacacctcaagaggccagtgttcttctgcacaagcttccagttcctttcaccatgcttcttgatgtacttctctaagatggagtcctcccaagatgtccatggacctttcttcaacagcagggctacggtgctccttctgcaatctttatctttatcaacaaatgactcgtcatcgctattgctcatataccagtgtgtcctgtcagaatcaggatcgctgtcgctctcgtgcatcctgtcacaaacacgagttgaactatcaaaaataaaacagaaatatgtgtacatgaaaatgttaggtcagtggccacggctagcagagattaacaaatttatacccatataaaacttttacaaaaatcgccaaggtataaaaaaaaacggatacaacacttaatttctaaaatcaagaaatggagtgacgcctacttataaaaaagagtaaaatgcatggagggtcatataacttgttcagatgtgtcgtgtaggtcactctactttcaaaatgcacattaagtcactaatacttcctccgtttcacaatgtaagtcattctagcatttctcacattcatattgatgttaatgaatctaaacatatatatctatctagattcatcaacatcaatataaatgtggaaaatgctagaatgatttacattgtgaaacggaggaagtatcagttaagtgagtcattagctcatttaactatccaaatgatcacacttttttacacatgacatgccatctaggattgaaaatttgcttctagatatgtgcaaaaaaaaaaaccctgttttatttcccttctcctaacactaccccttgccaatacgcggaattcacaatatatatcaactcacatcgatcaattcgtggaagctatatgtactatttatacaggtatcgtagccatgaagattgcttgttgctaacacgttgtgcgctaattccgggattggctaatgatgtacggtaggacttaaacaaaatcacaatatagagggtttttctgcattatggagactattcgtcaaaacagccataagtgaaatgattcgattaaattaattaagtatggggttatttatgtgcagaagcaaattttcaatcatatgtggctatgctcatatttatagttaattgtgtcaataactcacttaactcacattagtgacctacatgtgcattttgaaagaaaagtgacctatatgatacacctaaacaagttagatgatcctccatgcattttactctataaaaaaataatgagatgcactcacagttccaatctcaactgagattggtaatttcagtgaagtagattgaaacgagcacagattagtagattacacaacatatcgtgcaagaaacagatccactaaaatctcttaggactattcccaacaattcaccgatcaaaccactaaatatgaccccccaagaaaagaataagcaacgccaccggtccattttttacctgaccaaaaatgcagggtgacggagcggtgggctgtcggagtgtggagtgtcgccggagccgggacaaaacctccgccctcccaccggaaatggtcaccggccgccactctctgcgacggaagagacgcgatgtgaaggggagttcgctgaggcgagatgggagatggagatgggagatcgcctcccccggcaatggcggagcggggagtttcgggggcggcggcgtgagcgcgagcacgagtatatgtgcggcaacgtcgcgtcggctgagcggtggttccattccaagtctatctcagtccaaatgatttttctttttttttaagtaaagaaaggaacgaattttatttttaatccaggccgtccgtttctctcctcttgacctagcgaatcagacggcttcggagcctcggatgcccacctgaaccggaagccgtactctctgttcgtataatcgtaccaaccgagatttgactggggagtactcctaatacaacaaatcattatgcccagattcattgagatacgtcacatcttgactctt

SEQ ID NO: 59145 - DNA, 1487 bp, Oryza sativa
agtcaaaagtcagttctgtcatgggaggaatgtgcttcagtgcaaagaacatgatatgtgggtggctgtcatctccatggtcatgctgaactggctgccagaaaacattcggggaacaactatggttcatgaaacgtgagacatttcccatcttttttgcactaatcttgatgggcagtggctcaaattcatcagctgatacatatgtactctcctcaccaatcaattcaggaccaaagttgaattttaatgtcttctcaccaggacatacagtctgaaaaatgtaatcatcttcactgtcatccagattaactttgagctcatcaatgacctcaccagtatactcacagataaatgcaccagcacgaatgggatcccagcagcgaagaccccagcctcgatttgcagtccggaagacctcaaagtgaaatctgacccctttttgggtcactctgttccggcaattcgtagtacaatggcaagcatcaccgcattcataaattattggcttgcggcacgccaaaagtcctgatgagctgtaaggtaagtcacctccgttatgttgtccacaagcacagttgggatcaccaggcaggcaaacactctggcatccgcaaccctgtaagggtttcatagaactgaggggcctcaagtatttgacttgactggcataggtgaaatgcccaggtcctttctcatggtctacctcattgacaaggcaaactgggagagcttcagccgcagatgatagatcaggtaatataaccctgcctctgcttgctggattgtctatccatccttgagtcatcttccacaatgcagctccatcaggctgtccaggctcacgcagcagtttgtacttgaagcaattgataccagactttgttctctccttccaggactcctgaatcttatagaggccatcatatatgtagatttttccagtcaggcaaaatggatccctgaagccccgcacaaccctgatctcgttcttcctatgcaggctcctctccagagcaaggttacctctctcaagcttttgatcatgcctctcctcactgttcctactattgccacctgaaccactgtacaccagtgtatctgtgtcatcatccacattctcatagccacctgctgcaacaatacatattgccacagaatcctcatcgcttccaaatttagcactcatataatcaatgccacccatactaggagcatgcaacccgatgatacatagctccatccggaaatagaaaatatcccctatttcaactccaggaacaagtcctaccctttttcccacattagccctgatattgcttgccatcatgatggcgccagccttcaggtcagcccgtttgctagtctcttgtatttcatccagttgcagatgtctacgcctaagtgcttcaaaggtcatgtggactgcttccacaacctccctgggatcactggatgaaggtggtctaaagggggctgcaggaatt

SEQ ID NO: 59146 - DNA, 3218 bp, Oryza sativa
  unsure (1)..(3218): unsure at all n locations
aattcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctgcagaggaactgtacatcaccacatctttatttggcttcaacaattagccttatctgttacctgatttgtttcttatcactgaacaaaatcagctagtagtagaaaatatgttgtcctttctttcctcaactactgttttgacaatgttatgcgagggaatgatgtgttaacatgagacagcatgatgaacttgatgcccctgttttaatccaagtagaagtagctactgtggtccaagagacaagcaacaaccgctgaaaaaccattgtctaccgagtctgatgactaaactactttcttgtggagtcaggaacagggtttcaaaaaccgccgggggcccggttaccgccacccggcggtacggcggttaccggcggtaaccgcggtaaccgcgcaaaaccgcgacaaatttacaaatcgaaatttgaattcaaaaattcgggcaaaccacgcggtttgacgcggtaaccacgcggtttggcgcggttaccgcgcgatgtgtaatgggttgcacagtaacgggccggcccatttttttttctttttccaattttcaaatttattctccgttttgctctcaaatttgaataaatattactcttttttgagaaatttcttcaccataaaacactataaatcaagcactaccttcactattttttttgatttttttctttttttttaaatttttgaatttggacgaattttattaaaccgtaccgcgcggtacgggtaaccgtacccccgcggtacgggcggtaaccgcggtaaccgcgcggttaccggcggtttttcacaccctggtcaggaagccactagcttggaacagactccccatttgttttgtttttttctttttcatttgcaagacagaatgtaaaaggtagtgcttcatccatttcaaaatataaatatttatagcacttatataccatagtctaaataacttatggaacactgattccaataaataaaaatccatacatttctggctaatcatattttatggtacaattataaataatctaaaatttgactattagtatgataaaagagaacttttttaatcttaatattttgtaaataactttaaaacaaatatggcttaaaattgaggagtaattgaggctccatttttatatgacttttatacgactggttagatttctcgtggtggaaccagtccacccaaattcaaatcctagatttgacacgggtgcttgtatttatggctaattattatttcagtggtagccgatatacgcctagtcttttaaaggtgttcgtatgtgtagggtgtaagtgtacgcgcgctgaggacgcatatgtttaatactgtgtttctcacttctcagtaaaaaaaacgtccgttatatgaaaaaacacagtaattttgaagcaaaacatcgtgatttccaaggtatgtgcgttggcgttgctcacctcacctacccgttcgttactagtagttcgctgcttgcacgatttcccggtgcgccctggccgtccgatctcctcggcgcgggatttcgacggctcagatctcctccctcctcatcactgactcggtccctctccgccgcgaagcgtggcggccaccgtcgcggcgaccacttccacctccagctcgccgccgcagccgcctcctcctccatctccacctccacctcctcctcgcctccgttgggcgagagggagacggagaattctccgctgccatggctccggtgcggctcggggctcccacttccggcgccctgctgcttcttgtcctcctcctcatctgcggcggcggcggaggcggtggcgttgctgccgggggtggaggcggaggtggaggcgggaaggggagctcggtgtacccggcgcccgtggtgtacccgcaccactcccgccagatctcctggaagcccaggttcactttctctcgctcgcgcgggcgccgccatcggttggttcttggtttcgtctcgatctcgacattggatggactgactgatgcgtgatccatggcagggtgttcctctaccagcatttcctcagcgacgacgaggccaaccacctcgtctccctcgtcagtgcccaccacctccccaatccaacaaattttcatttcttttctctgcatgaatcgggagttcttgtggatgcttgaactctgtatgcccaggattcattgagtttttagaggatttatgtttttttttaggcgagaacggagctcaagaggtcagcggtggctgataacctgtccggcaagagcgagctcagcgacgcccgcaccagctccggcaccttcatccgcaagagccaggttaggtcttgattaacgtttttttttctttgaattatttgttcatccggagtgtgagttcatcttttttattgaaaagtatctttgaataaagggggtcttttagtgtatgaagatagatgtgcaatataacttaaagtagttcttggctaaatgagaggattcttcctcccaattttgagaattttcctttaaatttacataattcttatgtaatgaacaatcatgtccaaatttgtaggatccaattgttgctggtatagaggaaaaaattgctgcgtggacatttcttcctaaaggtatttgactccattaagacaataacaatgcactttactattcatgcaattcttagatgttctatataattcataacttacacatgtgagatattgtcattttacacctaataatcaacctccctctgggcctttgttttcgttcctgtacctatgggcagtcttgaagtgaaagcctctaaaatagttatgctccacttggcatttcatttctaaaataaacaaagtaaagcctttaatgttgagcctccttacctg

SEQ ID NO: 59147 - DNA, 3559 bp, Oryza sativa
aattcctgcagccctttttttcctttttctttttgggtggggattgatagtagggattcttttttatgtgtcctcatgttgtcttccttcatacataatccaaatttatgttaactttatgtgtttttattttttttcttgtacatattatgtgataataatcagagaatggtgaggatatccaagtgttaaggtataagcacggcgagaagtatgaacggcactatgattacttcagcgacaatgttaacactctccgtggtggtcatcgcatagctactgttcttatgtacttaacagatgttgcagaaggtggagaaacagttttccctctagctgaggtaatttctttactccattgtctccacggtgtttttttaaaagaaaaggagagaaatctgagccaacaggccacaaccaagcatgggctcctttactttctcagcggttttgtgaatttgttttgggatctcttattgcatcattttctctacacacatttgtcaaacaggagtttacagaaagtggcacaaacaatgaagattcaaccttgtcagaatgtgctaaaaaaggtgttgcaggtataaatttctaccgatgttccttttttttgtttgtaattatgattcccatgatttttgtaatatatcttatgcatttctcaattgatatactactgctacctcagtgaaaccacgaaaaggggatgcacttctgttcttcaaccttagcccagatgcttcaaaagattcattgagcctccacgctggatgcccagtcataaagggtgagaaatggtctgctacaaagtggattcgtgtagcctcattcgacaaggtttatcacacacaaggcaattgcactgacgacaatgagagttgtgaaaaatgggctgccttgggagagtgcataaagaacccagaatacatgattggaacagcagcattaccaggttactgcaggaagagttgcaacatatgttagcgatcccattgtaaataatcaacggtaactgctttgtcggcagtctgatttatacaggaatgggttaaaataagtaggttcatgaggtttttggcacaaattctaccagttttggttacttcctgatgacaacttggtttttgttaccattcttcaatggtaactggcaggaattagaaagcaactcattgttagtatccataatttatgctagatggagatgcactttatcagtgcaatttctttggagagcaggtttttgtttttatttcatagagttgtcgacttgagcctactaggttatggttggattctgccagaatttacaaacatctggtctggttttcatctgtaatccttgagttgtcgacttgaacctactaggtcatggttagatcctgccagaatttacaaacatctggcctggttttcatacctgtaatccttctcatttgtggtatatagcttcagtgatttttgaattcattaatcaaatctctttatcactctaattctgcattctgtactggaatatgttcaattgcctgctatctgtgtgcaactcaagagctttttactgaccaatgatgatgaacaaagcttcaggagagccagaactacggccatgtttgggaagccgaagattctgagaaatagccgataagtagccagctagtgataatctgtgttttctagcttttggaaaccactatttcattttatggattctatagcttctgatcctcagaatattgataagaattgaagctgtttggaagaaccggagattctgggagaaactgtaaccgccaaacctccccaaaaactggtcctgaaccttttgagtctgaactctgaaccatctcagggcaagtactataatgtctcatatgttgcctctaaaagtgccatattggattgagtgataaggtgaaagagaaaagtgagaagattgatgatgagtcacccctaaattaagaggcaacctccacacaaatttcaaaaagagtgcgagaagggtgtcttttatttcataagtgaataaaatagacaaatttagaggtggtagtcatatttgccctcattagtcatgacatctcctgttcctttctcacgacatgacgccgtccaactgcgagaagccctgcacaagcacacaagatccttttgggtgcttgcccataatgtggcagcagttgtagcagaagtgagaaccctgatgagcttgcagttttgcagcccagctcacatgggaacagaaaaaactcacaaatggatggacagttgggaattgaatttgatgatgctgttgcttgccatcttcattcattgctgctatcttggagtactgtacaagatgtgcagtcggtcggtgcgttgtgtccacattcacaaccgccttcattcattcattcattcacttctatgtgcatcatgctggcaaaggcatttgtcattctgttttaactactttgctgtgagattttcttttttgccgtgaattgtgtcacctgtaactttgcaaccatgaacagataatctgcagctataaacagtactcactctagtaaaaagaagttgatgttggaaaaactaaactctgttcttctaacgtcaaacaaatttgaatgggtattcagttctctcaacgtacagtttttaattcaaggaatgtcattgacaagtgtccaaatctaagaaatgtcatcgaaaaatgtgagttctaaaaaaaaacatcgtacaaaacagttttatcccaaatgcggaatggacgaaaacctaacggtgatggtaattttggaacaaaatccccaaaaatatcatcgccgttagggttccgtccattccgcgccattgaatatattgttcatcctatagcacttaacggtgcggaatagacgaaaccctaatgatgatggtaattttagaacaaagtcgtttgtaagatgatatttcttagattttatacttgtcgatggtatttagaatttatacttgtcgatggtatttcttagatttggacgtttgttaatggtattttttggattatcttaaaatgtaactaaaggaagtatagtagatatgctgcaccaaggaagaactttcttatcatcatgctgttctctttttttttttgaactttgctcatgctgttcttgtgacaacataaaaccagaaaaagtactagtatttctcacataccacactaggtggttacatgacgacttgtgagtcatcacatcaaacatatgaacaagataagtatatacgtccttgcaaggacaaatgtcatggaatccagcaagttttacatcaaaaggaattttatagttacttaatacgtctttaaataaaaaggaatttgattatgatcagcaaggaccatacaaacaaacagccacatcacccccagaaaatgatagctagttgagcggatcaatcaaacgattctaaacatcccggcgacgacgacggcggcggcggcaatggcgacgccgacggcgacgaggtggtcgccggagcggccggcggcggcggcgttggtggacggcgtcgccgtcgacggcggcgaggc

SEQ ID NO: 59148 - DNA, 1560 bp, Oryza sativa
cttttatatgttggaatttcaaaaaaaaaaaaggtgggcaatttcagatatttcaaacgctaaaagggactgatttactgaactagaacaatatctttgccaaactaaatcaaactaaaatatctatagccggaggctcctcatacattaaattcctaatacttcatttcaaaattgtgaacctcctgccttagccatcactgacaaacaatcaaaattaaactacggatatttcatatttctacaattctactcaacaaaagctatggcgaatgatcaagctaattaataactccagttttcttaaaagtacaaaacgaacaacataattagtgagagcaagtacatgcttaccagggaactgtgggccctcaccggagggcgagacggctgccggcgaaggcgacggcgttgggcccattggaacattgaatccaaaggctgcaaaattaattatttcccaaacttaattagcccataatatgcttactaatcaaaagcaaataccctcaccaaaagtatagagctattacttttatcattaagacctatatatcctgcatataacaaaaaccaaaccaattctagcaatcatttgctcgattctgtcaaatcaatttcactcgtatgctcaatatgcatatgccaaaagatgagtagcatcgaaatcaaataataaatctgaaaccattttacctaatatagtagtatattagtatgcatataacaaaaacaaagaaacatatctctatatgcaaccaataataagtaattaagatataaatctagtttaactttttttttatggagagagtgctgctgctactgctactagaagtgattaaagtgataattgggggagattaataagattaaagattagggaggtgattgattgcctgcgcaggtggagacgggaggggtggagacgcggcagatggcggggagggcgagggcgcgggagtagtcgacggcgatgccgtaggagtcgccggcgccggagaggagctcgcagaggcacaccgggttggactccaccagcccggccagctccgggcagcacggcttgtccggccgccgcgccctgctcccgttctgcacgtacgtcaggcagtccgacatgttcagcagcgccgtcaggcacgcctggtccagcaccggccccgctggccccggcgccgccgccggcgccgactgcgcctccgccgtcgtcgccgccgacgccgccagtagtactactacggcgactgccaccgccgccagcgtcgacgtcggccaccgccgctgcgccgccatggcgcgctctctgggggctttgatggcgagtggttcgttaggcggtggaaggagaggagaggagaggaatcgaaaatgaattcggaggcgtcgtgtgacactggcttgtcctgcagggtacacacgtatatatagagtgatgcgtctttttttctaaaaaaaaattcaggttacacaccaccgcgtccaccttgccagatataaatgtgttcacttagggtgtgtcttagttgaggaaataaaaatttttgggtgccatattgg

SEQ ID NO: 59149 - DNA, 2383 bp, Oryza sativa
tgatgatgcactgcaagtattgtggagaagaaaatcacaactcagggggttgtaaactaaagaagcagggcatcagttctgaggaggcaaagaggatggttgccacagcaaaagaatcacttgcaatggagattcaacaaaatatcactgaacaagaaccaaatgttatcaaccaggtaaaatatcactgaacataactcctctgttgcacatgttttttttgcatgtcttatgaactacatgacctatggtatatataggatgtcatagatgaacatattgctgcttctcagacttcatctcaactactatcacagctaggaagcactgtttttagtcagatggctgatcaggtaatgttgttttcaatcatttcaatctcacattgcaaactacttgtcattgcaaactatttatcatgtatatatgttctgaattttgcagccaaatcaaagttctgtgctatctcaacaactaggcccattgccagatcctgcctttatcatgtctaacattccatcagcaaggccagctcctcttacaaccaacaccaaattagggaagtcagtggcactgaagaaaagaaagaccacaactggaaacaagaagtctgcaagtgccgcatcaaaaaagaagcctgcacctgggattggaacaaattaatgcctattagttagctgggaatatattttgtttagtgacaatctgacaaaaaatggtgttttggttgtcaacacactgtgatgtatataatggattaaaaatatgctatatcagctgcatgctgtagtgcaagtgcatggctacttgctgattgccagaattatagttgcattttgtgatactaagtgctgaaagtatctgaaatggatgttctgcctttttactgaatgtgtgcctcattttgcctttgcaatattgtgcctcaaatattctatgaattgaacaagcattccttcaaaatttgtatagacccaacattcacaaagatgcagattaaagaaactggctattttattcatcacacaccatgcatttttagtgcatttcacacattacacatttcaaccactcctaaagaaagcatacatatttgtcaccgcaacaaccacacaggcagctactacacatctcaataaggcaacaatatccctaccaatgtctatcaacaagttcatcctcctaacaagcactttaatctgctcagcaatttgctctgcatcattttcaacatatggttgtgcaccctgttgaaccattgcatttgtctgaacacgcacagcagaacatggactctgaatatgcacagcacgagatgcaagatgcccagtattaatcaagtactcctcatattgttcctcccagtaccaaaagcgacatccaattccatctcgctgcgcaaaaaatgtacaaaattaacctcagcaaaccgatgcgaattgaaaattttccaccacaacacagattatagaagagaagaactaacctgatggcaagggcaagtgtaaaatatgcgccctttattctcaggcgtattagccgcacgcctaatgattgtctcacaatcgcaacaagggcacttaatcagagggaaacgcccctttcccttccgccgattcgtcgacgatgaactcgagcccccttccatggcgccaatcaaattgaagggcttcactctagatacgccaaatggaaccaattggatgccccgcatccgagcttgaagaagagggcgacgaactgaagatggaggcgacgaatcgagcctccctagggtttcacggcttagctcgatggggaaaaaaaagcgaaagagtgggggatttatcgtctgagggctggcgaaaaaataaggggcttaatgcataatgcaccaccccggctgtctcctcccctccacgttggcaagccacgtcagcgagcagaccgagtcaaatggggtttggacaggcaatgtacggctaagcaagtttagggacctgtaaatacgatttgagagtttggggacctagatgacacacccttacaagtttgaggaccgctggtgcactttactcttcaaaatatttcttcaaacttctaattttttcgtcacattaaaactttcctacacacataaactttcaacttttccgtcacatcgttccaatttcaaccaaacttccaattttggcgtgaactaaacacaaccatatatgtgaggaaggcacttgacaagctttgcttggttattcgtattttcttcgattccaaaataaacaaatttaatatagagataatccattgtatgccactgagtttgtcatgggtctataatttgccactgactttgtcacgttctataatataccatcgatttttgcttaacttctacgatttacca

SEQ ID NO: 59150 - DNA, 3325 bp, Oryza sativa
cagtttttatagtactacctccatcccatattacttgtcggtttgagttgttgtttgtactccctccgtttcaaaatataagcatttttagctatgaatctagacaactgtgtatccagattcatagctaaaagtggctatattttaggacggaggtagtaatatttaatcattcgtcttattcaaattttttttgaaattattatttattttgtctatgacttgttttattatcaaatttattttaagtatgtcttgtttttttatatttgcactaattttttaaataaaacgaatgatcaaacgttggaagaaaaagtcaaagcgacaagtaatatgggacggagatagtagaatttatttttaaaaaaacatacctttaatttgggaaatgtgcgcgaaagtattcgtccaaatgtttgtgctgccaatcacagccttacgcctcctttgaaatttgatatgaccaaacggatttcattgagatcaaaacccattcctgtaaaattcttatgttccaagaaacccttacagcccacaggaaatgatcggtttgcaattttcaggctgacgttacaacgcgcttacttcaatataaacatacggaaagctactgaaaaggaatgaagtgccatccaagaagaaaggcagcagaatgctggccaggaaggcaacgggggataaactggtaaggatattgggggtggctgcacagaacaggattacgtaacaatacgctatgcccaagacaagtcaatactacaacatctgtggcgagtacagaggtacaaaagtcaggcaccgtaagcctttcgattaaaaaccaaactgaaacacgcacgattttttaacaccccacgaaaaacaatctgatagctagctcctttggtggtggaacctaaagagctttatcttcccaaaacatccacatcattatctgtcatgactatatagtttcgatacgtaaaaaggcagcgttcactcagggatatccgccatgtcttcctttcatttaagcccggccaagatgcttcaagcctgtttttaggatataaaaggcaggtggttagttgcctacaaacattttaggtaagatatgataacgcgcggttaaagcgctactgtggatgttctatagcagcaaatatgccattgtcgtaccttgttggcaatgttgttggaaagccagtcaagcccctcatacaacccctcaccagaggtagcacatgtgctctggatgtacctatgagaacataagacgaataattcagattgcatagaaagtttaactttaaaacactaatattgggtattgtcaacacagttggataatgcacactgaatgctattacttggttcacaatttgctaatgcatgaatggttttacttggtttaggacaaggatttagtacttaagtagaatacaggagcaccattatgcgagcagcacatagtatgctgaaagcatataaatacacactattgctgatcaatctaaaaagccctgtgtgagcaggccataaacttttaagaggaaaggaaaccataccagtgccgctggcgcaaggagtgcagaccaagcttgtcggtgatctcagcagcgttcatggcattaggaagatcttgtttgtttgcaaacaccagcagcacagcatcacgtagctcatcctgtagccacaacatgccaacattaaaactatagcttctagaacatcacatgataagcatgatagcatgtataagttgtttcatccatgttgggctctttagaaatttcaaatagctttggaaccacatcttatgcgtatattaccaatggcagatcttcctgatggctagaggaaaaaagggaaagagggaatcatgggcaaagaatcttacaaatcacacgtatttatgaattatgattctcaacaacagaatatagcaaaccacatgcaatttatgaattgtttcccaacaagagtctaaaggtagactaatactttgaactctgatattgatagtacctcattcagcatacggtggagctcatccctggcctcaacaacacgctctctgtcattgctgtccacaacaaaaatgaggccctgggtgttctggaaatagtgcctccacaggggcctgatctgtattaataaaacacacagaaaatatcagatcacaagaacatgccaagacaaaatagatgagagaatgaagctataaacaattgaaatgataaattgatatgtttgacaaaggaagttaaccaaatctaaattcttttttttttcataaaattcaataaaacagatccatcagagcttagtgtaaggtaatatatactgcagtttgcatgcgtggtttctgattatgcaagcatgttaataacaggtaattgacaatgttaaactatataatatgcaccaaaaaaataattcagaaataatagctgatcgaaggcaatttcttaccttgtcctgaccaccaacatcccaaacggtgaagctaatgttcttgtactcaacagtttcgacattaaaacctgcagttatagacagcaagtttggatcaatgtaaatgctagcagattgtttttccagtgttttaacttcctaaaaccatataattctaccatcctacaacattggctgaactctgaaagagagtattcaggttttaaatccagtaagatgaaacacattgaaggagacatctcagtaatttatttaagtccacctagcatataggagtaaacattatacgtgaagtggagtgtaaacacacttgagccaaataatcaatttgagatcagctaaaactaatcccattgctaaacagttcttatcattaagccagcccaaaaaattattgtctgactaaaaaggacctaattctgacctttgatctattgctgagcaacgcaagctggaatgttaattatgcgcacacagcctaacttaatgcgatgggacaaatggagaccgtgcatctaccataccactataagctgaattactgaacacatcgtaacaatacgtgcacagcataggatgtggattggaaacgcaccgatggtggggatagtggtgacgatctcgccgagcttgagcttgtagaggatggtggttttaccggccgcatcgagaccgaccatgaggatcctcatctccttcttggcgaagaggcggctgaacagcttcgtgaacgtgagccccatctccgctcccgctctgaaaacgaaatgaagacaaaaaaagtcagtcccgtagatccacagggtctcgatagaaaaacgagcggaatcaaagcaaccgcagctagatccgcgagatctgaagc

SEQ ID NO: 59151 - DNA, 7152 bp, Oryza sativa
cccatccagctgctgccgaaccgatcggatcggaagcagacgcagaattccactcaaaaccagcgagatcgaacacgaccagcgggggaatttcgcgggggcggtggttaccgagatcggcgacggcgacggcgacggcgacggcgatctcctcctctccttctctcccctgctctccccgcggcggcgtccggctccctcctcctcgcgggcgcggatggatcgcaggtggagaggagaaatgggcggagagggagaggagatagatggggagagagaggtcgttgaaatcgcgcaagggaggaggttatataggagggggagggggaggggctgggtcaccggcaggtggggcccacgtgggtttgtggtgagggcgtggaggggcaggttggagggccctgctggtaggtgggccccggaaatgtgcggtacgcgtcggtggtcactaggaattttgcgattatatataccctcccggagtgcagggttcgacctgtgggtttactgatttgtatggggtcaccgaaattctaaaatttcagaaattttagaaatattgtggaaattttggacgaatttttttgaaaaaatttgaatacaaatttgaaaattgcgggcgaaatttctgaaaaatgaaaaaaaaacagatagcaacaaaatccgttcggcaagcatacaagttgcaactactgcatcacaaattcacaaaatacagccaaacaaaacccactcacagatgataaaatgtaggttcaaagtctgaacagcagcacatcaacacatcaggcgaacaatatagtgagaacaaacaaatgtgaaaagagggataataacgaaccttggtcatgcctgagtccgtgcctaccttagtttgccattcttctttgcactctaagcctgaccttaaaaatggacctttgagctccacctcttctcttgttccttgcctttctgggattacctcgagggcaacctcaataagggattcaaatgggatgagactgtcaattttgttgctctatgcgagctccagagccgcccatattgctgccacctcccgcttctatcaccgtagcagctcagcctcctcctcctttcgtgctacaacgataaggtagagatgacgcataactaggatgatgacaactaggtaacgtggcataaagatgatgatggtgaagcttcgaggacagctgatgaggttaccggtagtgcaccgagacatggcgaaggggacataaaagagtggctcttcatgtagctcggtgagactgagatagaggcatgaaagaaaactgcagtatataactctattttataatgcatgctaagctatggtatttttgttcccaacaataatttacataaggtaagattcgggatcatgcactattttaccacataaaatttatatatagtattaaatggatttcaattatcaacttatactacgggtagttatgaaaacaattcaaataacataattgcccttcatttacgatgcattgaaacatacaaaccatttatccatgagaacagtagtagcatttatttagtttctttatatatctatttagtttttttttgacgcgtagcattcgttcattaagggaaatagaaaaacaaacagttgcaagaagttctaacaggaactacatttataataagtgagagactattcaaataagagatttaatatttcaaaaatgtactccatccattcctaaatataaggcacaactactctcaacccaaagaccaagaaataattattatcaccttatagattgggttatcctaataaatagaatgcatgcacccaataaaattagattgggctatcctaataaatagaatgcacgcgcccaataaaattagagatcttgatggtgtaggatttaaataatacttccttcgtttcacaatgtaagtcattctagcatttttcacgttcatattgatattaatgaatctagatacatcaatatgaatgtgggaaatgctagaatgacttacattgtaaaacggaggaagtaatattccagtgaaaagagtgctagttaataacatgcatgcatgtctgccttatattatgaaataactttaaataaaagaacgttgtgccttgtattattgaatggagtattgaagttctacggtgacatggaattaaggaagagactattcaattattgtttttcatatcccaaacagtttttttctctatcatgattttgaacagtgccaagattttttttaatttcaaacaaaaacaagctggagtactagtaaaataaataaaatggcccaatgaccaagtgacatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccgcctcttcccgcgcgcggccccgccagccggccaccgtctcgggtcaaatcgaatcgaatcgaatccaaaggtattctcttcgctcttctcctccgcgggccgcttggattgatggctcggggtcgcgtaggtaggggaatctgttcgcgggttggattgggttgggttggattttcttctccttcccaattagccccccgtccagtttgttctagatttctgtgatgcgtctggtactgatggatgttagtttttgcagaggaaaatctggggttcagttgaaccctaatgcccccaggttaggtcagcctcgctgggtatcgcggctgctgaggttacttggagaggggtagggtggaatcctcgggggctgatttggtgtaattgagagcgccgattcatgattcaggcaatggcttcgcatgctggaggtagtggcggcggcggcggtggaagtggccgggatgctggctcggcgcagcgcgggccgatgcaggggttggcgaggcaagggtcgctgtatgggcttacactcaatgaggttcagagccagttgggggagccgttgcttagtatgaaccttgatgagctgcttaaaagcgtgtttcctgatggcgcggaccttgacggtggcggtggcggtggcggcatcgcgggccagtctcagccggccctggggctgcagcgccaggggagcatcacgatgcctccggagctgagcaagaagacggtggatgaggtgtggaagggcatccaggatgtgccgaagaggggtgctgaggagggtggccggtggaggcgggagaggcagccgaccctgggggagatgacgcttgaggatttcctggtcaaagctggggttgtcacggatccgaacgatttgccaggaaacatggatgtggtagggggcgctgctgcggctgcagctggtacgtctgatttgaatgccggagcacagtggctacagcagtatcaccagcaggctttggagccccagcatccaagcataggtgctccttacatggcaactcacctggcacctcagccattagctgttgctacaggtgctgttttggatccaatttactccgatggccagatcacttcgccaatgctcggggctctttctgatcctcagacacctgggcgcaaacgctgtgccacaggggagattgcagataagctagtagaaagaaggcagaagaggatgataaaaaacagggaatcagctgccaggtcaagagcgaggaagcaggtatgattaatccttcctacttagaattttctatatattgtatgctcttactttgcttattataatttactgctttcaaacataaaggcctcatggattctttttttttaatctctggatgtattaagttggcatttctcttactcatacagtatttagtctaatatatcaatatatatgttatatctttccaaagctgtaagaacataccagttgcagtagcattggaatgccattttccccttcttttatggatcatgtatatttatttcaccgctgtgtgcattctaactggcaggcttacactaatgagcttgaaaacaaagttcttcgtctagaagaggagaatgagaggctaaagaagcagaaggtactttctctgctgttaccattgtactgtttctattttgtcattcctttagacaaatgatattccactaaggactactccctgtgttattatgttgatatggctttgaaatactgttgttgcacagtcgacaattcctgttttattttagctagttatttttttctctcgctatccacttgccacagttgttacaccaacaggtccaaagtggtaacagataactagataagtgctatatacttttgtaattgtgttagtaatttctatttgatctgtttacttaaggattatgctatgttctccttataaatggcaaatgtaccagatgtagttactactatatttgaactatgaaacaatcaaatgaggctttgattttgacttgctatatatgcaagtgcctttgactttctaaggagacctatatgaagttcttgaggattttaatcaacttatcatgctacattatactcctatatatcagcattaaatatgtgaaacactagtattgtcatcaccaattttgcgcatcattgcaatcttttaaagtgtaaattttaaatgttgcaatgttgcatacattaaatcactgaacacttaggtgggcctcctttttttggttgccttttatttatcaatcatggtaatgatttatcaaccaaacatgccttttctaagatttttgcatatgaaactactctgtatatctgtagagctttacgggttatacatgtgctgcaattccatagtaattcaccaagatgcttgattcccatgcccttaactttgggccttttccccttgaacagagacttgatgctgaacaaagtcacaaacatctctctgtactattagcataatagaattgatggcccgttgatatttgacaaacggttttatgacattccattatagtatttcttacagtttagaaacgaagtgaatcatgctgcccttgttcttgagattgggtaagcaagaccggcaatgccatttagcttatagcatcttgttactgttcattcatgttgatgtcccttatgagatgattttgtcccccgctgtttccaggagttggatgagatactgaactccgcgcctcccccggaacccaagtatcaactcaggcgaacaagctcggccgccttctgatggtgacgatgtccatagtaaattttgtagattatatggggtctgcccacatatttcgcatcctttggcggtaggaacaatcgatatagcttgagattccatcttccccctccagccggtggtggtttagagcttgtaaacaccagcaccagcagagccctagccatgtcgccccagctgctgatctcttcggaggctttgtcacttgtcagtatgtaaattctccaaggcacgtgtcgctgttaagttctcagagctccttggttatacatgattgggccctttgcctgtttcttgtggttggttgatacttagtacttggttgtgatcagtgtacgtgtggagacttttgttatggcctgatcaacatcagttcccctgtttcggctaagataacgatgggtgataagttgacggctcacccatgcaacacatatcgtatgcctgtctgggggagcagagttttagattgtgagaagtagctgatgggaatctagagctttttgggtttaatttattttctgaattttgtaactacagtttcttagaatggaagttggattgatcgagaaagctggagactttatgaatagctgtagttgttagaagctcctccaaacaaactctcgcgtggtagtctgtttctcgtaatctggatggaaagttagaatgtttgagagtgttggagattccagaaatagctgcagcagacagaagctcctccgatcattggagctccaaatctcgtggtttgtgtcgaatttcgaatgaatttcacgagataattccgtgtttctggggctcgcatctcatcatttccccgtgctttcctgcacgtgcaatcattcggacagtttggcccggaatcatgcatccatccatgcgtcatgactcatgagtcctatagactactcgtgctagtacaaggaggaaggagagccgaaagcagcagcaggctaggctgggttaggctgctctgcttcgcgtcgcatgtgccgtgcatggctcagggcacgctctgaatctgatctgacgaacggaatgcaattagccatggcatggcaagcgcatgcaggctggctgtcaaatggactaatccaactcgcagcctctcaccacatgcccatcatcacgcccatccactcctaatcacctccacttcattactcacatggaagccgtgtgagcttaattaagctcatataagctgaacacttcactgcaacagcctacattcatactgtccagcaaagtgagccgcaagcaggtcaccaaagccatgagatctgccaccatttgtgtcctctgcatttgcattctcatgatcctgcaatgctttgccagcatcagtgcagtggatcttggcgatgctgcagcttcagcgtcagggggagaaggcctgatccggccgaggaagctgctgcagaatgcgccggcggcgaggtcaccgccgtcgcgctccgccgccgccgtggaggtcgaggtcaatgcgagcctggggaagcagaagccgtcgagcaagtcgaatcccaggcagaattagaagctaagctactatcagtagacgacacacgctcacatggagctcttccgagatgtggctgtagaaatgtacataggaattttgatgtggaattttagtttcttcctcgttttccctttgcaagtagagtgttcaccatcaacatcatcaacagttcatcaccagtgatagtgtagttgcttacaaaatcagaggatctgaataggcgagttcccttcttttatgttgctgtcttgattgcttctgcctcctttggacacccttgaattttgatgatagcttctagttcctgatgattagtttggttttg

SEQ ID NO: 59152 - DNA, 4354 bp, Oryza sativa
aaaacagctgttcaaatatctgatggaagaagcaggtgagaggaacccattattgcaatcaacacaacaattcctggttcacatttcacaatcgactgtttgatgaaatcctgaattcgaccaatccaaatggagcaaaaggtaaatactaacatcaactgaattagaatgggaacgaagggtaagttgatccctatgtgaagatacatctacactactttctaaaatgttaatcaacgacacatgttgctccttgtccatcatgctgcatggctcgcaaacaaattttcaccatggcctccgcccaccgatacgcctggcaagttgcatgtccttttgcactgcagaacaaacgtttatttgttaaaccacacaatgacaacgctgataagctttacagggaatagcaagcagcatatttcacacctcaaaactcacaaaccaactaattctccctatgtttaatcaataatcatgataaatttaagagtatgaaaactagatatgacattaaatataaacacatgtattaagaatcatcctgcaattagaatgttattcctataaaaaaatagaatgcttttgaagtggatgcgtatatgatatcatgtaggctgtggcatatatgatatccatttagcataataatataaagggagaaaaagaaagagaaaagttcattcagaatgacaacttactgatggtaacacgcttagcatggatggcgcagagatttgacacttcaaatatgtccactaagtggtattctgctgcctgcaggagagggaaaaccactggaaatttgcaggacagcaagtaaataacataatttattttgtgagaattaagtcagctctttgttccttttcctggttatgcagaaacagacatggctggaaagaaggaactgaaattggtatactctatgatagcaatcttgaacagacacaacaaaatagggaggttgcatatttgtagtatataggtgttctactgaaaaaggataataatttagcaatctgactcataaatcaacacacagagatattcattttattgatcatggaagatttgtacatttttcagttacactcttgagccgtgacttgagtcttgaagcagaatggaatttaaacagtataattcagtctgacccttccctaactaagccatcagttgtaaacttataataaacaggtttgaccactgacctcttgcaatgcaaggagagcttcaagggtccaccgtgacacatcctttaatagaaatcagtgatctccctgacctgcaaattttatcggcacaaaaagcttccatcacacaagtttgcactacgaaatatttgatatagagagaaggcaggttcaggatgtacccaccagccgagaaaatggtgcaaacgggatcagcagttcggtggttttctgaaatttcctgatctcccgcagtgccactgtgcctggacggaagcggtgtggcttcctctgcttcgtttgctgcctaggcgtccctgcttcacacacatgttaaagttatttaatcacaggagaacaaaaggagagcaattccaaagccaagacttccatatggatacctatcatctaggtagaacagacgctatttgaaccatgacactaaagaaagtttactaaatcagttcccacgatgcaaagactaataatggatgagcataaaaatcacctatcaacatcgtgtctaaaaaccacacatttcttggctagcaatgcttaataccatgttttatggtcataatgtttcagataacccctccatggaccaaactggatttgctattatttcagaatgaaaacaagaaaagctttgactgatgagcaattgaagatctttctgcaactactgttcttataatatattcagaaaacaacgatgaggaaagtacagcacacggtaaaacagagcaagaaaagggacacattgagcccctcaggtcccccggaatccaagagacagaaaggaaaagctccaacgagcccatgaataaccctagaaacccccccaagagaacgcacctgaagccgatgttccagccgcgctcctctgcattccatcaaacaggtggtgagcaagccatccatccagccaagatacaaaacaaaaacatatccccccacaaaatcaaaaaatcaccaaacgaaagacccgctcccgcacgcaccgtggtcgccgaggtacccgtgccgcctgcaaaggggacaagcaagaggcgggaaggggggggggggggcataagcttcaccatccaccgccattgaaagaaaaaggaaaaaaaaaaagaaacgcagagggggagagagcgcgcgctcaccaccagcgcgctgcgccttcgacggccgaggggagcgttcgaactggagcttcttcttgggctccgccttcgacttcctcaccgccgggtgcttcgtgcgagccatctcggcgtcggcggcggcggcggcggcggcggcgacgtggcggtgggttttcaaactgaagcggcgtggaggcaaacgggagagggtttcttttggttttgggttggggatccctttttgcggttaggcccttggttttgttgttatttatgggtcagtctgtgtcagttgcgtttttcacatcccacaaggccacaacgccacgcgcgcgtatgtgtccaacggtcgagtgatcgagttatgtttcttgtttttttttccttttttgcgaaatggagttacgtttcttgaattctatcccagaatagtcatttcttgacattatttgacactgacaggactgaaactaacactatgcaaaatttaccaaaaagaaaaggatgtcaatgcaacggtcgaatgaaagattgaagaggaatgtttttttttccttcaaaacaggcactttcccctttgttttgcaggaataattaaacatgaatgcatggcaagctcggtgtagggatggacatggcctgacccacatttaatacctggaccactcaagttcaattaaatgaacaaaaattcacacgacatggtggatcaaggattatccactggttagttcatgccatcgaaataatactcgaccgacggaggaaagaccgcccacatgactttttattaagaagcaacctcaaccagatcggccaacgcgaaccttgacctccacatacggaactcacccctatggatcactaaaggtgagtttgacgataaggtgattgaggagattaggaagatacgcaaaaacgaggtgagccattggctcatgattaattgagcattaactattttaaagttcaaaaatgaattaatatgattttttaaagttcaccgtttagtagtttgggaagcatgcatgtgaaaaacgagatgtttttctctctcaatctcccagatctcccaggaacgaacaaagcctaactccttaaccgtgcttcgagatccctacccctacacaattatccaaaatccatgcaacatatttggcagtagctatccattttttctctttttttggaaatcaggtaaatatgttacccggcttgctattcaatttcacccagaatatagtgaaaatgtgaaatccgcaccgctcataattttttcggacgaggtgacaacagaacagctacagttttgctaccatttcagcagccgacacagatgaaaatttcagataaggcagccagccattcgctgcagaagtattagcagtacagatactagtatttttcctgaagaaatcgatcaatctgagaagcttctgctgctgctgctgctgctactgtgggcggagggaggagaggaggacgtcctggagggcgctgtccttgttcatggcggccttgaactcgtcgaaggtgaccttgccgtcgctgtcggcgtccatctggtcgaacacctcgtccagcttccccggctccgttatgtcgcctggcaggcactcctccggcaacgccttgtgaggatcaccaaagttcagatgaacagcagctcgtcagattttcaactcaaaacttgaaaagagacatgaacaagccatctcaagaagagcaaagatttggttttccttttttaggagttcttactcggagcattgatgccagctcttccttgctgatgcagcctgaccgatcagcgtcgtacatctgaaaagaaaaatgcagtttttttttgtgtgctcatgatcagatgctgaaatacctctcttgttatgaattttaattgaatttgaagttatgtatgatatgatatcatgcaatgtttctgatattcctgtacataaattggaagggctgccacttcagtttgagtcgagtgcatttggaaatttttacctggaagcacagggc

SEQ ID NO: 59153 - DNA, 1448 bp, Oryza sativa
atatgtgcaaatatactcctgcaaaattgggacttcttcagtgttggaaaaaaaaacatttgttttcagagaagacaaggatatatgactcccccttaaagcaactgtagtgttcctcaaattactaactgagaaatgctagtcccaaaattctagtaattacacaagaggttttaggctgatcaagtcatgatactcacattcgtccaaaatgaagccgcagattatccagctcctctgaggtaaggtcatgggttcctaaaagatttctcagccttttagtcctcaatgccactttgcagctcaaaacgctggctatcgcagctgcccgcaatttccttctagcattgaacttttgcagttttgagacgacctctgcatccatgagatcttgcttggcgcagtctccaatcacccaaggatgcctcagaagctggtttcaaatgacacatgatattcaaattaagaacagttatagtatcttagctaacatggtaatatgctgaaaagggagcatatgagacagacatcacttgctgttggccttttgtaaggttgaacagaaagaaggcgcgaaatcaaatctttcgcggatgaagatattgttttccatgtgtggtcctgaaaactgaattcaccctgaagaagcacacaaattatatgccattagagcaagttcctgattaatacaggcattttcgaataattggtgcctaacacaaggactacaaatcctcctcttatagtcatgttattcaaaggcactattgataatggaacccataattcttcagaaacaaacggcacagtttatttattttttcagtggtttactgaacaacatttgactagcccagtagccccatatccatactgactcagttcgtgtttttcattggaaaatgtacaatccaatccatgtgtcttttgtggaagagaacattcttttacaccttttcagtaaaatgtaaggtctagttagctactggccaactgctattgatttgacatctcagggcaactttttctactagaactggacaaaatataggacaatgcaggtataaactgaagtgctaacaactaccaaaagacgacatttcagcaatgattggcaggcagatctccaaactatgcaatgtcatttgctgcaaacccactgataaaaggctaacaacttcacactcatgctgaaattttagagtgaatcaaatgcccaacacataatttgggactggaaaaccgtatggccgactcacactcgaggtcagctacatgtaactctcaccaaaattccattttttgcaagaaaaacaccctcacattcacgggccagaattataataattctgcttcattagaaaatgcaaagatacttataaatcatcttgatcagaatacttataatgattctgcttccactaaaattgcccgaagtgtttaatagg

SEQ ID NO: 59154 - DNA, 1418 bp, Oryza sativa
gggcacgggctttgtcccctgcttcatacccgccatcgccgggccgagcctcctcagagtcttgatggcaacctgggtcttctcttcagacttgctcactcccctccttactattgagaacccgccccggccaagaacatccacaacttcatagtcatcggacaactttctgctctcagtcttggacattatggacttcgactgcctgctctgaagaacttgataaattgaggaaccgaataacaagactcaattggcagtaatccagtagcaaagctgtgtcctgaaagaagtaatcagtagcgcaggaagaacaaatgaatcatatgggtatctgcaggaagtaggagaaagagaatttggggaacagcagagcacaaactggaaggagcagttaggagtacaaagcaagctccttctcctgaagacctgatcagtaaacaaaacaatatgagagagcattatatagagtaatgtgagtactgaaggttgtgacgatggaagaaagggacatgtgcaacaaccaacacaagggaataaaccctatcaaggatttctttttgtgcagagaacaaggtgacaagaagagagaaatgagatgattggaagaagatgacaggccaaaatagtttttgttgacctggttgccactgcttggagctgctctgaattggtcttcactcggtgaggcctaactgtagtttactgctttgtcttagacagttgtaagcacaattccactgtagctgacaacatcataaacatggaaggtaagctctcctcatgcaaattaacacaagatgtaaattggccaggtatggtctggtcaaacggctggagaggaacaaatgaatcattttgatagacatttgtgccatacaaattgacaaatcttcactctggcatgagtttcctctttccaacttaaccattcatcatagaaatcgataaggaaaccaaaattgcagaggcaaatgtaaaaacaaaaagattatatggctcatgaaattacaatatgtaagcaaaacttccatagaaccatatgttaccactgtgacaataacgggttcacagctccagatatatcatgaatgccctaaacagatgcttccacaaggacaacgcccagacaaaaatgcatcacataaacaaaaaaataataattttctagatgaactatgccgaatctccaaagctcaatggctcttgtgacgcttagggtttatctttccataggctgcttgcctttcggtggtcatcttcaactccctcctcctacgcttccttcgttcacttctggttgattttgccttgccatctgcatccccctgttcattcggcagctccttctctggttctgatgaagcagggccttcctcagacttagacttcttctttttgaccttcttgccttcttt

SEQ ID NO: 59155 - DNA, 906 bp, Oryza sativa
ctgccgctgcagtggcgacggcgacgacggcggcggcgaagctgggggtaattagggttttcgcgaatcgagaggagcaaaccaatattaaaggaggcaaatgacatatgggtcccacctttactgaaggcccatctgtgaattttacggcccaagaggacggaggcccaggggcaaacgcgtaatttcggcagcgaggcggcacctatatacaccgcgtcgagctaaaccctaaccagccgcccattcgcgccgccgccgcagaagccaccgcgccccgcagctctcgtcgtcgtcgccgcggccgctcgatcacgatggctcccaccaagaaggcggtaaggttcctgatcgattgcgcctccctccccctcctcgtcgcgctctcccgctgcgcatctcaccatttcgttgcgatgtttttgctggtttctgattggtgggttgtggcgatgatgcagaagaagagcacggacaacatcaacaacaagctgcagctggtgatgaagagcggcaagtacacgctcggctacaagaccgtcctcaagacgctgcgcaactccaagggtatcgatcccgaccgattttttgttgttttgttcgatctggtagtgttagtggatgttgattgattagtttgctcgcttaatccgaattgtagggtaggtgggagtgttatgattgattgatgcgttgctagctaatcatagtctgcctatagatctgcgtgttagtttgtgcgataattttcgggtagattggactgtcttatgtttatttatgggtggaattgttgtaaatcctttggaagttgatcggctgtaaatttaagtttagatggattgtggttgcaattatttgggatgcgttgtgaattgagttgcattgcggttgggctgcaggaat

SEQ ID NO: 59156 - DNA, 3796 bp, Oryza sativa
attcctgcagccctattttcctctatggcaccctcagaagtactgaatatatttgcctctttccctgtttcaggtgactcggacatcatcaacacaacccctgcctcccagtgaagaagtttttacctatttagttgagatgtagggttcagacgtgcttacatggccaatggctgtttcttggttatctttagttgtgtaattttgctatgctgagttgggatctgccatacagataatactccatattgttgttaaggcatttctatggttttgtttgatgagatctctatttatatattgagcaagtttattctcctgctgttctgtgagcatcagcaaagagagcatcatccaagatgtttgcttccttgcttatgtggttcaaaagctagactatggttgttaactatctcgaagcttcgaatcacttgctttgttttttatccatggtgtgattcgctgattgccgttttggtttctgctcctggagaatctggaaacgtagtgtggcttccacgtttgcttgtcgatttgattatcgccgtttagcagctgctgttttgtttatgcttttctatattccgtgacgtaataatgcctatctcccagattgtaaggttcatccgtttgtgatacgagcgtacttaatgctaggagtacgtgtgtatttattaggttaatttaagtgagtttctatatattgttgtagtgttagaagtgcatctaacaaaactaattttgtgaaacattttttgtttgaacaaggcacgtgtttactgataagttgatgtgagcaggtcaacaccatctaattgggcacacagattagctatcacgggattagtaattttgtactactagtgtgccgtagttggtagtatcatgggctcatagtggtcttccctattaactaagggtctattcactttgctaccattttcaaccttaccaaattatagtattgtcaaattttagcaaggttgccaaaattttggcaaggttgtcaaattttgacaagattttatatgtgcttagtaaaatttaggaacaaactaaatgtagcaactttttttttaactttgccaaaacttgataagattgaaaatggtagcaaactgaacaagccataatcgtggaccaaagaaaggaaacaaatgttgaccatcacggaaggttctaggggccagcagaatccacacctggcacagtattatgccatttcattaacatggtttggttacctacaaaattcacattcccaaaaccaaaacataaatatagcacaaaaaattgacaaattttatggaatatatgaagtagagcaaccattatacgagtttaattgccataataatacgcaatacccaaatatagcggctccctaatctcctctcataattgccggtgcgtgatgcgggagttggttcgaccagcccaaccgcttcccacccgaacccgacctgccacgtcggaccaagtccaacgcatttccgccccctccacccaatcccgcgccgccacgtgtccccgagtgcgcgagaaatttgtcctaaatcccaccattaccgcggccgctttcacatctcctcctcctcgtaatcatcttctcttctctcttccccggcggcgacgcggcggcgccggtcaaaccactcctcgccggcgaggggagcgcggatcgggctcgggaggaggctaggggtttggctcgctcgctcgctttcggcgtgcagctgaggcggtggacttggcggctgtggcggaggtggggaggtggaggtggaggggagatggaggggttcctgcagaagctgaaggggctggacgcgtaccccaaggtgaacgaggacttctacaagcggacgctctccggcggcgtcgtcacggtcgtcgcctccgtcgtcatgctgctgctgttcgtctccgagacccgtaagtgtgtgtgcgcgaagcagccgccgccgcgcggatgttgtgtgctgttcgcgtactctcccatccgtggccgtaatggctcgatgtggtttggaattcgaggagttggttcttgccaacaagatcaaagtcggatttcgagttgtcgatggggatggggatttagagtaagatttgaattcaatgatgcggtgggcgtgttcctgctgctgctgcatgcttgaatgtttggaatatttccaggggcacctgaccgcgctcttggtaatttctagaagaaggtgcccttttaggtagacaggttttgcggtgtgtcagggtaacgaactaaagatgggcatgttgcgatgggcattgacgctaatggtgatgtatgctgcgcgcgatttttcttttctttttctttttccttttcgggtgtgagattcctgaaaagttcaagaatgcttttggctgagttcctgcgtctctgaggaagataaattagtttatttttttctgctattacttggatttatgtgctgctatcactgttggttcgtgaagggtaagtttttgtgttgttggctctgcatgttggatcatgcgtgcaaaattaggtcgtcacaaggattatgccgttttcaagttaccttttgagtaaagtctgttgttgcaaaggttctgttttatttggccagcatggccttacattactttggagtttggagaacaagaggttacaagttgtcgaatttttatgctctttttgtttggtgcaatttgttagtgtttatttttttaaaaaaattctggtagtgagaaggttctttcataaaatgtttttgcagggtcatatttttattcagcaacagagactaagctagtggttgacacatcaagaggggaaaggctacgagttaatgttagtatttatttgattgttaaactagattcatgtcatatgttgtacttctattgtttctagtataaaatgcatactcttttgtatgctattcacttacaatctgttgggaactaggtgtgaatatttcctgttaacttctaatgctaaaactgttttgcagtttgacgtaacttttccgagtgttccctgcacccttctcagtgttgataccatggatattagtggagagcagcatcatgacattgtacgcacttatgctatatcatcttctaattcttagtatgtgttgatttgtccatcttattattccattgtttgttgtagaggcatgatatagaaaagaggcgattagacgcacatggtaatgtcattgaggctagaaaagaaggcattggtggagcaaaggttggtgatcactgctttagttacactttgaggttgagctcattaataaactaagtgattccccgcgctttgctgcgggaattaccaaacaattctcaatatatatttttcgacaatcaagatagcagtaaaaaggaaaaaaataatgaaacatcagggtttatcggtacttatcatgaaacaaacaaatgatatccgcgctttaatgtgaaacatataacatattataaaaatgatagatagatttgttaaactattgtgcaaatgatgtgaggggtggtgattagatatgcttgcatgttgatttgtagaattaaataaattgcagatgatgttgtatgcttgcatgtcttaaatatgtaataattgctagtgggtgatgatgtgacattgttgcatgttgagctttagacttagtgagctataactttatagaaagtatagatttaaaatatcgaactagagtcgtctgtacaaattattcttggtgacctagtatatttccctacgatgtacagcattgtagttgttggaaaacaagtggaa

SEQ ID NO: 59157 - DNA, 1171 bp, Oryza sativa
tctttgtaccctcatgtcaaaacagatttcatgaacgtcagtgctcagtggacacaaccagcatcagatgggacataccaatacttcataaaagtgagctcttgttatccatgtttacgtgcttacatttgtatcagttgtttctgctacaaaccatcatttgaaaagaaacttactgggttttgcttaaccaggttgttcctacaatttacactgatctaagagggcgcaagattcattccaaccaagttagtgaagtttattgaatcatgtttatactttatattttttttccaagcctagtgatcttattgttacttgcattcacagttctcagtaacagagcattttagagatgggaatattcgccccaaaccccagcctggagtatttttcttctatgatttctcacccataaaggtagtaacaatggagagaaattcgtatgtagtcatgttcatttttctctttttatgattctatcttagcttgctctactcatcttctcaacctgtggatatgtgttgccaagctcatctgttgaatggctggctgtgttggtgtgaccattcttgctgcacatgcagaatgctccaaattcaccatctgttattattcagtactatttaattactttggacacaagagaagtctacaatacctttgtttcacctttatctattctgacactgcaggaccaaactggaatttgtaggctttaggtcatggagagtttctaaagttagttattatactagtcagtagctaaaagaatcagttcattgatgagatatatctgttaggagtatcctagcataaaatttggtattatccttttattatttttattatttgctgaatggctccaaaaatgtctgcatatgcatcgtaacactttgaatacaaaattgacagtgcatgtctatactcattcaaaagcctctagtggtggtggcagggaatttgccaccccactattgctttttgcagtttttacaaattgtcccctgatatttttctaatattgtggaatagttcaatatttggttcaaacaagtgaatagcagataatgaaataaacaaacaattgatactaagatatttgataaaatatatatttttcttacatattatgatattgtttttcttctgcccatagcaaagcttgggc

SEQ ID NO: 59158 - DNA, 1834 bp, Oryza sativa
cctaagttgacgtcttctgaagccttcttgtaagaactgccagttcctttttttttttttgtgtgtgtgtgtgtgtttctagtttacaagaacctatcatggcccaaatctcatggagataggactggatctatatcttgcccttaacatcaaggattaatcctgaactgtaatttttaacaaggcggtaagatagataaaaatattagagaatatctgcccatgtagccaaaagagataagattggcactaagtatagtgctaatccactggcaaagtcaacttcagaaaagaaacctcacaaatgtaacaggaatcagcatatattaaagtattaaacacaccaaaatgaacacgcaaatcaaaaatataatggcagctgatatcctgcagaaattgtcagcatcagattggtcgttttcatttcacaatcccaaaatgaatgtcatgtacatggaagaagaatctggccgtctctttttcaaggctaacagcaacctccgtgtatggaaacttcttccaaccattttcctggcagcgcaagaataagttgtaaatgaattagtttattttatccataaagtggtaagaacatatatgcggagcattttgagtgcaatgcaacatctctgtctcaacatgcagatccaagaggataaacacaagactcattggcaagaggacactgagaaaaaatggatatctcatatgtatagtatttattgatgttataatagttaagaattgccatttcaggcatcatccttcgcagaaataaaataaagactagtgagtcatagagggacaaaaagagcaaacaatcagcttgcatgatgttagttgcataaaatcatgacatggcattgggagagcaatgagaaagatacactaacttgatatgatttccatataaccaacagaatgtcaccactgtacagagagctaatacaacagagagcaaagcacaacctattacatagaccagaagttaaaagtaactagatgactgcctggaccaacaagctaggtacccagtaacagcacaagatatctagaagccattcatctccagaaggtaagttcgcctcttcatcagcgccttcacagcaaacttgaatggtccatcaaatgctccggagacaaatgcatccgtttccttgcggctagtatgaccgccattgcttccctcgggtgagggcttgatagcgaccaacgttgcaccttgcaacgcaatgccgccaggaagctcaagatatggagcgtatttgagcttcatgttgcatgctggaacctgagtcctgttagaacatgctgaggccgacaactggttctccctaaattccttaagctgctccgctcccatggacaatgtgccctggccatcagcatcggtcagtaccaagcttgtaaagtgggatgatccttgataattgaccgaagaagataatgtctcgttgatgccgcaatcagagagctgattgtccacacgacgcggagtttcaaccctccattggtatagaaggattccggcatgcttccattgtcctccgaatacagctcatgctctgcaccaacaggcttgcggtcgacctgagtacccccaagaatcacacaattctgaagcgtactcccatactccgctcgccatttcaggagaactccctcctcagtccccacatcccccgagggcagctccacccgcagattccggatgtgcgtgaagttccggagcacctgcgccggcgagtgctgcgcgagctgcgggaacagcggccgcccagcaccgttcgggccgcgcatgctgtggaacggcttgatgatcgtgaacagcatc

SEQ ID NO: 59159 - DNA, 4440 bp, Oryza sativa
gccattggaaaccacccgaaatggagaaatggatcaaacgccctccccccctcccccccgcgcgaggttgcagagaaatggagcactaatctttgcaacagaaatgccacgaacagaagctgctgctcctcctcgaccttgtcctctccgaatggctcacgcaaccatctgaaacagaacaagaataagcacaccggattaggcgaaaaagatgggagagaattgaatgccgcgcagcatgcataaaaaaaaagaaaagaaaaactcgaaagaaactcaaatcaagaaaccgagaagacgacgaatccaaagagagaacctacctcagacaccgcgccaccaccaaatcaaccgcgagggccaacctttcgccgcccacacgcgtccggatccgacgccgacgagcaaccgtacggtaccgaaatcgcgaaatcgggagaagggtcgcgccgttttctcaccggaatcgagagtccccccctccacgcgcagctcctctccgaccagccggagatgccgaaagagcttcgatcttggaggccggtgggggcgaatcggacgggattagggtttagggagaggggaattggggatgagatgttcttgttcttgcctctccttttctttcgttttcgcgaagaagaagaagagagtttccctgggcgaagtgcttctctttcttctctttttttttttttctcgtcacaccactcgacgcggctctcctttaatatcgtctcgccgccgttaaggtgacggcctccggcgccgtcagttccacgtcagcagtagatgcgaacaagcgttcagtaaatttttcacttaactgcacgttcaccaccatacatgcaacatcctactctcgggacccgaataaatcacagaaataaaaaaaccgaagaagcatgaaaaatatagaattatgttaggaatgcctctttaaaacatatgattgtaaaacaaaagaaaacacaaaaaatgaccgtataaaagacacatgaattttaaggagagacagagactcaaataaaacttttcatgaggttttccctcatgttaaatttcctctaaaagttacatggaatgagacatattctataagaattttatggggttcatttatttgtttcaaatggctatatgggaaaaaaatcctatagaaatacaattcctacatatttccattaggtctccgtctcatacgctcagcccacgaaaaagcacacccacatatgaataatgttcgttgatatcagaatttgaaatcgagtcatgtatccaggacatcaccgttacaccactgatgttttatcactaaatatttatatattgttagcctcatcgtttgtcatatgctaatcatttgtcatatgccggttataacctgtaattgcttattaaaaaatgtgggtaaattttttatatatactatttaaaagttaatgaaaaaaataaattatgataaaataatatccaaaatcaacttaaaactaaaaattaaatttaaagtttaaattttaatagcggtttataagctaaaagacgaactatggagttaggtatgttgttaacaacaaacgagcaactaagatttctattattttccttaaaaagtattattatttcaccctcttcagtaactactttttattatttaaccctgatttttccagtgtgtggctgtgagctttcaccgtttgagagcagcttcagtgctggtgtgtttggatcccagccattgaatgccatagctacagtattttcgccacgctatagtgttttacgaaacgtccgccacactcctgtggcgagccacgccgtggcgtggcattccaagccaccaaccaagcatctctcaacatgattactgcgtaatctgatttttgccaactaaccgccacgtcattgagattgagaacgaaatgtgtacagatgagttaatttggatgaagtggcaaaaggaaggtgacatggcaggcagcatcggcttgattaatcactataaaagggacatgatgttcttagttgttaaggcaattaatttattcacgttggataagatagaaccaccggtccatcaatattggtcacaaatagatacggtatccttgatcagtttatatctcaaatagtttttttttaacaactcacacgaaacggtgcgaagttctattcatagagtagaaaaaaatacaagattacaaccctagaaagtcgtaaccaaaaaaataaaaaaattataccaccacccacatactaactgcgccaaacacagacccaggagaagtctagcaccggaccggccaccactcagcgtgaccgaccgtcgctaggccaacaatggaacacatccgagatcgcccaaaaacatgacccttacaaccaacgcaaagcccgactctacccacatcttcaggatttagggagagggggtgagagagaagatggaacacctctccccctagacccttcgacatggccaacttgtagaaactaggccacctccacaagagaatgagaatctagagcgtgcttgcaccaaaagctcgggtggtttcggcaaggggatgcctagacgacgtctccaaggagaggagcgacggaacaccgccgccgccgtccgtcaaggactcaagagagccgatactaggctttcgctcagcaaccgcccttgaggggtaagatggcactacaacaccctcaagaggggaaatgacactcgagcgtcatcgttatcggtctggccaaggccgggctgggttttcactggccatccaccacctaccaatataccacagatgcaccattgctccactgccaactaaacctccgccgccgcgtgggcacaccgcaccagtgccccccgccggccagtctccacatgcagctacctcactgggctccacctccattggcttcgcctcccgttgcgcatccatcgtgcgccagccgtccttgacgccgccggccacactgcaaggctaccggccgcaacactctaccggcattggccagccacagcccccggccctcgtcgttgccctctgccgcaggcgcggcctcctgcccctccaccgccgtcacggcctccgcacctccatctccagcacctccgcgctgtcgcgcccgccgctgctagccgcaccctccgtcaccgacgccctgttaacagtgaaatttggtaagcccaaatttaccatcggcttagagtcagtatcggcttcaaagttttagaatcagccgatgggagtcaagtcgccgcgatgtcgtgttcttggtggagtcggatcaatcaaatgaatcttatccagaagagaccgagttcaaagagaatgcacatggcaagttatctattaattatgaatagtttgttagtttccttttatctttagaaaagtgtgtttagtgtcctataaggactttatcttttccttctatctttaagaaagttgctttcttgtctgacaaggacttgtatcaacccataggtataaatatgtacacccggggtctatgtaatctatcctcacgatcaatacaattcggtgcatcgccaccttttaccttttctactttattttatcgaccggcaggacttggcacctgacgtggggctacatcgttgttcgatctccggcgaagggataagtccaatgttccgtcggcccaggcaattgtctcatctacatcggcgtcgttcaaggctgcatcagtatattcgacctcttggattgctctggtttggatgatatatttgcctacctatttatcatatgtctatgttaatctagtcttagcatatcaatttagctctatcggctgcttctcgttttagggtttctgccggtatcggctaaatcgcgttgctatattagattagcttagacatctaccacactgaaaactcaatcaacggcttgattgtctagatattatttttcttttcatacttagtgttgcatcagttaagtttgatctactaagtcgtgtttagaactataatctatagcctgcttcttgattgccaataagggtttcatcggggtttcagccggtgagttatctggacgttgcatcggctcataaggattgcatatacatataagttggatttagccgatgacaacaaaggtttcactgtttaatctaatcttgtggatttcatgacatcggacctccagccgatgtgtgctttaaccttcagatcgatgcttatttatcatatcattgctagccgattggtttctactggattatatttctatattatatcatcataagccagttgcctttatatcattatctacattggacatatagccgattgcttaaaccttatcgctatcggatggtatcagcatcggctattatcggctatcggctggaactactccgttggcttgtcagccgatctgctgcttcgatctagctatttgcata

SEQ ID NO: 59160 - DNA, 1561 bp, Oryza sativa
ttgatgagatgcggacgtgccagtcagtttgatcctgcaactgacaagatatgcaaatagtagatcaaaacatccgatcggctgacatgccgatggagtagttccagccgatagctactaatagccgatgccgatactagccgatagcgatatggtttaagcaatcggctatatgtccaatgtagataatgatataaaggcaatcggctgatgatgatgtaataaaataataatataatccagtataaaccaatcggctagcattgatatgataaaaaagcactaatccgatagttaaagcatacatcggctggaggtctgatgtcatgaaatccacaagattagattaaacagtgaaacatttgttgtcatcggctaaatccaacttatatgtatatgcaatccttatgagccgatgcaacgtccagataactcaccagctgaaacccttattggcagtcaaagagcaggctagagattatggttctaagcacgacttggtatatcaaacttaactgatgcagcactaagtatgaaaagaaacataatatctagacaatcaagccattgactgagttttcagggtggtagatgtctaagctaatctaatctagcaacgtgatttagccgataccggcagaaaccctaaaacgagaagcagccgatagagctaaattgatatgctaagactagattaacagagacatatgataaataggtaggcaaatatatcatccaaatcagagcaatccaacaggttgaatgccctgatgcagccttgaacaacgccgacgtagacgatacaattgcctggaccgacggaacattggacttaccccttcgccggagatcgaacaccgatttagccccgcgtcaggtgccaagtcccgccggtcgataaaataaagtagaaaaggtaaaaggtggcgatgcgccgaattgtattgatcgtgaggatagattacatagaccccgggtgtacatatttatacccatgggttgatacaagtccttgtcggacaagaaagaaactttcttaaagatagaaggaaaagataaagtccttataggacactaaacacactttcctaaagataaaagaaaactaacaaactattcctcattaatagataacttgccatgctgcattctctttgaactcagtctcttctggataagattcctctgattgatccgactccaccaagaacacgacatcgcggcaacttgactcccatcggctgattctaaaactttgaagtcgatactgactctaagccgatagtaattttgggcttaccaaatttcactgttaatagagcgtcggtgacggagggtgcggctagcagtcgtcgtttggctccaccaccaccagatccggccgccatggcatcggtgccgccgttgccgtcgccgtcccacaacagacactgacatccttcccgccggcgccgagcgtcgccggatgcctccccgccagatccggcgcagatctggtggcctcgtcctccgcagcgcctctaaacttcgtcaccaccctcgccaaacgccactgctcgaa

SEQ ID NO: 59161 - DNA, 1588 bp, Oryza sativa
acaaaaggcagttaaataactaatctaaacaacacgaacattaacaccatcaacgaataataccggagagtccccgcaaaaaaaaaataccggagagaaaaaaattctctggtctctggtcaaaaatggcgagagatgcttgtatcagcacgagaaaattattgcacgagatcaaagataaaaggagaggtaggtgtcctgtttttaattgttttgctaatgataatgacgatacagaagatggattaagaccttaattaccatgtacagggcataattgtgtgttcatactgattgaggccgacatgaacggctacgggcaccaaccaacgtgccgtctcaatcgcatcattttccactgccgatttgggatttgttttttgcgtgataacaaatctagcaaggagatgcctaaccttgcaaaaaagacagaaaataatcagctctgaaagtgttatctgatttactacataataacaatataaaattaacggtctcgttgcaaggaccacttgttgatttctttgtcaatattaggaatactagcatattgcccgttacaaagggattttaattaaataaatttattattaacatgttattatcatctcgtaatcattgtacatgtgaaccttattaaatctatatttttttccttcccaccaaagtaagagttggtgagagtagttgatatatgagcactctaaccctacatgtctttttttttttgttaaaagatgggagttggcattggggtggtggcaccactactcccttttacaaggactcaaggatagatagtaatgggatgataaaaatactggtatgagataaatacatgtgaaaaacatagaaacaatggagaaacttgtttaaaacgtataagaaaaacatagtattagaaatatgtttttttttcactaagatacttaaccatatcataatgtaatcttgtgatacctacttgaaaaataaaaaactatccgcttgtgaaattacttattttattatacataggtactatatatatatatatatatatatatatatatatatatagatagatagatgtgttgtcggtaggcaccaccatacaccgatggattggataggatatcaacgtttttctttttcaagttagataggagtccttaaccggttcacgttctctatcgtaatggtattatcattacatctattataatgatttttcgttatatagatattatattagtagatcctcacctgtacttaaccatatcagaatgtgaatcttgtggtggtctacttgattttgttttatttttaaaaaaatctaacccaagtggtgcattacactgtagtcctcaggattgaaatggacatgacggcataagacggtacgacctgcttgcgacaggatcgtcttaactttcacctgcaatcttcagttaaaaccgtgacaaaacacatgtctcacctacactctcatgccttctcaaaaatcacaacctacttgtactactaactacttctacttaaccatcaaactgcaaaacctgttgcagaattgaggaaatttcagagcagagagcccacagttttttcg

SEQ ID NO: 59162 - DNA, 1760 bp, Oryza sativa
  unsure (1)..(1760): unsure at all n locations
tctatttctagggagaatgttgaggcaaacttacgatgctgacaagctggttaggtgccgagttggattagacatcgttggttttagtttaagaattgggaagaggttaagaacctagtggaatccactgcgaggggaagtgctgaagtgatagggattaaccctgctaaggaacagagcagagaccatcacaaatccttacaaaaagaaaaaaaagaagaagaacttgtttcggtagatctcgatgaaaagctgcagctcctttacaattatgttccgcacgaagtccacaagaaaaaagacagtgattttagtatgattagtagtaacttgcaaccgaagcgacattttcccctggggtaagagcaaaagagccacgcgatccaccgttgcagagatcaatgatcatatggtcttgtgagtttttttcttaagaacatagtctttccgtaaaagaaaaccaattattctactaaaaaaatcacattccttttatattggtttttttttgacgggaaagtatggtcttgtaagttgtgaggctttctcttgacacgttgtactactgtgcatatcacaacacgttatcttaccgcgtcagcgtcggacctttaagcagcggttacttttttccttttttaatatagttaattccagtatgggatgtgacatatcatacgaatctaaatatgtatatatctagattcgcagtactaagatatgccacatctcatgctagattaacttatttttttatggaagattaacttatttttaaacggtggcagtagtgaaattcaaatagctttgatttaaaaacacttttgaatttgagctcaaattttaaaacagttttccccgtgtaaaccggcacgagataagagataaccgcaaaaaccaaatacttgtattcctacttgttattatcgattttcaacgatcgatgatatttcaaaccataccattttagggtaaagttgctaatgatgtgcatatatttagtttcttgccaaattttaataaatacataataaatcctgtgaaaattttcacaatattattaacttaccaatattttggcaatagatttattttgactataatgtaaacaacctctaacttattgagtactaccttcaatctacaagagattttagcaatacgatatatagtagatggagatagtataaagctgtgtgcatataccgaagccgagtaacgaagaacaatgtgatatgcagttgcgacgcaaaggaacactctatctgcgtggataaggtggacttgattcgtcgatggcgacgatggcgagacctgcgcggcgacaagagacagagacggagtcaagcgtgacagacaggcacagaccaccacctgctcctattcatggtcctcgtttgtgccgtgcttatcctccattctctcactgctccctccacattttcgtcgaggagacaaaatgtccactattattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59163 - DNA, 16914 bp, Oryza sativa
  unsure (1)..(16914): unsure at all n locations
ttttccacgggatatgattgccgtctaaagcccttcatcacactaatttcttcccccaccacatcgctcgctcgctcactcactctggttttttaagcagaacagcaagctggagagaaaggaagtggatggagcagtgagcggaagctaagcagtggataggtcgctgtgtaagggaacaggcaatccacaagggcactccatgtgcgttggaggcttgagaagcaaaatgtgatgccctggtcaaagataagcacagacacgtagatcatgctgccaattgccttgggcatggcagtttgccaatagtttcgagcaagccccaattcagcttcatggtctacatgcttgaaacatggctggttttgcatttctttcattagcaatttgcactggcaatttttagttggaatctgcaaaactttgaaaaatctctggaaacatgagacttgctgaaacacttttgaaactcaattaagcacttattagacttatggaaacactctgggacttgcttacttgctggaatttcttacgaaggttgtcaaacctgtcaacatgttattaaacttgggtttgaaacttggcgtttcattttttaaaactatctaaacatggtgttttagtttttgaagctcccagaaactgcaaggaagtatttgaatgcttggaacatgtcgaactttcctatcctgttgcatcggcgtcttttgtttttttgcagcaagtagcatccttataaaaattcataaaataactcaaatggaatatctcatggatgaacctttgtccctacatagcatcttgatgggtcaactcatattccagtacatgaaaaatccaataatatagcattacgcatcattcagaaactgcaaatcagctattacaggctccaaaagacatgactcaactataaaatcggtataactatttatctaaaaatggcatagtttcatggcattagtggagatttcctgaaacattataaataacacaacaacttataaaaaactgatttctgcattcagaagcatcagcttcttttttaaaaaaaaaaactatccacatactgaatatatgtccaatccaaaagcaaatgtcgaaataaaaaatggcattttagataaacagggtgcctgaaatatgatgcactaactaataacacaccgcagatatgctaaacagtatagtggatacttgcggtttaaatgatcaaaacacacacctgaaaacaaacagacgataaactttactcattttagcaatcactgcaaagcgacttcaccgtgcctcaaccaagaaagcatgccaatttccaaaacaacagaactagatacaattacccagtgaactagagtactaaaagaacaaagcaagcaaaacccttcccaccattgaagtgttaaaagtgtgatggaacaaaaattcattcaacgaagactacagctgtaaagaccagcagcaacggcaagatacatgttaaaaggtcaaccaacagtcctgtccaaacagccgtcatgctgcacaaggaccacgtcaccaatcagaaataaatccaaaggccacagatttctcaagatcgccaaagctgctgcgatcgcaatccaacccagcccagcccagccgcatctgcgaacgagacgaagcataaaaaccccatctttcccaggcaaagcacaagcagcgacccccccgtccggagttccggaccatagccccaagcaagcgggggcatccgaacgaggcaaacaaacaaccacccactactacccaacagccaacagcacagcgacggtaagttgagccgcggcgcgggggcggggggatcactacctgcgaccgaagatggaatccgccgcggtgggcgacgccagcgcggcggcgtgcgcgctcccctccgagaccgaagggctcgacgccaccggattccgctcctcctcctcctcctccaccttcaccgccggcatcgcgcccattgatctaccgcctcatcaacacctccgccgcctaaacaaacaatcaaaaaaaaaacaaaacaaaattcccatcagaaacactcccccaacttaaacgcacctcgcggaagaagggaatcaagcgccgccgcttaccaaagccgccgccgcccagatcggggggaagcggaggatcgaatcgaggaagcgggtggggtgggggaaggagagatggggtggcacgaaaccctaggcagggcaaagggagcgagctcctctcctcctcctgcgcgcgcggctgcccgtctgggggtggtgttgcggcgcggcggcttcgattgtgtgttggggaaggaggaggaggaggggtttcaaaaaacctcgcccgttgaaggaaaggaagggaaaaggaggcgaggagttagcagacggggggaataatttactcccggtcctggatctttttcagataggggctccaggttactggtaatttcttgctaggtgagttgttggtagccatagtatctttattttctcctttcctaaaatatactcctaacaaatctggataaagatctgtctaaattcgttgtattatgatatgtatcattcaatcctatatcgttattttttgggaggggtatagtagtatataatattagtattacttcatccgtttcatattacaagtcactttgatttttttctattcaaatatttttatgtttgatcgagtttatattaaaantataaaanacattttcaacccacaaaatgaaatattttattaaaatatatttaatgttagatttaatgatattgatttagtgttgtatatgttgctagaattttctatttcctccgtttcacaatgtaaggttttctaacattgtctatattcatatagatgctaatgaatcgagttcatataatgtctagattcattaacatatatatgaatgtgggcaatactagaaagttttacaatacgaaacggagggagtataaaattgatcaaacttgaagaaatttgaataaaaaaagataaaatgatttataatatgaaatggagagagtagttaatattaagtttgagtaataaagctgtagttttcttacaactccgtactaacaaaaatctcaagcgattgattgatcattgattccatttgaaatataaatagttgagattcaatcacaatattatacatcagattttgtaaaaggttatataaaatatagtatgtatatcttttattatttattaagttagattagactagttaggcgtgtaaactacaatagtgcattatgttatcagcattgcatatcaattaattgttttcttaaaaaatagtataacataagctaagatgcttatttttctcacgggaaaagtaattttataccctggaatatgagttgcattacgtttgcttcatgcaatcgtctgacgtcactagtggagaaatcgtttttaggcccggttcataacccctctataatcccggtttgaaaaccgggactacgaatctgggactaaagatcctatctttagtcttggttcaaatacccgggactaaagatcgatctttagtcccggttggtggactaaagatgggagtgggcaatagttttttttcattaacttactatttaatctctaatttattttctcccaaattaggtgggatgcgtaccatcccaaatacacaaatcaatcatatacactacagattatacatcccaaatcaaataaacatcccaaatatacaaattatacacaaatcatgtacatctcagatccatacaataagattccaaaaaaaattatacatctcaatctatacaatgaaccacagattcttcatatcattctacacatggatcacaaattctttgaaaaaaaaagaaaaaaaaacgaagcaaagccgccggtcggctgagccggctgccgcctcccctcctccccggccgccgcgcggccctccgcgccgccaccgccgccactgcgacgccgctgcgccggccgccgccacgcggccctccgccggcctggccgcccaccccctcctgctgcgcacactggatcgagttgggaagggataagaagaaaaggagataaggaggaagggaagagataagactagagatggagggagagaggagtgggtgtggatgagaaaagagtggacgagaaaagatgataagtaatagagataatatactgcgttttgatctttaatcccggttcgtaacaccaaccgcgactaaagatcctggaggggcctgacaacacctgacagcatgtgaaccgggactaaagatgacaccaaccgggactaaagatcacgtagtcccgttctacttataaaccgggactaaaaaccatctttagtcccagtttttactgcatccgagactattgtggtttttggtcgaccgggcaaagatggtttttcactagtgctttttaagaagaactacgctctaggtgtcaaagcttactagtacagttatattccttgtccaattgtatcaatcccaatgtttcttttggtcaaccgacattggaaggttgtgttctttcccccccctcctttcccaacttatcttccatatttttcacgcgcacacttcacaaaccactgaacggtgtattttttgcaaaaaaaaaagtaggaaagttgctttaaaaatcatattaattcaattttcaatttttaactaatatttaattaatcatacataaataaaccatcccctttttcgtgcttcttccttccaaaatgcatctgaagaattgcacccgctgcaccgaggagggttcacaaaaccgatggaatttcgcgaaaatcgaacggatttcatgaaactactaggtctcggtttatgaaaactggtcggtattagccagtttctgtacggcattgatcaaaagtcattggtttttactagtttttgggtcggatttcggtaaatcgatgaggtgcggtttttacttcgaaatcgaaaagttaaaccctgtcaaggatactaaggccctgtttctttcagcttgggattattataatctagattattgagtcaaattactataagctagattgttataatctatagtagaataagcggttagttgtttctttcctagattattagagcctagattattgggtttgcaagtctaaagagggagtagggtggcatggtgggtaatttttcacccaataatctggaaaaagctcacctaaatgagattatcatattataataagccgggctccaaattataataagctacttcaataagttgtctgtttctttcagcttactcccaataatctggattataataatcccaagctgaaagaaacatggcctaataaacacagaagaccaacactctcatctttagcataacacatactccctccgtctaaaaaaaccaaatcctggctatgtatctggacatgtgttatgtccaaattcatagtaatgagttttttttttccatagaaggagtaagtcataacagcatcagatcagaggggttgaaggaccaagcggaaattatccacaactacaagggggcgaatggaaagacgctggccagccagcgtgcgatccggggacggaaggaactgaacaaacggaaaggaaagcgacaggcggcgaattcacggcgcggtgacggcgccgtcggacccgagcccgcgtgttcggtgcgatgcgatgcggcccccgctaaaaccagcagttaccgttgcgggtccgagcacgaggctttggtggttccagtttgaccgtttgaacccctcgcccgggttgcatggaccgtccgatccttccgtgggccgctcggcgccgttcgatgatcgctgccgcgtgcggtcgcgggcggtgggcctcgcgatcgttcatggacaacgtctacgtgtggcgtgacgcgcgtcgttgactcgataggaaaagaagagatgcatggtgacatactgacatactccctccgaaaaaaaaaaaaaaagaaagaaagagataaatcctgatttccatgcccaacgattaaccgtccgtcttatttaaaaaaaatatgaaaaaaattaaaaagacaagtcacgtataaaatattaatcatgttttatcatctaacaacaatgaaaatacgaattataaaaaaatttcatataagacggatagttaaagttgaacacggaaaaccagactttatcttttttttacggagggagtatataggtcattaatgtattttgtttttgtttgttaggggcactgacgtcatcgatcccttccagaagctttgtgaaattgctaaaacgcaattggcgtagatttatctctattatttacatggtgttgactgagttaagctattcaacgggaaacagtgttgacgccgtcacaatttgtcctccaaggatctgtcagtcccatcggatggcctaataagccaaagaaaaagctaaattttaaattttcaagcttaattttaatattgattttgacatattttcaacgtagtttcttttttaacattggcttttaagtcacaaagaacacatttataaaagttttacccataaattcatttttatttcctaataagccgttttggcttattagtaaataagccaaacgatggggacctgtatttttcaggttgttcgaggaagtcaggagcatatgtttccaaaattaaattccaaattttaaattttggttgtagagggatcatattttaatttgctgaaaataaaagattaagtccgagcaggagtaacccattaatacataattaattcaaacttgaaaaaaagatgtgttttatgttttaaagtaaattatacatgaaaagttttcatacgaaacgtgctaataaaaatcaaggtaaaatatgtatctcaaacacgacacatgtactcttgaatctgtgagccggctataaacagaattgaattgtctctcagactacatcaaacacgatatatgtactcttgaatctgtgagcctaagcagaattgaattgtctctcgaactacataaagtcaaaatcaattggcattgaaaagctcacaagtggctagatggttaactagaacatagttgtttctccggtgtacggaattacgatcactgatcagaacaacatttgatcactgttgcatgctggctgcagaatctctcacaaaccgcaaatctcgttttctggtggggctgcaaaaatagcaaaagcccttggcgcgctgaaactgctgatctcctgggccgtatgggcccacataagctgggccaaacctctcggcccgagaaggacgcgcccataccgccctacgtgcgccgccggctgccgccgtgccacggcggcgccacggcaccggcgacggcgatgtgcatgtgcccgtgtggcacggcgagcgcgccgccggtctccccgtgcagccggccgctcacctggcgcccgccgtgtccgaggcgccgcgtggcgtcgggtggcctggccgtgtccgcggtgacatggtcaccaggcgaccactggagcgcgtcgtggccgccatttctcctcttttgcgcccgtggctcggctcggctcggctcggcgccccgtcggcctcctcggtttaacttagctcggtggcaataaatggcggcgccaccgcttgattcacgcagggcggcgtgtcagacggccatggcggcgtcaaggtgagatcactcctctcgttggaaccgggcttcgttttatgctgcagcccatgtgttcgactgaattcccctgagaggtctcgagctctgttgctccgtttgatctgcagattggaggtttgcatacttacacctgcaccttacacgtctagatctagtatttgacagttgataattatcatctcttgcttgtttttggctgatctcgttcgtgtacgtgggttgacttctgcctgcttgctttccatcgttaatttctgcaagtgcaatttgcaattccatatgtttgatgtgctagttgtgcatacggcatactgatagtctttttcatcggcccgaacgatttctataccagttctgggcaacgatttttgtgtccatatttttagtggaattctgctccaaaatggcatccagtaggttggacgcttgtagggttgggtttgtccctaaatgctaacatggggcagcttgtcccccctgaattcagccaaataacatgcttttgtatagaaagagacagctcttaaccttctaacccaaaattagttttatttttcacttggttgcttctgcaagcaatctcagcaggtgtccgttgtgtttttctgattttccttaggaaaggttgagaattgaaagttgaaatgcggctgcacaaataataagcatggagagcctcatgtgaaacatgtaacatggttatccatcaatggcttgaaattttggagagaatttatctttctagaaatggaccatcttgttgtttttattcttctatagcttcctaagagaatataatcagtactagatttgtgttgagtgtgactttcctcttgcacttcatttttgctttagtcgtatacttgtatgcagttacataatgtgtttaatcagatgctttcaaatatcataaaatcttctacctattcagagtgttctgtttcatttcgcagttctagcacacattttgttcacacgggacagaattggtggttttaaagtttgttttccatctaaaatttccgtactccagtattggtttcctccccttttatgctgcatctccccagggagcttacatgatttctataatcttgaatccttagcttttgtcggtcttaattctgacagttttcttccattatatagacttggtagctctgattgtgacgtcctctatggtacccactgttgatctgagcatagttgttggcctttcaaatcatgatctttcaggtatattgatgtcactaagctacacagaactgaggattgatatagactatggcatctttatgttgcaaatggctgttgcactggaaaaatcactttctacctgtacattttagctgtacttagcttaatatgaaccaccagatggtagttaggtcgccttgctttagcacttcagtgtgatccaaacctacagagagaaaaaaaaaaggtagcttccaaagcaaatgagcttcaagttggaattagcaataagtactaaatatgggaaatgaatggtcataagctctgcaccgaaatgacgaaaactacatgctaatccactgatgaaaaggagtcttaatatatattaagaacagtcctgaatacataccaaaaaaaaaaggtttgatatatttgggcttccagtacaatatcgagtttcagtgagctgtagttgtgccaagctagctattagttgttgtgctgtcgatgttgtaatacttcttcaatgaattctcctctaagcatgccatacctttaacttcgaagtgtaggaaggggcatctgcggccgacagctctttgtttgtcaagatcctcacttgatcagtctccgacaggtcacaggcctggcttcaggggattcactttcatagctgctgtgactttgcaacgcaaacgaagcttcaaggtaacggctcacctgatctgattaagattgctgctgctgctgcttcacaaaggggaatcgcaagaccttgctgtttcctctcaggatcagctgctaacaggtatgttcataactctgttttgcgtagctctcgtttctattcctctcactatctgccagccatggatcaaccttcttcttccttcctacttttcggtttctccaagaaattagtccacttaggaaagtagcacactaaagagctgaattagattcagattcagaaatgcgcactaccaaacaggactgcaaaccactactagtatttcagtgttctttcgctgagcctatctataatcatgtgccaccttttaagcgggcacaaggaagcatcatcttagctgggctgctgggtgtagtgcaggctgcacgaaaaaggaacaagaaaactacacgcaaggaccaaagtaggcgcgcatgcgtgcgtccgtgtacacagttataaacaaaacacacacacagacgtaattggtcctagtttttataggacactgccaacagttgcctccgcgttgtctgatcaatccaacagattacataaatgctaaagctaagctaacctcttccttaatgcccaagtgccccttcactctgagtgactgcatctttggtggtgtccatgtatggtcgtaccagcagcaacactgaaacagcaagctcagcgaggagaagaggtgaggaggtggtggtggtggtggtggggctcgtcattacagagtgcagacttttccctggggcgccgcacagcaccgctcaactcagtagcttcactccagcagcagcggcagcagaagcagaaagcgggtagccatggcagaggagaggaagaaggagaaggagaagaagaagaagcacaaggagaaggagaaggagaaggcgggcacccacggtggggaggcgcacttcaagccgagcggggaggtgaagggggtgcgggtcggcggccagttcatcgtgaagtcgttcacggtgcggcgggcgtcgccgctggagctgctccggctgctggacatcccgccggcgtacctgagcgagtgccagagcctgccgttcccgtccaccacggcgtacatgcccaccagcttcaccatcctggcgcaccaggcgtggcacacgctcacgctggggctgggcaccaagaagtccaaggtggtgctcttcgtgttcgagtccgagggcatgaaggccgccgtcgaccagctctggccgtccatgatcccgctcggcgacgtcaacaagaagctcatccgggggctcaccggcagcgagatggcccggttcaagttcaggaagggctgcctcaccatctacgtctacgccgtccgccgcctcggcgccgccggcttcatgtgcgccgacgacctcaggaggatactcgagtccgtggtggagctcaaggatttcttggatcacaccgccatgctcgccatgcccagccagaagagcatcaccttgcagtcccgggtcgcagtggctcactgatccaactctcccaagtgctcttgatcgtttcatcggtgcaggtactcctcctggcttgcaatctgcagaggagtctaattctttttttgcggttcaattggtttattccagtgtcgatgttccacttcctctgctggaagggagttgtatagatctactgagcaaaatctttcgaagatgataggttttttgtttcaaaggcatttcttccccaaggatcatacaccttggtatactgtttatccatgaaacaaaataatccatcaatgagaaccatctgtaccatgacattcttgtcgcattgtacagaagccccaacttgttaccagtactctttattattggtattgtacaggtttcccgttctctcatcatccttagttcttactccatgaatactcattacttgacacaatcacagaaaaacctctgaattgtccttgtgtagttgtgttccttgaatactcattgcttgatacaatcacaagaaaaacctctgaatcgcaaactgcctctggtgtttctttctgagatgctgtcattagagatgggagctatccagagaggaaagtgaacagcaaagttcagaatctgagagaaagtgggtgctaatctctgtttatgtgggacgtagccatcatggagttcatagaaaagaaggacaaatgctcttcttttacctgtctggctctgcctggtccgttattcttatatatggagatgccaatggcccaatgcaaggataaatttgaccaggagttcatgctccatattgtgcattttcaccagggaaataacagcaaagccaaacccaaaaggacagatgggtgttggtcatgatcattgagcgagttaaaaaagtttgttgggcagggacactcgattcagtgtcatgatacaagtggttgagcaagcatgggccaccacccactatggcctgaatcattaacaacaaaagccatctcatctctcatcttctcccacacaacagtgccacagagggacagtgcaccccttgctgtgacctgcattcgttgtataagatctgtactccagttctgtaccccaaaagaactcaggatatctctttcagtagtttagtgccgctgttactggttgctgaatttatttgcaatgcatgtactgttatctatctctcattctcttaccgttctgtctgtaagcttcaaagcttgtattactgcatgggccaatttggtcgaaccaatcacccatcaaggctgtgtttagttcacactaaaattaaaagtttgattgaaattgtaacgatataatagaaaagttgaaaggttgtgtttagaaaagttttggtgtgatggaaaagttaaaagtttaaagaataactttggaactaaacacggcgcaggatcgtcggtatggtggcactgccatgaatcggcatgtccagctaaaagagctttattttttgcctgagctatgcccaaaaaaataaggggacacctgcattgctgcctgcctgccagcgagccaccgcctctgaatcgtgccgccgctggatggctccgccaattatgccgccggggcccaagccgacggaggagaggagaacggatggagacgtatttatgcgccctcaacctcaagtgggtggcggtgcatggtatggtggtatacaatacaacgtttcctgggctactgcctctcggtgtctcccttggatgcaaattgcaggagacctttctcgcccaatactccctccgttcacaagaccgttcacagaagttaagtatatttaacatttgagttttttcaaataagttattcctatttgtaatatttatacatttaacacttaaatgaaaagataaattaaatgtttgattagaattcaaggagtcatctaaatactcattggatacatacttgcattcactccctgattctataatattcaacaacatgatttaatttctctctagtcttgatgacaaaagtaataggtgtaacttttatagatggtgggagtacaatacaacgcgtcctgggctcctgcctcttgggcagtgtttggcaaatgtgttagagaaatgatttcccacccatctttaaatcctaaccattcattatccctcatccgtttaatcctaaccctttattcatttctcaatcccaatcccactcctcatttcccattatccaaacacaccctccatgtctcccttggatgcaaattgcaggagacctttcttgcccaaagtttcaccctgatgatttgctgttcttggtcaagcaacgagctagccaacgagctcgtggttagctttgatgcgtttgagaagtttaaaattcttaagagtaattggttgatagcccgatttctgataaccttattattttttatttctagtttattttttatgaactttatagttacagattctcgtaatctaaaaactatttaggaaactaaagattatagaagaagttactacggctaaaagccctctacatatgacctaagtaatattatctacgctgttgagggtgtatgtttgcatcgcagagagagcttacggctatacgagcctttctatcaagggaggatctatgattgagagggattagagtggatgggtacgggcattagtacatggctctattattgctcttgtcccaggctttatggatagctttttgactcgagcctttgctttcacttttcgttttaaaagattttagttggattttcaggagactcaccaacctactgatgacagatacttcacctcatgacctcaagtcctcaacccagcagcagcaggatgaaaattttcttttattttttcttaaagtaaaatatagaaatccacgtacacttacgatcaaatttatagctaattattctttcaatgttaggtgatgtatccgtcgataacgatgcgcctatgatgacttcataaatctcagcatgtcccgatccagccttttgaagatgccgatacagtgatgggtcatttaactataaaattaaattcacttaccgtctattaactttacgtcaagcctgtatgacattcctaatccgccgacgagagatggaagatagaagagacggccggcgagcctgggagaggcggcggcggcgggcttacgagagacggaggaggaggcagccttgggcatgagttggttgcatgagctcgctagtagagagaggagaggggaagaaagagagaaagagatagaggagatgaggggaagagccgcgccggcgaccgcatccccttcacacaacggcgacgaagcagaggagatagaaacgggggagcttgaccacagcgtaggcaaaggagcagaggggatggagacgagcggtggtgacggagcgaaggggatgtaaacggggagctcgaccgcgtcagagatggcaaagcggaggggattggatggacaacgacgagtctcctaggcttcgtgcaagggtgacgactgcatcccctccacacgacagcgacggagcgaaggggatgaaaacgggggagctcgaccaaggtaagggtggtggcaggcctgcaatgcgaagaagtcacggcgacgtcaagccgtcgaaggatagccgcatctagctatcacacacgccctgcgccgtccggatcttgttgtgcaggtctgtcttgaacggacgcgacgggcgcttccgcgccctgccaccatcgtcgtttcttggcgcaggtgatcgagcacgtgaaggagctaaagtgccaaacgacggcgattgctgcggtggcgacggcaaagaaaggtgcccgtgtcgccaccgtgcgtttgggggggggggagtggaaagagaagtttatgtaatatatttttcgtgtgacttatgtgtggatcccacattatttttattatctccttgctgactaggatgccacgtcaataaaaccactcatgtatattgttatgggacctattttacacggttttgaacacttgggataaagattttcggtattggggattagggatgtcacacagacttgacgtaaagtttgagggatggccaagtcaacttagacgggctgagccgatggtgatgacggcccagctaatccgaattccttcctggcccggtcatcagtaggacaggccagaaaactatccaatccagcccagatcacgcggcagcggcagcagcagcgtaccccacctccaccgggctccacgtcggccaccgcacccaccgcctcccgtgttcaaaattcgaaccgcctagccgcctccttccttaacggtcgccgtcctcctcctcctccacctccacctctacccccgccgcctcgtctcaccctctctcgctcccagtctccctcgtcgtctcctcctcctcctcctccatccgccgccgccaccggcctcgtcctctctccttcgatggcgaccgccgccgccacgcagtcgcagccggtgcgcgtcgtgctgcgggtgcgcccgcacctcccgtccgaggcgaactccgcggaggcgccgtgcgtcgggcttctcgggagccaccccggcggcgaggtcaccgtccagctcaaggaccagtacaccaggttcgcctcaccccctctcttctctgtacgacggatcacgttgaattccccccaatttcgcagctcccttgttgagcgctttcataagatttgttgcatccttagttgaggaagatcgctactactactgttctgttcgcctggaaatttggttgcgaattgattccgtcgacctagtacatgttcnnggatagatcatgcgagcggcgtcgtcttagcttttttctcatgattatattcatttggtaacaccacttccgcagccggaacgagtgctataagctggacgctttcttcggccaagagagcagtgtctgcgagatattcgatcaggaggtcagcgccgtgatcccgggaatcttcgaggggaccaacgcgacggtcttcgcctatggcgctaccggcagcggcaagacctacacgatgcaggtgcccattattttttttttcacgacggcaatgtgtttgatgaaatgccgctgcaggggagttgaacctattgctgatattgggggatccttgttgctgtgcagggcactgaggatttgccggggctcatccccttggcggtttcgaccgtgttggcgctatgtactggcacatggtgctctgttgagatctcatactatgaggtatacatggagcggtgctatgacttgctagagcccaaggcaagagagatcatggtgctggatgacaaagatggcaacttacagctaaagggcttggcctgggtaatgcgctggggcttgattattcttacttgtgtttgctgcaatgcattaggcatcatcgattgtgcactgtgcttactttcgtattttcatggttgaaggtgcctgtgcgatctctggaggaattccacgagatatactctataggagtgcagaggagaaaagttgcccacacaggcctgaacgatgtttcaagtaggagccatgctgtgctatcgatcaggattactactgatgttgttaaagggaagcttaacctcatcgacttggctggtaggactcttggaaagctggagcaggttgcatatatttaagattcacccttcctgtttaaaaccatgttgtgttggttttacattgccaggtaatgaggacaaccggagaacttgcaatgaggggatccggctacaagagagcgccaagatcaaccagtcgctgtttgcgttgtctaatgtcatatcggctctcaacaagaaagagccacggata

SEQ ID NO: 59164 - DNA, 3018 bp, Oryza sativa
  unsure (1)..(3018): unsure at all n locations
aggaatctcttattcagcaataccttgatttcttaaatgttgcaaacaagtatgtgctacatgttctctatttcactttctttacatagatgagttatatctcatatttgatatgttccacccttttctgattattcattctgtttatttgtggatgcagggaagaactacagaagttgaaagtatgttccttgcttctcatcataatctggaggctattatagcagcctgctctttctgactaatttttcctttgttagggcattggtgaaaggagggcagagtacattcttgagcttcgagaagattcgcccagaccatttaaatctgtaagacttctagactactaacagacaatcctgatagtgagatcattggtcatcttctaacccaaattgatttgacagctttcagatttgggaaatattggtctatcatcaaaacaggtaacattttgctcttgttttctgtaggcacattatcatatcgacacgtcccttcttttatgtactaacataaaactcctaactaattcatttatgtcgcgcatcgaatagatacaagatattttgtgcaagacagcgactggaatcttcaaatgatcaccggaatggaaatgccaccgaactctaccactttgaagatgctggctcatattaacggtcagattgttgtgggctattgacttgtgattatcagccaggtctgccgctgaatcaagttagctccctcctgtattgccgaatttaagcaatctgtagtttgtgtaccatccatgattccttgggtgtaattgtagctgtagtcatctgatgtactactagagtatggagcaatggttgctcctctctgttgtagattttctccgagaaaccgccgtttaatttgagctgacttgcacgagcagcaggaaatgaaatttgtggaatatttcttggtaccttgagcattgaatccgtgaatttctttcatgttttggtgaattcgagcaccagtcttgctctttgttgcagattttctccgagaatccgcattttttactttgattagttcattctgctgaactgaaatctgtgaaacgtttttacattccttgaatttgggcaccgatgctgcgtgttgtgtatttactcacagtgcaacctttccaaattttctatagtttctgaacataacacacaataagaaaaaccgtattgtagtgtatttactgacagtgcaaccattgccaaattttctgtagttctgatttctgaacataaaacacaaggcgtagttctgaaaataaaaaatcgagagagaaaataacatgttctgatatctgatttctggtcatagaacataatgagtcgagaaaaacaaaagaatcgcccaccgtggggctcgaacccacgaccacaaggttaaaagccttgcgtnnnnnnnnnnnnnnnnnnnnnnnnnnctggcattttacaaatataaatactctagtagtaatttacatctgaaatgtggctcaagttttcttcaggttccagaccacagaagcacacaggttatgcctttgatagatttttgtccttgctgtgattaaatccattggaagcacccacaatcctgattgaaccatcccaaaagatatgcatagtacagtaggagttaaggagtatatgatatgatatatcacctaaagctttaacatcatttatatgcaaccagttcttacggtgattgcacggatacagctttgaggcatgaaaaagacacccgtccttctcttcagctatttgctaccgtcctggacagggcgccacttattcgttagcagatcattcacaagaccagactcgagaactcctaaaacagctactgccaaatgactgaattggacaagatgaaaacatcttcgatttgcatatagctgttggcctctcgttgcataaccaattgatgcagatgaatccagcagacattttaagattgaatacatatatatgcttcatcctttgtaaaatataacaatcttataacaaattagacataaaaatccgatccggacagagggatcatatcattttttttcccagtatgcctgccagcattgccagcaagggcaacacatagaccagcatttatcacaagaaaataaaatgcactagtagtagttgtgtccattgccatggatccaacaccaaatccttgagcggtagggcacacagttccctttcatggctaccttcattgctgacagtgtcgcgatcaggcggtcgctatccccaatctgttgacgcgaacaaataatgccacggcttctccggctaaagtcgcatgaaccccacactgtacttggctcgtgatgtgtttttttccttccatttccatcgtgtcacctgatcgctctcgaggctttcgtgtgtctggtgagctttggcacaacacgccaggccattcctcgccgttgaaacgttgaatacgccattttttttggttgaaactacggacatctagctgtcgacagtcgacagtttttgaggctgaaaactttcgattttttgaccgtgcgatctgcgccgtgattcctgtacatgtgcgcttgcaggggctggctcgaacccaggacctccatcctggaaggcatgcatgcgcatgtttttgagaagttagatgagttatattctagttatactccagttacaccctagatataatgtaactacagtgtaactgcattgtaactacattgtaactactatgtaactaaaatataacaacattatcatctctatataatttagatatattgttacatatattattttaatatttatatatgagttacattatacttatatacgaaattatattgtaattatactatagttagatttgaaagttttcttcttaaaaaactttcgacagttctctagatagtcccatgctgtaattgaaaagtacacttaaaataattttaaatttcaaactctttttcagttttgcctatctttttaaacttcaaactcttttcagggctgcagg

SEQ ID NO: 59165 - DNA, 1317 bp, Oryza sativa
ttgcctctcctttcgaataacctcatgtctacacatagtaagcctttagctagctagactttagctactattagcatcttttgtggcttgttagcggctaatatgttcagatgactatatacatctttcgatatagctagagggcaaaaatattgcatctattacttaggaacaattacaaaaataacatatatggcttttcagacacatatgcatgatcagtggcggagccactacttgacaggtcgagcggccaccgggtagagatgttcgatcttcatcgatcaaaccagactcaacggcgtacgtcgctggctccgccacagcatgattatgactgaggttaattaaataaaagagaagcaagtagcaatgagactaccactcacgaacgtccaacaagtagcaacgactactcatcaacgtctccaagtagctagggacgatcgagtagcaacgatacgccaaaatggcccaaagctagctagcaaagccgcccaagctaaagctagtgcacgctccagccacagaaaaagcaaggccgctgctgctgagactgagagcgaggcgcgggcccggaaaaatctccgcggccacctctccgccaatggggcggcggcgcccacgtgacatgcctccacgtccccctcctcccccaccacctcccctatttctatctcctctcttcttcttcttcttcttcccccatagtttagatagataagtaagcagtgagctacctagctagctagctaacagtgagctgaatcagcagcggctcctgtctcctggagcttgctgatccagtagtccagtactactctgccattagctaagctagctggagcttaattagtggtgatctctgtctctctcaagctaggcgccatgggagactcatcatcctcagcttcgtacatcagaatggtatatatacttatatgctagtatgagtttcttctgggttgtgtgtgttagctgggtgtgcatcaaatgagaggtgtttacaattaagctgccattgttaattaattactgcaggttcaccacctgatagagaagtgcatttgcttcaacctgaacaaggaggagtgcatggaggccctggagaagcatgccaacatcaaccctgtcgtcacttccacaggtatacttaattacttacccacttctcttcaagaacatatatatatctccatgtgcagtgctacctatagactctagctagtttctctcccaaattatatatatacacacgtatgcgcattctcttcgcaagctagtggttgcaccttattatatatgcatatatatcat

SEQ ID NO: 59166 - DNA, 785 bp, Oryza sativa
ataaatgtgccgtaagcatgcatcatatatagattagctagccagctagctgccacaaaattaaatcatgaacatgtagttgtgtgtagtatgttattagcacaagaaatcatgtactaggtgtcatgtactgtttagtatatatgtgcatcttatgtatgcaaacatgaatgcatgcgtggaatattcaggatatggaagattgtcttcatgcaccttgcgatctacaggtgcagctgatgcactgtcgttgctaatccctttgtgacacgtggcatggtgacgtgtacctaaccgatcagacagacactcaggaccccatggctcgctagctagttgccactctacctcttacactgtactctgtcgtcatgattgtggacaaatgggacgataattctctccaaaaaaatagaaaaacatatatagggaaacaaatacttcctccgtcccaaaaaaaaaagacaaacactggtttctgtgcccaacgtttgaccgtccgtcttatttaaaaaaattatgaaaaaaaattaaaaagacaagtcacgtataaaatattaatcatgttttatcatccaacaacaataaaaatacgaattatgaaaaaatttcatataagacggacagtcaaagttggacaaaaaacccagggtttacttttttttgacagagggagtaggtagcaaaatgtttaaattaattacgatatacgcagttataaatgcaggagagtcttttaaccctccatgccgatgtcccctcatttctccacggcattaaaataa

SEQ ID NO: 59167 - DNA, 3200 bp, Oryza sativa
tgtgccgcgcggcggcgcccatgtgcctcaacgtgggtcggttcccccctgcagtctgctcctcgatccctttctcctcgatcgatcgctcgtcggttattatccatcgagctttcggtggaagcgtgcgcgcgtccagcgcgatccggacacgcacgcacaatgctgtgctgcagcgcatgcaattgcaagtacatgtgcgcgcgcgtccgcgaccgcgagcgccgtcgtgcgtgcgtgttcccggcaagattcttccggaacatgctaaattattgacgctaccaacggcccgaaaagcaagttcatgttgttgtctaccgaaatcatcaatctaaaagccctctccaggctcacaactccagaggttcagatcgacatactgctgcaacgttgcatggttggttattagaaattgaaatcgacagaacagaagagtcgtagcagcaacagcagcagcagtccacgccaaaattttgttcgatcggttcgcgacgaacgagcaatcagacggcatttgagacttgagagggataaggatggacctcgcattatcagctgcatgcaatgcacggcgacggggtcctcttattaaatgttgtggcagggtgacatgcatcgtctccactctacagtgctgtcagtgcgtgcatgcatgcactggtggtggaccggtgcaccggccatgatctcttatccacaaaactgaaagtagcagcggtacagctcactagatatcccccccccccctaattttgacagttctccgtaataatttttgggactacctatacatttgtcgataaattttctcttaaaaatttatcaaatgtaaatacaatataattatactataattactctataactacaaaataattacactataacttacatgtaactacactgtaactatagtataattatattgtaactatagtatgactacactataattataataattacactgtaacttacatgtaattaaactgtaactataatataacttacatgtaagtgagattctacctttagaaaacttatgtttggcactgctcacgtgaaagagggattatgaactcgcaatgtatgtttgtacgatgcgtgcggaggccatcattcatgcatacatgttcggatatgccctgccgctttatctctgcccttcatctgtcatctacgagtgcatgagccgcgcctgtggccggcggccggcggccgtcacaagaaacaaatcaaagcgtcgacgcaaaagcacgaatcccgagattcatcaagcagttcaaaaatcgataaattctgaggaaggaatttgtcaacagatttatagcaaaatcgcaattttttcttgttagagtagtatactcagtctttttctttaaaggatatactcagtagtatttctaatgtacattcgtgctttgcgacgaaccaagctcatatgtaatcaaaatttgggtggaaagttatgctttttcgatagatcagaccaattagagattgattgggggatgaataattaaggataaatcagaatggttatgtacgtatacatgagaagaagcgaacattatggcggggaacggaaggagaacgaaggtagcaatagataacattgttaagtttcgaacatgcatttaattgcttcttataaaaaaatatactaatcattatttcttttattgcgatatattttatcactaaaagtaatgtatgttatatttgtacaaaattttttaataagaaggtggaaaacatgttaataatcacaacgctataactttaaaagcataagcacttcattcttccatagggacgactatgtttttcaattctactagttaattaggattcacgctattttttttcattttaacaaaccacaattaattatttcttttttattcaaaacaaagtacaatgtagacacttataaatcacatgtacacttatccttataaaacgagcacatgagcacatgtacaccctattctaagagcaactccgagcgtctgattaacatattttgatgctgaagtcatcataattagctcgttcgttgtcgacataactatatcgcttaccattaaaagtataattaatcgtaaatacgagtacacatgccaagtttttaacttaatttggtgaacggattccaccgtgaataacctaaccagctaaacttatgctcaatttgtcataataactactccctccgttttaaaatgtttgacaacattgactttttagtacgtgtttgaccattcgtcttattcaaaaaatttaaataattatttattcttttcatgtcatttgattcattgttaaatatactttcatgtatacatatatttttatatatttcacaatcttttttaataagacgaacggtcaaacatgtgctaaaagtcaagggtgtcaaatattttgaaacggagggagtaattattttcgtaataagtttttactagagttcgattaatatatccaactccaaaagtcgttgaattcacccacacctgcaaggctacaactgagatgcgcaagtgtatgaccacaaggtgagaaatacataagcacttttaacctgcggtccctccaacccaagatgtcgctgggcagccggtctcgtctttatatataccaccactcgcttcccttctctcctcacattacccccggccgcaccacccccttcttctccaactcttgcagctgcagacacaatcgttaaatcgcgatcaccgcagcaagccatgtcgtcgcagcggcccggccgtcaccagcggagggcgtcgcagagcgtgttcgtgctcccggataacttcgccgacctcgacgacgtgccggccggcgccggcggcgccggcgaggacggccggaagggcgccgccgcgacggcggacgcggccggcgggcagcagcaggctcgcccatcgccggcggcgcgccaccggagggcgatgtcggtggccgtggcgtcgtccagggagctggagatgatcaaggaggacatgggcagctacaagatcggcgcctgatgcagcatcgatcgcacacacaggggcgccgtgcttagtacttgcggctaaatcgtcatgtgtatggccgggtaattttcgtggttaagcgcggcacgcgtcgcgtcaaccgatgtctcgcttggtctctctcttcttcttcttcttcttcttctt

SEQ ID NO: 59168 - DNA, 4151 bp, Oryza sativa
ccaattaagatatgaagtagtagaatttatcttgactttcgttagtatacattttaattactaaatgatacatttcataccaattatgtagaagttatttaacatactagacacattcattttttttcaatttaaactgactaaaacttaattcatcatacactaacgactctcttattttacatgtccgtatctgatctttatatttagacggagccttagtcacttaatggcaataccgcaatagcgtacagaatctcatactctgcgcgtatgcgtagctggttgtcactattcgcaggcagcaaaacgcatctcaacttatcgctccagcgtgcgatgcgacgtgtcgacacggtgggcatcttctgggacgctgtaaaaaccaatagcaaaagcacacctagctttcgttttattcgacagaggcctcgtttagttcccaaaataaaaaattatcatatatcatattaaatgttcggacacatgtatgatatattaaatgtgaaaaaaactaattacataatttacgtttaaatatgcgagacgaatcttttaagtctaattgaaccatgatttgataatgtggtgctacagtaaatatttgctaataacgaattaattaggcttaataaattcgtctcgcagtttcctagcggaatctgtaatttgttttgttattagactacgtttaatactttaaatatgtgtccgaatattcgatgtgacaaccaaatctaaaagttttccctaactaagcaaggccagaatactcaagataaactcaggttacgatttttttcctaggaagtaattcaggattgtaaaaaatcaatcctaagaacatgttcatatgtgtacaggtttaagatttgatgttctatgacactccataaccagacagttatgcatgcatgtggccatgtcccagacgacaccgagctgagaaagcctgaaaccgaaatgacaaagatgccggttgctctgagattcgctcgcggaacacgagcatatgcatgccgatcatcttcgcgtcttcacccccgttttgtttctttccccgggccggaatattggccccgcccgcctgccaaccaatccaaccgagccacatgcgcaatcacgcaacacatgttctcaaattactacttcctctttttaagttgaacacggttattaaaaaatacgtagaattaaataggaatagattgtaattggttggaaaggaaaggtaagtcgaaaaaataaatggtgaatggttgtgattggttgaaaaatgaatgtttgtgaagaaattattatattttagaacaaatgttaagtggtaaaattattatattttggaacagagcgtaccagatttacaatcatcaacgcgagagatccgattgtacgtacacaagcacgtacgtacaaccggtacttgcatcattgcatgataccacctgtgttattgcgtttatttttccatgtcgttttcagggttttgattagcaatctgttgtacacttgtgtactgtatttgtaatgcgggtgtgtgtatgattggtgtttgctactagtgtgcgcccccagatctcgatctggaacatgcacacatgatggatcatggatggatggatggaccagggcaccaaaggctcaatcatcttgatttgataggccgttttttgggtcgatgtacgtgtcgatggacatctgtacacttgcaaatccgtagcgaatcgattgatggatctgttatggattgatgatatattacaccgacatgacttgtgtgtagttttctctttttttctaaaaaaaaatcatcggtgtgttaatgtgtttcgtggtggattatttgattcgccagatttgacgaaagttaaatttggactcttcgtggactcgagttgggtctacatttgtctgggcttgatttgttcaagagccccatggcccattcaccaaagcagtttgtttgtggaataagtccagtttgactcccttagttagtggctgattcgtaccccagaaccacgatacggatatctcgatcccccattcccccaactattcaaactggtacaatttgacttcctcgacggttttggaggacggtttcgctaatgtgacccctttgtagcagtgttgacttggtcttcgtccaacgtggcgttgacatagcgcttacgtgacattagatttttttaaaaaaaatatgtggggtcccattttgtctcacaaaaaattacgggacccactaacacgtggggcttaaatgtcatcctcttaccggtgcacgcacgagctcggcggcaccgcctctcccctttcccttctcaaccccctccccccgctctatagcatcggatggcgagattcgaggtggtgctagcgcaggtagagacggaggagtcggcggcggcagaggagaaggccgcgtgccccgaacatgattccggcgctgcggcggaagagggagatgatggcacacctcgtcccctccctgaccacatcttgtggcatgcagggaggctgatgcaaacgacccctccccgaccacttccgcagcgagatcctggagacacaataggcgagatgcagtcgctctctctcgtcctccactcttgctctcaacgacgtaacaaaagaagtagacatgggcattgtggtcagaacacatgccaaacaatagtttggcatcggttgggagtgactttaacaatccgcggagtggcatttgagtaaaactctcttttagcagtgggagaatgtcctatttccttgttattttctcatgcggattaagattttatctcggtttccgttagcacgcttttcaagctattaaacgacatgtttcgtgaaaaaaaaattcttgatgaaagttgctttaaaatatcaaatatatcatctttcatgtttgtagtaattaaaactcaatttatcacacgttaatagctttctcgttttacatgcccgctttaaatcttaatttaaagtagaaacgaacggaccgacgtctaggactacatctgggttttctcggttattttcgttaaacggcacacactccctctataaaaaaacaaacttcgaagtctttgatctttggacatacagattcatttccagaagttttttttattgagaccaagagtgtatggttgaatttactgtaataaatttggtcaattccttaatacgtaacgtaacatgaccaataaactattttagtagctgtagcactggttaattttttctccatccaacatgtgacatttcgatggcttcgccagccatgcatatttcgaataccctcaatttatcataatcgcctatccacaacataaatagtaatcatgcttcaattatatcttcgttataaaatacagctctctgtcttatctcataaaaatacttcaaacgtgctgatattttatagtgacggagagagtaccaatttgtcaatgacagatatagtacgatgaaagctatcggatcggtgataattgtgcaaacatctcgcgagagctatcagctactacgtactatgcattatttcagttgatgtgcactttttctgaccaaaatgcatatacactgaaagaatttctctctcgtcctaccgaaaatagagtactactgcactacattcagattcgcaaaatcgcaactcgaccgttcaaatcaaaatcctaaaaatttctacgggacggaacacgccaacctgacttttgttcgtgtttgggggcgcttttccacagtataaaatcacagatacccttttgattttgataaaatcccctatgtacctatgaacagagttcacccttccccgcaaaaaaaaaaaaacataattcacctaatcctttctatactcttgaattttgctcaatcccttacatacccctgaattttagtttggatcccttccatgcccttttcgctagttgaccgttaaatttttttaaaaaagtccattttaccctttgctatgaagaaacataataaattaatgaagtatattgttggaatgtaaaaatttattggatgagactattatatttatgagtatgtaatgcaccatattatttgtgacaaatttacttttacatatgatataaaaagttaatacttatttattagttattaaaagtcctttt

SEQ ID NO: 59169 - DNA, 2955 bp, Oryza sativa
tgtttttgatctggacttgtgttttagctgttttagttagagaattcagatgtcagcgtcttatcctcttcagtgacggcgattgggtcaggtgatgtatagtgaacgtgtactggagaatggggagtggagaacttgcagcagcgatagttggtattactgatcagtgtgtttcatccactgatgtcccttttgtttagtagtagttgattggataccgtaatttgctgttactcaacagttttgtgccatgtctgttctgtaacgatggtgatcgatttataggtttcgttgtacgttcacattatatgataatttgtatttatgattgtattgtgttaataatatttgaaaccaatattatgtttgatagtggtgatagattttattactctgccatgagttactaattgaattatgatattaattattaagctgaagatattatattgaaaggcggaaagcgtacacatcctgagacctgttttcttaagaaattgttgtacccttttgatgctggtaaaatttactgaagggttgtttatggactgttgagttgactattttttacttcctgctttgatattttgtctttaagctgcatgtgtcaagcctttggtttctgttgtttgcaatttctaccttacagctatgtaacatggtaatttctagcaccaatttactgattctttcctctatatttcagtgctcaggaatctggatatttcaggtctgtatgttttatggaagaaaacactggttttcaaacagagatataagttttagctctaagtccaaagttctcattctgcagatgtagacaagaatgtttaatacagatggtggaagtcatttctttggtgtttgaaaattattatcaggataaaaaggtcatgtacaaaacaagtttaactaagttgactgttgagtctatttccaacttcgcactggtctcattgtgtggcattgcactcatcataatcagataacttagtattcttcttttgttatatacttctatttacagttcaaagccctggagatgatgttgcagaatattaccagcaacagtcggaattgttggaaggtttaatgaaatggatacactcacagatcgtggttttcttcctggaatgtccaaggtctacattcttgctctagtaaggccttgtttagttcgggaaaatttttgtgttgggttgtcacatcgaatatacggacatacatttgaagtattaaacatagtctaataacaaaacaaattacagattccgctaggaaactgcgagacgaatttattaagactaattaatccgtcattagcaaatgtttactgtagcaccatattgtcaaatcatggcacaattaggcttaaaagattcgtctctcaatttacacgccatctgtgtaattgtttttttttcctacatttaatactccatgcatgtgtccaaacattcgatgtgacagcgtgaacatttttgttttgggaactaaacagggcctaacattaaaagaaaaaaaacttcattttgcagataaaatgttgaaagatgcatctatactgttttctaccttaatttgatcctatctgtgcaggaagaatgtgaaaaagttgccagaagtgaggcattagccatccggttatctaatatagcaaacatggttctttttgctgcaaaagtttatgcctcaataaggagtggttctctagctataattgcctccactttggattctctacttgacttgttatcaggttttatcttgtggtttactgccttttcaaagaaaacatcaaatccatacaggtacccaattggtaaaagacgcatgcaacctttggtgagtttccacaccaataactgccaattaggcataatttgccctgcatgttctatgcttttatttcttgaatttttctattactagaataagtcaatcatttttgttgaactctgatttgctgtagtatccatttatacgttgtttaagagataagagagacataaactgtataaatcgttatgtttcttgatcagtattcctcttattaacgaactctgacacaatccgtttgccagggaatacttgtttttgcttctgttatggcaacgcttggccttcaaattatcctagaatctacacgctcattgttttatgatgtaagtcttttcttttctcttcttaccattctttgactgcttttttcaatacaattatttgattcatattgattagcgtagttggtttttcacttctctattcaatctaaaccttctagcagatattatcagaatgcctcatgttccatgtgcttttgaaaaaaagtcattttcacgtccctttaatgggggaagattttctaaaaaaaaggccaacttgtccgttttcaattttgtacatgcctgtttggtacacttatgatagttaatatgtgtgagtactccatttcgtatcgttgacaatcttgcacttaaacttaactaactgttaagcacaccgtaataaaaattaggacagtaacataatgatcagattaatcaggtagctattgattatcttgtgctccagggggatactttccgcttgacaaaagagcaggagaagtgggttgtggatatcatgctttctgttacatcggtgaagctcctactggttgtatattgccgttcattcaccaatgaaattgtaaaggcttatgcacatgatcactttttcgatgtcatcacctatgtcattgggcttgtggcagcacttctagctaattatgtttaaggctgtattgacccagttggggctattatagtaagtgtactaaagtagtaccttggctctgtataattccttgtttattagaatttcactgaaagaactatcatttcctagaattgtgagatacactatagaatttgagtatgtcacgaatttaatcgggtaagacaactattttgg

SEQ ID NO: 59170 - DNA, 1171 bp, Oryza sativa
tgatggtgcctgatcgaccgaaatcttcagtatatgtacaggccttgataacaagtgcaaagcaaatcatgctttgcagtttgcaccatatcccactttaattcctgaaaagcagtccagagactcacaccgttgacggaggcgttcgttttgttaatttcttgcactgtgctgtctgccaatctactcatcacagaaaaggtttgagcgctcctctcccagaaaagctcagtggtctcgccgtcaccagaccgagtgcgacacacgttgtgttggagaaagctagtctagaatccggggcccctctcccggagactacactgctagtgcccgctgccctccgtctattggtttcgcattctcactgtagctcgagcgagacggccgtcgtccggccccggcctacctctacctgcgacggacgcgtcaccttcatgggatcagcgctcgacgccggatcggctccccctcccctcccctcccctcccctcccctgccttacctccgcgtggtggcgcgcgcacgcgtcccgtacgtactcccgtgaaacggctacaggacaacgacgacgccagctcacgagaaacgagaaagggacatatgattaattaagtaggagtattaactagaagtattataaactttaaaataaatttatttgatttctaaaaataatctacatatttctttctaaaaaaacgtactccctccgttccaaaatataacaactttagccctcaagatttgtcccaaaatataacaacttcttccccaacattctcttcttaaccaatcacaaccctccaccatttactttttacacctacccccactactcatccaatcacaaccctccaccattcacttatacctactttcttaataactgtgtccaactctaaaactccttatattctgaaacggagagagtaccatttagcatacttacagaaaatgagagagtagccaaaatgaaaagtttattcaaactcagccttatataagagacaggtgtcagcgataaattaattgatgtttgatgacatctctaaggtcattcccaactcaataactaggatgttgtccataatactccctccatttacttttgatagttatatttcatcctgacacacagaccaatgataagtaattctacttatcatccatt

SEQ ID NO: 59171 - DNA, 1269 bp, Oryza sativa
aaaattgaattcagaatgcgccatggttgatgtcggtgcactacctgggcgccgatgccgtactcgcgggagtcgacggcgaggccgagctcgacgttggcctggacggtgtcgtggccgtcgtcctggaggttgtaggcgcggagcttctggccgaggccgatgccgcggcctcgtggccgcggaggtagacgaggacgccgcggccggccttgtcgatgagctgcatcgccaggtccagctggttgccgcagtcgcagcgggcggagccgaggatgtcgccggtcaggcactcggaatggaccctcaccaagacgtcctcgccgtcgccgatgtcgccctgcggatcagccacaaaatttttgcatttgctgaaatgagcgatgaactgatcgatcattctgctgcccaattgttatttctaacccattatctaacaaaaaaaattgttatttctaacacatcaaacaagaacagaacttgcagaaaatttgctgaaataaacgatgaaacgatggagtattctgccaatttgttatttctgacaaatcgaacaaggacagaatttgtatttttctgcccaatttctagtccaggagaagaagggaaaagagcaggaatttgcagaaaattttactgaaatgagcgatgacttgatgagttaatctgctcttctgacacatcaaacaagaacataatttgcattttctgcccaatttcaagtcccaggagaagggaaaagagcataatgtatatcacctttgcaacagcaatgtgctcggttccatcaagcttggattggtagcagtaagctcggaaaaggccccatttcgtcggcaaacgagatacagcaatcagttccaccagcttctccctcttccttctatacctgaatcagaccaaaagaatgagatgagatttcacaaaagatgtttgcatatctgaaaaatcctaacatatactgtcctagttccatgaccaatggcatctcatttctggttcgagcatcttagcttcaaattcacacggttattttccatgattaaaaatacctagttcctcctaggtaattcccatttttcttatttcaggttccaccttggagagtagtttcagcagtgcattctaaagaagaacaattctggctatgaagtttcaccgaaagaaagaagaaaacaagctataagttcacaaagggttcaccttaaggtatactaaccggatgagatcagcgattgaaacaattgggatatcatgctccaaagccat

SEQ ID NO: 59172 - DNA, 4919 bp, Oryza sativa
  unsure (1)..(4919): unsure at all n locations
tattcatgcctgaacaactatcgatttgcctcgtgcatgtcatgtacgggagcaattccttctctatccaaattctaccatatgagcgggagcaatccccacaattcttgaagacaacaaaaacaatgctagctaggagggcgaggcatgcagatttaaaatacacgtcgacaccatggccgagtatcgacgagatgaaatggtcgatttatcaatatttgtgctacgtccgagaccgacgaggccggacaacatattagctaaagctaacaagattggagccattcactcattccatctgtctatgactgacgaggctagacgaaaccatggccgagtgccaacatggccaggtcactatactattaacacgtctaaattggacaggaaacggatacaccgttgctgggcaccgacgaggcaaaagcaaccacaaaatccatgtttgatgaaggctagggtacatgactgggcaccgacgaggcaaaggtcacccgcttcaccaaattctctccgcacaccgacgtgatggtagtgtattgtgaccgggttttggcgaaacaaagccacctgttccacattcactatattcaacgttaaatctgcaccaacctcaaccttcggcgagtaattaattttgaagacaacgatcctaaagcgcagcttaatcggaggtgttccataggctcgctcatgtggatgtaattaaccggtagccttattgctaggcgccgggaatcagcggactgtacgcaatctcgagtcagcatacctttccattaagcatttctcgtgaaggcaaaaggcgaactcctgcgggagccatcatgtatttgtaaatattcatgttaatgaatcatgattaataaaatacagggttttcctattttctgtgtgttcgtggttttgttttcatcaaacaccaataaactcctcagctatatatagatcgtttctttaacatatgataaattagaagtagataaataaaagaataaagggtgatccaaagtgtcgctgagataaaattgtctagtctaaaattaaaacattggtttgaaggatgatccaaaataaaacatcgggaataaaaaagatagtatgaagtgaaatttactcgtaaacaaatctaatactaatactccctccgggtttataatactcgtcgttttgaacaagagcacggtcttcaaaaacaactttaatcattattatttattataatatgtatataaatgttaacaaatatataatttaattgaagtatttttaagattaatatatacatatagtcaccatagtttaaagacaaatattttagaaaattttcataatcaaagattttaaagtttgatatcattcttgtccaaaactttaaagtttgatatcattcttgtccaaaacgatacgtaaactactctcagctcggagggagtacgaaatatgttagtacgatgcagttttttctcatttttacgctactaatacatcagtggggccaaatgaaaccgcatacagtgctaatcaccagaaaattcacaaagcaccagcacctcctccagtaactgccgatgccgacggtttcgatcggtagtcctgccgatgccgacggttgagaattgtggtactggtggcaggtgtgtgtgtgtgtgttgcggcggtcggagcgtgaccagctcagcttcccccggcccccggggaagtaaccggccagctgaagtgcgctcggcccgcggttctccaccggtgcgcaacggcaaagtcgacggttcggctgggttgctgggccgctcatcgcacgaggccgttcgactgcctctccccctcaggattttgcctgtttgggccgtgcacatcaagcccgcgaactctgccgcggcgagtagttcgcttcaggttggtttggttcggttccaaattccgccctactaatttattggtaatttttaatagtatttctagtttttttattaatgctaaattttaacaatatatctctttagatagtaaaagttttagccatctaaatttagtagtgccaaaaattatctaaactttgataattttagtatggcaccaaaccaaacttgcccttcatcttcaatccccccatccccatcggtgccacgccgccagtcgtatccaaacttttctcggaccacaatcccgatgacggtcgcgtacggcgggacggcgacggctactggaaagcccacgaggaaataacgtacaagttcacggtgacacggtcgcgcacacagccacacacacacagggtcgcaggcacagcaccccggttgcgtcacggaaccgaccggtcaccgcgtccgcacgtacggagaggatggcatactggcatattccccgcgcggtgctctactgctcttctctccggaagcgccggatttcgtcgaacgggtcgaaacacgcgggcgacatcaatacatcatatccgcacgccatttggcttttgcttccttcgcgcaccattccatcgcgcgcacgagcggggagacgacgaagacgaagacgagccaggccgcgagggcaggatggtgatttccgcggtcgcggtctcgtgagtacaaacgattaacaaagttcgacgtttaggttaggtaggtcaaacgcgtgcgacaacaataatgacaagaccaatcagggacgtgtacttttttttaacagaacataagcactcacaattacaccctcaccctcatcactatgaatacatactgacatgctccttccgtctcaaaaaatactccataacaacttctcaattaacattcatttcctaaccaatcacaaccatctattattcagtttttccacctacctctacttctcaaccaatcacaatcactttctatttaattttacctattttttaataaccgtgtccaactctaaaactagcaatattctagaacaaagggagtactccacagtgtatatcatcatgttatctattattaaaaaataattaattataaatacaaataatcatatcgaatctaatattacttaaaaataactgaatatattttaaaaagaacctaaataattagggtgtagctatatatatggcgccatatttttcatcaaaaaaaagtcagcatgtatttacattgtaagtccctaaattacatatgtaattttagtgtatttacaatgtaagtctcaaaattaaattacatatgtaagtactaaaattacatatgtaaattcgaaaattacataccaattacatacgtaagtggggtgtaaatgaggtgtaactactctgtaagtggctgaaaaaaaatcgactgtagtatatggcgccatatttctagcaaatccgaataattaagctacgttttattcacagcaacgttgtatttcgttatactagtatactaatgctccaaaaggcagtttacaaaaataaaaaaacaacattatcttgtcagtactaaagtttttacacgtggacaccccatcgcacaaatcttgtggggcgcacgatgccaggctcacgtgacccgaatttttttaagcctactttggttaatctgtcccatcaccagaacattttggcgtgttatacgtcgccagaaatctctacggccacctatagcatcacgagccccagtctatggcacgtggtcccggaggacatcgtggcccacgtgccagtgacacgagcgtgcggtgcaggcggttcgcgagggtgtggatcgcatgtgtgccccacgcgatgcctcccatccaacggccacctgtccatccccaattccaacctcgacatggaaggttccagaagcttccggaaacgaccttccccatgttcgcgtcgcgtggcttctcgtcgaaggaaattttgccagaattttcgcggatatttccttcacgaaaccttggtgggagaagggagatggaattcccaatggcgtgtagaatttcaatttcgaattatgttttaaaaacggcgagaaaatgtggaatgacgcaaatgcccttctgcctcctcgcttcttttattgtcctcctccctcctctctgtcggtggtggctcctcccctctcgttgcttgcctccccccgatctgcaaagccggaggcgctcccccggcggcgaggcaggcacggcgtggacggcctcccccatctccngtcgccaccgcgccctagccttctcactccctcccggcccccgcgcgcgcgcgcgcggccgaccagccggtggtcggcttccgtctccactcgaatcgaattcgaggtatcatccattcccctcccgtatcccgccctcgtctccctccgccgcttcacgtgcccggcgtggcgtggactggagacccctccggcttggattggattggattggtttggttttccttgttctggaattttttaaaaatttttgatgcgtggtgcgctgctgattttttgcagtttgtttggagagaaatcgggggttctaggtgaacccccatgcccgacgttggcgcggtgatcgaaggatcctcgcggcggagatgaacgtggttgggcgggtagggtcgctgatctcgcagggggtgtactccgtcgcgacgccgttccacccgttcggcggcgcggtcgacatcatcgcggtcgagcagcctgacggctcgtacaggagcacgccctggtacgtccggttcggcaagttccagggcgttctcaagggcgcggagaaggtggtcaccatcaccgtcaatggcgtggacgccagcttccacatgcagctcgacaactctgggcaagcctacttcatgcgggagcttgtgcctggcagtgaaaattctgggacaagttcggaggaagaggaagctagctgtgagccctgaacctccggcgcggagtaagagcgacggggatctttacatcggagcgaaaggcagaccaggt

SEQ ID NO: 59173 - DNA, 1036 bp, Oryza sativa
gatgggagccattcagagatggttttggttagtgtggatgggcatgtcctcaccgcccccatttcctcgaccgaggagaatgtggaggatgtgcagctaagtgaaccccaattccacttgggacctggggagagctcaagtggtgatttcagccgcagtggtgaggtgtgggaagctggcattgtcggtgatttatacatgccacaggaaaaggttaagtttgattctggaaatcaacaagaggctttggaagaacttggtgatgtaccaattgagacggataagtcacatcatgtccctgttactggagatgaagtgctccatacctcagtttatgaagatgtgactagtgcattgaccaatgaagtcgaatctctagttgtcccagagttagggaataatgatgaggactatcaagccttgatcaatgtagatgaggtccatgacatctcagagaacaaaaatgagggttgccgacccccttctagccaatatgaggtttgtgatgtctccaagaccgatgatgagggatatcagcccttggccactgaagaacttggtgatgtaccaattgagacggataggtcacatcatgtccctgttactggagatgaagtgctccatacctcagtttatgaagatgtgcctagtgcactgaccaatgaagtcgagtctctagttgtcctagagtcagggaataatgatgaggactatcaagccttgatcaatgtagatgaggtccatgacatctcagagaacaaaaatgagggttgccgacccccttctagccaagatgaggtttgtgatgtctccaagaccgatgatgagggatatcggcccttggccactgaagatgaggctcgtgatgtctccaagaacaatgatgaggggtatcagcctttggccactgaaaatgaggcttgtgatgttccactgcttgagaatgacgaggcttgcagggtgccagctaatgtagacaaggtttgcgatgtcagcaatgaggacactgagttagaaattgctagtccagttttgg

SEQ ID NO: 59174 - DNA, 713 bp, Oryza sativa
tgcacccctttatttgctttgacgaagctctcatgatcatacatcttttagggagtgatctgtgatactcttcgtcgaacttacggccttagcttgtcagctttccaagttgtatcagcagctgctagtcagcaatttttctctttgtgttcttgtagctgcagctcctctatgattagattactcctggttcatggaagcaacaggcaacccaaaactgtcaaaacacgctgtatgttgtacaagagaaaaacattgtacatttcctaccccattttcaccttctccttgtgctgtatgtaacattcaatgcctgtaactggtaaaagtttcatgtgctcgtcatctgatattttggatggaatgaattactctatagctgatcattttatgatgtgaaacccatctaattttgctagagcatggctcactttgtcttgtgattggtcagattatggcctcccgcggtgaggtcttctgttgctgatgaagaaaagttaggccttgtctagattccaacttttttcttcaaacctccaacttttctgtagcattgaacttttctaaacatgcaaacttctaacttttgtcgtcacatcgtttcaatttcttcaaactttcaattttagcgtggaactaaacacagccttagcatcagttgtcagaacttcctgggtgcatcacctgccacaaccaccaagaacttaaaactc

SEQ ID NO: 59175 - DNA, 1226 bp, Oryza sativa
ttccgactagcttcacaaggtgatgggctagatgacttgggttcgaagcctcaccccttctaattatttgatattaggtcatttcctaatattcacgttgaattactcattattgctgtaagtcattttagttttgttgtaagcaaacttacgtaactttgactgagggcttgtttggttcgtgccctgggcatctagcatgagaaatttgcatgcctgagaggcacgagaaaagttgattacattgcctggtcaggttgtgcacagctacctgagaggaaagaaacactattagcagattcatgaacaaactaattgcatatattaaggatgaaaaacaagcggaacacaagggaaaaaaaatccccaaatccatctactatatgtctttctttatagacatatcaatcacataattagataagatagatcaattgcataagttaaaaagagagcaggagaaaagaacgcaaggacagaaatcccccagatccaagcattcatcaaatcgctttggcacaccggcgacggctgctgcttcgtgctgaagatgggcccggccggcgacctcgcagtagcttcgtgtgacactgtgccggatctgacgacgacggcgccggcaaagacgaggcttcgagcgaattagaaggcagcgacggtttccgagtgtccgcgacaacaacggcatcagaggttgggatttcgagagacgatggcggcggaggaggaggcaaggtcgtgcgcgaacgacgacgccgacggaggctggggttccgcgcgacgacggcggcagcaaatagcgatggctcattggctttgtgctacatgaaagaagataatacacgttcgctgctacgcctgaaggtcaggctaatcacgagacagcatgcatcaggtcaggcaagggcaaagaaccttcaggctggtaaccaaacaacacttaaaatgtgccaggctagtcttaggtcaggccacttcttctcagggtagcaaccaaacagcccatgagtctataaaagaaatacggcaacatctgtaatactccgaatataacaaataagagaactataacacatatttcaaggtggatttaatggtactaatttaatattatagctgattgtgtatttttctttaaactcaattagaattagagaagtttgatttaggatcaaattaaaatgacttgagttcacacaatatggaaaggaatggatacaatggtt

SEQ ID NO: 59176 - DNA, 1080 bp, Oryza sativa
ccctaaaattaaaatgatgtgacagaaaagttgaaagtttatgtgtaggaaagttttaatgtgatgaaaaagttgaaaattagaagaaaaattttagaactaaactcggccatttgcaaaatttacactggctttaagtaaattaacatttgcaaaacttacgaacgactgggcaacataaaatatctgattgctcttatagcgagatcaaagctgtcgaaggagagacccgtttggcccagagtcgagcattgcacagataaaaaaagaaagaacggagcaaaacagagttactcacaataattaactaagaatgcatcgccatatccaaaagctgttcagatgaaagttccaaaccacaggtaaaccacagcgttcctcccccacaactctcacttaatttctaccagaagcaacgacgatacgacagatcaagccacagccaaaagagacgatggcagaaagaacatcgtgagcggcaaccatggagcagtttagtcgacctcctcgatcttggggcctgcgccgctgccgcccgccggcgcgtcctcgtccatgcctccggccatgtcggcgccggggccctggtacatcttggcgatgatcgggttgcagatgccctccagctccttcatcttgtcctcgaactcgtcggcctcggcgagctggttggtgtcgagccagctgatggcgccatcgatggcgtcctcgatcctcttcttgtcgtcggcggcgagcttggaggcgatcttctcgtccttgatggtgttgcgcatgttgtaggcgtagttctcgagggcgttcttggcgtccaccttcttcttgtgctcctcgtcctcggccttgtacttctccgcctcctgcaccatcttctcgatctcctccttgctcagccgccccttgtcgttggtgatggtgatcttgttcttctgccccgtcgtcttgtcctccgcggacacgttcaggatgccgttggcgtcgatgtcgaagcagacgttgatctggggcacgccgcgcggcgccggtgggatgccggagagctcgaacttgccgaggaggttgttgtccttggtcctggcg

SEQ ID NO: 59177 - DNA, 3427 bp, Oryza sativa
gaagtggttcaccatgcggttgtcgaagtcctcgccgccgaggtgggtgtcgccggcggtggccttgacctcgaagatgccctcctcgatggtgagcagcgacacgtcgaacgtgccgccgccgaggtcaaagatgagcacgttcttctcgccgctgctcgtcgccttcttgtcgaggccgtacgcgatggcggcggcggtgggctcgttgatgatgcgcatcacgttgagcccggcgatgacgccggcgtccttggtggcctgcctctgcgagtcgttgaagtaggccgggacggtgaccacggcgttcttgatggacgagccgaggtaggcctccgcgatctccctcatcttgatcagcaccatggacgagatctcctccgcggcgaactgcttctcctcgcccttgtactggacgacgatcatcggcttgtcgccggggccaggcaccaccttgaacggccatagcttcatgtcactctgcacggacgggtcggagaacctcctaccaatcaaccgcttcgcatctgcgtttgagattgagaaaaatcgcaacaccagtgagttcgattgctccatcgattcagcagaaaatttcaaatcaacaaagcaatacaatggtccaactgttcaactagcatttattatcaaaattctacacagcactacagcagtgagactcaatcttcactaaatatataaaagcaaacataatctccaatgagttcgattggtccattgattcagcagaaaattccaaatctaatctactaaagtaaatccaagaagcaaacataatctccatctattttagtggcattcatcaaaattctacacagcagtgagacccaaatcttcactaaataaaaagcacgatttcgatttggtcgagaaactgttcatatactattccagtggacctaacaacatgcctgtgcacaatgaaccaaagcaaaattgacatattaactcctttgggaattggcacgagcagtaagcaagtaaaattgatctgtaacatatgctcaacttttagctacgcgtgaacaaatcgcagaacctctcctaacacatctattcagaagaagaaaccacggagttgcagaactgattccatagctactccaacccatacagattacagaggacagaaacataattaccagaggacactagaacagggcatcatattctcatcgatctagtacactcttttacacatccaaaactaaaaaaccacggtgcagatcgcgttcacagtcacaaccggcgcaagcaaaagtggaagcagggagagggagggcgggaggatgcagggtaacgtaccgaagacggtgttggttgggttcatggcgacctggttcttggcggcgtcgccgatgagccgctcggtgtcggtgaaggcgacgtacgacggcgtggtccggttcccctggtcgttggcgatgatctccacgcggtcgtgctgccacacgcccacgcacgagtaggtcgtccccaggtcgatcccgatcgccggcccttcccccttcgacatctcctcctccttctcctccctctccaaaaacctcgcggaatagaaagcgaatattcgcaaacgcgcgctctcggattggattgcttgctgctgggtggaatttctctctctttctgatttctcgaacgagacgaagcgggggaagaggggaggggcagaggttttgtggcggaggtggcgggggtctagaacgttcgcgcgcgggcgatcctggccgtcggattgggggttctggaagggtcgggagggtgccggttcgcgtgaaaggaagaggggacaaccaatcaggaggcgacacggtggggacgcgttggtgggccccgcttgggcgcgcgctttttgaacggtctcttgaggtctgggaggttctacactgtgctcgtgacgatggataggcggagtcggtcctttgtttccggaaatcctaattcgctaacgtgcgaccgcttgatttctcgcgaacactttccaaattccaacctaagggcccctttgaattggagaaaaaacataggaattttagaggattttaattctatagaaaaattttctatgaagttttttgaaacaaaggattgaatcctattaaatcttttgaaatttctatggaatggccaatcctatagagattttggaggaaatttagcaaaagcttcaatctcttagtaactttgagtctatctctctcatctaattcctgtgttttttctgcggttcaatcaaacggccattcctatgtttttcctctattttacaatcatgtgttttacacttacattcctatcaaaatcctacgttttatcaatcctgcgattcaaagaggccataaataaagacaagactcactagagattatgggtagggttaggatttcggaggtaaagggagatagagccagggaggtgcatcgaatttagagggatggcaccgaaggtcatgaaaaaaggacagcggcgagatagcgatggcggcgccaaagccgcggggtcggccatgggccgtgggccggtgttggtggcgggggcaaagctaaacgaaataggggaggaggagaccgaccgagcaggcccgcgctgacaagttgacgcctttcagtgccgacaaggccgggtggtggcacggtcaggaggtggtggtgggagaaggttggagtcgaaactgacccttgtttggatttcgccataggaggagcggagggagttcgccagaggaagctcgccggagaggccgtcgccactccaggagcccacgcaccgtgcttcagcccccgctcctgctcccgtcgttgatgccgtcgtccacagaaagaaagtcgcatgttaaaaagaaggtagagagagtaggaggaggggctaatgcgctgggctgttggaaagagttcgcggtcttcgagcgccggcccattgcacccacccccttgtttcggtgtttggagcggagagaggcaggtgtgggccgtcatgggcttttgttgcaccctgtaccgcgaaaacagctgcacagatgcacaagatcgattcgtccaatggaattgttcagtacaccgtagctttctcgcctgttttatgcttggattttgacaatatcaaatttgataaattttagcgctgctaaattttgatattgttatattttagtttgatgtgtttctaaaatttgatagctttttatgagaggaaaattccggaactaacaatttttgatagtatgcgattgatcaaatcatatttagtttgttacctaatcaaaatttgatagggttgaaaatggtaataaagtgaacatgcttcttattgtcaaaaccaaggtgtcgaggagtgatcctctctagcgggaggtcgtgagaccccccctttgtgagttcggccgggggataaggcgcgatgatca

SEQ ID NO: 59178 - DNA, 1192 bp, Oryza sativa
ccccaagggggtggggaaaaggcaggccgcacggccacgtggccagatgggaaggttatttccctctaccgtgagtacccccgagcccatatcaccgacacaaggttatcaaatattggtggcgttgaatgtacttagtttagtgcctctttaaaatttagtagtgtttttatgaaagaaaagtttcggaggtaccttttttatgaaatgatattggtaagattatgtttaatttcaagtagcaataaagcgaacatgctcttaacatttctcgcgtgattatatatgtgtttatatgttaagcaatttaaaattgtcaaaaccatgctatgtttggtttattactacattgtattctcaataacaaaaggacgctacataagttataaaaaacatcatcaaaatataatcatatgttcttccatatttaaacttttgctacggtgaaaactttcttacatattaccgtacaaaaggtatttatttacaataacaagaaaccatacttaaaaaactttcttcctccactcaattttatttggcattgggaggatacggagtatcacaacatatttactgtaaaagaaatggacacttgacagggctgatttgtatgaaatcaaatatactctaaagatcattttggaagtccaacttacccccaccccctcaacttatgcaaaaatacgaattaaccctcattttcaaccctccccctccccctgtagtttgtttctgtacccttcaatggctcatcggctacctcaagccctccacgattagctacacacttggttgccacctcccttgttgaaccaaccaccattattatcatgcgtcttttacctgacttgtacatactcaagtagtcgatgacatctcaagctcaggatgagacagggataaagtaagaggaggaagaaattgaggtcactacaacctcacttgaccaaagcctagctcgagtcaaggcgaagctcacctagctctgtatcgtttgtggagagctcatcgaggatgctgtggacgaagaaagagagatagacgtcgtctggtgctccgcatccgctcacgttgcctcaagccacgcttcgcccgcaacccagtcatattgcctagagctccatcacccatcgtgaatgcgtcatagttctagtggcggaaacaataggggagagttatggagtaagga

SEQ ID NO: 59179 - DNA, 7544 bp, Oryza sativa
tcggtgtgtcgcagggcgatggatcaccacttcattcactcccacgggaattcaccaccaaactcgacgactggtgaagtactaaccttttgaagcctgaatcgaaagatcaccggtcggctgcggcggctgctgctactttactgctcagtttcagatcgaactcacaaaaccacatgatttaacgtgaagctagttatcaaactgttaacaatgcgtatcggtaaaaaaaaagaaaaaacttgtatataaaaccttcaaatttataatagtaaaaacttgattaatcatgtactaataacagctcgtctcgttttcatgttatggactagtcaagtccaattataccttggaatgcagcttgggtgcgtccttttgattatggttttagagcagcaacatattttaaagagataaaagaagagagagaatagcaacgagctatagatctgtagctagctgtagtacggattttaagacgtaatgagtatatgacatgtgggaccaggtattagttactccctccgtactcataaaggaagtcatttaggacaatgtttaagtcgaaccttgggaataaaaaacataaataactcttaagttgttgcattgaaaatgtaaaaattatatgaatagatttgtcttgaaaaatattttcataaaagtatacatatatcacttttaaaaaacaagaagtcaaagttgtgttttgaagaccatgtcgctgtcctaaacgacttcctttacgagtatggagggagtatatagtaagtaactattatatgaattggctattacattggctatagatgatttggagttggtagtgggctatactattaaacttgctcttagttgattagctgcacgcaaaacgagaaatatcggatagtgtataattaattgagtattaattattaaaaaatttaaaaaatctatttaattttttttacagaatattcaatatataaagttttgatgcgtttaatagtttgaaaaacgtgctaatgaaaaaggagaagtagctaagagcaaggttaataatacagctaacctgttggctataaggttccttgcagtcttctctcagcctacccatataatagatagctctttacaattaatatagggcacacttgtctctctcacagagtttcttggttattgtgtctaagccggctgtaagtttatagcccttttcttatctctctcctctcttctctcctccatctcggcatttagccagagcaagtataatagtaggctataagaaggctgaatgcttaggtggatgggagaaaagaggatagagatgagaagcgggctataagtttacagccggcttaggaacaggaaccaaaaaaatctgtgagacagacatatgaaccatatatttatagtgaagaattaaccactatatttaaccactatatgataggctataagtaaacagcttgctgtattattatccttgctctaaaaccaatttctcggcgacatgaagacatcagagtacgagacatcccgttgaaacatgaaacacaatagtgataggaccaaagtgggtggcggtccggctgttataggacccggccaagacatgactgaaaactttggccagagtccagacggttccaggtgtcaatgtgtcaatgcttttggaagctgctgatttcatgtttccgtcccgtttttcttcaggagatctagccaggagggacagctaccacaaagttaggcgttctaagatttgtttgtcactcgtttagtcgtgtcttcaacatgagtcaacaccatattgtcagtgatcagaaagaaaggagagttaaaccatccctattaatttagtatatataccaagttaggctgagattagtttcaaacttccaatttttctatcccatcaaaactttcctaaacacaaacttccaacttttctgtcacatcatttcaattttaaccaaacttctaattttgacgtgaactatgcacacccttattaccaacccaacccaagtaggctagtagtacacataacgttgaccaagccattcaacattttttttagaacagccaagcagcatgttgaatctatgtgctactctacctgaagtcaagctgatgagctactccactcgatatgccaccaaccctagtgtgaaaaaaaaaactgaaacagccggacgccactcgagctaacggacccgaccatgtaatcggagaatataaaggacggcgggatgggcgctcgctcgctgcgtccacgtcggattttgctacagtagggtggaaattatgcgaaaaagccctccgatttttcgtaataatgtataggtccctagtgtaacattgccggccgggcggctggcagcaggaaggagcacaaacttggcgatccgacggggcccgcacgtcagcggccggatcacattagctccctatttgctgagctgctggaaggccaaagggcccgcccggcacggcccggcccaggaacagctgggcacgggctagcagccatcgggccggcacggcccgataggcacttcgtgccgggccatgccggcccatgggctgcacctcccgcccaggcacggcccaccagctgtcgggccgtgccgttccggctcgaaggtatgggtggcccatcgggcctttttttaaataagtctatttttttccctcctctttgggctatatcatatgtatagctaaagtaagtctatattccatccctcttctttgggctgacatatgtatagctaaaataagtctattttctatccctcctcttcggctgacttatgtatagataaaaaaagtctattttagatccctattctttcatccatggcacataatatgtctatttttactcccatatttttttttgtatcggcctagctgccggcccatcgtgccgggccggcctaacatgccggtggaggggcccaagcacggcccgatggtcgggccgggccagcatgggcccgacctccgtcgggccgtgccgtgcttaggccggaccaaaatgccgtaccatgggtcgggccgtcgggcctcggaccttttggccatctgcctgctggttaatcaatcccttcaaaccacagcgtagaaatgtacaccgacatctagaaaacctcctaattacgagtactactcgagcccagtgaaccagtcagtcagtactctgtagcagctttggtctacctaggattattactaggaaacacaggtattctgttccaaaaaaaacacacacactcgtgttgggctataaatactcgtgcacaacgcatgccttctgcgacagaaaagagctggacgtggtcacgtagagtgcaccactgattttctacagcgactcttgagtggtggcaatgagcaagcggcagtttggagagatggacggcggcatcgacacggcccgcgtcctcatgctcctctcccggcggcggcggcagcacggcgacgtcgggcacgcgcgcgcggcccgcgtgttcgagtgcaggacgtgcgggaggcggttcccgacgttccaggcgctgggcggccaccgcgccagccacaagcgcccgcgccacggcgccgagcgcgcgccgcggccagcaggcgacgacgacgtcggcgccggcgccggcgccgcgctccgcctcgtcggcgcggcgtcgtcgttgtcgacggacgaggcgcgcgcgggaggcggcggccgcaggacgaggggcgccggcgccgcgcacgggtgccccgtctgcgggctggagttcgccgtcgggcaggcgctcggcgggcacatgcggcggcaccgcgccgccgccggcgacgtcgcggcgccgcgtgtgaagaccgacgacgttgtcgttggagacgagtgcaccggcgggatttgcttggacctgaacctgacgccgtcggagaactgcgacaagtgccggcacgcccagctcggcgtcgccgtgaactctgtgcaaagaacgatactactggaccgtcccctttgagctgacccattattgtactgatttctatacgttttcgttgtatttatctagcctttatatgttttgttgcacgctatagaatcatataaagatttttctatatattttttgaacctttcaatcttaaaattttacaaatagactatcccgaaacttatttctaaagctgaaccaagagtttaaatttgaagttttgaggtggtttacttttaaaattaaaaaggttcaaaagatatataataaacctctataagttactgaagaagaggagccaaaatgcaggaacagcatcactctattccatgcatccattgattaactgaaaacccaatagcaatacagcatggactacgttacacactgtagcttgcagttcaacggattgaaatccagcgtacagtagtagccccccaggcaattgcaacagctacgtcaaaagcatgagtagttgcttcaaagaatggaagcaaagataggtacaaccagatccgtatcatagtgtgtcttcttgacattcttcctataacagcaagacagggaacaaacaatgtcaaataataaacgatggaggccgagaaggcgaacgtctcctcaggagccgcagcatgcagatccagaagctgctggtttgtcggcaccctgatccgtcttgttgttaatcttgattgtcttgtcctacagtgcaggagcatatgtttcttagaacaaagagcaagatgatgtttgagacataattcagtatgtacagttatctgtacctcaggcttggagtcggtctcagcaagcctctgcttaatgtcacgtgcaatggagaaaaaaacttgctccacgttgaggtttgtcttcgcactctggaatacacagtgcagtgtaaaatcaaaacaattgtcactgcaaaggccactttcttttcaaaaaaaatgacagtgaaaagaacaaacaattcaggcagcaacatacagtttcgaaaaatttgatgccatactcatcagccagtgcttggcctttcgcagtagggacagcctggagaaataacaagaacaggaaacaaataagcttctaactagtaatcctcagggaaaactgagcatttgaccacaacttcaaagtggggatacggtatgaatgaacaccaaggataaaaactgtgatgtacccttttactctcatccatatcagccttgttgccaaccaaaattttgttgacattatcagaggcatgttgctcaatattccgaatccagttccgaatgtctgtattgtcaaataaaacagcagtgacaaaatagttcaaaatggaataattaaggaaggtatatatgtaaggagacagtactgttgaaagatgactcgtcggtgacatcataaacaagcaggatacccatggctccacggtagtacgtgaggtaaaatgagatttacttgatcaaaaggttctcatttaacttcacagggttagtatgctgaatggaacaataattataccagtggtaattgtccggaaacgttcttggccagctgtgtcccaaatttgtagcttaatacgcttcccgtccagctctattgttctaattttgaagtcaatactgcacaaacacaaatactgcaatcagcgtggagaagataataaattgaaaagcttgcgggcaggagccatagagcggtcttcccaacatcagagaacatacccaattgtggtaataaagcttgtagtgaaggaaccatcagaaaaccgcaggagaaggcaactcttgccaacacctagaaatggaaaaatgagaaaaaagaattcttataagaaaattggccagcacaaaacttgcctgaggaactgccattagctactaaataattagttcaacagaatacactaacaaaagtgaatttgtaaatattatggactttaaaacagtacaactgctagagaaatagcatgctaccaaaggttatgcctaaaaatttgaactaatagacttacattggatactagaaagaaccaaaaacaatttgtaaaagactaaatcatagatagtcataattaaaaacaagtagtcatcactgagcaaaagaatccaagatcaagacctattagagcacgagctttatgttacagacaatcatgaataatctggcaattgtcatgaaaacaatcacttatttgatcctatcaatgaataagtctcgacaaggaatatagtggaagctctacgggtagtggctcaaagcgagagcacaaaatgcccctggttgatttgagctattggtataaaaatataaatttctgctatgaacttttaaacaattacgctatttcatatagctgtaatgtttgacccattagtttcacccctcactccaactttcttccaacagctacacatttggagcatacaccctcacgagcaaggaactatctagttccactctcaacaacatgtagcacaaattccatggcatgcactaacgaatgaaaattatagaggaaagaatagcacataacatactctctttaactctatctcctattgcatgattgagtgccaaaaaagaaagcattgcttcatgcttatgtgcaacgtttctcagatggccttgcacactgtcgaaataaccttagtatcagcttaatcagaaaagcctgcaattccagttgaccatttccaaggttcttccatccaaggaaaaacttactgaaccacgaaattcatttttttttctcctcgccattttcataactcctaactttgcttcttcttcttctttttcttttttttttacataaagcacagtagtggtagttcctgcctgtatgtactaggcaagtaggcattatgtatattgtaggttgaacagaaaccaaattcacatgaaagacagatcatgcacacaagcgcacaccaaaggcaaatcctttgcaggatcctagttgctcgcgtggcccaatccacctgcgatccaaccaacaccgaggcgcgggaaaacccacacgacatcactcgccgtggaatggaaatgggaaggcaagatctaagctcgaggtggtgtcaccaaccgctgtccccgatgaggaggagcttgatgaggtagtcgtagtccgcccgagccctcgccggcggcgcagccatctcgtcgctccgcttcacaccctcctcctcctcctccccctactccacagcccacccggcgcgcctcctccaccaatccccgacctgcagcgaacggaaaaaaaaaaaaacagacaccgtgagaatggcagcacgacggcggcggcggatcccgcgcgggtggcggccggatcggagaccgcaccggtaggcgcggcggaggatcgcgcggcggcggcggtggcggtgcggatctggagaacggggaggagggagttggttttttttttctctccttttttcccttcgcttttttagtttgctggttgattcgtcgccggccgcatgagcgagcgagcgactgatcagcgcgtgcaagatcagagctgggttttgtaatttgttcggtttttttatggggtccggttcggtcggt

SEQ ID NO: 59180 - DNA, 1498 bp, Oryza sativa
  unsure (1)..(1498): unsure at all n locations
ttcttagaagagtttgtgaatcttaaaagagaagttgctaaaatatgcggtcagacaaatacattccatcacgtaaaacgcaatttgatttgatttcatgttagggttaatgtgatttgccccaacctaatattagttaatttgctttagagttcatagactttttctaaaagaggtgtactgaagcacacccaaacataatacgattttttcagctttcgcttagttaaagttgtactatgttacacgatatcaaccaattattatgagcttggagagatgtatttgcattagttttccttataacaagtagtattgacagcgtcttatttgtgacttgtgagtgaaaaattacataccgtatgtctagttcaagtaattcactttatgtatatgtttccccctttcagctgagattgtaatgtttgatggccacattgtggtgtataagttcatccaagacctccatttttttgttactggaggagaggaggagaatgagcttattttagcatcggtccttcaaggattcactgatgcagttgacattattctcaggttatactcaacctatttaatgtatctttgtttttctaccttttattttgttttacatttatgtccctacctgattgcatgtattctgtttcccgtgtcatcggtttcagaaataacgtcgacaaaagaacacactnaaaatctggatctcatcctattgtgcctcgatgaattgttgatggagggtaaatcctagtctcactggatgtcaaatgttcttattcctttcgtttgtatgtccggctttcatggcacgctttataatcggttgtctgctctagtaatgaacatgtatatttttgattggaggacaaatgaattctcttagcacatttacttgttaagaatcaaaattctgtaccttgaacaatcctatttgaggtggcaaaatttgataaattagacaataaatgggaatgatattgaggtggcaaacttttgattaggccatgaacatatatgcctgtcaatctgatagtctattaatattttaatatttcaaagtgtttcaaaaagtttttgccagtctcctgatgtgtggtactgcaaactgtaataagctcaatagtacttgatctgaatgattatacaggattgtcctggaaacagaaggaagtgtgatagctgaaaaggtgtcagcacatggaatagaaggtgctacttcactcgctgagcaggtaagttttagccatgatcttactaaaggaagctgttcggtttaaccaaacataacgagttattgctctctgaatgcagactatagttcaagccctaacaacagcaagagagcacttgaccaaatctcttcttatgtgatgtgctctgcttttggagctgaagatggagtagcatcccgttgtacattctaggactgatacgttcattgcaatagaaacgacggaacagaatatatgaatccatttgcgtgtagagtggcacg

SEQ ID NO: 59181 - DNA, 3130 bp, Oryza sativa
gcaccccgatcgttttccttccgtcttgatccacccacacacacgatatgacgtttctacccctcacaagtacaagtataatgcatgtcaatgaggggtataaatgtcatatcatgtgtgtgactggatcaataacgatcaagacggacggaaaaattgacggaagtgctaaaaataggaagatggtgaactttggatgctattaaagtgaaccggtaactttcggtgctataaaaccaaaaacgtgaactttcgatactatataatcaattttgccttaaaattatccggtttctttatttgccattcaaaattgactctttgctttattgctattggacaaaattttgctacacctaatatgccactaccgttagcccctgcacgtgaactcgccgttagttcctcggatcatgtcaaggttttctcagaaatgtcgatcctactctcatggccttgtcattcttcctctctttaagttgtcctggcaagcgccaactatcattcttgcgcgactactatcctcttagctagaaaggtaagtgcatgcctagacctataggctacaacatcagatctatgtccttgttccgatagttattttcggataatttgagacttagtggaaagagataaacaaggatattttggtctttttactgttcatctaacggaccgttgatgcaagattgacggtaatggcatataaggatagcaaagtttcgcctaatgtcacgtaagagaaaagtccattctcaatggcatataaggaaactggagaactaataaatttcgtcttgtaagaatgtatattagacgcgcacacgtgtacatgatatcatgggacaacgtgtgcgtccaatcgtactcttggtaaaaagggacacacatgttggtggtctcgtagctgctgcagcccgacgcttccatgcccgatcgacgtcaggatgttcatctcgtgggctcgcggccgatgtgaaaccgcggcgccggccagtgcccccagccaggcggccatcaacgcatgcggcacgcacgcacgcacgcacgcacgcacgcacgcacgccacatcacgcagcctcggcgtggacggctctgacatgagccgggacgtcgcggccttcgcgtacttattaatctcccctccccgggggggaacaccgactcaccaagttcgcgtcctgctcccgcgtcgcgcgcgtgcacacacacacccacagctagcgcaaactaaggctaggctcgccgcgagaggaaggtaagtaagtacgtacatttgcgcgaggtggacgagcttgacgatggcgagtgggcaacgagcggtcggcgaggggagcggtggcctccgcccgacgacgcacgtcgcgggcggcggcgggagcgcgcgcggggagtatttcaggtgcaagacgtgcagcaagacgttcacgtcgttccaggcgctcggcgggcaccggacggggcacacgcggatggcggcgcggcagcggcaggagcacggcgccgcgggggccgccgtcgtgggggctaccaacaaccagcggcgggtggtttccgcccaccagtggcacctgtgcgccgtgtgcggggtcgagttccgcatggggcaggcgctcggcgggcacatgcggcggcacagaggcgaggcggcagcggcgacgccgccgccggcggctgcggctgcgagcgccggcgccgtgtccagcatggagccgccggagatgatcgacttgaacagcccgccggcggtcgaggaggccggtgaaggtgatcagaggttgagcgtgcggaacaggagccccatctgcttaatctgctcgtgtagggtggtgttctctgtttggtgattgtgtgcgcgcggttgcgtttccaatgccattctagtgggaccaaggaagttataaaataaagtgggaccaaggatctcgatccgtcttaaaaaaaacttaatctagtaattggataggacataatctggatatccagattcgttgtattagattatgtcctatccaagtactaggttgagttttttttggacggagggagtatgtagtataatatgtttgtgcattttccgtgtaaaaaaaaagatgcactagcaatttgtacattggttgaaactgcatcattgtgcttatggtgttcttattttctatatctaatttcagtttcttatatatagattctaatatttttaagtatatgctgattgtactttatcttctgcatttcgaaataacatactcatcctgtataccatagacacatcacttatacacatgttgagcagtgatgatattgtgtgtttaagtctcaatagtgtacaagttactatgattccgtcaagaagtggttcctaccataacttaacgcactagattgtgtatatcatattgttgatgttttgcattcggcagaaatgtgtgaggaacgcgacattcgggacattcggcaataagggtttacgactataatcactcgtctaaaccatataaagcacatgattttacctagattcacacctactaaagaagaaagttaacatgtcgaacgacgagaagctgatcataagcaatgtttatccggcatggtccacattggagtgtgcccagagatgaggccgggcactcccagacttgctcagtagtagtcctgtgtggtttaggtcactgggctaccatttgtgggtccctagtccaagctttaggacgggatgaggtgtgtcacctgcacctcattctgtattaagtgtagggtagggatgtgcgttcggtctaaatcgagagttcaatctagttttttgggtctaaaaaagttcggcctttcaaaatagattaccaaactcatcctcacaaatcttgaggaaagtgggaagttaggctgatgggctgcagtttgaagatgggctacaaagccagtagcacaatccctggttttttacatagttcaggtcttcgggcatttcgggtacccgaggaggatggccgaactacccaaaaaaagatcggtctttccacttgcccgatgtaactacaaaccaataaccaacacttcaggttcttcaggtccggttttggttttttggtctcggtttttttgcctatccctaattaagtggggctgcag

SEQ ID NO: 59182 - DNA, 738 bp, Oryza sativa
cattggctcagttaatcagtgattagcagtttagcactactaagtaatttcgaaatcgaaatctttgtaaattaaacattttgaatttgaaatggtgacatagctcattccccaagaacaatgaggagaggaaaaaaaaaacaaagcatggagtggtgcagtgatgttctacagtacttcgattgagcttgtaggcgtgtgcattctctgaattttttagacccttcttcgtgtcaacatgttggagtgtgtgaaggtgtcattcatgtagtacagtacaaaatggcctggctgactgtctcgtcggattctgaatttcaggtcagcaaccatcgattcagaattcagagagagagagagagagagagagtgagagaaagacagcatttccatgaattttctagagcaaatcattttatttcgattcctactagcacgtttttcaagctattcataaaaaactttctatataaaagttgttttagaatatcaaatatattcactttttaagtttataataattaattatgtgctaatatttctctttttatgtgtgtcactttaattttcatctttatcattttcaaacaccacctgaatgcatgtgtgacttcgatgtattcaagggattgaggtaaaactgcacaacagcaattgtacacaatctaaagatttaacggccaaaaccgattcaccacattaaaatcgaaacaatacattttcatagtagggctgcag

SEQ ID NO: 59183 - DNA, 1716 bp, Oryza sativa
tagtatttctatacatctaaagtttatacacctaaagtttagtttatagatccaaagtttataagtcaaaagtttacatacccgattcaaatttaaatttgaattatgtccgattcaaatttgaatttgaattcaaatattttctatatatagtatttctatacatctaaagtttatacacttaaagtttatagacctaaagtttataagtcaaaagtttacatactcgattcaaatttgaatttgaattcaattttttttatatatagtatttctatacataaatttttttaacttttgttttttttaaaaaaattgtgtggtatactgtagtagaaagagaagaaggggaggaggaagggggagaagagggaggagtatagggggaggcggggccaaccgatcgctgggcgattgcctgtcggagtctgaaactaaaaacttgcatccgaattaatgtatcaatccctggatcagtaaatattgatacatacaatataactggttcttcattgcatatgttaaagttttacaatactaagggttttacaataatacgtactcgcctaactaattaatacacagcggaagtttctatacattctgactagggaggtataaccttaagggattctctaagttatcggggtcatcgtattaatagtcataggggtcctccttgacccaaatctgaaaaaggggttataagagcaaggatgagtattcgcaatactcagcaagttatcatggaaatatgttatgcattaatacatagtagggttctttgcaaaaagcagtaataaacaatctggaaaagttatagaaagaatttataaaacgtatagactttagatttctaaccagggtaccatatgagtcccgatactcaattccatgagtacggctattcgaatagtttcaaagatattctactgcagcagatgtacgttttacccgtagtccaggacttgctgataatcatcggctttagtcatggcccagtattaagtcattaacaattgtggcacctgttccatgaacttatatcctcatatgctctgaatgtattgttaacagcagcaagaggagttctggcgttcccgaggtatttaagggggaactgatcgtatgacaccacgtcatctcgatcagggtttagaaatataccatatagtttatactcgagtatcacaaaccatttacctgtacatggtaatggttaaagttgcccttcgcggctatagttgcctcctgcgcgaggatttaaaaataagaaccactatacagagatgccatattgctaattaacataatagctaggtctgtccccgttctagaaactgcggtcgtacccgttcgttcgacataagtacctggtaataactatatcgattgagacagtacttgacggagcgtggggctcctcaccgggagaccgcgtaggtccccctttgccggttcggccgggggcgctgagtgaggttcttcaccctcgatctgtggaacgttcgcgagagagcaaatgcacaagacacgggcgatgtatacaggttcgggccgctgagaagcgtaataccctactcctgtgttctggtggatctgtgtatgaaggagttacagagcaaatggagagcaagagagttcaagctctagaacccctctttttccttctcttctggttcttttttttctctcaatctcctcctcccttttttg

SEQ ID NO: 59184 - DNA, 1355 bp, Oryza sativa
tgcatgcatattgatttccaaccaaactcaacaacaaaatcacccacattcacaaaaacatcatagaatcatccacaatttcaacaacaaaatcatccacaaatttacatcacaaaatcatccacaaatacctagattaattagatcatcaattatcagcttcattctccatctctagaggatcaaatacctagatttattagatcatcaatcctgtagcctaccgccgccgcactgggcgccgctgccgcctgccggtcgaggaggaggagaagaaggagtggaggaggatgggaaggagtggagaggcgtgcgggcatgcgacgatgccgaggagataaggaagagagagagagagcgagagatgcgtgggagagagatatttagtcccgcttagtaataccaatcgggattaaagatataatctttagtccaatttgttcggaggcctgacagctattaaaccgagactttaaaatgatcttgttaccaatcgagactaaagatcaaagagagacgctgaacttttgaactgggactgaagaaagcttactacactattaaacttgctctaattaaagtataaaattttactgctcataagggaatcttttcctaccgatatgaagttttagtgcatatgtagtttcgtacgtactatataaatgtatcaactgtagtttcacagtatccctttttggttttggataaatttgcaattctaatactgacaacaattacttatgcagttgtagcctctaccgtttgagctgaattaaacggtacagactatccagagtgctgtagcaaaagtactatataaaagtttttttttttttgattctgctgtttgatcacgtagctgtgaatctgaattgttgatcatcaaaatatcaaaatgaagggctgaatatatatatacagtcctaagtgcagtcatagttatggctggaactaatctcaatcctcgaggaacgacaatacttatttttctttgaaatctgttagcacgttttttaaacatctaaacgatgtgtttcgtataaaaattttatctgtaaaattagctataaaataacatataaagttattttttaaaaatatgtaataactaaaaaataattaatcatacgttaattccctttctcttctttttacatgcccaatacccattaactctatctccatcttcaccatttcaaacacctctctgcggcgagaaaatggacatttagccacgtccaaaacagggtttcactaaaatgttatcccgaaaacgcgtttcgctaaaataccaatatgaagcgcgtgctcaccgccactttgccagtttggaccttttgtgcattttcgaa

SEQ ID NO: 59185 - DNA, 5321 bp, Oryza sativa
cttacgaggtgagcccatccaaaaaagtgtaatcgcgaaaataaagattggatccagcacgacgctgcaagcgaaatacaccctaagctacaaaataaagactggggagtatagtccccaagcatgtcgccctcagcgcatcagtaccagcggcaaaagtaactaatcaagcaaatttaaggtggcaaaccatgcattgaaaggatcaaaaacacaagacaggaggtttttaacacagaactaacaccatgatgtttagctggataatagagtgcaattctagtagtagggttctacaagagtaaactcaacaagacaatattgccatggacttcatgaacttggagatactctatttcttcttctcggtgtgagcgtgaccgccaccagacctgcatatcacaaaagaaagttagtttaaattgaaaacaaagcacaaggctaaagaaaatataattgtaccaatactattaaaactcatcccgaatgtttcattttcatgaatttaagtttgtcaactttataataccattataaaatgataaacaatgaactgtacacatacaaaagtgatccttcctaaaacatatagtatatctaagcaacaatctgcactgtgccttaacattcattctttgtttaagacacacgacaggtccaattatgttacatatgatttattatttcctgcgcaatacaagaaatttgtacttataatcacaaatgaacactacctttcgaaaaaacacacatacaaagacactaaacaatatagaataaataaaacaaatggtagcacagttctgataataaactacaaactaacaattacaactaaactagttcaaacaatattaataggcacaaattcaattgcaacggaagacaaggtaaccaatagaataataacaggtgtttttatcaaggctggaagattacacacctcatcttcctgaggacaccagccatctcctctctcttcttcttggccctcttgtgggtgccaagctttctctttgccaccttcagtgcacgcttgtccttgccaactttgagaagctcagtgatacgcttctcatagggagcaaatccagcaacctccctgatcaagttcctgacaaaggtcaccctcttggtggatttctgcaaattaacatgccaacaaggtaagtgcaaatgcaataggaaataatggccagtaaactgcaaagcagataatataaagcaggatcaaatcattgaaccaaacaacatataatagaaaaatagcaaccctaggttttatgtaatgcaaacaaaaaaaataacacaagtgcaccttggatacctcagagaggaaattctgttgatacagaagcatgacttcacacacagaaacatggcaaacaatatcttgtcagctgtaagaataacgaactaaaaccactattcccatcattttaatgaatatctaggcatacacatgtagactaattgctgaaataaaaaaaaacttgctcccccacaaatacaaaggcaaagcaagaatagtacaaggggaaaaaatacagtaccaccgccatttctaaatacaaactggaaaaaaagacagaaatgaaatgcatactaggattgagaaggttgaggggtcaactatatcagtcaatactagcaggcatcacgccctctgcagcatacataggatccatgcaaaaatctcgacctacaacacgaatctacggagagaaacgaagctacgcactaaatccacacagatcaaacacggacaagcatcaccgcccagctcgtcgggctgaaacagctcgtgctacgggatcagaggcgcttacccccttgcggtcggacgggcgaggcggcagctcgcgcttggtgacgacgtggcccttgttgatgcccacgaagagcccggacttcggtgcgacggcgccatcggggagccctttttcctgcacgacaagcagcgggagaagatctacgtgagcggcgccgagggaggagagaggctagggtttcagatcggaggcggaggtggtggcggcggcggctggcttaccttacctgggagaaatgaagcggcggcggctagggaggaaaccctagcggaggagtgctcttatataggcgcgcgccgcgtcgcggtatccagggtgatagacgggctgggctaaatgggcctttgttgtgggcttgtggccatgtgatttccttgtgtttttcattttattttgggatggaataagtctatattacctccgttatctcttccttctcgttgaatcatctctcttaaccgcaaaacctagtataacgcctctcctatcttcgaaaaccaatgcaagacgatcatggttgattcgctgagtcagcaggtaaggcacacatgttagggactatcctctcctctagtttgcccctcacccacgcggtcttcgccttgtcgtcgtcctccttggccgatatgaagtatgagtccagcataccactatcggcattatatccgagcacgataacccacccccctgcatggttgtggagcaacgggtcggcactttgcagatttggtggcggtggcgatggcccatcgtagggcggaccacatgttgtcgtagcaggcggggtgctccggcgtgaggcagtaattaactaacaacacgaggacacaccgtcaggagtagaggcagttggcaaaccagtgctatagtgcatccatgggcgagccgatgatgaggttgtcgctatggaggtacaagacaacgggtagtagtttcttcttgccgccgcaaccatcaaggtcgagggaagtagaggcgcacccacggttcgatgcctgggtcgatggggatatcgcctccccgcgacgccaagggcaggacgtgagtgttcgggaagaggcactctacgctactgctttgatagcaccggataagcggcacgaacttggacgtgatctcgtcgttgctctatcctatatgcgcgacgcagagtcgcgcatatgcactttgtgggttagtgaggaacacgttgtaaccacgccctccctcccgatggatcaattcgtccccaccgagccctgctccaccgaccacctctctttgccatcttgtccttttcgtgttctcaccaccgtgccacatgtccacacttggggtggaacgaggaggaggaaaggagagaagtagatgaagcagatgcagagctgactagtggatcccacacaacccacctccttgatttacccacataggaagaagacagagtcctgacatgtgggccccacccactaacttagcgagtcaaccgtggtcagcctgccacataaaaaaaaagctctccgcaaaccatcgaaggagttgatttgcactaattttcgatgataggggaggttatttctggttttacggttgaagtaggctattcaagcatggaggaagagatgagagaggcaaaatacactttttacttttgggacattagagaggtgggccacctgttgattagggaagggaaatatgaactgggctttctcgttgagctttcctcgagcaaaggcctttgtacgtcattgatgggccgtcaaatcactacagttcaatgtgaggtgcttaactgcttaaggccacatgattgggcgtaaaatcaagagaaaatctcacgtgtacctgaaattttacccaatctcttttgtgccccggagttttgcttattttcttatgtacctctgaattttagtttgcatatcttccatacctgtttcattagttgatcataagttgactattgaattcttatcaaaaagtccattttgctattgggtatgaagaaacatataaatttatcgagtactataattatgatttacgacaaaaacgtagataagacactataaatatttatttattagttactaaaaattgtttatgtagcaaataaatagatttgtcttataaaaaatatgctgcagtatcgccatcaacaaaaatatgcttacttatacaatttaaaatttaaaaaatagttataattattttattttatatctaaaactaaattttatcgtaaacaatatctcgaacaacaaattcatagaaataaaagtctcataaaaaaaattctatactccaatagtatattttataatttatacatgtttcttcatatcaaaggacaaaatagtttttcactaagaatttaacggttaactaaacggaaggggtccaaactaaatttaagtggtatgtaaggaatgagcaaaattcagaaacataaaaggaatcgagcaatgtatcataggcatacatagaattttctctaaaatcaaacatctatattagccatatagattctcaagttctcaaccgactatctttttggattacgtgacttggtagctcggtggaatcaagaagtgaacttaaaacatctgtgctgtttcaactatggttttccagcgtcggaacgtgtacttaaacatctgtgctcggtacaaaaaaaatgctgtttcaggattaacgtccgttctacccccagagaaacggagagacagacagaagagcgaacaatctgttgcaacttgcaagcatcaagtataccactgcacaatatgcctatgcttacctgcaactgaccagcaatatcctttggcactactcttcttgtttacgggcacacagtagtaacagtggtactgatcagtaggcacgggctgactactagtcatccccattaacactaaccactgtttcccatcactggtgtagtagtaggccgctgggtttgagctgtgaacccctaatcatttcgtgagcgagacatggtgtacgctagctgtttatagtccagtagtacaattattattatggcaccggctttggccctatacaccacgtgaccacccatacgagaaaaaaaaaacactctccgtcccaaaataaatactatacaattagtagatttatgtgttctttactggctgtcttatttaaagaaaatttatgaccgatattttgattgttattatatgataaaatatgaatagtattttatacgtgacttaatttttaaacttttttataacttttttaaaaagagaatagtcaaacgttgaacatagaaatacgttaatgaatttattttacgatagagggtaaacctgcaaggctgcaccccgtgcagtcgtacttgcccaattgcgacggcttcccaggatagctcccagctaaaaccaagcacgagaaagcccaaataagccgtatatcatatatggacatgggcgtatatacgcatatacttcctccataaaaaaaactcaaccagctctctta

SEQ ID NO: 59186 - DNA, 2184 bp, Oryza sativa
ctgttccgccagacaaagagccaattggggcttggtaaatctcctttgtgtgcaaaatcctcgtcataccctgggccaccctagagtccggctcagaatttagggatgtgttttgtcagatcatgagcagttcatccacctgagcctggcagcagaagacagcctgggagcaaactgctcgctgaaagctccactgcaaacctgcgccactgggaaactattttgattccctcgagggattgaattcaatcgtttgtttaaaaattatctacacagttatatttttttttcaaaaaaaaattaataacttttatacaacatgcatatgatactttacaaaatctttcaagcttaactcacgcatttagatataaaaaacatattcagtaaataaatagcagatgtatttgtaaacaaacttagtaaatgtatacttatctgaatttgttttttttctcaatgtgccgaatttgaacttgatttaaaatcaaaggctgatagaggtcgctatattatatatttggcattttattcttatttttttataactatttacattagatttaggagagaaaaaaaacacgagagacattctcgaaggattttgaatccattccaagtagtagccgtagttgcatggatgggacgccggaacgggatggcatcggtagcagcacgggcatatgcacacgttctgtctggtgtgggcaaacaccgtcccgtgctgatttatcacgatctaacccgtactccccgttaaaaaaaccaatctagatgatgatagaatactactagatagatatgtccagattcgttgtactagatggtgtcgacctatctccatataggttgaattttgtttggacggagggagtacgtgttatcccatctgtaagtacaactactaccaacaattattcctaaggtaaaatgtatgatttcgctcccttctcttttgaatggtggtgaatctgttaacccatcttcttccgtttggaaagtatgatcattttatacgtttttcttgtgagaagaaaaaactgcacacttgcattgcatctcatgttatgtaaaactggtttgttcgtacacttacatacatacctcgcatgttgcaaataaagaatgcagaaaaaaggagagagaaaaactttggcaatttgtgggcaccggagatgccgggaaggtattaagctactataaactaatgcttgtttcagttcatgcttatcagccatacctgcagtgctcagcaacaccaatttggtgtctaaaattgcttccctttggctttagtttttctttcctacctttgattggcaatggcacgcggacgctaaggactattcgtttctgcattttctttacgagatttccgcttaaagcagagaggaatggaattatttttctccttcagtgggatccttttgatctgatttaggacggttagatgctgacaagcagtgttctttatgggggaatcattagcttgacgtgttaataaattatcgaattattctgttgtagtttcacatcatgtgatgcttagccatgaggagaaattctggggaaaaaaaaccctattgctgtcttgcagaattggtttttatcagattatcaggcaatggtgatgtaggatagatgatcctgtctgttgcattgcagctttcatgacccaaaacatgagtaaaatatggaagggaactggtccttgttttctgcttttggacttgtcccctcgaactaccaatctctctttgttttatctcacatctaactacaccttagtttggtaagactgaatgtctgaatcactaatatctgatagaaaaacaagggcaacaccataagaaactactcgaactagcaagtagcaacaaatctatggctcactgtcagggaaataccatgcaaatgtttatgatttttttttcaaaatatttgacaatatttatatagcataacatatacaattccacgatattccatgactcgactccacgttcttttccacttacgtattatggatgctaggctttcaaaacttctgaatggtatagttgttacaaaaactttcttcattggcgtttcttaaatattttttgaacaactttttaatatttaattccttcgtttatgtcctcgaataacttgtcttttaactcaatttcatccataacccat

SEQ ID NO: 59187 - DNA, 1977 bp, Oryza sativa
cagaaatccatcgcgccattgtaagtacatttatcacactcacgctcgctgtcgtcatcaacctctgcaaatctcgacgagctcttccgggccgtcggattccgcggcggcgatcttggacgccgccgacgagaggaaccggaagccggcgtcgctggcgctcttcctcaccgacgccagctgctgcgacctcttgcagtaggcgatcagcccctggatcgggttctccacctccgagctcgcgctgctgctcctccgcagcgccggcgccgccgcgccgccgtcggactcgctcgacgtccgcaccgacgaggaggaggagcacgacgacgactgcggcgcaggggacgtcttgttcgacgtcgagtaccggacgatgacgctggagaaggacctcctgtggccgccgtggtcgcgctctttgtgcttccctcctccgaccgaaccacggccgccgccgctctgtgaggaggcgatgcacctgttgcttctcatctggccgaacgggttcctcctccatgctctgtggtggtggtggccaccatgggagagttctttggtttctctcgtcgcgccaagaatggcgtccttgtcgtcgtcgtcgccggagctcgccggtttggcggcgaagatcgtcttgatgtaggccttggaggccttgagcttgaggccgaggttgagctgcctcatgaacctgagcttccgcgaccacggcttcttctcgcacgccgccgcggcggcgtcggcgagcctggccgcgtactcctggaagtactcctccacgttgagctccccgctggcgtagcacgagttcgccggcgacgcggtgcacgagtcgtacggcgtcgccggcgccgtgcttatggcgagctgccgccgcccggcgccgccgacgacgacgcgcccgtcgagcagctcctccaccatctgtatccgcggcggcaggtgcagcggcagcagcttccccttgtagaacagctcgtccgccggcgacgccagcggctcctgctcccaccgggcgccgccgccgcccagcggccccgacatgtggaagtcgaactcgaactcacccggcgccgtcgccgcggcggcgctcgtcaggtccatgtcgatgtagtcctcctcctgcatcgcctcctgctgccccagctggtgcttgctcgccattgccaaggtgagagctcgtggctccggagctgaagctgagacaagagggcaggagacggtggctgcgtcttgctacttatattagccgcttaatcatggtggattaatgggcttagagcaaaaatggacacttggacagtgtcatggcatcaaatgaggcttaattacaaagtataaatactttctttatccttatttaatcatcacctaagattttcgaggtcttttcaaaataatcatcctataacaaatgtctctttatttgtttgtgtaaagagtaaatgagcatcattgaatatgctgcatgcaaccaatcaagattaatttttattgatgcaactacatgcaatatttaaaacttggtactattcacgagacacgaagcaacataccatcttaactaatgagaattaattatagaatgatggaaatttggttgtttcagtctctgtgtttaggtgatgatcaaaaataggatggaaggagtatcttgtaactttatatgtattgtgattacaggcgttttagcacataacacgatattccggatgccatgatcatatatctttaaaaaatcatgccgtaaatcaattgttctttatttcaccatacttaaaatcaaatcaaatcttgaaattaagattctttttattaaaaaaaatttagccatgtcagttaagattctcttatcttgcttaactttaatagttttgcacaacttaaaccatataaaggggttaatgaagtatgaaccggattaatcatactattatggtgggccctaccattagccgtatgatctgcctcttg

SEQ ID NO: 59188 - DNA, 3202 bp, Oryza sativa
ggcgccatcaccgccgtgccgtacaacgggagcgtgctcgccgtggacggcctcatcgtgccgtccgggttcgacctcgcggcgtcggagtcgcggccccccgccgccgtcaacatcaccaaggtcctcgccgacgcgcgggccttcaacgtggcggcgtccatgctggaggcctccggcgtggcggacgagttcgaggccgacgagcgcggcgccggcatcacggtgttcgcccccaccgacgacgccttcgccggcctccctgccggcgaccgcctccagtccctccccgccgagcgaaaggccgtcgtactccgcttccacgtcctccactcctactacccgctcggctccctcgagtccatcgtcaaccccgtccagcccacgctcgccaccgagttcacccaggccgggcgcttcaccctcaacatcacacgcgccaacggctccgtcgccatcgacaccggcgtcgtgcaggcgaccatcacacgcacggtgttcgaccagaaccccgtcgccgtgttcgccgtctccaaggtgctcctcccgaaggaaatgttcagccgcagcgactccgccatcgtcgccgtcgcgtcggcgcccccgccggccgcgctgccggcggaatcacccgagagcgcgccgacaaagctatcgtcgccgccggcgctgcgcgacaccgccggcaacgcgaaccacacggcggcggctgcggcggtggcggcagcggcggcgacgacgaaaccgacaattggccggtggtgtatagcattgttgtatctactactactaccactactgctacctctggtatgagatccggttcgtttgcttgtccattaccatccttgttgagctcgaatttttgcttttcttttttcttttctttttttttgttataacctgtacactggggaaggggagaagtttgagaagaggtgaattcagattgagctgcaaagcagcattattattattattttcgctttctttttttctttttgttcttaccagctgcttcatgttggcaaaagggaaataatagtactagtaatgtaccatcctgtaaagatccaatcgattccatgttcatgttgtgcctgatggctgatgcttcatcatattcatccccatctttgcttggaagatttgcatggggttgggggaagaaggtggtcaagtgaccggggaggtgacgggagaggaaaggagcagggtggggggtggcagtgagctggctgggtaggggacgccgcggccgtcaggccggcgtcagcgctgccccgttagattcgatcgcctttttttttcccctctgctcgcgtcgtcgcgctggcccttcccttgcccttctggcacttgttgcgtctgcttcttgtctccctgccacgtcaccgcccggcaggaattccaccagagctgatagccccaggaagctgatcggacggctgagatgcaaccctggtagtagtactcgcgtgcatcttcttgtgaaacgtgtgcactcttcagctgttaatgtaagctgtgaacctgtaatttagtagtaagagatactacctccgttctaaaataagtttattttcacacatatcatgtatatactaatatatactaatataaaataaaaaatagaatatttctacttcatcaaatcccaattcaattattcattattttatctacttcgaatacaactagtcacttagttgtgctttgcgtgactctgagcgtcagcataacctacctatataattaggccattgatcatgacattaattgaaggtaccggttttgtaagtatgttaatttcttcgttctcaaatgtactccattaattattatatataagtatttctagtttttttagtaaagagtaagattaaggaggaatgatttgtttcaatcacttactattaaaatttgaactgctccaattggctctttccgaacatctgattggctaaacatttggctaaaaatgtttagatatgcattgaaatttgtttcctataaatgcttatatttgtatgtaaaatttgaatgatagaaaatacttattttgggaatgatacagtagctagagatgtaaatggtggaatgttgtaattgattgacattaaaaagaaggcgaagaaattaaataggatatgactatgttggttaagatgagggagtagatgtagaaatagctatattttacgataaattttgaatgttaaaggcacctatattttagaacggagacatcaaaaaacatttaatgctcctaagtccagggtgtatgtgtgtgtttatagggattgttttaaaataaaattggtacatagcggatgctgcttagctgttgtgtgttgctccaataccaagcaaaacaagtgtataacagagtatttacatgtacactcttgtacattatcgatataaacctgcatataaattcaatataaatttatggctaaggcttcatattttttcctttatttagtcatgaaattaattaagcaaacgtatatatagtgtaaaaagacttctttttaaacagcggtattaaaaaggctaagtacatgtctgctttttgagatctttagtctgggagcatccggattggtccaacatgtttccattatcatatatgagcatgatgatccaacggtgcatttttatttaccagttcatctaatggtccttaccattgtagatgatgatgtgggtcatcctcctttcagaaagcttgttgctttcatatatttagactatcgctattccatgaatttcgatgcaatgattactttaaaaataaatttattttagataaatgaaacgggctaaaattgaactcattacggaaaggaggtagtatttacagtacttatcctaaagcaatgtgttccaagtagtcaaggggggccctaacatagtcagtcgatgttactctacgtaccagcgagtatgggtttgcctaacatccgtgaagacaagatgcttcttggttcagtgtgagctggtgatgttttgggtccattcgccgtgaaatgtcgcgtggtggcgcgagaagacttgtagccttgcagtcttgcgagggttcgcgcccgggcagtgcatatgcgtgctgtggcccccccgctttgccggcgtttgccagcctcgcatgtgctctgctttcaggcaccggctgactggtagtgcccaaccctaattt

SEQ ID NO: 59189 - DNA, 1356 bp, Oryza sativa
aatattctttagatgattgtccattctataggaatttcgttggatagaataggatccaatcctttgctttaaagtccttcatagaaaatttttctacaggattaaaatcctcaaaatttatatgtttttcctacaaatcaaaggccctagtactgatggtttatgatctcagggttcagaaacctgaaaaccccatgccaattgatggaacacaatttgtggcgtgtctattgaagttgtcaagttgagtgaattccgtgtatctccaaattttacccaaaaagttactactagtagctagctaatgggtaaaggcggacgattcatttagctcatttggagttcaacgctcctcacgtagaggttcccaagttgtaagtggactgtagttgtttttcatttacaagttgtaagtgtacattattttatttaattgcgctggtcaatattcaaaatggagaactctggtttgatatcacattgtgatacattcttcgatcgaaaagcttaagccgatgagcaaatattgacaaatcaatcatacttgttaggaatggaggagattttgtagaattttcacatcgatcagtaatgaaaaaaagggaaggtatacgcagttcggacctttctcttttgccaacgagttctcgcggtgattagtacttttatttcatgatatatgtatcctcgctgcacgtaggaggcctcatttggaacgtggaattttagagaatttttgcggtagtttaatttatcatatactcccttcatctaaaaagaatcaataatgtatctaaacaaaaagaatcacatactcttctagattgatttttttttaagcacggagggagtactccagtgcagcaaaatccatgtgttctaaaggagcttcgaatctgttttactggaggttttcatgaccgttgagattgttgaattgaggtgtacgggtatgtaatgttcgttcttcatttctttccagacaagaagactacggtgcagttatcactgtccagtcctctcctcgctgcacaacagtaagtgtcctgttcagcactgttctatcacgtctgtgaggctgcttttctcgtactacaaaccgatccgaggtgcagttgacattagcactgccatgccacgccacgcaggatgcgactccgatacgcgtcctcataaacagaagggtgaataaccaaatatgaccttgaactttcacttaaggatcaatttagtccttcatgtttcgtattgtccaaataagtccctaaactttattgtgtgatttgatatagtccttggacccactaaaaatgccacgtgtgcatgccacatcacctgcgcatgcaaattcaacat

SEQ ID NO: 59190 - DNA, 2539 bp, Oryza sativa
tgaactttttttttaaaatttttttaccctcttccttttatttttgaaccttttaaattttttttattataagttcaaaatgcttatttcaccttcttatttttccttttttaaagttcaaaatggatattttaccctcttctttttcctttttgaacttttttttttaaaaagtcatcacaagttcaaaatgtctgtttcaccttcttattttcccttttatattaaaaactaaaatggttattttaccctcttccatttatttttgaaccttttaaaatttttttatcataagttcaaaatgcttatttcaccttcttatttttcctttttaaaagttcaaaatggatattttaccctcttctttttcctttttgaactttttttttaaaaaaagtcatcacaagttcaaaatgtttgtttcactttcccttttttaaattcaaaatggttatttaccctcttcttttcctttctaaacctttttttttttacaaaaagtcatcacaagttaaaaatgtttgttttaccctcttatcttttatttccaagttcaaaatgcttatttttaacctcttattttccctttttttaaaagttcaagatgcttatttcaccctcctatttcaccttttctaaaattcaaaatggttattttacccttatcttttcctttttgaacttttctttaaaaaatatcataagttctaaatgtttgttttaccctcttttttttttcctattatcaagttcaaaatgcttattttaccctcttttttttcattttttttcaagttcaaaatgttttccttttttttagaattttgtaatgcttattttaccttcttgttttcccttttttctaagtccaaaatattaccagccttccctctcaagcaccgtcaacacagtctcacttctttggggagcgtctgtgtcatggccgtttggatctagccttcctactagtggatctagggccctaccaccactctgcaaccccagagcagttgttgtcaagccctccaccacctctaccctacgccgctgctgctctttcgctgagatgtcgcccctccctcgctccagtcacgcactagagcggttgcttctaaacaaggacaataaggagcttctatctcaggagagaaaggagaggtagaggaggataagatcgaaactgagtgttgggggagggcttctatcgtgggacttagagagtattttatgtttgttaaccatgccacgtcgattcgttggtcattgcaaactctatatatactatatagggtgttgcctgtaaaaattgattttgacagacaattccttaagagggccgcttataaaactgttcctatttttttcaagcagtcctcttaaaactaccaggtagggctagaattatggggtcttcagttattttagaagtggaaattttatagtccgccttataaaaatcaagcctagatgctgtgaaaaatcgtttttctggtagtcttctcttcatctttctttttttggctaacaagttcaaaatgttttctcttttttttacaagttcataatgcttattttactatcttattttccttttttttccaatttcaaaatgtttattacagctcatacagttttattgctgccctctttatttcaagttcaaaatgcctactattgctcattcagttttgctggaattgtcagctcaaattcaccatgcaaaaccgggacgaatgcaaagggagaaaaaaaaatcccctacgcctgctccatctgggtgcccaaaatttccgcccaattcttgggctttggtacctcagccatatcggttatctgagcccaatcaaaacgccctacacatctcccatctccacccgtccatttttccaacgttctagatccatccaccgatctgtggcctctccctcacgaccaatcatgtcccacctctcccctctatatatcccccctcccccatcccataaatcaatccccacaccatgtcgcaacgcatccacttcctctctcgttgccaattcgagtcttctcaacctctcgatccgggcgtgatggtgccgaaggcggagaagaagccggcagagaagaagccagcagaggagaaggtgcccaagggggagaagaaacccaaggcggagaagcagctaccgacgtccaagtagggtggcaccggtgacaagaaggggaagaagaaggcgaagaaaagcgtggagacctataaaatctacatcttcaaggtgctcaagcaggtgcatccagacataggaatctcctccaaggccatgtccatcatgaattccttcgtcaacgacattttcgagaagctcgagcaggaggccgcgaggcttgccaggtacaacaagaagcccacaatcacctcccgcgagatccagacctctgttcgtctcgtcctccccggcgagcttgccaagcacgccgtctccgagggcaccaagggcgtcaccaagttcacctcttctaaattggtagcccttttcctttcggtttgtaattgtcaaca

SEQ ID NO: 59191 - DNA, 5216 bp, Oryza sativa
acaacaaatatttaccactgttactgtggaagcagcagctgaaatatcctcaatttctgcaattggagacatcataggaatcatcaatcttgttaagtcctcttccttcatgcccactgagatgatcccagaaccattcctgatcatgaatgcaatagattctgggtctgccagcgtagctgccatgacaagatccccttcattatcaccgctttcatcatctacagcaataacaaactggagaagaatgaatagttaactttgtagctaaatttaactacacaagggaaacaataataatgtgactgtacaacagtacaaatgaaacaacaataatgcatatgcatgggtactgtcctgaattttgaagtgtgtagagccttgctagttgctacacgaaaatttgagtattacagtatttctattcagcttatcattttgaatgaaaatgtggatgaaaattgaaacagcattataaggacagcaatatggtttgctattgcataaatgcactacagcttggtttcacctcaccaagcaaagaatattgtgatggaaggctggattgctggaagaaactaatgtcactgtgcatgtatttggagtattattgtgcatgtagaatggccttaactttggtcttgaccatacatggtccatgtccaagaagtacatgagtggaactattttgtcttaaactaggctgagattggtaagtgaaaagagaagtactgagtacacagatgaaaggttaaagacgtgaatagatattacatacctttccttcatgcaatgcgcctatagcctcatcaatagaggaaaaaccatcagttggtttgtctgggtcaccctctgcatcgctaacaaagaaatcaccagtttcctgagtgattttagcaccaacagtccgaaaggaagcactagatccattgaatccttgcaaaacaggtccattattgctttcctttaaaggatcattcaaattctctcctcccccaagtccaccaattgcataacatctcaattttaagctcccctttctgataacagcaaatcctatgctgttgataccaccgcttccttgttgaaccctgaaagatcagaataaccagaaaattacagagaagatatgaaattttatgatcccagaaaatttcaacaagaccttttgcatagacaaaacaaagcgggagaatcataccttgtgttaacaaccgtttgtgatgacaattgagagctcagaagaacacggtcatttggtgatcccggtaaaaccgatccacgctcctcaggcttgtcctccgagatattgcttatatacctttatcttctaaagtgtcacaacacctctcagcctatcatttggagttatctgctcatgaggataacacagggaaaatccaacaatgtggaggcaaaagcagccacatattcagagctgcaagatagcagctgccgaaccggcacatcacacactttcaggagatgccaagataatggcatttgattgtactcttagactccagtcaaatgcaactgaagttggacctgataatgacaggcaggttcatctttcattcttttttggatgatttatgccccccataatgacacttggaggccaatggctcaatgcccatatgatgatctcaagaagttattagggacttgagaatttctccagattaagccattttctgaggcaacagaagatcaccagattgccaaatgagtactcaaaactttcagaggcacacagcgagagagccaagcgtcccatcgctctgaaacttgcatagtgtgtcgtcctagtactacttcccctaagaaatgcaggtaagcgaggtcgcgccccgccgcacctgccgatgccggggggcgcggtggccgtgcgctgagccagccgcgggcgtcgactctccgagggcggcggagagagcgcggcaccggcgatggccgccgcgccatgggtggagaaggcagcctaggcgccacggcgacgccacgccgcagcatctccggtggggggaagaggtggatttcgccattttggcctttttgggagagaaggctctgcttgatgatgcttcgatgatggatggggaaatcaaaaggggaccaacaaggattatcgcaaattctgtgatatcatacgagataacgactcaccagatgaacctttgattctgtacatgagttagactggaaaccttttttttttctttttggcaaaatgtgctaaaacttgcttcctctgtttcataggataagactttctagtattgcctacattcatttagatgttaatgaatctagacatatgtatgtgtttagatttattaacatctatatgtatgtgggcaatgctagaaagtcttacattgtgaaacagagagagtaagtagtactccgtttcatcggatgctttgaactttttctaagtcacttcttttactttgatctgagtttatagaaaaactaatttgagtagtagattctaacacatactaacactgccatcatattagagggtgaaactccactctgacaacgattagtgaacatggatttgtaacagacattgatcgctaacagaattatcatatagaacaagtatcttgcataatgttattcatgttctaaagatcaaaagaacctctcaacaacataaaataaagctagagaacgctctggtttgtcataagccttctgctccggagttctggctgattttaggacctgcccattgtttgctggcgagtgacttggtccatggatcaagagggacccgctgaggtggctgtggtgttgcaggttttgcctctcgaagttcattctcccggtcgacaaacctgtgtatgatgacatggccaattgaatctcatcagtcatcatgacagtttcctgattgaagttggttcttttacagtttactagttaaaaaacaagatgaagaaaacaaaaattcatttcagagagtagcagtgtagcaccactttctaaacatgaacaccacaaaaagtaaaccagtgtatcgatatgaacttgaagtcgataaacggatttattagaaagaaaacacaaaaagggatgcttgccttctgcaattcttgatttagtgaaagaaacggatgattttttttttgaatgcctgaaacggatgaatagaatagacatgaagggtacttgtctgttagtccaatagttacaactttgaaatgaatatgaagaaaacgaattgcatcagaccagaacacttgcaacaaacagcaatgagaaattcaaatgtaaattttgaattttcctagttatggtaaacaaggaaaagacatactcaatgtatgccattggtgcagcatcgccaacccgtatcctagtccgcagtagtcttgtatatccaccagctcgatctctacaaacaaaggaaacataatggacatgcataaggtaaatcttgacagccaagttcctttagacatgctagccagaacaaaaatcaaaatcaaaagtgaaaccaactcatagcgggctaaaagttacttgtagcggtaggcgagttctgtgaataacttgtgaacaacattgtcaccccgaacaaaggctgaggcacgtcttgctgcatcaagcgtaccctatagaataatagaactttctaatgttaacataggaacggctttgacagtaagaacattaagagattaatatatctggcaaggacatttagctcatgatgctctagacaacataaacgatatttcaaatccaagaaattccccacattagaaatctgtggactctctacctcattctgactgagcaccacttggataattggaatgtgacaagttagcaacattaagaaaaccattttccaagattccttgcttacatggatataaagtactcgcatcgtcacaaaatcagttacttttgaagcctattttttcttaagccaaagaatttgaacaatatacctcacgttacatagtcagaattttcatcgatctgaatcatttactaatggcaggattaccaacaacttgtaagtaaggtacaatcactctatattatccggtgatatttttttctttccttttgttgtggtcaaatacataaggtcaaatcatgtaagtctgctaccgcctacggcccagcaaaggatgagaattcagaacaagagttgcacaagaacgagaatttccagcttgagttttcatctcgacagaatgtatacctctttgccgagctgcaccatctgatccgctttcgtccgcacctccttcgcctgaaacgtcaagaagcaacacacagaaaagaaaaaaaaaaatcaaatttcctggcgcagaaaacctgcattcccaccgctaggtgttcgacgaaatgccggaaccacggagagacaggacgcgggctaccttcgcgacggtggtctcgatccgctcatgcttcaccagctgcgacaccatagtcctgcccagggaaagggatagagaagggcaaagagagagatagacggacagccgtgggtcagggccatgacttcagcgtgggtgcgacgaggcgaaatggagaccggggagatggggttggagaggcggagaagccagacctgagcatggagacgcggtgggcggcgtggcggcccagcttggcggaacttccccatggcggcggcggaggggggcggcgccggcgggagagcggccccggcggcgagcgatcagacagtacagtgtgaaattcaccaagttgcactttggtaggcctcgtcgccgtttgtgacagagtgctacgtttcatgggcctttacagggcccaataattctaattgggccatgtcctaatgtacagccaacctactactgcctctatctcagtttgatcatcgtcaaaaaattttaaggtatttttttcaaaataatcatcatttaacaaagtgtctattgcttggttttgcaaagagtaaatgtgcatcgtggaatgcccggtatgcgcgcaaccaaccaaaaataatttctgttggtttaacccatgcgatatttagagtgtgaattaatttctgttggacacgatcactttcatcgatgatgattaattttagaatgattgatgttttagtgtcattgttcttgttgttctttacttaagggatgatcatactgggatagagggagtatacttcagaaattcagattttgtttggattgaagcggggg

SEQ ID NO: 59192 - DNA, 2634 bp, Oryza sativa
catgcaggtacagcttcatccacagaaacgggtagactgccagcacagcctgcagcatgaggaaggtcagctagcgatcgaattgcatttccatcagcagtgttgcatgcttcagtttcatcacattatctgaaaaaaatgtttcagtttcatcagacattcacaggctatggcttgacctaccactaggaaggaatggtagctcatggagaacttcccaaagaagccagagtagagtttcctctccttcacaaatgggagagcttggtacatagtccacactgcggagatggcaagaaaagtatatttacagcaaaagactgcaagattagtaggtgtaaagagaggggaagtttggtgggtgagaattttggaattggcttactttctcctgggcctactccaattggatacagcggtataaaggcagtgtacctacatggtgcaaataagtagaaagggttaattagtctctgatcaggagaacagcagtcacctggaaaaaagaccataagcagcgcggtaaaactagggactggtaagcaacagtagtactgcagttaaacattgtgatccattattatatcatgtaaagaaacaaaatcaacatagcagcgatgtactggcgattttggagtaggaacaatattagatgaacctggatataaaaatgacatgcatggtgattcattttaatatcccagttaatagttccagctcagtgatctttctgtagcttactcaatacggttattgtaatttgaacaacaagtttgcaattttacaacttcttttagaagacagaaggtaaaacaaccatgatactgtgtccatctttctgcttcctatgctggtttcagtgcaaggtgtctttaaacggaaaataaaaatgacctgtgaccaaaaatatttttgaagaatggagaattgtgtaactttctaccaaaaacaatagaaaacaaccagaaaatagtggaaaacaagaggtgtactgggcaccgagcctaagagaagctactaagaaaatactgtggatgcatccttggatgtgggaactggagttcatttgcaaatcaaacctgagatatgttagccatggtggacaaacttttaaggttgtcagagcataatgtgagtatctgatgacctgcaccatgaagaaattagacttcagataaaagactgaacaaaaatagcattgtcttgcgaattatttcaaaataaggtaagtactgagtaccattgagttaaaccaaaatgtagatgcctaaataatgcttttcgttcacatgcacggaggttagtaaaagggtattttcgtgtcatagaacttggaaacatatttgtctgtcgtggatttcagttggtacatgcacagacagttctattcatgctagcatttccttaggcagtagtaccagctcaacttatcctcttaacagctaaacgtagttgtcagatcatccctttcaacacgtaattgacattttaatatgaatgaaacaggtgaaataatattagctccattggcatagatcattgtgcagtaaaatagaaacaaaatatgtgcatcctgagaaggttccaccagaaatttctcgttatatcatgagattgcatcatagaaaatcattttttaatgtactcaaaaagcatcagtattgtttttatgagaacaaggcaaaccacaaaaagaggagaaaatgatgtagtatcattttgtgccacacctcagatatgctccaagccatgaacgttatgaacacggaagggctactctgaacctgcatttggcacaggagactaaattagtaaacctaagttgaaaccttgagaggcactactgtaaaaaggtaataacagaaaatgtatcattggaaattttataataaggaagaaatttccttcttcactaggtcgaagtgcaaattcgtttttgcggttggctcttccatttacacatgacaaaataaaaaacacaaattctacgggattttcacatgaatttgttcaattcctccaagaatcccgcaaaattcatccgttccaaacgaagcagaaatttgcagtcctccccacctcggggatttgccgaaccacagcgagaacgaagtgagtcctccctccccactgcaagaaggcaagaagcggcgacgtgtgcaccaatcctgaatcaaacagcaacgaatctcctcgtcaaatttcacatcaaagagagcggcgcgcgaggaattcagcggctcaatcaacccaccgatggcggcatggatcgtttcaagaatcgcccacgtctgcagcaagccttgaaacaacaagaaacgaatccccaagaagggggaaaagaaaaacatcactccctccgctcgtcgagacgagaccaaatcaaagacatacgaggaagggcacggaggagggatacacgcacatacgaggtcgccggcgacggcgtatgacgagtggacggaggagggaggggcgaggcagggcagcaggcggagcaaggcgacgaacctgcagaggaggaagccaaaaagaaaaaaaaaagaaaaaatcagagcgaaacgagggattggacgcacgaacgcagcgaacttctcggctgcgggtggagtaccatccgagggcctggacgga

SEQ ID NO: 59193 - DNA, 888 bp, Oryza sativa
aggctgcagtttacaggcccagcaccagatggcatgcctgtaatctgtgtttcttcacaagcactaacagcaatattcggtcacccgctgcatcattatagaagaaccactcctagttcccaatgttttggacagtgaattttttaaaatgctctcgtactgctgttgatctagtccttggtttgtcagcctgtcatccattttccgttgcaaagctaccaattcctttcagtctttgagcattcacttgttttgaggcagtttgatagcagctctgaagtcctaacatttccctttctgttttttttccctgcctgtctgatgtgttcccattccttattacagtaggcaaatatcgtaatgtagatatgtatcagttcctaatgttttctggtttgagcaggtgttctggatactgaggaattggctgttgtaaacagcacattccgcaaggcacagggttccaggttgcctggaatcgctgaggaaatgaggaggtcaggggagtcaacaacttcgactcttgaaagcgaaagctgggtgatggaaaatctggagactgagctgtttgacaacgtccgtgcttcgatccagagatcgcacggcaatcctggaaaagccccaggtgttactgctgttatctcaaaacccccgaagtccaaggcaaatgttcctcgtgttgcaggtaagaagcttcttctgagttttattatctgttggtttcatgtttgtaactgatgtagttattctttttgctacttccagcaaggaagggggttgatctgatgcctcagagtaaggtatatagcacaattcatatatggtttgatctaaaattatagtccttgtccatcactgaccaaaatttttcgatgcttgttcagataa

SEQ ID NO: 59194 - DNA, 721 bp, Oryza sativa
ccaagtacgcagccaaagtaatgatgatggctatcgttattcatttgaaggtttgggcatccaagaaaacaaattatcttttggacactttgttgagattgagtaacatttctattactctattgcagttgagaagaaatacgatagtaataatgctgaaggctttgaatctcatcttgttgctgctctaggaatccagtgggctcatgctgtaactatacgtctagtctttgaggctcactcaggtctgtctaattatttttatatttcacaatgaaacagacacctataaatattattaacgccattttcacccaccatctgatatgctgcatgacaatgcaataggaaagtctcaactacatttgatttcaatttcatctatgtacacgcattatttatctccttacacctttattttattatcgtataccacttttgatatacactttaagtggcataattaaacttgaggaaccacaacaatgtttattgtcttttgaacttgctctgtgtaagacctgtacgtaaggatttggtatagctttctgcattgaatgcagtggtatagcatcagtattactagttctttcattatatgtttaacaaatcaaatatctgttttatatttacctgccgtggtagttttgtatgagttatacagctgcacttgtataggtcacaggtacatcaaggtagctaaatcccctatgaggcgcag

SEQ ID NO: 59195 - DNA, 4277 bp, Oryza sativa
aactcagattgttttttttcttttcctagataaattttattatgtatagactaggttatgtgatctgacactcgactctctctttctaatataaactcttcaaagtatcctacaagatacccttgtatatattaaagatattttagatccaatgcgtgatttacttatacattgcacacgttgtatgcatgcatttacttcctgtgagaagtagagaactgagaattggttcatttagtcgggacatactttttttaggagtgctacaaataggacatttgatatttttcaaaacatcggacggtgttgcactgtattgttgcaaaatgtttcacatgttgcactcctcaatgagaaatgattcagtgaaaaagtttcagatatttcatcaatctaggaaggtgttgcattgtattattgtaaaatgtttcacatgttgcactgctcgatgaaaaatgtttcactgaaaaagttttagatgtttcatcaatcaaggaaaattgtttcatcgcttcaacggaagtgtttcaaccaaatgcaatcgaaacatattgattgtaacatgaagattcaatatatgcaacatcaaatcaaaacaaattgaaacaccttaatacaatagaatgcaacaagctaaaatagtaggatgcaacatccctaaaactccaacaaaacaaacccacctccatcttcttcaactccagtcgccggctcctgagaaaacccacctccgtcttcttcttcttcaactccggttccgacccccgaggaaacccacctccattttcttcttcaactccgggataccgtcccccgacacctccgtcttcttcttcaactccgggcactgccctcggacaagtaacgacacgaggtaggtgacctcgactaggaccaatcgctttagcattagaaccccgccggcgttgctgcatcgcctccatcgccgtgtggctcctagcaagctctagtgcctccccctaccccgtgtcgtcttgcccccgtcgctaccactgtgtggccaccaatgattcgtgtggtggagatagccaacaatgctggtgaagcagcaagagaagaaagagagagaagaatgaacatgtggtagagaatgtttggataaagccgacgttcgatattttacagtgtccggacatccgtccgaaagcattttcgacttttttttgtttttgctacacatcactcgtgtgaaaaaaaatttgtttacactcaaattttcgtccttcagatagacttcaagatgtgtgctctattttattttacatatcttcccaatcttgtttttcatttttttgggctgctatataacggaatcccgttttcgaacaagatgatcccgagtaggtatcaggtgtgatacctatcaggtatcagacgattctacacaacaggatgatctcgagtaggtatcaggtgtgatacctatcaggtatcaaacgattctacacacgtttcaggtgatacctgcaagtatcatatgtgatacttatcaggtatcatgcgattttctaccacgtatcgcgtgatactcgcgaggttcatgtgaaacctgtcaggtatcagatgatttcaaccacgtatcgcgtgatactcacgaggtatcatgcgatacctatcatgtatcagacgatttctaccacgtatcatgtgatactcgcgaggtatcagacgatttctaccatgtatcacgtgatacttgcgaggtatcggatgatacctaccaggtatcaggtgattcctactagatatggctgggcatcccgttgggggaggagcacctcgacacgcgcggtcgccccctgcagccgtcccttgtagacgaggacggcgatggcggtggcagaggacgggcgcggcgacggcggcagtagcgggggacgggcgctgcggcggttggggatgggcgcggcggcggcggcggaggcaacggtggacaggcgcgacaacggcgggggacagcgacggcggccagtgagtatatggataagaatcgcgttgtggagaggagctatcccgttgggggacggtatcccgtcacctagcattccccttttttttctcaaacacaccacactaatgagggcacacgtagggatggcaacgggtcgggtcgggcacgggtagagcgattccatgcctgacccgagacccatgtgcccatgcccgacccatgcccgaaagggctatcaggcaaaatcctatgcccgtgcccatgcccgtcgggcactgcatacccgatgggtacccatcggccctgcctgtgccgtgcgccaccaccgccgtcgtgcgacgccgtctgtgccgtgcaccgccaccgccgtcgtgtaacgccgcctaagccgtgcgccgcctactcctatgcgccgccgccagccgcgccgctgccgctagcccgcgttgctgccgccgccggcagcgcagccgccaccgacgccaatagcccacgtcgccgccgccgtcggccgtgcagccgccaatagctcgcaccgccaccgccgccagctgctgtggggattgggtaggagaaggagtggggaattaggttagggtttctattagttgagtatatatatatatgtatctggttagtgggccaaatgggccaagaggaaagggtatgaggcataagagatgggccaaaattagcaaatacatatgtatcgagtagggcatggattatccgcgggcaaaaaataatacccggccgctgctcgctatgttctcgggtctcgggcgggcatgcccacgggcaaaatattacacccatgcccatgcccatcgggccaggtatccgcggatacccggacccgtgggtaaaattgccatccccgggcacacgtgaaggaactgtggtaggggagaatgagggcacacatgcgggtttaaggtggtacccgaacccggcacccgcattctcaaacccgaacccgctaagacttgcctactccactaccgcttctactgcttggttcgagtcgagggtttctccttctcccagtgcgccgccgtcgccaacatctggagcctcgcggagccgctgattcagcgaattcctctgcaattagaggtaatcctctgcttattcacgccgcgtgtagcgcggatttcggtgattttggttgatttggttgtgattttgctcgttatgtgtgttttgtgacgcgaattttgggggattggtttggtcagagatggggagcgtggagctcggagcggaggaaagggaggtcgccggcggggagggggggagcaagggggcggcgcctcctgctagggatattaggcggtacaagtgcgatttctgcagtgtcgtccgttccaagaaggggttgatccgtgcccacgtcctcgaacaccataaggtcgctcatggcgtctctcgcttcatagttcagaacctcagatgcgtctagtggtcatattctccgtgctttggctgctcgccacggtggttggttacttggatggatgaatgattgactgtttggttttgtcggtgctgctatttgtgtttttaggatgaagtggatgatttggatgattacttgggacgtggtggcggcgagacgtgcaaagagatggaccatgattgcaaggtgtgcggtgctagttttaagaagccggcccatttgaggcaacacatgcagagccattcacttgaggtatctgaatttcgatacatgttcactgaaatgatcaagttctttggcgcatgtgatagatgctatgtgtttctctgttcagagtattacttgcaatagctgtgatagatgctctgtcctatgtagggactagggatggtgatagttatgctgtgttgacagcaaatttccctggacagttaatagttgtcgtttcactccttttttggttgggtaggtttgttgatctatgctgatttttgcagactatttcactattttgttacatatggatgtgtgaagcattggatcccagagaactccaaaatgcgagaaggccttgagtggactagtaccaggatggggagacccttctgggaagctccttcaagaatgcctctttcacgctcttcttcaggtgatttcttctgttgcaaaaaactgcttgctctatgctactgctgttattgttacgtgcgctgcattcttagtttttccaagctattgaaggatcttttcttacgcgcaagtctactgttgaagaactgcatgcgtagcgctgttggttgtatctaatccaagcaccacttgatggtcttttgatcaaacagttaa

SEQ ID NO: 59196 - DNA, 1390 bp, Oryza sativa
tccatcaagaatgcctcgttcacacactttttcaggtttgcttgttcatttcaaattgctcattctaagacttgattttgttccaactgttgttattacttacagtgatatgtacgtactgagatattgttattctcaagctacttaaggatcctgtcttagatgcaattactcagtcaagatacacatgtatatttgtcactggtatttgactattcatgcagctgtctcatttgcagcatagtagtgtgattatcggaacagttttagcatattgcactgaatggatatgtgtgtacattgacctacttattttatgtcaagtaaatcataaagttctgctttcagtataacatttaaggtatatgcttttgcagaggcccttttcctgccatgtagatggttgccccttcagctatagcaggaaggaccatttgaaccggcatctacttacacatcaaggaaagctatttgcatgccccatggaaggatgcaaccgtaagttcactataaagggtaatatccaaaggcatgttcaggaaatgcataaagatggctctccttgtgaaagcaagaaagagttcatctgtcctgaggaaaactgtgggaagacttttaaatatgcttctaagttacagaagcatgaggaatcacatggtgagatacttgtgtgccatatttttcttactgtctttaaatagctcagcaaccctcctagatcaattttatcatatatagactggttatgtcatctgacactctgactttttctatttctgagctagaatactgatataaactcttcaaagtatcctgcaagatactcctgtttcttttaaagatcatttatctcttcagatcaaatgcatgatttacttatactgtgcatgcgctgtatgcctgcttttacttcctgtgagaagttgagaagtgagaattggttaattgtgccgtgacataccttgttttacttgtgcagtcaagttggattatagtgaagttatctgctgtgaaccaggctgcatgaaggcatttaccaacttggaatgcctcaaggcccataacaaatcttgtcatcgacatgttgtctgtgatgtctgtggaaccaaacagctgaagaagaacttcaaacgtcatcagagaatgcatgaaggttcctgtgttactgagagggttcgatgccacctcaaggactgcaagttgtcattttcaaaggtaggatttcaatctttcagggttgattctgtttcacagaatttttttatttctttccaataaattgcaaatcgttccatccttttcaattttttttttttgggggggggggggggactttgaactgcagaaatcccatctggacaagcatgtgaaagcagtccatgagcagaag

SEQ ID NO: 59197 - DNA, 1556 bp, Oryza sativa
cttgtgacaggcatggtaatttatcaaggttggtttgttctacagtgtaaatacgtgctcgtcgttccgactcatctacctgaagattgcattggtaaagccgctatattcagtaaggcttgctcaccatgcaattctgctggatatagtttcttaactgaatgaagcctgaaggcatcaacctcctatgcttcaacccccttggggttcctgaagtttgttatttcgccgtcagtgttggcgtgctgctaatgctaagtaatccttgtcttctttgcaacataatctttcggtgctattaaagtgaaccaccaaagttcaatgtcatatttcaaaattcatgatctttcgattgtacaaaactaacttttgaaaaaagaaaaaaaaatcagcaaactctacacatcactggcatttcaagcattcaagctaccagtaacagtgttagcttcactgcaacacaagctcatgaacacatcagtaattccaagcaacttcaaacaccgttaatctccactctcacatgcatcagtgcaattaaaacccacgatcaaccagtgccaaaacgatggtgagcgtgagattggagcaatggcgatgcggcatcactcgcgaattcgcaattgtttgcaaaacatcaacatgtaatattggaagatgatacatcatattcaagcaacgcaatgcgtttttatgggctaccaatgtttctgcaacacaaatttgcaggagaaaaaaaaatgagaagagagatgcggtgatcacttgtccgccggtggcgttggagccggctcgtcggcgggcggcggctgcgccatggcctcctggcgagcgcggagcgcggcgaggacggagacggcgggcatctggaggcagccgacgaggtactggtaggactggaccctggtgggcatggactcgagctgcgcgaagtcgtcggggctgtagaggcggccctcgaagacggcgccagtgaagtcgttgagctgcagcttccactccttctggaagtcgcggtacggccgcagcgccggcgggatctcgtcggagcggacgaacagccacgcgttcatcccccgcgcgaacggccgcaccgcctcccaccgcgtcccggccaccgccgccgccacgtccgagttcttcgccacaaccagcctcgccgtcggcggcaggctggcgcggatgctccgcagctgcgacaccgtgaacccgtggcaccagatgcccgccaccagctggcactccaccagctcccgccgcagcagctcctgccgggccagctccgccgccgcgcggatcgacggcagcgtggaccccacggcgcgcacggacgtcatccccgacggcggcggcggcgagggtttcccttgtgcggcaacgcggagacgaggagcttttctttgctttgccttggaggagtagggttgaagaagactggtcagcccattgggccgtctcatccatggactatggcccaacccatctaggtgtcacttagtgggccgacatattactagtagctttcaagttggatgggcctgaaatggggctgcagg

SEQ ID NO: 59198 - DNA, 1073 bp, Oryza sativa
gatcccttgcgttagttagatggtatttgttgctttataatactacaaactcaggcctcgcaaatagaaagtccggtatgtgggagagagaagttacatatatataatatactatatatactaatcaataatggatgcgacgaagactatttatctgcaagattcttggtgcctttgaggccactactactaggtgactgccaatagtaacatgttagttgagagggacttaagattccagcgtgagctacacctgtttatcttcaatagagggcatgtttagttgttgaaataaaaaattttggatttcacatcggacgtttgaccggatgtcagaaggggtttttggacacgaataaaaaaactaatttcacaactcgcctgtaaaccgtgagatgaatcttttgagcctaattaattcatcattagcacatgtggtttactgtagcacttatggctaattatggtctaataagactcaaaagattcgtctcgcgatttacatgcaaactgtgtaattagtttttctttttatctatatttgatgcttcatatatgtgtccaaagattcgatgtgatttttttggaaaaaattttggggaacaaacagggcctgattttagaaccatgggattggactggacctcgtcgctgctatattttataacaacatcgatatttctagtgctcccatgcttacatcttttcgtgattctctagatttgtcctttagtttctctctaccgacagcgtctatatattcagtcacaaattcaatggtatacttgatggtaatgttccctgcttttaccaagttttatttaggcccctttggttagaatgaaaaacatactcactcagtcccaaaatataagaatttaatattggatgaaacgtttcgtagtatgtatcttagatggacttcctatccagttctatattcttatattctgagacggagacagtagcaattttataggatggcactttagaacaaaggatcagacacattagaatcctattcaattcctatagaataactcaatccatacaagatttgaagtaaatttaac

SEQ ID NO: 59199 - DNA, 2847 bp, Oryza sativa
ccaccaccacctcacctcaccacctctgcttcttcttcttcttcttccccgtggtgtggtgtggtggtgaattgttgttctgttcccttcatttttcgttgattcgtgagcgcggcgacgtacgtacggtggtaagcatcgtcgtggattcgtctccggcgacgggggggagtgggtagggtagggatgttcgtcaaggactgggactgaggtgatcggctaaatgtaccgccagaacgagtcggccctctcctgcttctacctcttcctcctctggttcttcttcttgaaatagactccacgccgcgccaattcccagcccgagcgggagccagctgctcaatccgtcgttgagattggttgcggtttgctctagcttgtgaactcggcggagatttttggttttttgttttggttttgggtttggttgggtgagtggtcgatcgatcggaaggtgttcgatcgattgcttgcctgctttgtgatggagttggatctgaacaacgtggcggaaggggtggtggagaagcatgagacggcggcgaggagcgactccggcacgtcggagtcgtcggtgctcaacggggaggcgtctggcgcggccatcgcgccggcggaagaggggtcgagctcgacgccgccgtcgccgccgccgcctcccgcggcggtgctcgagttcagcatcctgaggagctcggcgtcggcgtcgggcgagaacgacgccgacgacgacgaggaggaggaggccaccccctcgccgccgccgcaccaccaacaccagcagctgctcgtcacccgggagctattcccttccgccgctccctcgccgcagcattgggcggagctcggcttcctccgccccgacccaccgcgcccacacccagacatcagaatcctcgcccacgcgcctcccccggcgccaccgccgccgccgccgcagccgcagcctcaggcggccaagaaaagccgccgcgggccgcgctctcgcagctcgcaataccgcggcgtcaccttctaccgccgcaccggccgctgggaatcccacatctgggattgcggcaagcaagtctacctaggtaatttcatcgaacacatcatcttcctcctctcaatccaacgcgacatcgccatgaacaatctaacaaacaccttcatcttctcccaaacaatcacaggtggattcgacactgctcacgcagctgcaaggtaaagaacacatcacatcattcatcagaacatgagctctgtgtttgtgaaggagattgagagaattgaatgatgatggatggatgcagggcgtacgacagggcggcgatcaagttcaggggagtagaggctgacatcaacttcaacctgagcgactacgaggaggacatgaggcagatgaagagcttgtccaaggaggagttcgtgcacgttctccggcgacagagcaccggcttctcccgcggcagctcaaagtacaggggtgtcaccctccacaagtgcggccgctgggaggctcgcatgggccaattccttggcaagaagtaagaacaccatatatatatatagctctctctctctccatcttcttcttcctcatcttttcatttcaacatgttcttgatttattgtgattgtgatcatccattttgagtagggatgatagtaagtagagatagggtgtgattagatgcatagaacagataagagttaagctagaaattaggcagtggatagggaattcctcaccggtgggaacgccatgcttggctgcaggtacatatatcttgggctattcgacagcgaagtagaggctgcaaggttatcatcagcttggattctcttctcttgtacaattgattcaaaccaaaaaaaagtcttttcttttttaaaattttactttctcgtgttgttgattttcgatggaccttgtaccgactcgaatctcctctctttttttttctcttcttttttctcttctcgttttaaacatcagggcttatgataaggctgcgatcaaatgcaatggcagagaagccgtcaccaacttcgagcccagcacatatgatggtgagctgcctactgatgctgctgctcaaggtaacatgcgtgctgaatctgatttgattaaattttttttctgtaactgattaactagctgatgaactcagctctgaacagatttaattaaatccgggttcaattgtgatttcttattatttttaggagccgatgtggatctgaacctgagaatatctcagcctgcagcctcacagcagagccccaagagggatagcggctcccttggcctgcaaatccaccatggatcatttgaaggttctgaattcaagagagcaaaggcaagttgcaattcagtcaaaattcttccgatggatgatttgtttgcatgtcaagcaagttgcagtaatgcgaaagaaacacaaaagcataaataatcaagattcgctttcaccgtggtagcgactaaagtatgatgtgcaaattgcatatgtagtcttctacctagtgtacttcatagaccccatttctattgctaccgtctaaatttgatttctctattgtcggacccaccatacgtacaaattggccccaaatttcatcaaatagtaacaagtttctctttttcttcctgattacgttgtaggagcatctctttcatgaaaactgtaaatgatattcaggatcactgcttagttgatatttcaactgaaaaacttgtgctttgctgtgcagaatgatgcagctccctctgaacttgctagccgccctcatcggttccctcttctgaccgagcatccgccaatctggactgcccaacctcatcccctattcccaaatagg

SEQ ID NO: 59200 - DNA, 1304 bp, Oryza sativa
tatttgatgttttaagttcgattcgaagttagtagcttgtagactttttgttccactgcttttgttgtggcgggtaaacgggcacgtccgcgggcaatgggcatgggcaaccatccttacccgtcatgtagtaatgggtatacccacgggcacaaataatctcacgggcatgggtatgggtaggcactacccgtgcccgtcacacgcgattgccatccctagcaaacactgttcgtttgttcgttctgcactgtgccaagatttggccataatggacagggaagcatttggtacttgtaagaatatatgcatgtcccttacagtacatttggaaccacacagttttttctctttcctgtactggagtagattagatttgtctgcaggaactttcactctctgatggctagtagagttaaatttgtgaaaagaacactgaaaaattcaggcagatttggtacagagaccgggtagaaaaaatctacaaaggacaagaggacagtgaaaaggaaatacagtggcgaaattttgacagattttaacatgaaggatagtttatggagagagatactactcacttttagagttgaacacatgtatcaaaataggtaaaattaaatgtgaaaatattgtgattgattgagaggaagatgcaaatataaaatttaaattatggaagattacgattgattgagaaaagaacgtagatgaataagtgattattatattctagaatggacggagtatattgggggaataataataactggtgcatgggtgcgacctcgtctggtgttacgtcgatgcgatgctgctgctggctgcgacttgtgaagctttttcaatgttttgttcgtcgaatttgacggtgaaattaccagacggacggcaggcagctgtcggcatcgggtcacccgacggcaaaaagttggtgccacatgaaaagaatccgtcacgtgaagggacatatgtaaactattttccatgaattccgactgctactagctagtatctctacactagtaaaacataatataagttttttttgattgtttaatatttttgtcttaaaatataagtatatttgatcagggccatcctagggacgtgcggccagtgcgcccgcacagggcccccaattttcaggggtcccctaggtccaaaacttcaacactatatattcaactcagtaagtaaattggtagcctaactagtcctgaaaatctgttatttttcttgtcgttttggcttcgattacgcctttgccggttcacacagttgcggcggttcgcaatctttaatcg

SEQ ID NO: 59201 - DNA, 2966 bp, Oryza sativa
cattaacaccttggtttttgcatgcattgcaacaaccttcaggaacagaaaacatcaataataacagtggtcggaaaagaagagagcaatttgatttgatgtgaaccgtgtatcacgcagtggataacaataatactactactggtaaaaactaacgaaactaaggttcaatatatttagttaagaggaaaatagggactcaactcctcatcaagatccaaaaccaatgtgaaaaccatgtataactagactaaatgcaactaatactgctaacagacatgccttttctttcaaatacaaccaacaagagtaccaatttttgtgaggacataaaagtgatgatatggaaaattatatcctgatcatcctaatagcttacactatagggcctgcctacatctccaaatcaagtactcacaacgtacacctagttttatgttttcgaggcacggtttccaatagtgaggtaaacttcattgtatttacaatttctgctatgttaatcatgtatggatttggcttgcacaaaccatttagatgtattcagtacttcagtacacaagtcttactagttatttccgactatcttcttcatcatcagaaagacgaatcgcatattcaagtggggactttctattacttgctctaaggttagtgtagatatgatcaatacaaatcagatatacaacatgcatgagaaaacaacttaatactatttattcacatcgcaattatcatactcaagtatttatttgagcaatatgtcagtgaaacattcagtagcaaatcctacatgtattgtgcatcttaaaagatttttctattcttaaacgaggaaatcatatttcctttaccagcatcaagtggcaactgaaacccacaatagtgttataaatgtgtaatgataatcccaaatgaaagattcatggttcacatttttcactaatttaatccaaacagtggagtaattataagatgatgctttgctttagataaaaaaaaagaacggaataaaaagaagaccggtccctgctgaagttttggctaaagatgtgacacagagtacagtgttagattataaaagaacatgccatgagtacagtgttgtttgaacaataaagtttaagtagaaacaggcaagaacacataccatcatcagttgcctcaagtggagtgcaaaaataatacttgacgccatgcatcagctttgtttcagcaaaataaagcctagaggtccagcattcctcatccttattcttcatctcaacagtgaaattatagtggcaataaaccttcctatattccataacactaaagcagtggtgcaatatttcaccaaacttgtaatcaacttcctaaaaaaatcttaaaataagaaagagcgataacaatgataataagatgaaatatactagtaggttttatgcaaggtcgcaaacctcaaaagcatccttttctgcaatatagtttctgaacgctaagaatgcttcctcggtcaaatattgaagtccattcgcaattgtttctttccgagaacgttgcttcaccgggctcaccctactaaaaaaggcctttgctttcttgtctagcagatcgatgtactcatcagacatgcaatattccactggtttgtttaagctgtgtttcattccaaaaatagtctgttattgtaacaatcataaagtttagcacgctacaaatatcaaaccagaaacatatatacaaaacataacacttatttctgaacaaataatcattttttttggcttggaaatcaaagaaaaaatcatttataataatattagataatgatgacaaggagttcaatattttataatatatacttaaaatcgtaaataaaaaaacataactatcatttacaaatattaaattgtccgattatcagaataacaaaaacaatccaaatttccaaagatatattcgactcaagaatgagaaggaagagcatgaccagacatcttatggttacatttatagtatcaatagtttcttgcaagccattggagtcaagttaccagagcaaatagttgaaagttgaatggataattttttttatacatataaaagatcatgcaattaaaactatgttaacacattttacatgttcttgcatgagaatacatctagaccatgggtcaacataaatatagaagaaaattgtgttccaagagataaatcaaaaggactgtaatgtaactatagggaaattaccaaggaagacgtggcatttcagcctgttcttgttgtgatggtatttctgacaagtggccaacatcattagggtttggagtggcatattctttatcagtgtgttgaaaaggaccggcgtcacttggatgtagcactccctcaggctcctcgtcctcctcaaactcaatattcaacttcttgcatctgaaagaatcaataactttgtagaaatggtatcgaaaattgaaaagggaagcatctacttagtatttttcagaaacaaaatcgaccatgtcttgtaattatgacgacatagtttgtattggtgtgaaaaaagagcaattaatggggttaacgatatacttcatagaaacttcaactgtacctacaagaacaagacaacttgtcgtctttgtaaaacaacatagaaagtaatgatggatgaataaacagcgcagaagatgggagaacttagtgtgatattagcaaataagtccacatttgttggagaaggaatactacataaccagaaaatacaacataaataaacaagcaactttgtggtgcaaatacttgcaaaaggggtcttatacaatagagctattaaattttttttgtgtaaaagggtaaacaagtagtgtattagaaaccgcaccactgcatatataatttatgtacaaaagggtaaacaagtagtgtattagagaccgcaccgctggatatataatttacgaatgtatcgtgctacactgcgt

SEQ ID NO: 59202 - DNA, 3961 bp, Oryza sativa
agtaatgacagaaagtatgacaagcaagattgatgaaacgcagaagtcccttctgtctcaatacccttggccaatgaactccagcggtttgtgggagagatctcatcggcatccatggtatactgacaagtcagtggcaatgaatgtgggtggggtgtcatggctgctagccaggtcaatgggtagggtgattcaagtggaaggggattgttggatcaggaagagagctcgtctggccatggtgtgccagcgcccagcagttagcgaggaggactgctaggtaggtccaaggggagaatatcaaggaaggaagcacaggatgagctcgactctcagcttagtcagcacataagacaatcattgtctctaattactactactatatgaggataaacttttggatactctatagttggccataaggcccgaggcccgaaggcccggcccacggcacgcctttttggcccgacccaagcacggcacggcccgacttgggtcgggcccgtgccggcccgacccgactgtcgggctgtgcctgggcctccccaccagcacgctgggctggcccggcacggtcgggccggcccggcacgatgggctggcaggccaggcccggtacacaaagtatagggactaaaaatagacatataaatgtcaatgtctaaagaatagggaccttaaatagacttattttagctatttatataccacagcacaaagaagagggaggtaaaatagacttttttttagctatacaatgtcacagcccaataggagggagaaaatttagacttattctgaggaaaagcacgatggcccatcgtgccttcgggccgtgcctgggctgtgagtgcggcacgtgggctggcacggcacggcccggtgcgtcgatcgggccgtgccggcccgacaagcctcggcccaggcacggccgggcctgggccgtgccgtgccgggcggcccacatggccatctataggatactcatggcacgcttttcaaactgctaaacggtacgtttcgtgcgaaaactttctatatgaaagttgctctaaaatatcaaattaatccatttttcaagtttgtaataattaaaactcaattaatcacacgttattactacctcgttttacgtgaaacacttaatctttatcttcatcttcatcttcaggagattcaaacaccacctatgtctacattgctactaatttggtttccagggacttattccaagtccctgtcacattgatgtttggacactaatttggagtattaaacatacactaattacaaaacccattccataagcttggactaattcgcgagacgaatcttttgagtctaattacgccatgattttgacaatgtgatgctacagtaaacttttgataattatggattaattaggcttaaaaaaatcgtctcgcgaattagctctcatttatgaaattagtttttttattagtctatgtttaatactctaaattagtgtccaaacatccgatgtgacatgggctaaaaagttttagccccatctaaacacccctaatgcaaaaggagagagtttctgtccaccagcacagagaaaactattcctgaagaaccaggacagaaaacccagaacacccatgtcttgtgtcttctctaccgctgcttccttgctgaaccgatagatgctgcccgtccatgccaaaacatctccctcccacaatctcccattaaagtccaattagaaattatgtatttggaagatgccatcctatttaatttagagttcattgtaatgataacaaaataataatactatataagacattttattagcaccacgtaaaaacattttctttagtttgtaaggtattccctcaatttcgtaatacagggcccgcctataattattcttttgcagttttttcaacatgtaatgccttataccaaagcttgttttaatgctatattatcaccattttatccctcaagtggtactactgttagttgttattgttgtggctaagcagtactactatagaaaagatagcaatgtcattttatccttttgtgttgtactgttgttagcttttaaaatttcttgatctatgtacccagctgatattgccatatattatgaaatggagggagtagaggatagaaacctagaacggtactttccattaattcagtctgttgctcttaagatgaaataaagttggtaataggcaaatagcaaaattagccaaaagcgcacatgatgaccttttaagaacatattccatgttctgcacattatgcacaagtcaaaatatgaagaataaacacatggaacaaatccttacaattgagacatctgatgaggtaacttgtcttgttcatgaaagccgacagtatcagccttgaccctaagcaaataccacacatcttaataaagttagcatgttgctgattcaaatcaatttaaaaagcatagcacgatattcaataatgaaaaggatgcttagtttgacagtaatatccacaatgttttcagcaggttatattatttgttcttttaccctaaaaagcatacagtttttttaataagttaaaagtattgtcctgacccctgatatatgagcacaattaatgcgagaaaaaaaacacttaagcctacagtaacaataagtcaacatgttagatgcagctcatggattggcaataccaaacaacaaagaatgcataattggactatgggagcagatgtaagcatgaataaaaatgagatgaatggtgcaggtgtacaatgcgcaattaccactgcaatctattctagcttagacatgggtacatgttaatctgttttggtatacaagcaagtgattgccaaagttaataaatgactggaatactcatgccgccataggagcaataaaaatgaggggacaagacatgacgcggtacattacttattgatgctctcttagataaatgcctgtgtaatgggactatgggagctggactaaactatcgggaacacgaggcaatcagtgtgacggttgtgagatacgaaggctgtgtttagatccaaacttacaacttttttcatcacatcaacttgtcatacacacaacttttcagtcacattgtaacaattttaacccaaactttcaactttggaaggaactaaacacagtcgaaacaatgaaggcaaaaccatgaaactaaaacatttagtatcctatatatctataattctatatatgaagttcatcctcactaactgtagttaatgttatttttctcatctctcattaagccacatcactttaattatttgtaatccttggatgattgatctatggtccaaattatctccctcattttctcctcttatgaaatcatatcacctcagttttgcctttagatgattaatctatattatctcccttatttcccttctctcattgagccacatcatcatagttttgcttttaaatgatcaatctatacataattcaaattgttataatcacatcatcttaactgtttattgtttttttttcaatagtcagtcaaagatgaaaattatataaagtcatctagctatcttacatgttatttctactattatcatacaaaattcccacaacaatgcgcagtagttattaataagatcatgccatcaagcacagcattttcgaaagtaaaaggcatagaaggtttcacacataaacaagattataacgcaagattgaaagcataggaaactgcaagcaacgttatcaaacatctaccacttccagcaggacaaaataaactaaggaagacatcatacatggttgaatcttcctcctttgactggcagatttctgcaggtggttgggatggtgtggtatcagcaccagagtcagacatttgttccactcgactgaacaaattttttaagaatgcatggtactagcaagcaaatttttttaattaaaaaaat

SEQ ID NO: 59203 - DNA, 1257 bp, Oryza sativa
cctgcagccctacttcaagaatcagcgtcacagaaaaacacagagtaacaccagaaaaattaatagtaggacacttagctccacggagattactaacagacggaccatactgagaatactgttattgtttcacaacgtaagcttaaacgtgcaatgagcaaatacccttatatatacgactttgcaactggcatagcacatatctacagattttagagagctaatcgaaccagctttgtcgataagataatatagctaagtgacactaaatatgaaaccctgcccagtcaaagcctcagacctttgtgccatcaacatcagaagcaaaaacctggccataatcgcccttgtcatcctcatccagatagtcagaccttgcattgagagctagcatctggcaaacaagccagaagagagcagcatcaagggccaggaaagcggctcctccaaagaggccagtcttcgcagtagggcactgggtatccaggtcatggtggatgttgttgcttcggtgaagaccctcggtgaccgttgcccagagcaacattgcaaacgccagagctgagacaagcctgatttcacaagaatagatgatgaaaatgtatcaatggagttagcaggaaaacaaaatgcaatgtcgagattctcaaatatcagcagaattaagctagtcccactaaaaattttgaatacaggtaattcttttgatctgaaaaaaaaatgtgtcattggcacagcttagcattaatctatggaactgtacacgactaatagaactactaacacctttagggtccatctaaggcaatgattccacaaaacaaatatgtattttttttattaattaataattttgtagctaatcataatcaaatgaaggctcgatgaggtggatccgcatcatgccagatactactgcttcaaatgcacatgaaattgttagctgcagatctgagaatcacttactcagcaataacgaagaacgcagataagctggcgcttcgaaataatgctccgcgaggaacagacttgctcttgtatggatagaagatagcggcatgccctacgatggtggttaacacaagtgacaccacggagaggcttcccattgcaatagttgggtcacttgggaacttgcagatgacaacatcctttcctttgataggagttccataaggaggctgcatcaaagaccaaataaaattcacaacaagtaacaattttcaaaagttcataaagagtgcagttgatgcaaga

SEQ ID NO: 59204 - DNA, 861 bp, Oryza sativa
ttccctatcgacaccaagcgtcccagaagtcaagcggacacaataattggttcgtatccatcacagacacacaaatcccacaaagcatcattgcataatgctgagctgctcacctgggtcttgccaatccccgagggcccaacgacctcagtgagcttccctgcggggattcctccatgcaatgcctcatccaatccgcggagcgtggtggccagccgcccatctcctcttgccctgaaggcctcgaggagcgcaagcgcctgcagatcaacaagcacagtaacaaaccccgatcataaacgcaaatgcactgtcccaatcatacacggatcaaccaaacgagagtaactcgaatcgaatccaaacccctcgaaaccgggggacggcgaagtggggggggggggagggtaccgtttggtacggagggcaggcgatctcgctgacgtgggcgacggcggcgcgggcggtgtggatgccggcgtcgaggacgcccatgagctccacctccggcagcgacagcacgtcctgggtagaatggggtttagcggcggcggttggtgttggagcagggggaggggttttggagggcggcggcgggggctgaccttggcggtggtgaggcggcgcgcggcgaggatgtgggcgaggtggggaggtagccgcatctccgagaccagcttgttcgccatggcgatcaccgccgatgggttgtgtggggggagagagagatcgggggattggatgggagacgggttttgttgggggggggatggatttcgaatatcttttgtttccgcgctctttggaattgtttcggtagtttttatatgtttttagtcaatgacatgtagtacccacgtg

SEQ ID NO: 59205 - DNA, 2614 bp, Oryza sativa
tgcctgaactatctatatcagaatagatggcatttttgtagtgtgttgagtaggcgcagcggtgtaatgtaaaaccttggctggttcgatgcctaaactagttatatcaaaataaataacatttagttggcgattaacaaattgacattgtacagaatttggcaaaaaggacataaagactatatcgtttctaaaaacttgacatcaaacaaattgccaaaattaccatgataaaaagatgttgtcagtaccataataatttgggcataacatagacataaaaaaataaccgacgtcccatttaataagtgtaaattatgattttgacacctatccttccagagccaagaccacgctataaattttatagcacaaaggtaataataacatttgtcatcactacaagttatcatattgtatcatgcgatcatgccagacattgtgatatctcatcccttctttctatatagttaagacccaaagctacgttgtggttaagccacgtcatcatcagttgtgaatcgttggattaatacattagattgtttctcagccgttggatagaaatgcggcatactcaaatgaaacagagcccaaccagggtaaggcccacctaaatcgcaggatgacttttagggtttatttggatcggtggggttccccggctcagaggggcggcggcgtctgctgtgtcgccctttccatcgcgcgcttgtggtagggacagcgctcggtggtgggagagttatcgcgccagatgaacgagcgtcgcctgatctggaagacggctcaactccccgcgagactgatctggaagctgcggtcgtttctcctccccgcaccgcgaatgcttctcctcccccatccaccgcgcgcaccagcagtgggtccgccagccgcggcgccgcttctcctcccccacacaagcgacgaggtcaccaaacgcctcaaccccctcagctctggtcatggcgtgcactgatccaatgattcaataaataccctaaacccactcggtcgcgatgtgcatcagatcaaaagcctccacccgtagcaacatgagcgagccaccgccagcatcagtgcatcagcagaaggggatcgccggcagtaggccaagcgacggaaacgagccataccacccgtaccagttcaagggaagttatgggcggttcccagtttctgtctatccctcttctaatgacctgcattatttggtttgttgcatctcttcgtgtcttctccatatgtcacagacatgttgctgtttgttgtgttgctgcccgctctgattacacaggttcatggatccatctgctagggatgaggttgttcccctttcatgttgaattgctgatccctatttttcccaggtcatccctaatccagcatttcaggtaaatatctctttctaatcaacattgattgatgcacatcgtttctcaccacttcagctattatgttcttgacaaatttcaattaatatccaaacttgccctcttttctttcgtacaacagtatttgagcctgcattttacttactccctacttcaatttttgcacatatttgattgcaggtttatttctggatttaagtaccctacaatgttgaataataaataaataggcgcagatttcttcttatggggtacacatcactaaatatgattgcaaacaatacatttcctgttatgctcaattctaaaatcattttatgttaccttgcaactgtccataaaccttatattttatattggtcttagtattatgtacaaaacactaagtaaacttacttactgatgaatcgtccctgcatataattactaattttctttcagtgagctgaacaggttggtgaagtaattattgtatatgcgactacggacaattatttgaggtgaaactttacaattaaaaatatcatctcacaggcagcaggtgatatcacacaggtcacaggatttttgtgattggagataattttcatcatatgcagcacaatgatcaatgatgtaagtgaaaggtatatactgccgcgcaggtccctccttttggtttttctttataaatgttaattgagttcataatttaaactatgatattatgatctcaattttttttttgaatttccttatcttccttattatgtattgaggagacttaagaataagtcacctatattgtataaaaattttcaactattcatttccattttctcatatgataggtactgtcagtttagttaatcaatatgcccaccccttattatgtaaaccatcagtcacacaagagataaagactgttctttagttgtcacctggattcatcctgctctagacatttgtgcagctaaaatccttcaatttagaatctattcatggatgttttaaacccatgccaatacataatatcccgcatcaacgcgctggatatcatctaatataacatataacgcatctcgcatccggtgtatcaccactccaccatacatcctcccaaccattacacaggcccgacgagtcccccaattgtcctacacctatcttcctcatccctcaacaaagacattgacaaacttgggaccacctcctttctctgttgggaagggcgatcg

SEQ ID NO: 59206 - DNA, 864 bp, Oryza sativa
aaggcaaaaaaaaaaaaagaagaaagaaagacctcccaaaattcaaaccatcccgcccatgtaaacaatcaccgcccttgactcaaacgaggacgcagtaatcaacacggctcgagcctaaacccacgcgtgggccctacccgtcagcctctccccgaaactgccgcacgcgtctcccaattcccaaactttcccttattattcccagaaaaaaaacctctcaccgccaacgtctctctccccagctcgccgccgccgcctctcccccaccccgcggcgatctagggtttggacccccgcctccgccgccgccgtcgctgtctcccgcgcccggccggacggcctcccctccctccctctcatggaggcgctctcgctcatcgacgtggccgcggaggacgacctcctgctcgacctcacctcgcccccgccgctgcatcccgatccgccccacgcaggtgagaacgaacgaacgaacgaacgcacgcccgttgctgtctcttgcgcttcgttttcgatcgagatttttggggggtggaatcgtggtgtctcggggttgattggtgctgtggggttgcttcgatctggggatctgacggtttcgtgctgcgattttcgttttagggtgtgatgaggtgatggccgccgaggcttctcgcctggatcccgccggcgattctccggagatgaggcgggttgtggatccggatggcgctacggaggaggcccctgagcagtcggagtctccgaagcggaggaaagcgaaggccggcgttaatctccgcaagagcttggcttgggacagcgccttcttcaccagcgaaggttgtgcactaaccaaattcccacccatgaatgaaattg

SEQ ID NO: 59207 - DNA, 6507 bp, Oryza sativa
taagttcttactattatttattgaaatctgagcgatggatatacaatttgtgatgtttcagtttgcgagatgtagcttcactagcttccccatttccttatcttagttatgcaatattctggaattaatttcatttcaactctctgcttgagaagcctatttcaggatctacagaagtaaaaccatctttgaaacctccgagggctctaccaagagttgctacaatgagagcgccaactaatacagctgtggcttctggaattccagacaaaaggagcagcactggtgcgtcaacaatatagattctatctgctataatgtttataggtggcaagactaacatgtattctcttgtaggaggtgtggtcaacaggcagacagttggtaaatctgtcaacaattcagttagcgcacattctaggcctggtggagtgacaaaatctacttcaacttcaaaatcaggtgccttaccatcatcattatcatcatcagcagcagcaacagcagcttcaattggtaatatgctaggtcaaaaacctaaatcatcaaccctaagcaacaagagcagaattgctcaaaggattcctgttcgttcaacgtcaaggactgatgtcaacaaagctaacccagcaagagcatcgagaaataatattccaactgggggcaaaagtaatcgtgtatctccaagcatttcgcctagcagttctgtggacagcttgagttctgtggtttctggggcttcaacagcttccactgtagggaagatgagccatacatctgagagcttcagtacacggtcttcttcattatccccttccctcagaaatagcaatgaccacgctccaacaagagcagatgcagacacccagggaaaaggttccaaaccatctggtctgcgtatgcctacacccaaaattggttactttgatgctgtaagtaaatttagtgttttcttttgtctggtccatttagtattttcttcattgtgatcatgaaagtattcttaattgatggcattacaaattataatctgtgtcgtatgcgtttgtctccagaagtccatcgaccaacagattggtgcacatatgcaagtgcagcccatgaagatccagtgttcacctcagctatcttctgctcaaatgggggacccagcatcgtctatcttgagtcagccggaatcgagactcgcagcctcacctcatgagaaaaaaagcagtgtccagagcaaggcatcacctttactcccccttgaagttgtacagatagaacttgagccttcccaggcgatggaacatgaagtgtgcacaccccagccctgcccagtggtagcagcagcagcagcagcagcagcagacacagcaaaggagaacattccggctctgcatcagaacatccagccaaatgatggcgctggttcgttagcagttgatctgatttgccagagattgtccaccatttctcttggggacgccaccgacctggcctcttgatcttgtagagggatttagtcgtatggtatgctggttgtttctgatacatccttattattggaaggcaattgcagctgaagttctttctctggcatgtgttgttttaactcttatgtcttgagtgtaaaatcctttttctgtacatcgcatgccatgataaggatttcgctctcggttgtaatcagattgcagaacacttaagagagttgacactgctatgtcaactacaggtttgcaagtaatcgtatatcagtcacatttgttcatctctttccctacaaattgttggttgaattgttcttgttcatataactctagattgtagtatctgaaagtagttaacataacactgaaattgtcatgcaagcacaaacttacaatgattttttgcatctcactgattacagtacacatcattgttactacaaagcatcaatacatctgatctaacagtgtgtgatgagctagcacgatcaccaatgcctacactttaggatcccagattgcgcatctggacttctggagcatgtagaaaaagattgcaaattgtcatcttcatcatcccatcaatgattaaatcagaacacatcaggttggcagtgtaagaggtgcatatgcataatgttatcagcagcattttatgtccctggagtgcaggagctaccaaactgatgaggtcaagtgactctttttttaattgggctcatctcacttgctcctcttcttggcctccccgtaaagaacaacgcctgcgactgttatcccgtagcctagcatccccatgaaggttaccgggtttctgaatatcaggatggaaaccacaacagcaacagcccctttcgcatttccaagaacctggtaagaatcaagcaacgcgttgaacattgttagctgcaaacatatcgacatgtgcctgaatgttaggaagattgaagatcatcaaagcatcatgctaacagtgcaggtaggagggaaggttggattacttggagagtgagtgggctagtgtgcttggtgactaggaagtttgtgaggttcacaaagtaggctaacgaggaattgcaaagcagtatccagataaaactcggatcctcccgcgcaagcgcagtcaccatagtgagcacattgcgctccatgataaacgttgctggaatcagcagaacgacggccaccggagccatgtaaccaagaagctccatgggattgagcttctccctgcatatcaaattaggtggaaagggaataaaattagctgaccaaattagttagaccaaaatgtgggtagcacaataattcataaaggattgcgatgtgatgaattattactcctccgatgacagcaagatcccctgcaggacagtcttgagcgccctcgcggcggttgcgccgatgcacatgatgaaaccaaacagatggaagcttggctcaccctgaaattgttgagattgttcaagaattggatcgtctctgttcaagcattgcaggttgggagagcaatcaaggcagatccagtgaggaatcgcggccgccttaccccggtggcgatgacgacgccggcgacgacggggatgagggcggcgtaggtggcgcacgcctcccggcgggccgcgacggcgtaggcgaggacggcggtgaagaagggcgtggtggcgccgacggcctggttgaacgacacggggaggtaccggagcgagacgttcccggcgaccacggaggcgcagaacaccgccccgagcagcgccaccctggcgagctgccccctggagcggcgcggccgcgcagcccgcggcgcggcggcggacgcggcggcggcggcgtaggagaggagggcgcaggcggacatgtggcaggcggtgaggaagaccgggtagcggaacccgtaggtggagaggaggaacttgttgaggaggagcaccccgatgttggacgcgtaccacgacgccaccagccccgccgtgaacagcctcccagccgacgccgccggtgaagacgcagccgcggcgtcggcggcggcggcggcggaggaggaggacatggggaggagggtgaggttctcctgctgctgctgctgccccatctcgactcgagctccgattcggactggctctgcctcgttaatggagagagagagagagagagtgagagagggaggaaggacacgtggcgggggattggggtggattaggaggctaattatgaagctctgtgatgtgatcctcactgttttttctttcttactccctcactcctgcagtttcacattgttcatcataaatcatattctttatgattagtaattttactattattaatgacaaaacattaatagttattaatgatataaaataatgactcatattttcttttaaaaaaataagacagacaattaaagttgtacacggaaactaatggctaagcttattttgagataaagtgagaactatttttttatattatttttaagtattttattgtttggtctggagcgtgacacgagatgtggacaaacatgtcaatgttatgcaaagtatgcaacctgtcgggctttggaaacgtagattattggactatcgtttctttatgagtttagggtgtacaactagctatattattttgctaatcacaatttctatggttttttttgagaagggacaatttctatgggttggtgtactgtattttagtgatattagcatatacatgtgccagtagcatatacatgattttatacgttcaactttatttattttatcttctagttggtttttttctagagacactgatttttttatgaattgattttcttgtgaaaatgtcccttttatggtttctgaaagggtggtttttaactttttttactttgttttttatagtagtaaattgataattacttctctcactccgtcctataaaaaaccaaaatatgataatgtcagggttatggataccacatacctaatagtaattgactaaatctcggcaggatccactacataccatgtcttatatggaaactgacctcgagggagttctggataaggaaagacaaccagagttctacatgaaaacgacaaggactactcagattgtatccatattggtttccctagttctacttggacaagaggacacctatgagtataaatacagggcccctggagaggagagggggaacgaccatgggaaaagacaatcaacacccaacgggatcaacacacgacaggatcaacacccaatacaatcaacatagaagcctacatacgccaagacacgccgccggatatcgacttcaaggataagcacggctaataccttgcggtgtctccggatactgtcaggagaaacgaaagcgctatctctgatctcgccgggcacggattcgaggaggaaggctaccctgttgtcgactacgagtcagatcgtcagactgccatgtcgacaacagttagattggctacccaaatattgtactggtgtgattatcatgaataagagcaataccggcttcggccaacaggatggcttcggccaataggatgtagggttattacctgacaacttaggggcccgaacctgtataaaaatccctgtctccatctcttttacctcagtcttgcgtatagcctagcaccgacgatccccataccatgcaaatatcagaattgcgacatcaaacgtcgacagataggatacgatgttttctataaataaatctgaagagagacaaagggagtacgtaacaaaacgtgtactcgaataaattatgagagtattttattttgggattagctaaaaatactgtcgagtgctttttagggaaaactttcaaatctaactatagtatataattttactagaactatactataataataataacttgtatatatgtattaaaataatatatgcaactttatatagagatatcaatgtagttatagtgtagttacaccatagttacaatgtaatgtaattatagttttgtaactacaatataactagaatgtgactttgatgtaatttgaaaaaatctgccataaacatgtgatgatgggactagcttgtgaaaagagggtttagattcgataataaaatatctcattacaaatcttagcgcggaatcgatggctaaacactcatgaaaactgtcgaaagtcagctagtagttccgtttatttttcatagtagtactaatactaatattaaggacaagtagaacgtctcacatcagagtactccagtggataaagacagctattaccgacgaacagatgggaagtcggaagtacccaagcaaaacaactgatgaggcgaacgtgtatcaacaggcacgaaattaaattgttttggagtaatttatgacggcttcttctccgtacggactttggaatctcctctaatgaatcgacttgacgtgacagtcgtagtagtattaacagatgattcaagttgacccgattttgcttctttttttttcctccccttttgctggcgatccaccaataattaacacaaagagcaaatgccccactggtggcatgcaactatgcacgaaacttgcacgcctctgtgaagtataaatttattatatatagttgaagtataaatttattatatatataaatttactcactacaatgtgagagaaaaacaggcaataagacatcgaatgcttcctttcaacatatggttatatacactgtgaaagttggtagtagttgttacccggtcatagcttgctacacgcaacaagtaaataaaaagagcaattttatggtacttgagggaggtaccaaaaattaagtataaaattttgtacctcatagtatctagataccgagaggaaccaaatttacaatagaaaaagtagtatctcatgatacattctcaaggactgtaaaattgcttaaataaaaatgaattatagttcagtcacaagctaacgagaaaatggacatttggccatgttcaaaaaccagtttcgctagaatgccatcctgaaaatgcgtttcgctaa

SEQ ID NO: 59208 - DNA, 900 bp, Oryza sativa
gctcctcgacatgggcggcgacctacttgcggcggagctcttcatcgaggcgagagcgtcgagacaccatggaagccgtgaccaactccaccccatggtgtctagccccttgagcaggccttccacacgacggtgtcgggcgcggcggcgtccggggcggccactagcacctccgcgtagcgcggccctgcccaacacgtgatatatgccggcacgcgcacggtgatccactcggccacctccagcccaacgagaaatcccggcacgattggcagctctcgtaggccgacgatgtccgggacggggcagagcatgcacgcgcctaccggaccaactccccagcgccttcacgaggctggtcgtggtggggacgtcggggacgaggaccgacaccctcccggccacgtcgccgcagagcctggagaggaatgtggcgtcgaggaggtctagcctcatgacagcgtggtgccggagcacctgctcctgcgtgtcgaggacatggatgacgtcaggaggttggacggcgtggatcaggacctgctcctgtgcgtcgaggatgatgtggtcgccaccaccacctccgacgacggggcctgggcggatgacctagaggaaagggcggaaaatctcggtgagccggggcaatttggtctcatcaagccgcattccaacgaaatagaattgaaaatggtgaaaatgacaaagtggctatgatcgcctgctccatattggcattttagcgaaacgcctttttggatggcattccagcgaaaccgcttttttaacgtggccaaatgtccattttctccaagctagcataggtatcttttgtgtatgggcctaccttgtttttctcgtcataggctttacattgtggggctcaataacaggggtgcagga

SEQ ID NO: 59209 - DNA, 1164 bp, Oryza sativa
tcccaattaactaatcactacaagaaaccacccggccggccgccggcgcaaagacgaaaacgttgaaacgccggcgacggccaagaaaaaaaaaaatttgccggcttcccggcaaaatttacagtggtggtgatggcttctttcctttttatcaatggtggtggtgatggcggcttgacgacgaagacgacggcgccgtcgggtcgaaccggagggtggcagtgtgttgggcagcagctgctgtcgtggcggctttggagaatcctgatgatgctgcagcggaggacgacgacggcgacgacgaggaggaggagaagaagggcaatggcagcgtgtgaggaggagcagggtgatgatggctcacctgcttccatgcccagcttggaacagctaccccctctgatggcttcctcttctgatccgatgatctggatgcatcctgcatcatcaaacagtgaaaaattgtacttagcttagcttgctgaatttcttatccatccatcaagatacaggtgtacaaattgccaagaactattatattgtatttttgtttggataaaatatgattatcggattggatttgcgacgattcaattggacagaaatctcagctacagacgtcgagatcacctttccgtccaaggaaaataagagaaggacgtaactgaagctatccttgaagtctcagaggtaaatttgaacaaaactcccaggtccaaatgtctaacggcaaaccagtctaacctcttttaataaccaattgatgtagtatactaatcattctgaataataacaagatggcagagtatcatttttctttcccaatggggaattttgaacaacagccgacactaattttataagatattagcacgttgagaggaacagttggactgacgatttataaaaagcctaacgcgaaatcgtcaactctctaggaagttccttttgaagaaaaaatcaaacatatttataatgcatatagactagtactgctaccctaattaggccttttctgaaaattcaagaacctacatatgaaacttgtgccaggcattaatactactgaagtcgacaggccggaaggaaatgaagcacattgatgtaagacttgagctaaactgatagccacacaagaatgcaagtggatgaagctaaatacag

SEQ ID NO: 59210 - DNA, 1081 bp, Oryza sativa
attcctgcagcccgagctaaacgaggttttatattaattagctccatccaacaaaatcacactagtgctaccagatacttcaatgcctaattgcctaccgacaaaaaggaccacagggacttgctcaaaagaggaagcggagcaataattattaaaaacaatggtttcgtccacccaaagttttcgagaagcccacggaaaatgcgtcaatcattggccaaccaatctatctattgccgcctgacaacaaaaacaaggcgtgcttcacgcgtaccaaagccagatgaagaagcgcacacagagactcacagactacctgacataattttcataactcgtaacgacaacagcttcaattcaattcaattcacaggatatttttttccccaatgaacaaaagaaaaggaaaaaagaaaacagaaaataaaattcgtgtggtgcagacagaataccgtctccagattcacattttctttcaaactactcgctgctatagctaatgtggtcgaggttgacgtagacacagaacaaatataaaactcggcacagcatatagtgcgcatggcattttgagagatcgtgtggatggcagctacaggaggccaaggaggataggcatgaatctctcaacgacggaaaaaggcgatagaagaagatagcagaagcaagctgacaggaaccatacaaatacacagctccaaaaacgaccacaggtcacacaggacacaacagcagctgcaggcaaagataaaaaaccatcctgccatgtggggcccaccaaggaaaaagaaacatacaatagtagcaaaggatccaatgggactccaagaaaaccaccttgaacagcatggtaaaagtaaataaaattataaaaaagggaaaacaaaaggaattgggaagactagctagctagctaggcttgccagatgtggtaaaccttaaacctacccgtttacatgacctcgtatgaggccctcatcggagcctcccttccgtgttgggaaagggtggaggtgggcggcgaccggctaccgccggtgaaccacaccggggggtactggaaatggtccgtttcgctttc

SEQ ID NO: 59211 - DNA, 985 bp, Oryza sativa
attatcaaattatagcctcatgggcaatatagaaaagcaaacggcctggatccaaggttcctccacttgacttgctactattgagagcaagttgtgtgttggtggtactactaccattacactgcttactctctttttttattattgaaaaacctaggaggttgcattcctgtgcaccatttatttcctcgtctctgactctgagttataagtcgataagaggaaaactttgacctggcctggctcttaacgattgccaggagacagcactgactgcatctatccaggggcccaccgccagtagctaattttcctcgagtataacagtatccctttaggatcaacaagtccaaaagggtcgtcattatctgacttggctaatcatgcaaggagatgctacgattctagacctgttttcaaacgttatgcaggaacaaaattgaaagaacatcaatacaagttgctcgaattccgggaagagtcaagaagaaagctctaggattcactgttcctagcaaggacggtaatttgaccactgttcagtttacggcacataacaactgccgtcaactaaaaaccttgaatagtagtattgtaaaagccaagagaacattgtacttgcacgagttgcaagttggaacatgagtcttttctaagttcaaaatggagcttaaggtcatagattgcggcggtctagctagcatcatcatgcaattgaaaaaaaaaatgcaaaaagttcattgagaaactgtagctttcaactacgtggtttacacgggtgggttggactacacgagctctagtggagaagacatgatggctatatagacagggtagacatacatgagacctggtttttatccttagacgtacgtcctggtgaaaggacacgtcacacaaccatatacgaagaaactctaggaatctatcgctaatgaaagttcaaagtgttctttataaacccagataaaaaggtgtgctctat

SEQ ID NO: 59212 - DNA, 713 bp, Oryza sativa
attcctgcagccctgtctcgttaaaattcgaagttttttttttctaacaaaacgatcattttcgtatttttttccatgttttgtttttacatgtgcttcttaaaatcccgcgtttcgttggtactgcattccttttcaattcagtttgttaactggaattccttttcttttagtagaaccaattgttgtgggatttaataaacaacgagaggtgctgaagcgatactagcatgtgaagatataaaaagattttgtgctgctttcttttttccaattcagtttgtttactggaatttcccctttcttttagacaccaattattgtgagatttaaacaagaggagaggtggtgaaacgatactaagccattgtttagttccaaactttttatttaaacctttaactttttcatcacatcaaaacttttttttttacacataaacttctaacttttccgtcacatcgttttaattttaacaaaacttccaattttggtgtgaactgcccctgtttagttccaaagttttttttccaaacttccaattttccatcacattaaacctttcatacacacacaactttactatcacatcgtaccaattttaattaaacttttaaactttagtctaaactaaacacagccctaaacacaccctaggaagataattgaccctgagcacacgaagcgtgtggacgaagaaggtcctcacgttt

SEQ ID NO: 59213 - DNA, 1033 bp, Oryza sativa
atgatcaaaattaattaaaaaattcttcccttttttttttggtactgaaaggaaccaaatttggtcaaattttgtacaaactcaaatgacgaaacctcgtgcgttttccataattggcgtgcattgaccttccgtttgggggtaggatagtgcatcactatccgtgcacggttactgtgtgccgaaaacggcaactctgtataccaatttctgccctgttcaaatccaactaagaattggtcgacccttttttttttaattccaagtggttgcatgttcacgcaaacacaaatgcatactattatatgatttgaaattaattaataagaagtgtttttctcgcagattgcgatgtctgcatcactgcaattaagccattagcatacgtgtattttgtgaacaggtttctgctagtgactcatactgctattcccagcaagcatcatcaccttgcagaaaagatgagacaaattaggatgcatgcgacaggataatgtaatgcctttgtcagctctgatagggacgattttctcccccttttatctctctaaaagaactgataaaagggacaatcttttgtgaatgttaatctacaaagtataacatgcaaacactatggactaatattattactgaattgagaagtacaagatggtaaatagtattatgtttgacttaccatcgttaataggggtttgtgaatccgaaataatctcaaaaggaatgcaattgtagcattttttttgttgattttataatttatactccctcgtctcatattataattgttttgactcttttgctagtaaaatttcattaagtttgatcaaatttatagaaagttatagcaacatttcccatataaaacaaacatattaccaaaatatatacaatgttatattcaatgaaactaatttgtatgtcgataatttttctataaatttggtcaaacataaacaaatttgatgcaaaaaagcaatttttttaatgtgaaaaacccttattggaagaaacaacaggtgtcgactgataa

SEQ ID NO: 59214 - DNA, 1340 bp, Oryza sativa
attcctgcagcccgacatgctttagtgttttgttcattcagattttttcaaaggtggcatgttttctgtttcagagcaagtcttcttctgtttgaatgacatgaactgcattagaataaactagttttaattacaaactgaatagttcacactgaattttttacaatcatgtttattgctggtgaattttaattttctgaaagtttgagatgacttgctttcgtgacagtggagagaattacttgtgacagtgatttgagtttccttattcatgtaaaatttttgaatgagatgtgtttatgagttgcatgaatttgctgatgttctacccaagagattctgtttatcctcctaaaattgtaatgattctgtttatcctcctaaaattttctcttctgttctaatactgtgatgttcatttaacaggaatttagaagtttcgagagaggcactgtctacaatgtgtgaacatgtgtatattcagaagtcaatatatgtgaatatttgaatgtctcaaggaaaactctccaaaatttcatattcttcaaaagatcagagttaaagtttatctagaatggtcagaagaacaaaattcaagatcaagattcagatccagattcaaaacaacaagatatttcaaaggaggaatcaaaaggtgcacttacctgttgatttttcctgctcttcacctttttccttctccaaatcgctcaaacttgtgattcctttctgtgtgtactgtaaatttgcttctctatcgtcaattttctcgttaatctccatctttttttcttctgacttcagatctgtctctgtttgattccccctatgttgaatttgctttttgctttttatatccagatcacgtgacactttcttcttgggtgccaagttttctaattaagtaacctggcatgtgtcacgtgtattgtgctcatctatttgggctttttttgttgatttattacattgggcttgaattttagactttttttgtttgggcctccatttaatttggatcgagtcagctgggccaatatctggcccgatctgtgtttttttttattttttttccttctattttgatcaaaaaacgttgttcgttggatctggatcaaatggtcaaaatattcgacagatgggaaacatcaaaatctgtcgcatgatctgtagacactccctttttaatatgttgaaactacagccggtgtgatggcccatagacatgcaaagaagacaatggtggtaagtcctcaaacgtggtggtaagtaaaaaaaagaaaaaaaaatctgacctgaccaagagaaaaccagatatcaatcgtatccgcctgctcctg

SEQ ID NO: 59215 - DNA, 4157 bp, Oryza sativa
gtgcgccgcggccgcgcgcgcgctccggcgagcgagtcgccgacaccaccaccaccgccgccgccaatcacagattaattaattccgatggagtcgtcggagatggcggtgatcgagtacgtggtggcggagctgagggacgaggcggcgggggccggggcgcacgtggcggcgctggcggcgctctgcgacgtgctggcggtcgccgccgaccacctcttcgacgccctccccatcgccgagttcgtcgcccgcctcccgcgcctcctcgcctccggcgagggagacgtgccgctcttcgccgcgcgtgccatcgccgaggtatgcgagggcgtccggccctgggcgaccagcttcgccaggtacggcgccatcgaggcgctccgtgacaagctcctcgccatcgactgcatcgagctcgccgaagaggtaattaatcggtagtagtaatagttatattcatctttctgaattaattatatagctatacttataaaaccctcttatataaaccctagttttattaggttaaagtactgataataatactatggttaatatgtgtctgtttaaataaaatttaaaccatttatatgcattaaaaccctagctatgttaggttaaactgacaatattatggttaatatgcctataaggactacatccagcttgtcgaagaggtaaaatttgtacgtactagtagtaattgtattcatcttttcggaccaccttaattgtaaacctaaaacccctccttaaaacctgaaagccggcctaaaaccctagctatattaggttaaacttgataatacaaccgttaatatgtgattttttttctaccttttaaaaaaattaaatgtatttcaggtgtacgagacaatcttttttaataaaaaattacgacacccactaatacttactgtccttatatttatatttatataccaatgatatagattttacactataatttatccatatttttgtcggtaacataggttttacgtgcacgattaagttaattatacgttcgttcgtgtattgtgtaacataacacgtggtttcatcaagactgcattcttttttttttacaacgacatacattttttaaatctaaatctcctattgttgttccatcaatagtaagattaaattgagtacaattgtaagggtatatccttctcttttatggttggttggtgtggatgtggtgctaaaggagacggttgcttcgttttgtgtgtttatacagtgccttcgcgctctgggcgtcatatccatggagtgccccaaggagtgcctcagccacggcgtgccagccgccgtgctgcagttcttcgacttcttctcgatgcacaagcaggtgaagcctcctcatcctgatcagactatctctcatctcttgtggtttaatccttctttgcgctgctctgccgcctccgtgcttgacatgcttgcgcccacgctcaccacctgtttgtggaaatgcctcgcagaagctggtgctcaagatcgtcgccaacgtcttgggcgacttcagcgcgaaggatgcggccaaggccatggaggccgcgcccgttctgtgcaacctcctgcaatccactgacaagacggtacgcgtgtttaattttatgatggttatattatgagtttgtcttcttcttctctttcttggagagctactgtttctgactgatgggtttgttgaccgttctggatgtttagatactcgactccgccgtttcttgcttggttttggtctctgatggtgcttgcgacagtgcccaacacatggaaaagctttacgagcttaatgcagtccaagcgacgatgaggttgatggagaacgacgggtggaagagcctcagcgatgagactttatctgtatgttgcatgatactgcttcctcagccatcgtttttcttactctaaaattgactcaaaatgaaatattcttgttattccacattaccttataaacctgtagccttaaagatgtaactaattatcaactctttaagtattcgaaatcaggagactctttgattaccacctttataattcgcatgtgttttttcatgtttcatgaaaaggcgtcctttttatttagaagtcatttttacggcaaactatcttagatgtttatggctccctttagaaaatctaaatagtgtaagaagtatcgacaacacaggcacactatttagtaatccgcagcaaagcacatgtggtatgttagctgttaattcattcctatcttagttttagcaattgatcattcatgactgaattgacatgtgtgacagggcatccttggtcttctcaaagacctagcttctctctcagcaagggctgtaaagtctctttttgagttaaacatttgtgatttgctcaagcagatgataacatactacacctcgtcgcacagtgatcacaataaggtacatttttccctgtgtgtcttagcatcagaaattttgttgccatgttttcctatgatgacctaatacttgacacaaaagcagattaaaaattttagtgtaaattgttaaagtggcgtcacatgtttataccttaatgtatattttcaagagttagaaaaattggtagtacttctcatttgttttttttatacaattacaatgaatgtgtgtttatcagagtaagtagatatgtgaatgaactgtacaagtattccattgtacagtagtttttcgtaatatctatttacacaattcaattcaattcaaaactgcaggtgcagacgcttgtagagctcatttattatcttatgccacctcttgaaatgtgtgaccatcgtaccgaactaatcattgcaaagaagaatgtcatcacagaacaaagtggatacatccaacagcttgctagcatccttacttttataatacaggtaagaaaattctctccagtctccttgtaacacaggaagatagttctgcaactatcccttgatataacatatttcttcttgtaacgtaggttgcgaaatctgctgcactatcatcaatttgctacagttgtgttgttgtcatcagaaacattgttgaattaagcacaccttcttccttggtggaggtacagaagacagtaaacctgtcaaggtgaacttttcacacagttgaattttctcccaaaaatattttgaggggccttgaaacacgcttcctttatttaactaaccaacttgaatgatggtactgatatcttgcccttgtatcagcttacttgctggctggttggcccggaagaaccgccatatcatattccaaacgctcaacgtttcgaagacccttctgagaaaagaccagaaattcttctttgagaccttcatcagggagggtctaaagcatgcaattgatgcaatactaacacaggaaaaaggaaagagccgcttgccagaaagttgcctttgttttgatttagacttggagacctcgacagatgatgcatgcaggattaataatggtgctatcctgaaactagcggaggagataaagaaaactttcttggtaaaggttgccaagtctcctcacaagtttgggtgtgcttttaaaagcataaaggaatttttttctcgtttgaattgtcatgccacggcacccccagctaaagatcaggatctctgcaagcagttgtctgatttttcaaggcaattattatcggatgaactgccaagtacttctacttttgagtttgtgcagagtggatctatcaaacatttggcaggttatctttccaatgggacatactttaattcaaatctcaggaattgccaggacttgataggggagcttaaggaggtgaaaatccggctgcagaagttcacgcacttggctctcagcgtggacaatgaaagctcggtgaagccacttgagattttggtggagaaactgatagatgcgttgcatgtgtggtatgacagtttccctgtaatcctggctgatgaacagtgcacacgtgagagcaccatgattcctctgagggattcaggaactgaggaaccaatgtcactatatataaaattttcgagatcagccagggaggaggagttggaggattatggtggagttctccctgttgatctttcttcgacacctgaatccattgaagaggtcctgttgcctgagatctgtaaa

SEQ ID NO: 59216 - DNA, 2268 bp, Oryza sativa
tgactaattttttaaatatttttcataatttttttaaataagatggatggtcaaaacgctgagtacgcatatctatggctgcacttattttaggatggaggtagtaccatcaacataaagtatcatatcttggtcgatttgttcagtgaaacgtttatatattcttttcatggctttgacctgtcagtcaaacaatctgctgccccttctgggctactgctgccgagttaccagatgctaacaacctaacagtacagtaattccattgttcttctgcttcatctgtgccaccacttgatggttgtggtttgccaacatttaatctactagtactgttttcttggtttttcgtttgatgactcattttgcatccaagaacacgacaactgttagctaaggattgcacacgaaccaaagcactggtgagtgctgtcatcatatgaggctcttgacacttttccagttgttttttgcgattggaaatctctctccttgaaactttttctcttttttttcttcttctcctcttgagcaacagaaaggtgaaaactttttgccatggccactttatccaccccaattccccctttttccctctctcatctgggaagattctttggttgtatcctgagagctggtttgacaggcaaatggtttgctccatccaaggtgctgttaacattaagcctgcactgtagtaactttgacagtcattcacaggcacaggtatggtgaaagtatggaatctctcttgtgtttatgccattgcttgctttctctctggctcatcacagggcttgctcgtgctcatctgggcctgttgtgtgttgttgcatgacccatcccaatcagaagctggctggacaagccatggtggtgggagaactgggaactggcaatcacaaccccaaagctgctccccttttggccacccctactgtgtttgtgtgagtgtgtcagtgaccaatgctaagagcaggtacaatagcaggctctaagccagctgcaaacatattttaaggagataaatgaggagagagagaggagagaagcgggctacagatttatagccagttgtagcacggactccaagacgcaatgtgtgtatgacagatgggaccatgtattaatagtgtagtatataactattgtataaatgagctattagattagctatagatgaattggagccggtagttggctatactattagacttgctctaacaggagggagtatactgcattgctagtgctactaccttgcaactgtttcagatgctatacttactactatctcccaattcaaaaggagtagcagcaaatccgaaccatcttggtaggacagtatacaaaatttttgaaatgatggtttgaagatactagtctggtctttttggacgatgccatccgtaatcgatggcaatggagtactgttagcttgttcttgattttgtttgctcatcactgcatttgctccatctcgatgtctgtctgcagatacatgggacccctaatctcctcttgctagattcctcaaaagcatcaccggccatgagagtgagctcaactgaaagcaagcatgcattgcattttcatttatacatttttcagtgaatacactactactcctactacaaaacctttgttttgaagccaaggaacagcgagatgcagcaggagcgtggcgtggaagctgacaaagtcacaaagagatgtctgcttattaatttgggagcctggactttggcgtgccttgtacaactacacaaagagatgtgaggtaggtgaagggtaatacatgatgcaatttatagccaaaagattgattggtactccactctactcctgcatgaacatgaggcatatggtatggtcaagtagcgagaagagagtgtacttcgagagaggaatcaaatctgccaccaagtcagtgccaccctagcaccatttatcagtacagtaccccaagccccacaacagtacaacttctacccccccccccccctccctccactgctatggtaatgcaacgcaatgcagtattggaatgcaatgcttctcaacactctgtcaacaaggaagaaaattgtatgaaaatgaatgcatcagaagttcagaacagattcaggatggaagcaaatgaacagagattcatattaataaagctaaagattcatatgctacattaggaaaaaagaacactacttcgaaacagggaaaattccactgctatggcaatgcaatgtgttctaaatattggtaatgcaa

SEQ ID NO: 59217 - DNA, 2282 bp, Oryza sativa
tttgctgtcagttgatcactgatgctatactgcataatgcatggtcaatgactgccccgggctaatgaacaatcatggacatgatcaggtcgctcaagaacaatgtggacaaagccacagggccaacgtcaagtacacctcccagtttgacaaacaagtgagggtaccatatcgtaggactgtagtaggctactcctatggctagtaagtagggtgcagcagcgcggcgggcatgatgctgcccccagtggccgtgacgccgcagccctcatttggctgtcagcgtccttggtcccaccggtcagcgtcccgtagggtagggttggctctagggggcggcttctgttccgacaaggtcgggccggttcggaggtcgcgtggggcccaccctgctggggcagtggattgtgcgctttggcacgcgcgcgctggatccgacggctgtccaccagaatccgacacgcccgggcctgcgccaccggtgcccacgaggacgatccgacggccacgatagcacgatgcgatgcgggctcaggcttttcagagagagtctgacctgtcgctcgtagcagcggtgcctggatttggctcttctgccaggacgcatcatatcctggcgtgcacgtttgattgcaccagaccagatcatccatccatggcagaggacaactggaatattcgtttaatttttactcatacaatggccagtctagatcctacaccaaaatttttcaccctatcacatcgaacgtttcaacatctgcatgaagtttaaatataggcttaaaaacaattaattgcatagattgcgactaatttgcgagacgaatcttttaatcctagttgctacatgatttgacaatgtgttgctacagtaaacatttgctaatgattgattaattaggcttaataaattcgtctcgcggtttactgacgaattatgtaattagtttttttattagtggccgaacacaccatgcgacaccctatataatacccgatgtgacacactaaaactctacacccttggatctaaacacccccattaatgttgtactttttttggtcctaatataaggccccgtttagatcccactacaaaatttttcaccctgtcacatcgaatgtttaaacacttgcatggagtattaaatataggctaaaaaataactaattgtacagattgcgactaacttgcgagacaaatcttttaagcctaattgctccatgaattaataatttggtgctacagtaaacatgtgctaatgatggattaattaggcttaataaattcgccttgcggtttactgacggattctgtaattagtttttttattagtgtccaaacacccaatataatatccgatgtgacacgccaaaactttatacccctgcatccgatgtaacatgccaaaactttacacccctacatctaaacaccccctaagtgcaacttggtgtatttgtgacatatcctaaaactagtcctagaaatatcacatatatactagattacatttatattgggattgagggagtaactaagatcaaacgattttgtacctggaccgaaggtaagctatttcgatattctgcatcgtttgctactccctccatttcaaaatgaagggcttgtttgactggcgggtaacgtacttcactcataaaatcagcagcgtgtagccatagcctagatgttgaacaggcatgtagttattattgttatgaatttggtagccaaaaatagctatattttactatagagagagtaatagtactatctctgtctcataatataagggattttgggtggatgtgacacattttaatataatgaatctagacagatgtgttgcatccactaagacggagggagtattaaactctaagggcgttcacaatgtacacacatggcgtgtggcaaagtctatccacctaagcacaatgcgtgtgtggagaagaaaagtaggtgggacccacgtgaaaaccaggttcgcgtggcttgttttggctccgaacctcagcgaaatttgtcagagaaaaaacatgccacacacagagcaggagagagagagagagggaagaagctcgccggagaagccacttccgcgccgaagaagctcaccggagagggagatgagtaggggcgccgacgccaccgccgtcgtccgcagtaccgcggccgtgagatccaccgcactgctcgacgccgtttccgtcttctgacgtgccactcgaaggccgctcaacgccgccgctatcttccgccgcgccgagctcca

SEQ ID NO: 59218 - DNA, 798 bp, Oryza sativa
gattgtagcttcagttttgtagcatacctaactgaggtcccaactcccaactgaccaaacaatatggactgagtgttatgattaggatttgaatagaacttttgagatagggacaaaatctcaaactaattctggtgcatactctggtggaccaaattctttcttcggaatgaaaaagcttcatgatttcactagttttggaaacttttaaaaaattatgtaggttgatgttactttcacagttcaggtgtcttcacccagttaatcacagaataagactggacatctaatcccactcccaatcagatgagtaatgttgagacgtgaaacatggatgatgatagaaacaaactataaagtcttggaagttaggactttgtcctaatgttggacaaaagttggagtgcatatgagtgtggtagttggtaatcactgactttgggagccagcaaggcacatttacgtgacattttttttctatagtgttaatagctactgttgtgacaccttgttcatgaatagctgccaaacattcccagttgcttctttcttttatctgatgacaatcttcgttttctttcatcaattcaggcatcaagtcctttacaagtaaatatgctgatggagagttggagagactaggtatgattgccctttacatagaactgttctttttgccattgattttattgcactcatgcttgtacttgctatgatctccagaacacaagctttttattggaatgcttccaaaaaatgtaacggacaccgaattgactgatttatcttcggggtgca

SEQ ID NO: 59219 - DNA, 2744 bp, Oryza sativa
acacacacacattttgcttatagtctgctaattgttttctaacgggtgcaggttttgtaagctacgatctcctgcttccgcacaggcagccattggtgtgatgaacggtttccaattaggcagtaaaaaactcaaagtacaactcagagagacaactccaagcacagtaaacccttttgacgaaaactatgatgaccacgcgatcaggttcctggtacatatttgtcagataattgatcgttgaattgtttgctctggccgcagcattgggagcttcgtgtatcttctttgttcaattcacattcttgaacactgttacgtcgtgtaatttactgcagcctagtggtagaatttgtttcatcagacccttgtacatcagaagtcagattcattcaattgtggacattttctcctgacagtgattccggtttctcattgacacgattccggactcacccaaaactattatctgaaccattattgacttatcatgtctaaatccccccatggaaatctgatgcttttggaaaatgcttgtcagtgattcatattaagtggagtagtaataatttgtcagtactaacgtggagtatcatttgacaagattcagaatatgaaatttggtggggcgagagtttgatgtctgagcagcagatgcagatcagaaattcagaacaggataaaagcaatggaccccctgcactccatcgtgcaacaactccagatggccatgccatgggccccaacacagggtattctttctagcttgtcccaacaacaattttgtcctttctcatgtgcaaccagcagcgacaggactacgctgcaattgcttgtgcttaccctgaattaaccggtaagaggcgccacagccgcgaaacggccaattgttttgcagtaactcatctgaacttttgaaaaagagtttctcctttctggctcgccgctaccaacatcaaaatggatcgtgctgtgtatgtttgccagctttggctatgattgtgacagtgtacttaattgcgtgtgcacaacgggttatctgagtaggacgcgttagctgagtagctgtacggttatcatgcacggctcattaggcacatctgcattctgcaccaaactcactgattagtctctactcagtttgggcatgtgaaacagtgaaagagtttgaataactccgtagtgcatcatcaggaattcaatctcaagctatctgcttgaattaaacatcactccttctgttccgtagtattacattatgggtttgtcctagatcaaccttcctcagatttaaccaaatgtcctaaatcaaccttcctcaaatttaaccaaatatatatatatatatatatatatatatataaagcaacattttcaacacaaatatactatcaaaatattcaattatgaatttgatgttacagatgttagtactatatatttttataaacttgaataaactaaaaaaaattagcttagtgtaaacctaaaacgacttggctgtgttcggaaccttgtgttcccaacacaagctggccgcacggaaaacggcacggtccattagcacatgattaattagatatttgctattttttttaaaaaaagaattaatatgattttttaagcaactttcgtatagaaactttttaaaaaacacaccgtttaacagtttgaaaagcgtgcgcgcgaaaaacaagaaaaaagtgttgggaacttgtacttccaaacaacatgagacgacggaaggagtaccctggtacgagaaaacagtctggtgattggtgagtaccacaaacttgtaataatgcttaccgatcccttggtagcacggcacgaagccccccttgtccaggctggccatggtctgcgacgtacggcgtagcctgcacaaacgtctatatgtagttgccgccaaagaggtcaacatactccctccgtcccaaaaaaaaaaccaatcctgtgtttgaatttaggattaggtttttttagactagggagtaggggatttgggggctctttgccattgacgccgtcaccgacgccgtgtggccatcccgccgccaaacgatcttcttgcaaatcactctcctcctagcagcgggtctgcacaagaaatggcggcgaaggtggggaggtcatctcctctctggcgaagtttggaaggggaaatggaagagatccgatggcctagattgctctggtagtgacatagttgtatggtttgatcgcgtgtgactttcccatttgatagggtctaaactcctaaatttaatttcaaaatttaatttcaaaagttgggtttgaattgtagttatggagttactaaaacccaattctacctctctaatttattttattagagcactttagtcagctcacttcattttttatttttatattgaagttgaaattgttttgattggactttagctccagaaaatgtggacttcagctccggacttcattttttttattgaagctgtgtcaaactggcggtagaagtcctctgtgttcgcatgagctcgatgtgaattgtgaactattccctccacacgaaaaaccgagcgtttcattagcgcataattaattaagtattagttttttttttcaaaaatggattaatttgattttttaagcaactttcatatagaaacttttttaagtagtacaccatttagcagtttaaaaaacgtgcgcgtgaaaaacgagggaaatgtgttgggaacgaggggttgcaacacagc

SEQ ID NO: 59220 - DNA, 1668 bp, Oryza sativa
ctgtctaaagactttgcagtcattggtggagtgggaaccagaattgtgccacttacaatactttcttttccctagttcctcagccgatgggattatgtggccagcaggaagttgtatttgcttctcccgaagtagcaagtcaaaaatttatcagctttagtaatatcatttaagcaacaccccatcttctgtcgatatataaccttgaaaacatcttcatcggaatcggctgcgtcacctctatcagctgtatcggctgtcctctgtccgatccatctcagccgatgcagactccagccgatgcattcgcagtcgatgcacactctgttcttcgaatcgatctctttatcgaatccgcctcgatcccaatgtcaaacctggttcacaatttaccaaatttgatcgtcaacaggtggcgctctccccttgcacagatccaacaacagctaccatatctcgtcacgacggcggcgacctcagcaatgacagtgggcgggagcaacgtgcaccgccgttgggagcgggcgaatctcgagagtggcgatgggcgggcggccggcgtgctagggtttgggattgtgcaaccagcagcggcggagctgggttttctttttgagaattttatttatatattttgtgattttttttgtttttgcatgtggttggcttaaatgcccgcatgcgaaaatcagattttcgcatgtagattttttagacctttgagctcatgtgggccattcacacgcatgcaaagatcgatttgggccatatgaaaaatgaaatttgtagtaggtgtctcttcttcaaattcagataaagatatttgttaaacaaaagtctgaaatgtgtgcactgaccaagtgaccatagagaataaaatgctcaattcagtaataaatatgggatacgtttattctaattcctaaataaaagataccagtctccaaaattttcagcatgcatgtatcaaatctacatgacgaaagagctaaatcaacccccattatttgtatatgacttaaatagttatagaataaattgaaaaaaatagtaacatagattgtgttgatattagtctatacataaacatgtatgactaaatttgatctacaactagagaaataaaaataataaaatcagacagtgaatagtactcatatagataaaatttgttatttttgtttctacatatgtctatcgaatttagacttgcatattcgtatagtgtcttatattattatagtccatcttatcaaattttacaaacatacatgactaaatttgttctacaattagagaaacaaaaataacaaaatcagacagtattcactacccatatagcgcaaataaaatttgttttttttcttcatatatctatcgaatttagactcatatgtttatatagtgtcttatattattatagtccatcatattaaatttataattttttatataactgtttaaattacatgcataaacctaggtttagaaaatactttccacagcacagttagaatctgaaatgttctggcaatgtatcttctgaaatgtaagaagctaacaactgcactaatttgaatacacaagcccagatcaagcgaactaatcaaatcaatattgcaattctgcacaatgctaataaaaagaaagcgagctgaagatgcacag

SEQ ID NO: 59221 - DNA, 726 bp, Oryza sativa
tgcattttgcttgcacgcgctcagtccggatcgcggcgtgcccttcttttcccaaaaaccgctactaaaattaggccgctttccccccttctctccctgcttgtgttcacagcaatagcagctcgggttggcttgggacacttaaaatattggagcagagcagcagcagcagtagtaggcaccactatgaattgcaagttgccttgtcccctgtttgcactctcacgaaaccgttagttctgtgcacatctttccgggcatgccccaccttgtgtggacaacagtatgttgtatgcaatgtgtgtgtggggtaggccaaagttggtggtacttgcaaacaaaaagtcgctttaatctcgcaccagttgcttgaccactacaggaaccgagatgcgttgccattttgcctattctgatgatgccatgatctggggtatatttctgatgtgttgttttggatttgtgatcgtgcaggccgagtacttccgtcaccttctcaagcccgtgacgtaggttgaccagtacataatcctcctcccttcttcacccgacgagagagctagctgcgcagcttctctcacaaggaaaaaaacagaggagacaaacagagtttggaagttaagagcagaagaagatgcagggagaccacgggtactacggcgggagggactcgccgccgcaggggtacggctacggcggcggctacggctacggaggggctgcagg

SEQ ID NO: 59222 - DNA, 1544 bp, Oryza sativa
gttgtttgtagagatgtcgacgtcgaggatgtccagcagcgcgggcaacctaaattgcctgtagtcattctggcacttgcgcttgagccgtatgtgccgcaggacgacgtagaccaggatctgcccgtggagacgggcgtggcgacgactcctttaagttggttcttgtcgtttccatttcctttgctcttctatcttgattagcttaacttaggtatttgcttgccgggcagacctcgaaagtgcgcttgcttatcgcgactgtcgcatccaatactggaggatgaagttcaaggtcgccgaacttgaggggactatgttggaagtgaagagggactgggccgtggaggcactccgaggtcgcgaggtgtggttcaactcgtacctcaggagttgttgcacaacctcgcgaggatcccgaggagtcagcggccggctatatctcgtggccgttgtcgtagacacgggtcttgatcccttgtagtactataccgtttgccctttcgacctatccgttactctgagggtgagaaaccgaggcgaagcatatcttgactcccagtccaatgtagtaatcctggaaatcggcgctgatgaattgggagccgctatccgttatgatgcggtgaggcaatccatatctgcaaaatatccccttaatgaatttgatggctttgtcggccttgatttcccccgtgggtgttgcctcgatccatttggtgaatttgtcgattgccatgaacaagaatttgtaaccgccctgtcctcgtgggaatggaccgagtatgtcgagcccccagcacgagaacggccaagtgagagggatggtttgcagtgcttgcgctggtagctttgtgtgtttgctatgaaattgacaagcttcacaccgttgtaccatgtcgcaagtgtctttgagggcggttaggcagaaaaatccttgtcgaaaagcttttccaaccaatgtacgactggcggcatgtgatccacagaccccttcgtgtatgtcgaggaggaggtgtttgccgtcgtcggacgagacgcatttgagaagtaccccgtttggcgcctttttgtatagatcgttgccgatcatacagtagatttttgcttgacgggttattttctcggcttctgcgtcgtcctcgggcaactcgtcgctgcttatgaatttaatgagtggggtccaccagtcgtccgtggtctcgatgtcggcaacggcgtgctctgcctctgtagccccctgagctgatgtcgggggtgactgggctatcttcgtcgtttgcctctttcaccgatggctttttcaggatgtccagaaaggtgccgggttcgagtggctctcgtctggatgcacgccgtgctagatcgtctggctcgatgttgtccttgcgatatacgtgtcagacctcgatcccatcaaatcttttttccagcttcctgacttctgcgagatacttggacaactcagggctagagcatttgtaatctttgtgcacctagtttgcgactagttcggaatccccttttacgatcagtcgcttgac

SEQ ID NO: 59223 - DNA, 3343 bp, Oryza sativa
cagtttgcccgacggtaccccgaacgtgcacttctcagaattgagcatgaggcgatatcgtctgaggtcgtcgaaggtttcccgtagatcatcaatcaacgagtggcatgtcttggtagtgacaacaatgtcatcgacgtaggcctcaacattgttacccagctgatcgctaagtgccccttggaccgtacgctggaaggtatttcctgcggttatcagtccaagtggcattttaacgtagcagaatacaccgaacggcgtgatgaatgttgttttctcctcgtcctcttttgccatgctgatttggtggtagctagagtaagcgtcaaggaagctcaagagctcgcaaccagctgttgagtccactagttggtcgattcgagggagagggaagtgatccttggggcacgccttgttgaggtcggtgaagtcgacacacatcctccacttcccgtgggccttccgcaccatgactgggttggctagccactctggatggagtacctctctgatgaagccagctttgagaagtttatcgagctcttctcgtatggcatgtttccgatctggtgcaaatctccgcagtttttgctttactggcttggcatcgggtcgcaccatgagtttgtgctcaatcacctccctggggacccccggcatgtcggacggctgccaagcgaatacgtccgcattgtcgtggaggatggtgatgagcgcgagttcctatttctcattcagtgatgccccgattttgactgtcttgtcggggttggcactggagagtggaacgattttgattgcaccgtctggtttcggcgtcttagtcgttttgatcactttcttgggtggctcggctgtggcgggtgggctgggcgtgtgttcgaccatgtcgaggctccgcttgtcgcattggatcgccagctttgcgttcccttgaatagtgattgttctcttcggcccgggcatcttgagtacctgatacgcgtagtgagatgcggccatgaacttcacgagtgcagttcttccgatgatggtgttatatgctgtgtcaaactcagcaacatcaaatgttatctgctctgttcagaagttgctcgcttggccgaaagtcacaggaagcgtgatcttgcccaatggcttggacgaagactgaagagtgattccatggaagggttgatcggtaggtgtctgttgacaaaaaaatcgaatacaccggcctgggagatctgcttagctcctgtgtaggtccaaatatgatgagatgcgggcgtgccagtcagtttgatcctgcaactgacaagatatgcaaatagtagatcaaaacagccgatcggctgacaagccgatggagtagttccagccgataaccgataatagccgatgccgataccagccgatggcgatagggtttaagaaatcggctatatgtccaatgtagataattatataaaggcaatcagctgataatgatgtaataaaataacaatataacccaatataaaccaatcggctagcaatgatatgataaataagcatcgatccgaaagtttaagcacatatcggctggaggtccgatgtcatgaaatccacaagattagattaaacagtgaaacctttgttgtcatcggctaaatccaacttatatgtatatgcaatccttatgagccgatgcaacgtccagataattcaacggctgaaaccccgatgaaacccttatcggcaatcaagaagcaggctagagattatggttctaagcacaacttagtagatcaaacttaactgattcagcactaagtatgaaaagaaacacaatatctagataatcaagccgatgactgattttcagggtggtacatgcctaagctaatctaatctagcaacgcgatttagccgatatcggcagaaaccctaaaacgagaagcagccgatatagctaaattgatatgctaagactagattaatagagacatatgataaataggtaggcaaatatatcatccaaactagagcaatccaagaggtcgaatgtactgatgcagccttgaacgacgccgaagtagatgagacaattgcctgggccgacggaacattggacttaccccttcaccagagattgaacaccgatgcagccccacgtcaggtgccaagtcccgctggacgataaaataaagtagaaaaggtaaaaggtggtgatgcgccgaattgtattgatcgtagtgataaattatatagacccagggtgtacatatttatacccatgggttgatacaagtccttgtcggacaagaaagaaactaacctaaagataaaaggaaaatataaagtccttatcggacactaaacacactttcctaaagataaaaggaaactaacaaactattcctaattaatagataaactgccatgctacatcctctttaaactcggtcacttagggataagcttcctttagtagattgatttccttaaccgaatatagcaggaatccaactattggcgacttgataactcccatcggctgattccgagatactgtagccgataatgattctaagccgatgacgtctttgccgattaccaaatttcactgttaacagtgtcaactcgcttcgtggaatttccattgcgtccaaggtgctggcgaagagaaggttgatggagctgccgccatcgacgaggactcgcgctaccttgatattccgaatagtgggttcaaccacgatcggatatcgtcctgggataacaacagccttggggtggtcctcatctgagaactcgatcttctgttcagaccacttcatcttgggtgcaaccccttgccatgtcgaacaaacctcacgctccacttttttgtattctcactttgaagattacgctgtggaacctccgaagccgagtccgactcctgagtggttgcctcagtggccttctcgactacacgtactcgcttgcccttctccaaagctagttgcttttccagcgactttttgaagatgaggcactcctctagagaatgtctgtccgacttgtgtatggggcaccatattctcttcgtatcactgccttgtgggtctgagtgtttgggtggtcgcttgtatttagacgcgaggacttccgcttgagctttcctcttcccactcttccgcttttcttcttgcttggttcgagtgcgtccttggctggcttcttctctcctcctgcctttgtcttgtcactcttgcgtctcagtgcattgtctgcatgggcgcatcgatcgacaacctcgaacaaccttcgagtagttgtgatttgccttgttgccaactcctgggtagtatagcgatctctgacaccagttttgaaa

SEQ ID NO: 59224 - DNA, 1529 bp, Oryza sativa
atgggattatatggagagaacaacagattacaaagggaataatagaactcgatggtaccgacgagatcgtagtcgagttgattcgactagatcacccgtcgacctggctcctgtagtttccggcttcgtaggctgtggttgttgtgttggctatgagattcaatccttaggtccccctaggggtcccttttatatcgcaggtcaggcggtctccaagtaggactcggagacatcggaccctgcacgatatagtaacgacccagtcctatacgggtaggaacctttccattggtgaacttagtgatggattccttagcgtgtacagagaatgtccgtatatgcgccgatgtaccgtattgccgtatagtgtacatccaagggtagagggtataccttatccgtaaccctgacaagtctattttcccttcctcctctttgggctaacatatgtatagctaaaataagtctatttttcgtcccttctctttgggctgacatatgtatagataaaaaaagtctattttacatcccttttctttcgtccattgtatacaatatgtctatttttactctcctattttttttgtatcgggcttggctgcttgcccgtcgtgtcgggccggcccaacgtgccggtggaggggcccaggcacggccagatggtcgggctgggctggcacgggcccgacctccgtcaggctgtgccgtgcttgggccagaccaaaatgtcgtgtcataggccgggccgtcgggcctcgggccttttggccatctatactcgtataagagagcctaaggaaaaaaaaggtggtttaataaggagatttagccaaggtctggtctgcgtgtcagtaaggttagaggaggatttagggagaggattactgtagggattagattagaaatctgttgggcccactttgtcggtgacccactcctctcccttttcctctcctctttctcgattcttcctcaccgctctactccctctcgttccccttctcacatgcgtgcgtgcccgagcgggaggcggctggcacgcgacggcatgggtagcggccgagcgatggcggcttagcgcggcggtgcgggagggcggcgatgtggggaggaaggcggtcgccgcggcgttgctagccggcggtcgggaggaggcgcctaggcggcggcgctcggcctggcgcaccggcggcgggaggcggtgaggagcagtggcgtgggaaggaggttgccgcgggagcgaggcaggcggcgttggggatggaaagggtggctggtacagcgatgagaggcggaggaggtgatgcggtacggaaaggtggtcgctgcgggagcgtcggccagcggcttggaggaggaggcaggcgagctggatggaagtgaagatggcggtgctgcggctccctggccggaagaaaatcaaggcggtcgagggaggagctcgcgcaggctggcgtggccgtgcgcggcggtgtcggtggcggggagaggatgttggtggcggctcggcaggggtggtggtggtggat

SEQ ID NO: 59225 - DNA, 1850 bp, Oryza sativa
agggttcaatagccttccggaatggatagggcagttcatttatctgaaagaaattagcatcttcgattccccaacttgacatctttgccagagagcatatggaacattaccaccttagaattattatatatttatttttgtccaagactggctgaatggtgccaaagggaggatgctaacaagatatctcgcatcccaaagattatgttagatggtgaaatatttataccgggacaagcaatcgatggatgagaggtatatgagtaataactattcttttcattcatctattaacgtttgcatttgcttcaacattatattttgatctagaaattcaatgatgcaaataatatttgtcttgtctggtatttgttctcacgtcatccctcaacgttttgcaattagttgagctctccaatttccaactgagtgtgctctaaacctgtcacactgtatttgattgctgctttatgaacgaatattttatattactgatgttaatcgattcctcagtcctcacctagctgtacacgtttcttaacttgtctgtttttgttttcatcttgtgatattttcagcacaagcaaggtttggctaatatgctatacttttgcagagcgaatcaaggcagagtgaaccatagatcaagcggtcttttgcccaggacagaatgtgtagagagcaaaaaaggagggacgaagcaaaattctaaatcagtcaattccaacaacttctgaatattatttcaccttcaaggtatactaagtctccactcccatctgtctattacatttttcacttgctggttggtacgtacgctaccgcattttgaatcgacagtaagctaatcgagtactagcatctatcagaggctggaagctccgtcaggggcgtcctctggcctcggccgtggtactcgaagctgtcgctcaagcggcagttcgccgtcacaggcgccacgtccggcgtggcgtgtccttcttcgggagtgggccgtacaatctgatgccgctgtccgccgacgccgtccgacgtgagcagcatcctctcctacaacgaccaaggtcaggaccaatgaacccctcgacgaacagcatctacctccggggcatctccgtcaaccaagaagaagtccggccgcctccctccaggcgtcggcgtgctcatgtcatgactcgacgtggccgcgcgcgccctacactgcaccgtcctgcgacgccaaggaaggcgacgccaccgaggatcgataccgtgcatgccgagcgtgagcccgttggaggattcacctgcgcccatgacacgcggaggcggcggcggggaactggatgatgatcgatcggtgttgagttgtgaaccaaagttcatttgcacataataaatatcagtttctgctggagcgaagcgcccccgcggtatggatcgttatcctttagggtttcaccttcatgtatatacctcttataagccgccattcggtgttgtaactttaccccgatacagtgaagatattttattggctggtgtcagtgattttttctctcctctattgttttttatgtttatttgcctatcgtttcctatcaatcgggtccaactcgctagcgcaggtggcgagagcgacacggcgtgcttggcgttcgtcgactgtggttgggcagcgacgatgagcgcggtgaccgtgcgggcgttccagatggagaacgtacaacgtaacttgttgctgttcgatgaggccgcgtccagactactaagctggttcagtcagtggcaccctttggttcatcaggatatcttgggttggtttggtttgtggtctaaataggtcttaccaaattttgtcaatgccaaat

SEQ ID NO: 59226 - DNA, 1468 bp, Oryza sativa
cgacgttgaggacgtgctggatgaattcgatgctgctcagctcatcaggaaccatcaatccaaggtacttccacatattgtcgtgtttgaataaatgttatatgcttcaactttacggatcagctgctgcacatgtgtgattttctttgtggaacttttttgcatcataccagcccgattaatttctaaaattaaaaaggaaattcatcttttccactaccatgccatttcccgatccatatcggactatcagagactagtctgagtagatgaaaattgatctacaaaggacactaatatagacagtgactttgactccaattttatttttcagctcaagttatacttttcctggaacaatccgctcctccagaaaatgaccatagcacgcaacatgaagaacttgagggataaaatagttgcaatagaaaaggatggcaagatgctcaatcttgtgcgtcatgaaccacatgcaaaagggagtagaagcaacgaaacttttactgtcagtgatgatatggagattggaatgctagggagggatgctgaaacagaaaaaataatcagccttctattgaaaactgaagccaaggaggatatctcaattattccaattgttgggcttggtggactagggaagacaaccttagcccaagcagtttttgcagacaaaagggtccgtgtctttgatatgaaaatctgggtttatgtttcagaggattttgatctgctcaaaattgggaaggctatcatcagaggagcaaacagaagtatcaacctggacaactgcaacttgcagtttgtaaacaataatctgaaaaaagaacttgccaacagaagatacttgattgttctagatgatctctgggaagaatatggagaaaatttggaaaagttgaagcagatgttacaacatggcggaaagggtagcaagattatagcaactacacgtagtggaagcgtagtgcaagtactatacactggttatcttgcaaatgaacggaaagtatgtccggtgcctgagcctgatcatatcaatttgggtgttttatcaccttacgactgctggagcgtcatgaagcggagagtatttgggcctgatgatggccaaaatggcttagaggaaattggaaggcaaattgccgagaagtgtggaggactaccactggtggcaaatgctctcgggcaagtaatgtctgaacataggacggttgaggcatggacagatataagggatagaaagattgttttggatttcaaagcagatcatcagcaagacactatagagcgcctaatgttgagctattactatatgaagcgagaattcaaaatgtgctttacatatttggcagccttttcgaagggtttcgtcatggacactgatcgcttgatccagcaatggatagcccttggatacattgagcacgagataatggtcaaaggtgtgtcaactatcttttgcggatgt

SEQ ID NO: 59227 - DNA, 964 bp, Oryza sativa
tggtggccggcggcgtgccggaggccttggcggccttgcgggcggcgcggtggctgggcggcgcggcggagggccgggcggcctcgcggcgggcggcgcgccagcggccggcgctgcagcggcagcggcaacgacaacgggcttttttttcttctttttagaatttgtgtgtgatgtgaatgtgatgtatctgtgatgaattttataaaatttgtgatgtatctatgatgtatcgatttgaggagttgaggatttgaggatttggggataatttatttgggattttgggatggggatggggtgaaatcaatatattaaaaacaatgaagaaaagaaaataataatggagcaaccggatctagctagcctagctctatctttagtccctaccaaccgggactaaaaaggctctatcgggacttaaaaattgatttttactcccggttttttcacccgggactaaagatcagtcccggattggtagtcccggttttcaaaccgggactaaggggggttacaaaccgagagtaaagcccctttctccatcggtaaattttttgtcaactaaacatgccctaagaatgaaaaaaaaaatttggtggagacaggatgcaaattaacaggctctcattcatccccaccctatatagctgtcacgtggacaaccgagcgatcgaacgtctcagctgggcaaggctccaggcgcagggcaaatagaatggaggagccgagtcacccgtcatctcccaagcctgtcggctcacgggctcagagcctcagattgcatcggcatatttactttgcaaatccgccgacgtcgtctatctcgtcgatcagctcttttgcccgttgtccgcgcgctcaccagcgatggctagggcgaacaccgttggtccactcctccttgacattggacgtaacccactgctgcaggtcgatccataccattgtcatttcgctttcg

SEQ ID NO: 59228 - DNA, 1622 bp, Oryza sativa
  unsure (1)..(1622): unsure at all n locations
ttatatagtttttaaaagtcactgcaatttctaccccttacttctgccatctccttctttatttgcttgctagatctaccactttctattcattctccttgtaacctttaaaaattggatcttatagtttttagagtctattgtcttgttaggtttctttttataatttctagaagtcacatcaaacgctgccattatactattctacggttcgtccaatgtcttttttctgtttattatcattgggattttaaaattcgaatataataatcattcgggttcatttttttttactttttagaagtcccgccaaaccgttaacggctttgccactaaactcctctatggcttatctgctgcctctcttctttattgtcattgagattttaaaatcgaacatgattgtcattgggtttttttttactttttagaagttccgaacctttaaaaattggaccttgtagtttttagagtttattgtcttgttgggtttcattttttataatttttagaagtcctgttaaacgatgccactatactcctctacagctcacccgccgcctactctttattatcattgggattctcaaaatcgaacataactaccgttggaattcattttttattttctagaagtcctaccaaccatcggtggctctgcaactatactcctatacacctagtccgctgcttctcctttttattgtcattgagattttaaaaatcgaatatgattatcaatgtggtntattttttttactttctagaaatcctagcaaccgccttgtccgtttgcttcacgacctatatgttgtccctccttttaatcgtcagtaggattctatttggtgttttatcaacaagtatatgtcgtttcaacgaccaccactctactcctttataggcatgttacttaatttatcttgtcatatgttttaggtggtatttctttcaatagtccttattttctatcaccaattagttatcaataaattgtattcctaatggaaatctttttattccttttctaatttcagaatttatttttttttcaaattttaactaatattgtatagtgttcttttaatatttttatttttcaattccagttgtttcaaaattgtattcctactcaactctcttttactttttttaatttttatattattttattttttattctgaattttaattaatctcgtatcgggttcttatatggattcttctttcaatattgcttatttttaatttagaatttctattaattttaaattgtattcctactttaactcttattttctttttgctaattttagattttatttttatttttcttccaaatattaactaatatcgtattgggtttttatattgactattctctcaatattcattatttttaattccgaatttcagctatttttgattttgtatttctacttggaatctccttttctttttctctgattaatgtgggaatttctctgattaaaaatcgaacatacctatcgttggaatttattttttattttctagaagtcccgccaaccatcggtggctctgcaactatactcctatacacccagctcactgcttctcctttttattgtcattgagatttt

SEQ ID NO: 59229 - DNA, 1976 bp, Oryza sativa
aaattgtattcctaatggaaatcttttttttctttttctaatttcagaattttttttttcaaattttactaataccgtatagtgttcttttaatatttttatttttcaattccagttgtttcaaaattgtattcctactcaactctcttttactttttttaattttttatattattttattttttattttgaattttaattaatctcgtatcgagttcttatatggattattctttcaatattgcttatttttaatttcgaatttctgttaattttaaattgtattcctacttgaactcttattttctttttgctaattttagattttatttttatttttcttccgaatattaactaatatcgtattgggttcttatattgactattctctcaatattccttatttttaatttcgaatttcagctatttttgaattgtatttctacttggactctccttttctttttttctgattaatgtggaaatttctagcacccacagcgaacatggtgccttctttcaaagctgttttaataatataatagatcacttctaacatttgaaatttgtatcaaaatataagtagttttatagtgttcattagtacaggaatgatgtcctggatgggactcattttagattgcaaacgaaccataagtggtcgcgtctataaaaatcgagctctattttcacgtgcggctctttaaaatgaccacactgaaaaatcaattttcgcatgcgggccactttaacaggtccggacttgttaagagacccgcacacgaaaatacctacccatatttttaatgccgccatctccgcccatcgcacactctcatctcttcccacctccctcctcctccctcgactcctctctctcctccatctcctcccacctcgactcctcccttgactcccatctccttcctcctcccttgactcctctctctcctcctccccctcctcccatctcccaatctcgacaacgacggcggcctcagctagggctgtggcatcggttagagcgacgaaggcggcggcatcggttagagcggcggaggcggtggcattggcgcgctagggtggtggctgcggagcggatccgtcgccagccaccgcggggaggccggatccgtcgcctgccaccgcgggaaggccggatccgtcgcaggccaccgcggggaggccagattcgtcgctggcgaccgcggggatgacggcggtgggcctgggcaaggcgtcggcgacgacaatggtggtgacggctgcgacagcggtggtggccgctagattagggttcaattttttttatttttttgttttgattttttattctcccatgcgggcggcttaagaacccacacgcaaaaattgcgattttcggattttcgttgacacctcgttcccgacgagtgaaagttccgcatgcaaaaatcaattccggctgccggaaaaatcgttattgtactagtggtttgcgcttgtgtcatccatcacatttaattttatttatatcttactccaaaacgatcctctcattttcaactcaaatttaagcgcttcattggaatagagtatccttaggaatttaaaggattcaaatcctaaggaaattttggttgtttgcaacgtaggaaaattcctttggattacaatcctatagccaaattccatagaaaattttacacgtaagctgcaacctcattttaactttttgtttaagaagtccaatacttcctcctccttttttagggtgaagttcaatactacttcttatctctttgtctctcttttcttttaaaatccatccaaattccttttttcctgtgagctatccgaacacacagtcttgtaaatttctgtgttttgcattcctgcggaatttgcttacacacgacatttcatttctatatttttcatattcttgcatttctaaattttatgttccaaataagcagtaatgtattcctataagg

SEQ ID NO: 59230 - DNA, 1098 bp, Oryza sativa
ggcatgatggctgcgatgatgatggcgtccatcggcgatcgagaggacgccgctcccgacacctgcacgcctcgggagccactctgcaccttggacctggtctacggtggacgccgcaacccatacatattaccgccacaatcatcatcatgccctccattactcctcctagtactacttcattatctctccatactgattcatctgcaaactggagtagtagcatttgcaatcctgcatattgcaccgctacacgaacaaaaagtttcactagccccctctgcattgtgggccccacttcttagcacacaatcacacatgcaattaaattttaaaatatactgttcattttttctttctcgtaaatatgcgggatgcaattttattgatacagatataccatcaatatcacagtcccgcgccacgaatgggagagactatactcggtgtcgtgtggcgcgttctggcatgcccaataagagagcccaaatagtcgttattcatccaatttcagaccggtcttcacataaaagcgttggttttccccaggtcattgggggccaagaattaaccaaattggccgtaaaatggggttaaccaattacatcaggatatttatgagaaaaagaaaaatgaccatatattaatatttcaaatttaattcctcgcacgtgactgtcggtcggtgacatatatataggcacgcaactaatagaagttagttttcgtgctccatccatgtgtatgcagtatggagtatggactatggtctatgagtatataagtatgcatgcattcatacgcaacgtgttagtgcttaattgcatgcgggtgctaattaatcttgtttgcataaggtgactgtcctgtctagtgtgccgctgatctttccatggaatctgctgctgctactacgaatagtactccattttacaaaaggtgcaggggatcgagggcgtgcaactacaaatgtgaggccgcactagcgtataattgtggatgaatgcatgcgggcatgtgttttggcccacctgcctgcccatgtgggcgcatggtgtacccgctgtcttttctacattgtgggtgtactcaagttcg

SEQ ID NO: 59231 - DNA, 1220 bp, Oryza sativa
agtcaaatttaagacggtagatgaagttgaacatggtcttcggagagtctatgatgtgacagctaggaagaattcaattcacttggcaagatgactgtggtgatatgagagaaggtggagcaatgttgcaggtggagtcaggaggaagaaattacaaggatagcgggagtctcttgtttacggtgagcctgatggaggcttgtcggggcagctcggcgtgagcggcgaaaaaggatcaactcaagtcttggtacacgaaggttcgagcaagtaacagattcggattggcgtgacatattcgccaaggtggagtttgttagagtttgtgtcgaatatgtgtacgtagtcggttacagtttaggacttggagttgtactaggtgtaggactagagtataagtcgactctatcctagattctctcataaatagaggggcgtgcctgttgtaaccgtatggcgacttagcatagcgagagggagcggctgccggcatcgaccggccgtgagtcgttgtaactctgatacgttgtatatgctggatcagggaggagcgcccgtaatcagtgccccggagatgtaggccttggctgaactccgttatcaaatatcgtgcctcggtgtcgtcatcgtgtttggatcttctatgacgtttcttccgcgtttggtttccgatgtgatttcgggccggttttataacagaaacatccaaatatattggctggaacatcaaaaaaaatcatgaaaatgtattggtccaactctggtttcttcctcctctttggtgatcgttggctcctttggtctctgttgcaaatccacaccaagatgtcatagtgcccttctactccaccgaggcgggtagctgctgctgcccaagccctcgtcaccccatcgtcgccgacaaacaggaggcacgctacttccagattcttgtagggaccattgtgttcttgctgcttctgcccatgccaatgtccgtaggatcttgccgggagctgcacgggaagctaggacgccccctcccccaccccccaatccaacaggggcgttgctcgacgacacaaaggagatgagtagtgtctctcagtccgccgttgaggacttgcgtgggagagagacgagagagagggggtcacgggatatgtggaacaaatgctcaatattttcttatccatcaggcgctcaataggtagcgttttggacgaaatatacagggtagg

SEQ ID NO: 59232 - DNA, 1138 bp, Oryza sativa
  unsure (1)..(1138): unsure at all n locations
cgacctgtgcctataatacatatatatagcttctgtggtgattgaacttacagtttaaccgatgatgctgcggccacggggcttcatcaatcctttatcttgcaaaatgtccctgacttgcactgcgccactccacatgtcttgatacgcatacaggttagacatggtcacataatatccactattttcaggctccagacagagcaaatgcttggcaacggattcacacatcttcagttcagatttcttgctgcaagcacttaacagcgcaccccagactccatgtgcttgtttcgatggtaaactctccacaaacttatgtgcttcctgcagccgaccagcacgcccaagcatgtctacaacacagacatggtgttctggggttgggataatcccaaaatgttctatcataagatggtagtacttcaatccttcatcagtaagtccagagtgactgcaagctgacaacagagcaataaaagtacttcttgtagctttcactccagaattattcatcttccagaaaatttcaatcgatttcaacccaagcccatggaatccaaaagctgatatcatggaattccagcaagcaatcgatttttcagcagaagattcaaatactctgatcgaaatgtccagtcttccgcacttactatacatatcaacaagtgatgctgaaataaaaacgttagtttgcagaccaaacctgaccacatgcccatgaatgttctttccttgcctaagatccccaagttgagtgcaagcacagataatgccgacaatagatatttcattgggttcaaaatcctccatcttcttgtagaactgaaatgccctcaagccttcgttattctgtgcaaaaccagagatcatgcaattccaggagcacagatttctaccaacgagactagagaaaattaactcagcactttcagtatctccaaatcggaagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59233 - DNA, 1049 bp, Oryza sativa
gtcaaactcttataaatcacaaaagtatttacgaagtgatttgatagttttaattctttatgcaaactgcattcactagtgcggtgtaacatgcattagacccggactatcatatttcctgacatttcctatctaggggttcattctctccccctaaatgactggaaataattcttatttgtcaaggaattcaggcttcataactatctctgtaaaaggtttccgactttcggagagagccttttgcaatgcattatgatagtggaaaatgcacataaaccaaacaaatgcaatagcactagttgcaggatggatgttcatgccgatggtctaaatttgctttcagagtccgctacttttaggactacatgtccttttctactgcgggtaatacaacaaggatatagcaaatattgcaattcatatcttatagttagtccgcttatgcggatatttggtacttcgtgctaccaattcaccaatcatcaaatgcaatgctagcattgtcctcgtggacttctaaggatgatttagtgagttctattggggttcacgtgatctttctggatcagtcttggcaaatacacggtgtctatgagacactagatgtttgctacttcggaagcgcatatgtccatacagtaccaaatgggagccgcagatattcctcgcaatccagttcagggatgctagaactatatgtggtttatgcactaatctcctgtcgctgcatactggcacacaaatattcatgatttgggaaaatcatgcatacatgtgctatgaccatacgagttgtaatatttattcttataattctaagactgaaaatggctaaaaatccattgctaaaatggtgtagcccaaatcatcacacttttagaaagttcaacgaggttgacggacaatagatgcttctataaagtgcatcatttgttccataggtaatatgaccgtggcactttctcggctgacaaattcagtttgttgctgctagcaacggtcatactgtttcctgtactatggctctggaaatatctctttctctt

SEQ ID NO: 59234 - DNA, 3957 bp, Oryza sativa
  unsure (1)..(3957): unsure at all n locations
ccatggctcttttatgtgataatatgattttcggtgatatttgcaaatttcaaatgactttcaaacaaatatcccaaataccgagggttatttgtgtattttctgaaaaattcagggtttacagtacaaagatttcaatgcaaaggaacaggcacttaatttccaaaaacagcaaaaatcacaggatagatactttcctttttctattttctttccatttttttctttccttgtcttctccttaacttcttttctccactcccgttgactccgcacctgccatgtgcggtggccgggatgccgaggtggcgcggcggcggggtggtcaggtggcgctggcggccaagcggcgcggcgcagcgcacggcggcctggcgcaacgcgcggcaggcggtgtggcgcgcggcgaggcagggcggtgcgcggcttcggcagcggcgcggccgtgcagggcgcggctgtgcggcgagggcgctggccggtggggacggccgtccggcggcccggggcggccggagcagcgaggcggcgaagcggccggaggcgaggtgctgcggccaagaggggcggcacgaccgcacgagacgcggcttggtgtggccggcgaccggcgctgcgcggcagccgggcagctaggcagtgctgctcggtgcggcggcgtacgacggtcaggatgcatggcgcgcgtgcggcagtccactccggtgcggatgcggctcgccgctcgcggcaggcgcgggggcttggtgtgagcatggcccgtggcgtccgcgttgccgtgcggcggtagcgcgggtcgcggtagtctcggcgtggccagcgtcgccttctctcctttccgtttttttaatttttttttcgatttcttctttctcttcttcttcctaatggcgcatgcgtcgtggatgcggccgatgtagacggcgcggcctagcgctgtgcgtgtgctttggcgcgacctggtgcggatgcggctcgatggcgcggccgttggcacagtcaggctgcggggtgctcgctggtgtggccgacggcgtgacgcgccattttcccctttcttgcacttttcttgtttcatttcttctctctctccttccttggtggtgctgccatggcggccaaacagtgtcgcacacgcatccagcatgggcttgctgcgtgctctcgttgcagtggcacggcggccagtgacggcgcgggtgcagccatggaggcggggtggccggcgtgcgttcaggagggcgcggttctcgtcggggtatccgtgtgcggcatgacgtggagggacgcgctcagccagctagtgtttttggggaaatccctaatcggctttcgccggcgactccaagtcggcgttagcagatntctccagagaaaagcaaaaacggaacgagaacgaggagagtaattcgttttcgcgattagacggcgagatgcaaaacggatctacgtgttattacccttcttcttcttggtatcgtgctgataacgtattatgcaacccagtgctacatccgtagttcaaaggggttacataatgtttataaaagtggagacacaagatatgagggtgtggcatcatttctcattcacccattgcattctcaagtgtacaaaacctctcctccaaccctctatttatagggcaatgccttgccactttacatattagtgatgggcccaattagggggtaaccgggccgggccttcatgggccggcggtttcctaacaattatatcgatgtgatggaggtgatcactcgatgtgagtgtatgtcggaagacgggtggagacatgagcgccacccgtaacacaaaacctttgcgaaaaccaaaaacttaataaaacaaaatgatttcgactgggcagcatgaatagaatatgggtggttctgtaaacggcaagtcgccaaccctggtcaattaaggactgagtcaagaagctatacaggaaacgaaacgagtacaaccgcatttcttcaatgggtatagacccagcgaactaagaaatagttgtggggtggcaccccagtcgtggtggttctgcagtggtgacgattgtgatggaagtgtggatcgattggatcgatcgtttgaatgccgaggcaaaaacctaaaatgcacctaagtatatattgttatatatattgtatacccccttttattatctcgggagcgccaggactcccttcactgctagctcgaggtgttgtgttgtgacgggagtgcaatggggatctatagtcgttggagcgggtgctgcaatgcgaggatgactgaaaaaacgggacgtgataagtctcatgtgttgggactaggcttatgtgttgggcaagtcgtggagtgcaggattaaaagcatacattaactgcagtgtgagtaaaacaaatctattcaaatagccgtgcttgcggttaatgagcgtcgggacttttactactcttgactaggctcatagattttaatcttgcttagattaggaaaagaggtgtgaccttgtccaatgagtgagaaggtcgtagtgatggaaaatgtgggaaaactagttgtgagggtaaaccggaccaagcgaggcttggggaaggtggatgaaccctcgcagattaacgaaccaagccatccttgaatccctgtgagcactatatacattctgtagtggtggctagctgagaacggttggtactcacccttgcttaattaaatattttagaaggagaagtcggagccgacttatacgtgtgccatgctgatgaagaggtgttgaagacggtggagtagggacctaggttcaccagtcgctgcctgtggaataagatggaccgtcgttgcttcgcttccgctaccgtatctacttctttggatatttggccttgtagatgaccatacttggtctatttggatgccactcgggcaaccattgtattattaatgtattgtaaagcctgtataacgatgtcagctttgtgatatacaacattgccatgtgtataccatctactgattcagagaatggtattgtaatcacatgaagttttcggtgtacaaaaccgggaggccgacacattaacattgctttgccctcgcaactaacaccggcccaccacccgctgctgaccctgggctccagctgctgcggtatcgcctacaccacccatcgctgatcagtcacctactaggccgtctaagcccgatcctccgctccaaagctctatccctatctttaacactaaacctacccctaaaccaaacccgatttacgttcacgagatgaaaatcttgggcacggtcgcggactagccttcccctttgcttttgccctacacgtctccgaccaaaaaatccattctgaatttcagacccgtccccgtcgcctacgtcattgtcggtaactcccggcagccggcacccagtcgccgggcaccgccacacatcggctccgtattctctacgaccagacacaagcccgcgctcgcactcactcggtatgttcaaaactagtactactactagtaactgcaggcatcagccgcagaagatctgcaatgggggccatagccacaagactacgtttccggacccaccggttcgcgtaagcaacaggccccacatgtcagttgcactgcgggctctttggacaatatccactcgctgaaaaaattaaggtgcggacagggtgatgcgagcaccaagagaaaatgtttcagtcactgacaggcggggcagaaatagctgttgcggtgtgggggcccgcatggcagcgagcgtggtggaaattagcggagacggcttcgtcgacgagcgcgatctcctcgcgcgataaggacacgcatagcggcacggcacacgcaggcagagaggcgagagcatcgcgactcgaggccaatttcttccttcccctttccttttcgctcgcggcgcgaggcgatcggatggcggcgtcgtcgtcgtcgtcgtcgt

SEQ ID NO: 59235 - DNA, 1370 bp, Oryza sativa
tttgaaagcacgaatcacagaagcgtcggtgatatcggggatggtatttctgcactcactaaagcgccaacatagtcccttaaagattcacccgaattctgtgttaatgtgtgtaaatcgtcttcgatctcgtggcgcttgtaagtccttggaagttagcgacgaattgctgccacaaatctgcccatcaagagatcgagtagggtgggaggtgcatcagccacgaacgcgcagaacctttcaacgccgttggcaaatagtttgctaacgcgttgtcgtctgccccggcagcgtatagtaccatggagtagacctggaagaattcttcagggtcagtactcccatcgtacttctctattgctccgggtcggaatctcttgggccatcggacatcacgtagagaacggttgaaagctctacacccggcgctaggggcggtgggttgtcggcgattgtgtgtcctccgtggatgtctatcggataacgaagatgaagatgatgacgatgatgacgatggttcactcggctccggtgtgcgattccgagggcgacgtacaggttctcgagaattctgtcgtcgtccaccattgttgtcatggcgccgatccccattatcaccaccgtcatgttgacgccctcgaccagcatcgtctggtgtccgctgttcgtgattgtcgcggtcgcggtggctgtgacgattatggtggtgttggtcttcgttcgagcggcctcctcgctcttcgttctcgcgacgtcgtaaagaaacacgatgtcgggaacgattcttgttgtcttgcgcgtgtcgtgcttcttggcggccattcagatagtcgcggagatcgccggtcccgcgaggtggaggggtagctcgtctaggcgacgtccgctgctccggtggttcgctgtcggcactgccagctgtcggtcgttctggttctgctctggtagcggcctcttcgaatgcgttactgagattggctaccgattcccgtagtcgttctgtccatcgtgcgagatcatcgttaagcacggagtcatagggagcttctatcagtattgcgttgacggtgccgagatgttgggccggcgtgaccgtctggttctccgcctctgcgttagcatgtgtagacgtgctagtcccaccaatggcaaatacgtcacgtgttgtactggaagatgacgagccatagtcttcgagcaagtgtaggactgatggctcgtggggatcaatgtcgattactccaacgaatcgatccgaggtcaacgtcgcttcttgttccttgtctgtctccttaagagagattcctgactgctggaccttaggaagcgtcgttctcatggcgcggagaaagacctagcagcttgagaag

SEQ ID NO: 59236 - DNA, 1086 bp, Oryza sativa
ccgttgcctcccaggctctgcgcggtgaggacgagctgacgtttgctgagcgcggcggcaacggagtggttggggcgaaacgggcagagggcgagtccgtttcgggcactacggcgtgcgtggcagcggcttatttggggttgaaggtggaggctggtggcatgaggcggtgtggaaattatgggtaccccatacgcacacggcatggttatccgactagttatagaggataacttgtatctatggaatatgtaatagatcattacttgggtattacgtttccttgtatattatggaacggcctagagtcctggtttggtaatattgtaaaatagatttaggaaaccgataccgtgttgcttaaggtttttatcttgtaatcatgcccccatcttatataaggtgggcaggaggctttctagggggcatgaacacataagatcgtcagatctatactacacccggcggattcaaatccccaaacaggagtagggtattacctctcattgagagggcctgaacctatctaaattcttgtctccgcttccatccacttttaggtctcgtgtgctattccattttattattgccgaattcatgttttgacagttggcgcgtcaggtagaggtgcgtcgagtttctattgacaagtgcgatggaataaattctcaggagtcgtcggcatcgtcttcgcttttatagcgtgagatccactgccgacgacaccaccttcatcttcggactagttcttctcttctggagtctgcctttcattgccatcgccgaaaattccgatgtgatcaacataaatagccaagcgactaatcaccgatccaatctaccaccggatgtcagtggccaaattatttccctgatgatcaagatttgaagctatcaactatcatgagtatccacagcccgccacgcaagtgcatatttccatctgacgcatgcgcatgtgtccaccgcatgacaattggctgaccaatcaggaagctgctagcaatggcaagcaatcaaattccaatcgccaatgttttttctcgtcgatatcaaattttctagcgagattcaattactacatgg

SEQ ID NO: 59237 - DNA, 742 bp, Oryza sativa
  unsure (1)..(742): unsure at all n locations
ttaaaaaaaatcttttgccactttgcctacgtgagttgctatatgaggtagccagtgtggaccagtgatatgcaatgtctgttttgcccctcgccttcgtttctctccttggagatgaaactcccaatttaaccagccgtctctcctctccgaatccgttcgcttggcggatcaactcgttggatgcaaatccaattccgatcaggagtaggcattcactctcgtttcctgccgatataactgagcgctagattggccatcgaccacatcaccaacaactctcgccgcctcacactcgcagatctgacagttgatttggggaaaaaaaattcaaaaaataaggagaaaatcttttcgccgccgacgaggaggagagggatgtcgcggccgaggacgacgagatgcccaaagcggcctgcgccccagctggccgtggctccgtgcgccgccaccggcaagcgccgccgcctcgcgccccccgagtcgccgtgggcgtcgttgaaccccgacctcctgcggctggtcgcggagcgggcgctcgccagcgacctcctcgactacgtccgcctccgcgccgtctgcgccgcctggcgctccgncacccgctgcccgcgcgggcgcgggatcaccgacccgcgcttccacccgcgccgctggatgatgttccccgagggccacggcctccaccccggccacgccaagctccgcgggttcgtccgcttcttcaacctctccaccggcg

SEQ ID NO: 59238 - DNA, 1372 bp, Oryza sativa
tacacagatgtgcaattctcacaaaatagttgggtcacagctcaccaaattcggtaattgtatggaaccacaagctgagagtgacggagttgccacttttagcattaaattctaacttactcattgtgcaaaacaagcaccgacacatggctaacgcaatacagatcaaataccgacatcaaatctagcagaaaacagctatacgcgaggaaatttgcatggtatcctctgatagaatggctacgctaaggctaaattaatccgtctcgcatccaaatcgaacgaaacataaatcgcattgaccagggtcgccacagtcagttcaaatttccgtacatccagatccaaacctcagaaacactgcctactcatgaatccgccacgagctaatcagaaatcgaaccgcagattccgctcgtcgggggggcattgcaaccagacgcaacggaaacgaaacggaatcaaaagcgagcaaggcgagagatctcggcaatgcggggctctcaccatcgaagccggcgcccggatccgggccctccgatcccctcccgcgccgcgcgaacggcgggagccagaacaccgccgacagcagcacggcgacgccgagcacgagcgccgccacgcatttcagccgcaccaccccaccgacaccgcagcagcagcaccaccaccaccccagtcgcccgctacctccccttcctcctcctcctccttttcctcctcttccgcctcctccgccccctgccccatccggcgggcgttgctgctggtgctgcccctcgccgacggcctccttccccatgcggcgcgatctcaccacgacgcatcccggcgccaggcagccgccgcctccgcctccttggacgccattgctggggggggggggggcgatccggttggtggagctagggctgggtggtggtggtggtggtcctccgctgctgcggcgtcgttgcttaaggaggaggagattgaggtgggcgagggaaggtgagagaaagtgagaggtaaaccgcaccgcaccgagccgaaggtgaaacgtgaaatgaattggagtggaattttggaagggaagggaggaagacgacgagcagcgctgcggttggagtgacctgacctgacctgaccacgccgagtagtagtagtagtagtggactagactagagttaagtgggtaaagctcacttattgttggctcggtttattaaattaaggtcgttaatttctttctggttgtgttggtgtggaataaatttgtaggtttagctttttctttctctttttcctttttcatggtgttgtgattggtttgttttatctgggtttttggtgaggattggtttgaagattttgaatttggaagggggcaaag

SEQ ID NO: 59239 - DNA, 1424 bp, Oryza sativa
aattaaggacagattagtaggatagagaaatgaccacaataaccttatttattgaacacaatacatgcacacattccatatataaatttaattaaaaggaatgttaagacaacaagttagagatgtgatggaaggaatggagattacaaggaaatgtattttgatgtaatcaatttgctagatcccacattagtagaaatacaatttttatgggacaaaggttcaaaggtagaaattcattttctatgggatggaggtagtacaaagtttagagtttgaattataaaaatcaaacataaaacggtaggttcacaatatcatgtaaaacctgaacaaaaaagttattaccactacaaattcaaaatctcaaccgagtgatctatgaagttgaaattaatcagcatacagtagttcccaaggtacatcatcttgtaggaaattggttttccataatttcggtatcgttcctaaacatatcatccaggcaatcccacgtcattcctataatttataaagttatcacaacttccctatctccaaaaaaaatccaatcgagacaagcagtctaagatacacttagttcccacctcattcctataatttataaagttatacacttagttcccacctcattcctataatttataaagttatcacaacttcccttctccaaaaaatatccaatcgagataagcagtctaagatacagttagttaaaaactcgttgctagacatctagcaattatcccaaactacactgctccaatcaaaagcagaaacagaactagatagagatagcagcatttttatgcagtcacatttccatgtaaggccgtgtttatttctatttcaaaacgataatcttcagataactaatttaaactcaaaatcatccagaattttacaataacatcattaggaagcgcaatagttcctcagcaacagcaaacagatctagaggtagagaatcttgttacagatctgatctaacgatcaaagtaaagaagcttgttcctcaccataggtagcccgggatcttgatgcggaggaagagcatggccatagcgtacgcgatgacgatggcggcgacgccggagccaccgaaggagacgcgaaggctccggggcctgttgcggtcgacggcgaggtcgaggaggatgatcccgatgccgccgatgacgaacatgatgccggaggagagcccctcgatgatgtactggccgttgacgcggccggggaggaagacgacggggcggacggcgccggtggcggggtcctggacgctgccgatgccggggggctcgacgatgacgtcgtagacgaggccggagacgacggcgaagtaggtgaggaggatgagggcgaagacggtcatgggggaggggagcgccaggttggagggcagcctcaggcgggtgcgcggc

SEQ ID NO: 59240 - DNA, 1507 bp, Oryza sativa
gatttcgtctagctcgacatcgagctacacgtggatggagatgtactcgccgatggccatgctgcaggcgtcggtgacgaggccggctagcccggacaggaggacggtgcgcttgtcggcggggcgcgccgcgctgatgccgagcatgagcgatgcggtggagacgaggccgttgctggcacccagcaccacggcacgcagccactaggagtgcacgctgccgccgtcgtgggtggcttcctcttcctccttggcctccgccacgatgagctcggcgtcgccattgatggtagccatgcttgtgcttgttgaggagagagcagagtgagacgcgcgccaagcatactcatcggcgctgcgccgctcctcgctactggccagcgtcaccgccccgctcttatccttcgccgacaccttctcctagtccctcgtcatcgcggcacaccgccgccggcactgccactgcgacgatggcagcccaaggtagcccgggtgagaaattaggtggaaatagagtgaaatggctcaaatggcaaacaaatgtaagccaagtcttggcagtggcattttaacgatgccatttcggggaatggcattgtggcgaaacccactcttacagtggcagaatgtccaatttctctcttccgagcaggcagtgtacgattggcccctggtaggacatccaaaaagacaaaaaaaaaattaaccgaatacaaaggcaaaatttacacaatggtggtgtttgggatagtttaatctctctcacgaaaacataagttcctataataagtttcttccatcccaaacaccacctaactttaaaattttacttatatgacaccgtaaaagtaaatctttagactaacgtactaccgaaaaatgtatatttatcgaaaaacaccgtcatgcactattttcttctttgtgatttgattaggagagataaaatggagcaattgctcgtttgaccctgttttaatgtctaactaccaatatgaccctgtttttaggtttgctcatttgaccctgctttttaaaactaaagatcagagatgacctattttgtgaagatagataacggtgttaactaagagaaaaattgtcctttttacccctgctcaattaaccatgttaaatttggcatagttttaacaaatttgagacagatttgtctatcactcatttgttcattcttatcctctctctctctcacgagaccactgcgaggggcagcaggaggagcgacggctcggcggcggctacagttgcggaggggcaaagggaggagcggtggtggaggggaagcgtcgggccagcgatgaggagggccgtcgctggcggcaaaggagcggcggcggcaacggttgctgagggaggagcggcggttgcggcggaggaactgcggcgaggcaactacggagggctgacagctgcggaggagcgccggtggtggctgcgaaggggcagtggcggcttagcgacaccagcagcggcggtggaggggaag

SEQ ID NO: 59241 - DNA, 1145 bp, Oryza sativa
ggttggtgtactctcccgccgccgctgatggcgacattgtcttcaccaccagctgccgtcatcgccgctgaccggtttcttcgccaccacagttggtgtactccgccgctgtcgctgatggcgacattgtcttcaccgccggctgccgtcatcgccgccgactggtttctccgccaccatggttggtgtactccactaccattgctgacggcgacatcatcttcacagaccggcttgccttcactgccaccgactggtgtctctgcctacacggctggcctattatgccaccgttgttgggcttctacgacttcaccgtcggcttgcctctatcgctgccgactggtgtcttcgcctatacggttggcggactcagccaccgttgatgggcctggtcatctacaccgccggcttacttccgccgccgctgaatggtgttttcattgccattgatggacgactttgttcccacatcagccacctctgccgtcatcaagaggaatattacaaagctaagtcatcatttttccttatatgatattttccttatcctctgcctcactacatcaactggttcgccgttgacttgtgagtcgggggctacagatgttatatcatattttttaaacaattttcataatatttatcttgattgcttgcgacataatctgagtacaaaagtgccaatcgagttatggagttctatcttcctatacttttcgtttggtttgtcgatggatagttgcctttgggctgattcctagcacccgggggcttattggatggaccgagtaacgcaaggtgctaagtattattaggaataaatcaaaagcatagagataagataaatttattttctgctctttacaattacaaaagtacccgagtagtaaattctgattcgtgaaactttgttccattaatgatgaactcatgtcactcatatgcatgtttgggaagtgcctaggccgactcccgatgcttgtgggctatgactagttggacagagtgtttaaacgtacggaatcatctgctcggggaaatcaaaattgacaagaggagaaatacatatttataaacatttttaaatacttgaaatttcctcgagtattatatttacatcaaatactactcatcccatatgt

SEQ ID NO: 59242 - DNA, 794 bp, Oryza sativa
  unsure (1)..(794): unsure at all n locations
cccccgaaagacagaaaactgacatgtatcttgtactacatttggttaacctgaccgatccattacattcgacggataaaacaatttgagtttcctactaaaatgttttggagtgagacttaaagcacatccagttctaatgaacatccaaggagatgcaagcgtcttacagagtaatataagcagtataatgattgatgggctcaacttaagactggatctagatgtgtgtgaaatttcagttaaaggtgtcaaatatgaatccactctatataatgacagtacgacatattaggctatattcatgaagcagaatgtgtgatgtgccaaattgtcaaagtggcaaaagcatgtgccatggtatggagggataacacatgcaacaaagctaagaatgaaataccttctgagcgtgcatttgtcttcagagttttagtaaagacagacttttcaaaggccaactttgacgcattactagaccaatcatccgagaagtatttcacggcaacacgtttcccttcagaatccagaagcaaaatgttcttcacagaagggcaagattcctgtgtaacgaanatggacaatcatgaatcattacatgagcttgtgcaaaggacagaaaaagttacttaatgctgcatttcatgttcatcaacaaaagcatcattgcatggaaaaacaaagttaaacattgatagaatgaatcaaataagaatgctgattcagtaaagagtacaaaaataaaaataaatgatatgtatttttttttaaaaaaaacaataaactggatcgat

SEQ ID NO: 59243 - DNA, 799 bp, Oryza sativa
cgcggcgatggcggcgttgtaggccttgaggtcgggcttgatcccggcggcaccccgcgccccgaagacgggagaagagcgcgagcgccttgggcgcgtcgccctcgcggagggcgaggtggatgaggttggagaagagcacgaggtcgggagccacggcgtcgtcctccatgagtggcagaaaggtgagtgcgtggtcgaggtggcccgcgcgggtgagcgccgcgaggagcgtggagtacgagaacgcgttggcggcgacccctctgtcccgcatatccaggaggaggccggaggcgaggcggagcatccggcgcggcacgtggagcagagcaggaggttgtacaggatgaggagcgcggaggtggggaggtctggcgcgaggaggtcgagcagcgcgacgccgcggcacgcgtcggggaggcgggagaggagcgtgccgaggaggcgcggggagacggggcggtgcggggagagcgcgggggccaggtcgtactacctgcgccggctcgcgtcgtccgcgcttctctggctcgtcgtcgagtctggcgctgcgacacggccgctcctcctccatccccgagcagcgccgcctcttttgttcgccggaggagaagaagaaaaactgcaggagagagagaggggtattttggtcagctgaagtgggaaaaatggtgaaaatcttgtgaaatggtgaatatagcaaagcaacggtatggcatcggttggaaatgacattttaacgacgccattccgggaaatgtcattgtggcgaaacccactcttggcagtggcagaa

SEQ ID NO: 59244 - DNA, 1309 bp, Oryza sativa
gtaggacatttttgttctttgtcatttgtccatgatatgtcaggacaacaatgcacagctggtctttctactgatccttgatttggtaccaccagctttgcatagcatagcatatctcatccttatcttcaaacttttctttgattagtttaaccttagctcatgcagttatcttgtaaacttctccgagagagcaaaggaagctagtaattattaagaacaaatactatttgttaaaatactgtaaattgcaaaagaaaaaccatttccttgacaagtatgctggtccaacggcatcctctgatagtctgattaggagcttccaattttttattagacggtttccagaaacaacagtcgatgttctttggtagtagatgcattgttcagagaccacgtgagcttctcttaccatgaattaaactacaagatcacatgcctgcagtttgatcatgtcttaaaaagttactaatttcttggcagagtggcaacgccagaagctttacggtaatcatgaggtgatcatcaacctaaagaaacaggaaagagagaatatagaatttcgatgaatggcgttccagttgcatactgcactttctggtgattattatgttctcttttagatattttttccttgttctttattaattcataaagccacactttttcaggttatgcgcagttctggaaagagaaggaataaataattccctagcctgtacaccgaatggtttaatcagcatcaaatactcctaacatgaacaccaaaacaatcataaataccattattactgcttgaagcagagtcaccgccactgtgactggcttgtgggcccatcaaaccaagaacaatggctcgtgtatcaactatcaactgttgatgcagaattgcagaacatgaacatgaaacaagaacagggaattggaactgaagtttcagtgagtgagaagtgataggaacagactattatcctctctgattttattacagcaatgaaccaagtaatcccctcataacaacaattacaaaacagaaagaaaaaaaaactatagcatgtagccgcccccatccagaaacaattacgtaaacttgacagaaaaatttacaggagatcgaaagctaaaaaaatttagtgaaatgaagcaacaatttcttcacaatttttgctgccaagaatacaaagccaaccgaccaaccaacggccaactttttttcctgcacgactgaacccgaaagctgcaactgcagctgcagctgctgtcgcttgcaccactcgcccactacaccaaccacatggccactagcccc

SEQ ID NO: 59245 - DNA, 961 bp, Oryza sativa
tagtgtatgtaagactttttaatgggctcaaagtttgggccaatgctacggaaaaggaatgaccgtaagagcaagtttaatagtatagccaactactagatccaattcatctatagccaatctaatagctcattcatacaatagttacatactacactattaatatctggtcccacctgtcatacacacactgcgtcttagagtccgtgctatagctggctacaaatctgtagtccgctgccattctctctctttatttatcttcttaaaatatatttacagctggtttatagcctgctactgtacttgctctaatttggcccaagataggtccaaaatggctcgatcgcttattcggcagcccaggaagcagcgagcgtgcaaagtggtgatgcaactgtgtttctttgttgtgagagttaactgtaggctgaattaaactattcgctgtggagttaaaaagtagccttcctcttattgtctgcgtttgtattgtgcttttttgaaaaaaaaaatctgcattagaaggtaacagatatcatatatcatatataatataagtagataaagattgaagatgtttccgtggtccgttatctgttagagtcgatttaatgtatatatacctactagaatattttttttagtcgccgctttcctctcacattttttttcaaacagttttttaatggtccgtccagtttttttttgccattttcttcctccccttttttttctcgcatgcagtaagggcttctagttttcggtttttctttcctcaccgtgtttttccttcgctaggccgaaccctacctctatcaccacgtcgaatttgtctatccatgtgtttcctcctccaatggattacaaaaatcgattccccactcatcgctcatcatttttcctatgattttctccttcaattcggcttggcctgatttaatcaccatttaactgtcgc

SEQ ID NO: 59246 - DNA, 893 bp, Oryza sativa
atgccatatgttcattcgggaagttgggcagaatttcagatgatctcatcaagacaaacatgtttctcaaagacttggtggcaatccatcggagaccaaaggagttttgaatgtggagctgacagtcggcagcaagactatccctacaacattttttttcatcgatgggaagggttcctatagcctgttgcttggaaggaattggattcatactaattgttgtattccttcgaccatgcatcagtgcgtgattcaatggcaaggtgacaagattgagatcgtgctagccgacaggtcagttaatgttgctagtgtcaatttagctctttgggagatggatgggattgattgcctgtctggaaaagtttgggatggagattttctaaaagtgtccgattgtgatatacagccaattgaagatggagaccccaaattattattttaagggcgtcgtgcagggttcaaatttctacaccaaggacacggtggatgatctcgatggcaaactgggacagggtttcatgtcggctgatggtttagaagatattgacataggcccaggagataggccaaggccgacatttatcaacaagaatttattggcagagttcagaaccaagttgatagagcttttgaaagagtatagagattgctttgctttggagtattacgagatgctaggactcagccgatcgattgttgaacatcggcttcctatcaaaccagggtacaaaccttatcaacaacctccaaggagatgcaacgccgatatgtatgatgctatcaaggccgaagtaactcgattgtatgatgttggctttatcaggcagtgccgatacactgagtgggtttcaaacatagtcccggtcatcaagaagaacggcaagcttagg

SEQ ID NO: 59247 - DNA, 1277 bp, Oryza sativa
cccggcccgagtgcggtttgatttttgcaggcattttgatcatcgttttcttcataaagaaggagatgggtttgcatgcaaacttcgtagtttaactcagtttttttttcctcccgaacggaagacattcagtttttcacacaaacatcgtagttttaactcctccaaagagtaggtttgtcattgcgtcttcttttttcccctcagatttggtagtgataataagttgtcattgttttgatccaagggatagaattcagttagacaaaattgaactataacaagagcatgtacttgccatttcgttttttttttcaattgagggcatgcatgcacccttactttgttggtttgagcctctcaactattctattttgtgcaaccaggttcttttatgcagcaaattcttgctgacgtgttatatcatctcttagataagaaattacacattctccatcttcaccaaagagattacaaattctccatcttcacgatgttcaagccgacttctcctcatattcatgaattgagggtgtgtttggataatgggaaatgagaggtgggattgggattaggaattgaatgaagggttaggattaaatggatgagggagaatgaatggttaagatttaaagaggggtgggaaatcatttcccttagatatttgccaaacactgcctgagctccaatttaaagatttctccatcgtagcgtaatcccgaaatggattcagaaagttcagatatatagttgagggttttggagtttttgacagcgacaaaataggatcgtatactttaactccacaatagtccttcaggcctagaaagaaagaaaaatggaaataccattaattagattagaagtagggcaagcgtattagggctgagctacaactcctaatttttgcttcaggagttgggtctagagtggaattgtggagctgcctaaacccagctccatatctctagtatattttgtaagagagctccactcagctccgctcctattttaggtggagctgaaactgtttggctgagctacaactccaatagaggtggagctggagttgaagctgtgccaaacatagtatttgcataatcaagagatccgaaatacgtagtaaaacttactccatctcggcaatttcgctttacacgccacaaaggatttgtgttccaaactccgtattgcaagtctttgagccctagaaaaaaaaaatataaaatgaaccagcaaagtcaaaaataagtaggattcgagtgtttgcataagaa

SEQ ID NO: 59248 - DNA, 1583 bp, Oryza sativa
  unsure (1)..(1583): unsure at all n locations
gggcggagctatgtgtatcaagggggcgttaaaagtgaccagagaacccatccacttcggcaattacctgccacactaactcacatgtttcgagttgggcaaggctctcactatcatgcaagaagcccagaacttgaactattcatccacaatgacacgtaaatgagtaaccatgttaatgacatcatcattcttcttcacacaagagcttggtgtctacccacagaaatagtcatgccaagaagaggctgcagggataaatacttgcaacaagcgttcgcaaatttgcgaggaaacatacgaatacgagtaactagaggaatataataaggatttatgtacaataatacgctttgttgcatagtacctaatttatcaagactcgcggacacttcacacggttttatcctgaaaaaagacgatacctgcaagatagaagccacggccaccagttgggagttgagttatcaggcatggcttgatgttcattccattggaaatgataacgctacaatctgacgagaaagagcgtacctttcaaattctagcttctgggtgacaataccattaagcacaagctctgattcaaacacctcaaaacctgcaacggtgcaacatcaaccagcggtttacgacaaatggagtaagccccagaactttattaggtacagggagcgtagcacacaccgttcttaatgaatggcacgcatattttgtagtcttgttcacaagagattacaaaagctcccattaaacttctattcttcatcttggacattgcgtttctctccaacacctggcaaaccaacaaatgtaatcgttgtgcaagcaatttaagaaatggaaattatgtatccaagtatgggatcctaacatattggcatgtaatgaagtagtgttcttaacagagaaaatgcaattaaaaacgaaccacaaatcatttgataactttcatcacacctnttagctatatcttgaaccaaatccagtaatattggcaacaacaaaattgaattaaacacatgtcactagaaatctccattgtaaaaaacacaggtcactagaaaatgttccagattgatggtaatccacgttgatcctactcgtatttgttgttgcatcacaaacacaatgcctccagatttttgtgcactttacataacaatgtgaagaattgaagtcctttatgtgcattaacttctaagcagctggaaagttcatactgttgcagaaacaagtaccatctaaaatctggagatagttgagatgacaacacagaataaatgaatgcaacaaagggtagattaccaaagacaaggaaagtgctccaaaagaaaattcagattgatttgaacagaggtatataacaagcgtataccttgccatgagcagtcactactaaacttttcaaagctccttgctaggtttagcatttggtgtgattagcactctactccctggaaattcaataaatttttaggtaacataaacatttcatattttggcatactgaagttaaagtatctcttggcatcaagataatataattgccaaaaattgctagtatttgttctcattttgat

SEQ ID NO: 59249 - DNA, 2032 bp, Oryza sativa
gtggattgaagtatgaagtacctgctgatgcttcatgatcagcaaaagaagaatgttgactcattctcaagccacttgtggtatcttgatcagatacgcttactgtgttagctgttgaaagctgttttacttctgtagttttggctctaagtgccgttggcttgatagcttcaatgaactcaatttttgagcttcccgaggtaaatatatatgtcctcctccttttaggatggattaaagcatctgtatctagtgaaagaggaatatttgagtcatttgtaccagatcttgtgattacttctgacacctcatgatctatgtctctttgagtaatcccactgctgatgtttctttttgctttccctgccatctgtttcgtatacttcctggtttgtgatgtgtttgtatgagagactgaactttcaccattttcccttactgtatcatctaccttgatttgcttgtattctgttgccactcctgatctgtgacgcaagaagtttacctttctcttttgaattggtgaatgaactgcacatgtcttatcaactttggttccttttgtcatatttttaacaacagaatcttcaggacgttcattctccttgacatcataactgacagttgaagcattgaacaatgcttccatggcttcagctgccatctgagtatttggcccaatatcatattcttggtataaatcatcagtaccacaaaatggttccgttttcttcagacaattagtacccaagtcctcatcaatgcattctagtatgggccaagccctggtacttgatccacagccaccgtgtttcacttgattattagcacgatctactgtattttccatggaaataatactggttctgcaatcatcaacagtgggggtatcaacccagtcaaaatttccagccttttttagtggggaactgcacctagcccttttggccaggcattgagctatatctgaacctaaagtagaagctgactttgccctcgttgtctggtcgatgcttatttgctgataagtttctatatcatcttctactagcagcctatccacaatgtcaatagcgttgatctgtgattcatcaccaggctcctgcgaactaaggtaatccaactttgcacatccgcttgcagaagtcatcatgtgcatgctgtaatactgaaatagacagaaaacacctgttatgaacttgtaggctaactgtgaatggtgttaacaacatggagttgatcgatcatggcctaaatgctgagtagacaatacttgaaaccaagagctggaatcttctcagactgaactgtgtatatgagaggaacatattttaagatgctacagtttctaaatcaagatacacataccaaaatatttatgcacacggaagacagaagtgtatgatcataagtaaaataaacaacgtttatgggcttgtttgagagctaggggtgaaaaaaaacagggaagaacatccacaggagggaccttttgggtgtcacgggatccccttgggaaattccacccaattgtttggaataaaaagagccaacaaaaatccctgccttacaaaaataaacggaaaattaagaaaaaattgcaaaatccaaaatcttcttggcgcgggtggtggtgtgaccaggcattgagctagacagctagtgaagggagggggctgccgcctagctcaccaacagagggggcaaccgccgtcgagctcatgaatggaaagatctccagatgcaggtagtgacagcagttgattagatgcggcaccggcggtcagtggttgcaagctaaacgcgggcgagagcgagagaggcagcaagatttatggtcggtttttagtattacagttgatgtggggttcgtaccaactagaaagagccaaaaaaaaatgttggattctgattcatatcagacagtgtattcgcagaagtaatgcatatgcttattgctattggaaaaatggattttatgataaatttggttatcacccagtccaatatgtaacagacgactgacgaatac

SEQ ID NO: 59250 - DNA, 769 bp, Oryza sativa
atacagttgtctaatggaagctccatgacttgatcagtttccaggcctttcttgccaagtttgtagtttgagattgtaccttttggcttaaactcatctggattaaatctcttcagaagacgtaagcagtgaacaatctggaaaagggaatgatttatacagcttgtaggtgcatgaagtatgcaacagcataaaatggttgcagctcacaaagggtactgcatagtaattaacacctttcatgcctaacagattgtattatcgcttttcattgcagtttcaaaataaaatattgcataggttgttgcagtggtaaaaaagatcacattattgaatgcaactgatacaatcatagagatttgttgacatagttttatcttgaatagcagtttttttcccttcagtatgagttattaattgtcaattcatagttttatatctcagggaagtctctagtccagcttttattgtctttcaaataagaccgttttatttggattcagggtctcagttctgtcaccttgtgcactccgtttcagattagtatagtggaaaacataactgtggatgcagctttgttggacaaaagaaaaggttccatcgccatctgaacaagggaatggatcatgctggtgtgtaattaaaattatgaaggaccgatttttaaagcatgaacttttttaaaagatacagagtcaatttcttgaatttcgttaacaagaagcaaatatgttaggaaaggtaaaacgataaatgtgggctgcaggaa

SEQ ID NO: 59251 - DNA, 1391 bp, Oryza sativa
ttattcctttttgtttccactcatcttctaaaaatttgggtgtgtaagacatcagttatggtatgtttaacccaatataaaggattagatatggtcttgtattctacaagaattaatatgtggcctctgaatgtggtgtccagatatcattttacaaaatctagtaggtatgttttctatttagatgttgcctaggtctgaataaaagtgatacgcgcacggtgaagatcatattgtagcggctgccgaagcaacaagtgctcgagtggacggtttcagaggggatagcgacaatgctcacaatcaccctatggccgaaagcagggctcttcctggccagtgagaggctcttaataacgtgcgaataacttgactggattaatcttgcttgccgaagaatacaatcgagtgccccctttataactcaaagggggattaactacttctctagataaatgactccctagatttaatggataatccttcctaacaacttaacaaactaaaaccatcgacctaggagtaaaacctatgcacacttaatttgtgagcaacaatacttgctaccaccatagctgacgcaataggagtacgtgtcggccatggcatcccagaagaacatcgtgaaactttgcaagcgatgagactatgagagagaggatgaccaagctgtagaggctgaccagttcatcgtcgtcatcggggtagagcatgaagatccactggttctctcgaggcctacgaggatgggcagctgagaaagtcttttctaaacctaggtgcaggcacacctaggtttagaaaagtttagatcactccaagattcatgcctacaagtaattagcccaaaagtatatcaacgaatatcgaatgtattgtctatttctagacgatcacctagaatacaatgagacctacctgtagccatatgtattgtccacctcaagctccctctttttcacttttccacctgtagcgacccctctctttttcactttccccttctgcctttacccaattcgcccccattttggcacagcgcatccgctctatggtccacggagacgacagagtaagaggtggtgacgtgttgtagtcccgcaatggagatgctcaagtatatgacactttgacatggaatattgagttatttcctttaattccagcatgcataataatgcttggtggctttgcattttaattttcatgtcttatgtcttctgtactggtatgacgactgcatctcattgttgcggcccaacaacgccgtcaagctggcgcagatcgacgtggatctgacatccagcatggtggcatggttcggcgacatgagaatcataaagcggaccatctccggggagctatcacttttaacgctggggctgcaggaa

SEQ ID NO: 59252 - DNA, 737 bp, Oryza sativa
gagctgggaagctgtgaaagcctcgcgcttaaggtgctcgatcaattgccgctgagagcgcacgcctctgatttcgctgctgaattacggctgttggcgagaggagacagatggtcgggagcgtgcacgtgaatggatcggtgaacggcggcaatggcaccgaggagaggctcgacgagctgcgccgcctgctcggcaagtccgacggcgacttgctgaagatcgtcggcattggcgccggcgcgtggggcagcgtcttcgccgccctgctgcaggacgcctacggccgtttccgggagaaggttcagatacggatatggcgccgggcggggcggtcggtggaccggaccaccgcggagcatctgttcgaggtgatcaactcgagggaggacgtgctgaggcggctcatccgccgctgcgcctacctcaagtacgtcgaggcgcgcctcggcgacaggacattgtacgccgatgagatactgagggacggcttctgcctgaacatgatcgacacgccactctgccctctcaaggtggtcaccaacctgcaggaagctgtctgggatgctgacattgtggtgaacggccttccatccaccgagacgagggaggtgttcgaggagatcagcaagtactggaaggagcggatcagcgttccggtgataatctcgctcgcaaaggggatagaagcatccttggacccaattcctcgtatcattacgcccacgcagatgatt

SEQ ID NO: 59253 - DNA, 1547 bp, Oryza sativa
caccacccacctgcctcatcgccggatccagctaaggggagcacggaatgggtgcttcgcctcggcagcctaagcttctggattatgtttcgttttagcactgctaataccagcttgctttccatttgaaattcagaaaaaaaaattgaaataatatctgaggaaggaggggaataatcaacaggaacatgaaaatcataagttattaatcagctgccagaagtgaatcatcacagaacagaggcatcagacatgcaggcaagaaacaggaacagataaaggtcacaaccacaggctgatgcttgattcctcggtacggagcacaagtgcacaaccttcatgggtacccgaaatcaagtcccatctaaaaaaacttaataacaacttaaaaactataccaacttcttactgtgagcacgtcgtcgatttcagacaatctcaaattttcatcacactgccattcatgtcttaaattagacaattaaaaccagacacttaagagacattgtgaatagaaagctccaaatgaaatttcaggtccaagtgcacaaaatgcaattcctgcagaatttcagatgtacactgacatgccaaatttcagttccatcctagttttaattcaaaaggaacatcacttgtccttgacaaaaggttcaaaacaaatgcaaagactgcaggtatgccatggccatcttactttcagcacaacctgaacttcaaaagtatgtttccttttagcactccaaatgtcaactagctccacatttcaaattcgtaataacatttgaaagaatctctgagataatactggaaaagaatcagtaggaatgtagcaatcataagttattaatcaacgactcaactgtcacaagtatattcactacaacatcagctgtcagaagtaggaaaacctgtccgttgcatcattcagtcattaaacaaatgcagagatcaggatttctctttgtagaatgttaaaatgattagcatcacagcagagggccagagccattcatgtcccaagttagacttatgattcacattatgaattgaaatctcaaaacttcaatgaagtactcaaaaatgccattcctgatagtgcacatgtacacagacatgccaaatatcaattacaaccatctgaattaaaaatgaccatctcttgtatctgacaaactgttaaaaaaagtaagaaaccacatccatccctgttaagcacaccataactgctgaactatgtttcattttagcactgcaaatctgcaattataccaatcaggttcacatttgaaattcgtaagaacatttgaaagaacctataagaaaagaggaaaacaccaacatgaccgtagcagcccaaatttattaatcaactgcatgaggtgaattaggagaattgtagcctgcatcattcagtcattaggcaaatgcagagatgaaactttctcacagtagaatgttaaaacttccccgcaaaaaaagtagaatgttaaaacgattagaagcccaccagaggcatcaggcatcatagcaatggaaaaaatagc

SEQ ID NO: 59254 - DNA, 1958 bp, Oryza sativa
ttcctgcagccctgctttccttaattattcaaagtaaacaattcttctgttttgttctttcacaaaatttacaatgctctacgatggactgttgccccacattcctttcactggtttggaagattcagaacaggaatggtccttcaatctatagttaatttcaataggcacatgtcactgccaccattttcatttcctttctgtagattcaagtaactaaactgctttcgtttcccacttcttcagtgcaaaacttgaagaataagatattttttaacggtcaaaaaaacttgccacatactccaattatacttatttcatttcagctgaaattaatgagctcacataaacttgccacagtattatccagagaatgtcaggacaccctgtcaatgtagctcaccgaataaatatttctccgaaccggttttacttttccctatcgatatattttttttcgcaacctatcgatattgagaatttggtcagatatgtagccggagtgcccaatgttatgtgcagtcatagaaaacacctgttttgtgcagtcataaaaaacatcataaagaccttttgtatgagtgttctgaggtcatacaatactgaaatgatcacagatttaatcttaagcaggctgtaattcttaagcatagttgaaaagctgatagggaaagtgataagcaaataattcaacgtgtagcagtcttcagttgttactcaatcaagggttatacaagctaacgtgccagtataattctaatttgcaaccatagaggatatcaacttcttcctgttgatggtggcatgtcctcaaattcaggcaactcagtgcttcaccaagcagcaacagccactcatataccaaattagacatttgcaaccaggttctcatatatccctgttcagatcagaactgctgaatcatgtttcattttagcacagcaatttccaatcaggttcacatttgaaattcgtaagaactttgaaagaacctataagaaaataggaaaacaccaacatgactgtagcagcccaaatttaataatcaactgtatgaagtgaattaggagaattgcagcctgcatcattcagtcattagacaattgcggagatcaaaatttcacacagcagactgttaaaatgattaacagcacagcacagcagaggcatcaggcatcatatcaatcgaagatatagtaacagagatcacaaccttcatgggttaggaaaatcagaactgcaagtctaaaatattggcatcatcagtatcaaatcttcattgcatctcatgttatggtaacaaggattcatggctcaatccttactcaaacgtgttgccaaatttagaaggattaccggagcagaattaacagaatgctgaacaatatgcacaaaattctacccatcccgatgcacatgcagtctcacctgttccagttgtttgattgcttgcgtcttaaaccattcaagaaaggcgacgtatgggggcagatagaaccaagtccacggcgaggagtctgatggcggctctcgcggcgggcagcggacgatgccctgctcgcagcatctgcccgtgtcgccgcaggggaacggcccctggacctgctgcgcctgcgaggtcgagctccctgcgccgctgaaactcacggagtcatccaggaagtagatgttgggagggcactggctggatttcctcatctcgacggcgaaggagcagcctcgcccgaggaagatcgtctggtctgcgagggtgtccaaggtgagtttcttccaggacggcggcttcagctccagcttgaagacgtcgaacgccaccgtggccttctccgtggagacgaacctgacgaccatgagagatgcccgcgggattccacgaggtagcgggcgagcacctcccctggctccggcatggtgggtcggggatttctgcggagctagtacttgttcacgggctgcag

SEQ ID NO: 59255 - DNA, 1483 bp, Oryza sativa
tgcgcacgtggcagtttcaacgtagccacgcccccttcacatctcatacctaagaatcctgcaatttcttttagcatatttccattttgttggtccttactgaacggcttccttttccccctgagatttctatagaaaataatgcgaatgtgaggtagcttacataaagtcgaaaacaatatcttttctacctacacttcaagaaaaagtagggggggaaaaacacagtaaattccgtagtaatagcaaataaatgggccttacatagacggcccagcccatttcaacagtaagatctccaccgagtcaataaaacgcagcgcctcctctcctctactccgctccgccgtcgctgttgctctctgatccctagggtttactttcccctcctcctcgaactctagggtttttccgctcgctctccgccaccatgacggccgccgagacgcaggaggagctgctccgcaagcacctcgaggagcaaaagatcgaggtgatccgtccactcccagcttccctccccccgccgctgttgccctcttcttgtgtgatagaagtctgttcaagaaggatacgatcttttaggatttgtgcgactttagatcggtgggtttggttagatcgtagtggtaaactgccggatctcgtttgctgctgaggttgcgcggcttttaggtgcgagatttgggtggcgaactgagtggttgttggagtgtggatttctggggatcctattgtcctctgcgatcaggagttctttttttactttatggggattctcgttgatgaactctgttgacctctgcaatcaggagttattttcctttcttggaattctcgttgctgtaagtctataggcctcttgcgtgctagtagtagttatgtgctccatgttgtttggcgattcacctatgaagagagatcggtacttctgctttcatggtactcctgtattaaggattacaagttctaaattgattatgaacatgctgaagctagattaaaagcgttataattgtttagcaccctgaagctagattactgctgtttaactatagtgattgttacattagtaacttgggctcatttgttaattagattgttactctaggattctttgttttcctgctgcacaaaggtacaagcctttctcttttactcttgagaaaagtccttccttttatgcatagcatgcttattttcaatttggaaatagcatacactggcgtgaatactcactattttattctgcatgtggcttggtctgttgtgggttatggccctgctttgcagggcatgtttgttacttgacagtcagttaaagaaaatgtcattttgcatgctttcagggagatgagcctatccttgaggatgacgatgatgcgaggatgatgatgatgacgaggatgacaaagatgatgatgtagaaggtgtgttggaatccatccttagttattgtaatataaaggatagatatatcagg

SEQ ID NO: 59256 - DNA, 857 bp, Oryza sativa
ggcgcattgataggatgaaccctcctccttggttatgctatcttgagagcggtaggtagtgttacgaaacttcaaggccttatatcatcctttgataagatcgactgtttgctatttaatatgcctttttcattcactggtctcgctacacatgcctgcatgctccatggcttctattatcgaaaaactgttgaatgtgaatgagtatgtttttttgcatccaagagtgttgtgggactgacatttggcttaattctgtgcaacacttgtgatctgcccactcgcgcgtcgtagaattttgtaacagctcaaattaggtatatgtactactatgtaaaaaaaaaaactaatcctaactacatatgtgtacatgctagcatagcatgtgctcaggtaaatagctatttgatttttttataggaagttcaagcatttgttcaagtaaatagctatttgatttttttataggaagttcaagcatttgttcaagtaaatagctatttgattttttataaggagaggtttcacggatgtgttcaagtaaaaatagttagaattggattggactatttatggagaggtttcacgcatgtgttcaactaaaaataaatagttagaattggattggattattaatgagacggtgagatttcaagtggtaaaaataattagaattggattggattatttatgagacagcgaggtttcaagtgtgtgttaaggtaaatagttggaattgaattttttatgagggagaggttagggctgtagcgatatgaagaaaccatcagtactgcacagagaactcaattcgcagcaagtcatcgaactcacaaacgggccgtcccgtcctgtat

SEQ ID NO: 59257 - DNA, 725 bp, Oryza sativa
caatgactacaagcactggaaattggaaaacgcctgagacacgataaagttatttcctcacaaaaagcttgcgctgtaacaattcgtcaggtcccattccaatagcctgctgaagccgagcgtgcgtttgtccagatcgaacaccatcagatgttctccaactgcatcccgccgagcaccaccgccggctcgccgtccaccggcatgccttccggccccatctccacgaccccaacgcacgtctcgcgtaccaggtagttgccgttcagtatcgtccagttacccgtggctccggcgtccagctccagggtgatcgccggcgcgtcgaagcccgtccgcttcatcatagggaatgacaacatggtgtcgcctgcgccgccgtaacaaagctcgaactgcttctgcctggccaccctcgccattctgctttccgttcctctgccgtgtgtggcgaagtaatcagctagagatcaaacattggttatggcgtaagtttgtctcgtgtcggatgctgtacctggtcacgactgtgtcgaacgccttgccgaaggcgcggaacacgtcggtgcgcatgatcgcgtacggcgtcgtggtgctgagcacgacgccgccgcggcccgtgcgggcgttgaggtcgagcgcgccggcgggcagggacaccgggacgtcgcgggcccgcgccacgacacggagatgcgttttacggggaggtagtaaccgccgtt

SEQ ID NO: 59258 - DNA, 1112 bp, Oryza sativa
ggggtaaagatagaggaggataagaggaatatttcccctcaactaattttagaaaaacacaaggggaaaggtcagatttggaggagaaaaaccgagccaatcggtctcagttcggctgctagaggtagaagataaacagtgtcgagggaggcaaattagactcttcgtcttgggctggctgaaaactaagcaaagaaagaaagagaagggggaaactcggctgggccgactagggctgcacggccgtgcacacaaaagagggagatgggccggaaagggcccaagactaggaagaggattattattacttttccaattaaattaatcaatgaaatgatctttgaattgttaaaaatacttcctatgctcaaataattccaagaaaaatcttgaacatacttggacacccaaagtatttaacaatattaagaccagaccatttaatgattaatttaatatgtgggtaattactgaaatgctctttgtatgattaaaaattaggaattgagctccaaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacaacccccggggggacctaaggatcgaatctcatagccaacacaacgaccacagcctatgaagccggaaactacaggagccaagtcgctgggtgatctagtcgaatcaactcgactacaatctcgtcggtaccatcgagttctattattccctttgtaatctgtggttctctccatataatcccatatcaactggattagggctattacctattaaggggcctgacctagtataatctttgtctcttgtttccttgatgtcgtatacgtagatcctcgtaccagcgtaccccaataccctctatatccggtctacgggtaccaccgtcgacaagacttattttagctatacatatgtaatagcccaaagagaagggacgaaaaatagacttattttaaaaa

SEQ ID NO: 59259 - DNA, 746 bp, Oryza sativa
  unsure (1)..(746): unsure at all n locations
aattttttcatggttatatgaagactaggtaaaaaaaactagggtgcctagaactactcttaaaaatcaaattaaaattcgcccccaaaaggagagggaaacttagaaggtattgtcatgaagaaaatattctttccattctactagtctgaatgtaggatcttaattggcattatagcatatgactgaataaaaaaaactgacgtatgtatgcattggttacaaaacaggagctctgaatttaaaataattaatatgaacgttacatccttggcataagaaaaaactcgtccattcgcattaacaaagaacatagtaccacatggttttaattagcatctccctctggaaataagttcattaacttgatggtacaccctgtgattctgcctgttcaacccaacacaactctactccttctgaaacacagtcaaattaacttcgaaaacctgaaacaatctatgttaatttgctatactgatcttcccctttgatatattccacaggagaagcttcgtgttgcactcttcgttcagaaagctgcacttcagttcatcgatggtacgtacagataaccgtcctcaaaaaaacaaaacaaaaaaaaaaaacgtttgctttcaattttgctcgaaatttatcactccgatttgattttgtaacaatggcgatgctncgatcctcctcagccgtcgcaagacggagcacccgttgccgagctcgcccggcaatgcggcttctccgtcagc

SEQ ID NO: 59260 - DNA, 1342 bp, Oryza sativa
ggagttcttccatattttacctgtggtatgtcaacagaatatctgacattgtcaaagctgagtgaaagcggagtaaatgggagaaccatccccctttgagtaacctcagtatcatcatcaacaattgttgaatcattttcagtgccgtttcccattggcctacgcgtacttccagatgacaagtgaacgtcacccacaatctcaccattcagattggcacgcttctctttcagttcctcttctgatactgactgacgggaatttccatatgctgtaaatcacaagatgaaatcattctcatgtttggatatagccaactctaggaaaaagagcaaatcagttctcaaggtatactcacgcctgaggtatgtaagggcaagggtgaagagagcattgaaaaggatggtgaagccgatcattgcaccaaacccaatccaataccacctggcttcagggaatactccacgggacttgaggacttgcacaccaagggtctcattggaggcagagctattcacaattttgttccagctgtgccccatgagttcattaactgagatggcattctgggcgtacatcatcggggatatccagtagccccaaatccaccatttcttcacttgctctgcaagtcgaacagaatggaacacttagcttttgataaaaagtgcaaaccaagcacttctcagacagataatggtgagcatttacctcttgctagaatgaatccacccaataccataaaaattagcagcatgaatgatgcaaagacatttgcaacaatcatgttcctcgctgccccaccaatgaatcggaaaagtgatcccgccatctgattgattgctaacatgagcaaatactgcttgaagaagctggggtaaacaaaaaaaagacaaatactctcagaacaatgcagagcagcactatagtaagatatagctgattatacacctgtgaaatatataatctcaataaatctcacctgcccacgtttgagtcaaacccaatgacgtagtatgttaagaacacatacccaccaacctcaataaacgtgattgggatcttgagaatccatgagggtatagtgtacgaccatgcaggataaaaaaggagatccctctgcttgaagaaaacaggcaacttaaagacagtgagcgcaagctctgagaaaccattgaacatgatcataagcacaccaaagaagagtgcgcccatgtagatgcccccgctggtcacagaatcacgtttcattttcgtacggaagaagagtgtcattgcaatgagtgacaccaccatcaacctgtaatgacataacaccatggagtcagtcatgctgctattg

SEQ ID NO: 59261 - DNA, 2154 bp, Oryza sativa
acatacccaccaacctcaataaacgtgattgggatcttgagaatccatgagggtatagtgtacgaccatgcaggataaaaaaggagatccctctgcttgaagaaaacaggcaacttaaagacagtgagcgcaagctctgagaaaccattgaacatgatcataagcacaccaaagaagagtgcgcccatgtagatgcccccgctggtcacagaatcacgtttcattttcgtacggaagaagagtgtcattgcaatgagtgacaccaccatcaactgtaatgacataacaccatggagtcagtcatgctgctattgctttacttacatagcaaccacccctttggtttgaagtaatgacagttacctggaaggttctgaacatgtagacgaaagagttcctcttcatgaggagaatctccctgtcaatatttgccttcagcagctccttgccaggagcaccgtaccttgtggtagccagtgcggcaggatggctcttactcttatcaaacggaacagcaagttcgtttgctatagctctccctgtgtggaacgactggaatgcactcacaaattccttaaccgtcacaaacctgtagggcttgtcatgcctcgcccagtactgcctttgatctttcttagaagtcacctgctcggcatttgcacagacatatattatcaaaaactgtactttatgtgttcatagaaaaaagaacagtgagatatgaacatacttcttgcaagaagtcggcaacacccttcctgtcaggacacttaaaccccatggactcgaagaattcaagcacatcctctcgggggccctggtacacaatctgaccgtctgagaggaggatgatatcatcaaacaagttgtaagtctcaggcgccggctgcagcagggagataacagctgtgccaccgaggatgtggacagtttgcctaagcgaattcactatctggaatgtagtggagctgtcaagcccagttgagatctcgtccatgaagagcgccctggctggcccaaccagcatctcacctacagaacgcatcaaaataggaataatcacaccgtggttcattcatagccgttagtctcaatctgaatttgtgttggagttcaatcctcaccagtcgtaacacgctttctttgcccacctgagatgcccctcagcatctcgtccccaaccatcgtgtcagcgcatatctctagtcctaatatctgcaacaagtaacgtccaatgcattgaacaagaaattcttgggtaattctacctaaaatttaatcactagctcaaagatggatgcaccttcagtatatagtcagtgttcacgtttgcctcctgtcctcccattgcagccgcctgaacaagttgaccagaaaaccaatgcttagtcctcgtttcaaaaagaaaaattaacaaaagtaagaggacaccaaaatcttgttgattttatttcggattcgtaaatccttttaccttcatgaatgcatcgatatcggcgtcaggcttaatgttcgctgccttctctcgccttgacagctcagtcaacatatctgaaaaaaaaaacaacaggaaaaaggaaaacttggtttagcatgcccgtccaaccatgcaatcccgcataatccgcaagcagtaaaaaaggcaactactactgctgagaatcgtgtagaatttaccaaagcgactgccaacaccctggcatcgtgccgagaaggcaagtgtctccctgacggtcatctctccgatgtggaggtcgtgctggctgatgtaagccgccgtcctctccggcacgaattcctccatgccgtgcccgttgtaggtcacttttcctgaagcctgcaattgcatctcgttatactcatcaacaacgtgtgaacgcccagtataattcgtactccagtatccatctcttattttctttttcccaaataaagaactccccgtactactctgtgttttcttctttggctaactcattcttcgtattagtacgtactggagcagtactactagtagagatgagaagctgaaacactgcgcctatagtgggatacaggcatctggaattgaattatttgcaagaagttggttttggatgaacgaaccttgagatctttgccgagccttccggccaacgcgagcagcaaggtggt

SEQ ID NO: 59262 - DNA, 2507 bp, Oryza sativa
gaagaaattgaattctaaaaaaaagacccggatttaactaatccagtctccaacacgagagataaaaattgctccagaagacaagagaatccatgttctttttttttttggtgaaaacaacatgtgggtgtgggagtgtgttgggggggggggggggatggtgtttcacctgcggggcttgatgatgccgctgacgtcgtggaggacgggcatggtctgcttccggttgggcagaatgccgagcgcgttgccggcttcctcgagggtgttggtgatggagttgaggacggtggggaggccgctgttgccgacgcggacctccgcctccgcctccaggtgctcgaaccgcacctcgatcgtcggcatgtcgatccccaccctgtcgcacagcgcaagcgcgaaagtcgttagatcaaacacctagcgggcgcaaagcagagaaacgcggccatgccaagacgagaactggcggcaacgcacgcaccggtcgacgcggtccttgagcttgaggaggaacttctcgttgtcctcgtcggcgacgcgcacgaggcgctcgaggagcgcgcggcgctcgcgcgggccgagcccgtgcacgtccacgacgcccttccctcctccgtccccggcgccgtcgtcgccaccgagcggcagggatggggcgcggcgcacgcggtcgtaggtgggcagcttctcgagcgccgcccaccgcagcgcctcctcgtcgtcctcctccctcgacgacctcgagaacacgtcgtcccctctcctccacatcgacccgctgtcccccctcatgctcccccctagccgcatgctcgccaccttctggatctcccccgccgcgtccatctcccaccaccaccaaaacctcctcgccgagagctatcaattctaatccctctccgttgtgcgcttctcgaggtgggtgattgttgtgattccgattcctcgcagtctgcgcgctgcgctgcgcggcgcggcaccgggatttcttccgggcttttgcaagtgaaggcgcggcgcggcgcggggtgtggtgtgtttggtcccgagtggggctgtgggggtttttgtagggggtgggaaaccgttgggaacttggggtgggtggggaggcggcgcgctgtgttgctgtggtctgtttgtgcgagtgcaggaggtgggggacgcgggtcagagtagcgaggcgcggaggcgggatgtgtggaagactagcctgctggtgctcggttcggtacaagtacgaatcgagcaccgtacacgggcaacatgtgtgtgtttgtgcatgcagccgtggctaccaagcatgtgtggggtttctagaagggcgaggtcaagcggccagcggcgtgtctgtcatcgtatccctgggattggggttggtactcctgtcctgtgctgctgtttgggctgacaggtgggtcctccttctgcggtatagtctgaaagcacatactttttctttcctttttcttagggcaagtactataatcatcttatcactaattccaagatgccatatagactcaaatgatgatgtggaggagagaagagagagaagagcagccacccctcatgcaaggggtaacctccatacaagtttcaagaaatggaagagaaagagagaagtggattggtagcaaatatattgggtgtagtgtaaatagatgcaatctattgtatttattacctctaaattaatgtgtagatgatttagataaaattatatgtgaccacctcctctattataaaacttgcccttatagtacttctcttctcctaaaataagttcagttttaccctattcatattcaacgtttaaccgttcgtcttatttgaattttttttatgattagtatttttattactattagatgataaaatatgaatagtattttatgtgtgactaaatatttttaattttttcacaaatttttcaaataaaacggacggtcaaacgttgggcatggatattcacagttgtacttattatgagacggaggtagtacttgtatagagtattgtatatatatatatatatatatggcttttatcttgctaatgcatttttcggatttgacaaaagtgacactacacagagtttctgaaaaagatgatggattagtatctttgttttactcaagtacatcacgtcatccgagtatctcacggaaaatagtacggccaaaaaagttatttttgaagccatcgttttagcgcaacggcgtatctgcaaacgaaaagtaatttataaataaaatttttatatacgtgttcttagcaatctaaaagtaaaggctgaaaagtaaacttcgatgaaaaaaaactcaaaattcagcttcaaatttaaggctaaaaattcaaattttggctgataaacatcagtataataaaaaagatgaggccatttgttgtaccctagagcattttgagcaatagccattattttagaacacccaaaagtcaaatagggttgtccttgtccccattttctgataaccaagatt

SEQ ID NO: 59263 - DNA, 14249 bp, Oryza sativa
aatgcatacggtccatccatattcaagttcacaatttcaaacgccacaaaattctaatttaaatttagaacttccaaacatcagaatggcatatatatcctcacaatttgtgaacatagttatgtaagaagtaaataatccttgtagtaagtgttcacatcaaatagtgagatgtttgcaatagttaataaaatagaaaccatatcttactataaataaagttataatccattggatcctcattttgatgttctgtgttgaatctttttttttcttaactctcaaaatcttttaaggtgctagggttctaaacctcaaaattggatattcctcgaaagaatgtctaaaaacgaaaaatcggtgcaaatttccccccacggtcccaagataatgcaacactcccacggtcccacggtacagagtcatcctaaaaaggaagagttattggaatgtttgtcctcctttgttccaaaaattccaacatagaattagtatgggacataatcatcttactaaattatgtctcatcctgattttaggttagatatttttttgaacttagggcttgtttggtttagggccataccaaaacattggtagtgacaaaacctaggcatgttttgaaactaccaataatttggtagggtagaattctaagtaatgtgtttagattaataccaattggaagccaaattttatattatggtgaagaaagttctagaattataccaaattaagtatgggcattaccattcatttggcttcaaactaaaccatcatatttactattcaaactaaaaaaattggcatggcacattttggcatcaatccaaaatggcccttatactatctatgagttgtgtgaagtggagcggacggcacagacacagacaggcttccgtaatataacagggaaattgacaaattgtagtgcccggatttacacaaacacaaccaaaacacccaatatattcggccttactcaggggacaaatggcagtctggtcctattaattaaccagcagccaaaccccttttgtcacatcaaaactggcacgttgaagcacttttcacacgcctcgccttgtctttgcttgctgctcgtgatcgtagaagtagtacacacaacacctgggagacgcagaagagagacgtggctggccgctttgcttttactagtcgtgtcggaccaaactagtcaagcccccatttacaacatcctccaaaaaaaaatttatttgtgtggattatttatccaatatttagctgtttgttttatttaaaatttcttatgattaatattttaattgttattaaataatactctatatgttacttattttttaagatttatataatttttttaaataattaaatattgaacataaaaatttataaataatttttttgggggacgaaggtgtaataatataggtttaccgctctgattctgccaggccttctagagggtcggcacgtgaggggttgacgtacatcgcctaagtaactgattaggcgtggctaattacgtactcgatcgagttggaacggcacagcgagcgttgagccttggcatgccaccatgctgtcttgtccatggagattcggtttcacgtgttctcatggcatcatcggaagcttccgtgtcatacgtaagagtacttcactgttttgttctcctgtgaccatttccttgagttgtttatttggtccacgttcaaatagagagatctatggcggtttgcagtgattaagttttgtttgccaaaataaagatcaaacactggttgattttttattatctatttgatttagttaatatacattttctccggtttcatatttcttaatgttttggacaataacattatctccaagatatattttaatcatgtttttctattataatatgtgcaataagtaaatatatttttacttttactatagtattttataagataaagttctagtactgcctttaatcaaaacatttttaaagttattgccattcaaaattataaaagtttgaacttaatcttgtccaaaatgtaaagaattaatattgtccaaccttatcttagattcttggatagttttaataaattataaattggagagttgtttcatgtggtcaagttaattaccttgctaaaactcaacagggcatgtgtatcactgtatcaaaggatatcatagtataatacagagcacaatgtacatgcttctattaaatatacgtgtaagtacaaatagtatccgactatgacctttacgtaccatgcatgcatgaaaagcatgtgttttttttctctttgagatgattcaaatcatatttatgaagtaataatttgatatacaatcttgcattttaaacaagattccccgcgagatcgaatgtgcgaatgaagcaggctttttagacattttcttggtttattgacacatttttctaaactttgttgaaattttaaaattttttgctaatgtcttgttttgcttactcaatttgtgacatgtcactctagaatgtacattaaaggcaagtgtgcttatgacatatacgcccatgtgggtaggtcccatatatcaagtgtgctttattatgtttgaaggattcctaaaggtattctcaattcctttggaataaacactatttatgcattcggtccataggatttaaaggaaattttacatagaaacactatgtcaatcctccataaatccttcaaaatgtattcattccataggaataaaaacatccactccatcctcttttattcagctcatcgaagaaaagattcatattacaattctttgttttgcacgtgtattcatatattattctcgtgtatttcctattcatgtaatttagaaaacctatgaacctgagagaccctaaaccttttttctcgctgcatttttccaacttccaaggcatagctagaaattcgatgaccatgtcttaggctaagttcggttgtgagtttgaagtgggatttttcgttgcatataaaatgagacaagttattagtacataattaattgagtattaattattacaaacttaaaaattaagttaattttttaaaaccaaacttttatataagtttttttaaaaaaatgtatatattgtttacttcctatgtttcacaatataagtcaatctagcatttctcacattcatattgatgttaatgatatatatatatatatatatatatatatatatatatatatatatatatatatatatatatatatatatatccagattcattaacatcaatataaatatgagaaatgctagaatgacttacattgtgaaacatagagagtagtagtttagaaaacgtgctaccgaaaaactctctaccgaacatgttaactagccaggatctacagaagatagtacttttttttagaacttactgaaagatagtacccctatgttccattttaaagtatagttgtagatttctgtgtccaacattttaccatccatttcatttaaaaatttctatgattaatattttttttctattagatgataaaatataaatagtattttatgtctggcttatttttttataaaaagttttaaataagatgacaaccaaacgttgaacataaatacctaccgctacgtttaaaatgggatatacggaggaagtactggttgacaaatgacaatactacatggaaatgaatcgatcgtacccctttaacccttttcctagctagtagaccgagctggatgcatgcatgcatacgcctttacgctttccctgcaagtcagcgcgtaaccccacacgtaagtccctcttcgtcgtgagcccgagacaaaacaccaacagctttaccggagaaacgaggaataagctttacaccggtcaaatattgtgttcgctaggcttctctggcatgcatgtttgtctttctagtatctatcgatcaatctcacctgtctgcgaaaaaaactccactgaccgatacgatatcgagcgagaaagaacacagcggacggaatatttacacaggaaaaaaaaacaggaattaacaaaagtgcacaggtggcatgcagctgatgggatcggtcaacaaaacgtagccttctgcaatctgcatcgtcgatcaggtgcatcacacccacatagttccgcacgtatacgtccacacgatcagtcaaaattgcacctggtataccatccccccaggtagggatgcaagtagccaactcccacaatccacgtaataacccatttgctagtttatcatttatattagtataaattttaaaagaaaaaatacactgaaagtgagataaacgggtaaaaaaaaatcccgtttatccgtcctgcttcctgcttgcatccctatccctacgagacagagatatgatcggcctgcctgcacgagcacaacgccgcacgttttcatgcacgcacgcacgcaagcacggctgcgccatcgccaattcgtcacgcgcgcacacgaacccgcgccgccgattaatttggacgatcaatcgctgggcttttgctcgccaccgatcgatcgaccgcgacgttttgggcatcatcgatcatcccagcagctggcgtctgttgtcaaaaagaaaaaaagaaaaaaaaaagcagcgggcgccactgttgccggagcgctagctcgacgggttggttcgtccgtctgattgttcctcgtttgtcgatcggaacgatgaattgatcagcccggttgactgctgacgtcgcgtttatttgtgtacgtactccatgctgtttttagcagaggcccggctgcgaccgactgattccgttcctcgccgcgaacattgaacacgtgttttttttatcgttaaatatactagtagtatatgttagtagttacggattagcagtaagacattttagctctgccttccagccatccaggcaacttagtacaatactttagggtgtgttcgcccccaactttctcaacccttctcactcgttttccgcgcgcacgcttttcaaactattaaatgatgtgttttttaaaaaagtttctatatgaaagttgtttaaaaaaatcaaattaatccatttttttaaaaaaatagctaatacttaattaatcacatgctaatggatcgctccgttctctgtgcgtaaagttagtgatgggaacctgggctgccaaacacacgctaagagcaagtttaatagtatacctcactactagctctaattcatctataaccaatctaatagccaattcatacaatagttacttactatactattaatatatggtctcacatgtcatacatacattacgtcttggagtctgtgccgcagctggctacagatctgtagccctctactcttctctctcatcgtttatcttattaaaatatacttatagctgactaatagcttgttattgtacctgctctaattctatttcccaacaccctccgcctcgttccaaactgttaaacgatgcgttttttttaaaaaaaaatcctatacgaaagttgcttaaaaaatcatatcgatgcttttttttttgaaaaaatagcgcgtgcgcaggagatggttgccaacccattccagcaaacacagcctaataatgcacagggacaagcagggttgcatgggccggccttatctcgatgtcttgtctacaattttaaaagcagagtcatcatcttatcatcctcctcttaacaaatgtagcgtgttccttgcgaaaaaataactatcatccctccctaataagtgggtttgatctattacaacgtattttatccattttaaaataaacgaatctaaaatgataatatactgggtttgtttatttattttggaaccaaagaagtgcaggtatgtaactagtctaaaaaaaattgcaatatgtttagggcaaatattgtaaaaattttactaacaaataagttccggtggatctagctctgcctctgcgagtacatgcattttcggatatactaactccgtctcaaaataagtgcagttttacactattcatcttcaacgtttgaccgttcgtcttatttgaaatttttttatgattattatttttattgttattagatgataaaacatgaatagtactttatgtgtgactattttttttaaaaaataagacggacgatcaaacgttgaacacggatttcgacgactgcatttattttaggacagacccaaacaggtatagctaactggactgatcgaaatattgtatcgattgaaactgtcagtattttaatacgtactctatctagctgttatgcaggattagccgctcttaattactctctccctactcataaagaaagtcgtttcgtacagtgacacggtctccaaaacacaattttgacttcttgtttctataaaaatatttattgaaatatgaaagtatttttcaagataaatctattcatatattttttatattttcaaactcaacaacttaagagttatttatgatttatattctcaaggtttgacttaaacattgtcctaaatgactttctttacgagtacggagggagtaattaattatctttgaacaaagtttcaaggtggactgcgtatatttttccgctgaaatcgcgtgttgaaatcaacagactatagtccatggaataaattttgacattaatttccggagacttctggctacttcgatcttgaaacgaaaagttcattaagctcttttcaccggtgaataattcatactcctatatagcttgctgccaacgaattacggccagacttgtcactttcgtcatttcgaaccaggcacgaatttgcttcgagggcgcactaaccttcgaaatgaactcccatctctcttcctcctccacgcctctgtttaaatattttgattcggcatcgcatatttcagggaaaataatgacaaagcagggttacttgctttattttccctaattaatttgttcttttataggattataagttttgatatactccatactactaacgtgggcgtgggaagctggatgttaccgttacggcattaccacatacagatggtattctttttttttccgataaaattgatggtattcttacgaaccatgaattcggtcgttaaccccatatatgctgtcgattttcttgttacaaaggaatcatttgatgcaagcacaacatgatgcacgttcttctgcatcattttcatctatttgaatactgttattctcagatacctcgatctttctcaagcctttgaataatattttctcagatacctgatcattcagtagatattggtcaagctctagacctgattacttaattgaccagatattaaaaaaagggggggggggggggaaccttccccttgcaaccgaaattagccaaccaagcaaagcacaaactgcacagtagtactacgatcgacaagtccacgaaaaccacgtgctactggtcccacagatgaactaaaccctgtgccggtatggtaatacagtcatcagtgacggcagtacattagtgtagttaactaattgtgtccatgctaggacacgcatcaactcacgcatgcaaaaatctttctaacggttttgggccttttggctaaggttaattaaccaaaccattagagatactcctagtatttaattacctgccacctagcttgggtacatcgatatcttattatcttactatatgacgagagagatcggtcaataattttagcctgatggcaagtcaacgcttaacttaggggacaagatcattagagatcaatctagatggagcttatttttcaaaacaattttcaagcaatgcacgtacgtcactcctaggagtagtatatagctcgccagctggtaattcttgcggatcggggcatgtacttcctgcggacgcgtaccactgcgtacacgcacaaaatttcctgtggaaaaaaaaattagggcatttaactatttaccacacttttatatttgatatttaactatttaccactacatgttaatgaaacgtgggttctcatgtgtctatgggactgtttaaggagtttaaaattctgagaagcagctggttggttgccagcttctatgaattttaaaaagttgggttttccaacgtttaaccgtctgttttatttgaaaaatttatgaaaaagtttaaaaaataagtcacacataaaaaactatttatataagaaaaaaatactaattatatataaaagaaaataataaacgatcaaatgttggatactggaaaacacaaattcgtgacggagggagtaaatatagttttgtttccttttgtgtgatcaacggtcacgcgaggcttaccaattgagagccaaattaaccggccgaacattcgattgaacgttgagtttgtatagttttccgcctatccgtttgcacgtgagctacgcccgtgacctgtgaaatcgatgataaatcacgtgcgtggatcaaaagcatatctaaaatcaacaaaatcataacagtctgcaccttaatttggccctctttagaaaatgagtttaattgagattagcagcctaagctagattgtgatataattaaaaacgtagtacaagtactgtcctttatgcctaacccacagtactacttcgtcacggaaaaggtgatcgttctacgattcacaaaatatcccataaaggtggccatttaagtaattaaatcatcgtgattatgttatctttacactgaacccgtcgcttaaagcttggaaatatgcccgttctttacctatcacggaatctataaaaataaaaatatatttacaacccacccactaggtctaaacttaatatgtaaatataccacctcatcatccactagtaacaattacatacaaagtttacgtaagcatgcagcatcatctaccatttattgaattcgacaaatcaatatgtaagcatatctaatcatcactcttcacattattttcacaacattttcaagatacatatccatctttttttataatacaatcatctatataatcaaaacgtagaatattatatttcatccataaaatctatgaaatccatttctctacaaacatagtttggctaaccagtttgattggtttttaataactaatatttttttactctcagctcatttattaaaaaatattaaaaattacttaataattcctgcagcaaattatgggccgggaatcacctagtacacattattatgagcacactttctaacattttaaacagtaccacattttttaaaaacttagtaactttctatataaaaagtttctcaaaataccttatagaacaaaatttaaagtttttaatagaatttattcgtttatacacttaaaaatattatcacataatcatataatttatgaccaactaattcattcagaaaaaaaaaggcttgagtcgcatgcatgcatcttcatcttcttgctatattatatttatattcgatcatcacccagattatccccacaagcaagatatgattgagagtttccagatttcgcgtaactaatatgaaggaaaatctaatacatccttcatctcaaaatataatcattaacttttttttagctatattcatattcgtttagaaattagtactaccacattttgagatggacgaagagtagctttaattaattggcagcgatgaacccatgaattattgggcaagatcaattaactgaattctcatgcatacgaagacatcaataagtgagatgtttccacgaatcagtgacctgtgacacctgtcaacgtatatatacgctagctctgataatatgagtatgacttgtgtccgtcgtcttctcagttagttaaattaaaccaacttctaatcagtcacgatgtctttatttttttttctttccttttttttttggcagcatgcgcgtgagatcattcgaagtttccacgaggtaggcagaatgcaaaacacgcacgggcacacatcatctgcagctgcaagaaggaatggatcgatagccgacgggtttgaatgccctggtggatcgataagatgtgtgttcttgctgaccaaggtaaccaaggcttaattgcttgggaaggtcgtcttggagcacagcatttgtactcctagctaattagctaattaagcttaattaacttcttttccttctggaaattgcaccggtacatgcaaatgtcccaggacttctcactttctcgatcgtatcggtcagttggtcagttgtgtgaacactgctagtaccgagtctttacaaaaagagagagcgaacggggcccgcgactgcgaggggggaggggaaggacagataccttatctgagacggacttcagttggacatgctgctcacttttcgtgaacacgtttcgtaaaccgccaacagtatgttatgcaaatatttttatatggaagtttctttaataaatcaaataagtttatttttccaagtttttagtaattactacttaattaattatgttttaatggcttaccttgtttcatgtggcattagttcaaccgtccaatcgaactccgcctaaagctgcatttgtaagtgcgaaaggtttactctaataagtggtatgaaaagcgaagcatgcaattagcacttgattaattaagtattaatttaaaaaaaataagtattaactatgaagtacaaatttgaaatttttattttttaataaacttctatataaaatattttgcgcaaaataatactccctccgtcctaaaatataagggattttaagattttgcttgcaacgtttgaccactcgtcttatttaaatttttttgaaattattatttattttatatgtgacttactttattatctacagtacttttaagtataacttttcgttttttatatttgcaaaaaaaattaaataagacgagtggtcaaacgttgcaaacaaaaaattaaaattacttattgtgggacggagggagtaccgtttagcagtttgtaggagaagcacttacggagaatgagacagtagctcagcaaagatggagatccctacgtctttgaaaatgagaaagagattagacaccttgcctctgaattttgatatgagtagtcatgggatttcacacctggaactctcctgtttatggaactctcttgtttatggatttctcacaacagtttttttttctattgctacttgggaagaaggattgttacacaatacatttggaactactacttgtttagggctagctagttttgaattttggagcttaatattagacaaattagacctttttttttccgtttccgtcatactcgtgccttttagactgatgatagtaataaatgcataaaagtcttatcgtgacttttttttatatcagtaatatgtctttggcttatataagctgtagttgaaaaaaaaaatctctaatcatgaatatttgacgctccagataagattctaaagatttatttttatattataaacaagcctgtaaaatctaatgtgtttatatgatatttattagtgtttctcaaaacaaatgtatattttttgttcttaaactaatcatttaacaaattattgattgtcgatttttttttacggaatcttgtaccggagggaaatacctagtataactttggacacgttactgcaactttcgtcccaaggtcctgggagtctccatcattagttgccgcttctagaagaagtaccaagttgttttccatttaggagaaaaaaaaagagatgacatcaattaagataccgctcgccttctagaacgccgcaacatcactgcgtcacacatgcatattcacaaaattcacaggtgagtccttcgatccgctgcatctctcgggccacatgggttcaaagatacgtacagtttgcttgttgaaaaaggcacaagattttgcaggtagacgtgcatctaggaggaggagtaattaattaagtgttgacagtggctaagctgcctgctgcctacatggccttctagagggttgactttctccggcggtgtcaaatgttttttttaaagcctcgtatacatttattaatagagaactgggagtacaaccagtttacagaaaggcccctcagactggggcaaattgacaaatacattgaaatttgcagaaaaggacttctaaagagtagaaaaaaacaatcgggtcctttccttgcttcttccacaaagacggcgatccgaccaaagtcgacggcaatggagatgatgaaaccggccatggcaagctgcaaagatatagctaaggagcatacccaaaatggggcatctgtagtggaggttagagcacccaaggacaaagaaataaaacaaaacttcccccgaagatccgccaccgattcctaggaagaagaccgccttgtagatccacttcactagaggtgtggaggccgaatgaccagcttaacaacttaaaataaatgatggacataaatttaacaacttatagtgatatagttgtagtttgtttgacttgctgcttgtgtagttgcgctatactcttataatcttaattggatgacataaatttgcgtatattgcttttgaggacctcgatcgtttggctgctatagggcaatgccattttggggagtgcatgtaggtgtaggatatttttgacaaatcgatattgtcggaaagctgagtcaatttgaactgtcaggagaaatagtgtatgttatagacgtgtccatttacttactaatttggttttgttttcgtaaaccttagcttattttcgtaagactagtaacatacgtactttgtaatgtatcaggtttataattagaatagaagactaatagaaaaatacaatattggatccggtggttattcacgcggagcatatggagatatttgcgtgcagtgacgtttgcatgtggtgggagaagatggaagaaagatagctccacttttgagggcccctttgaatcgcaggaatgagaaaatataggaataggaaaaacgcaggattttgataggaatgtaagtataaaacagactattgcaaaacataggaaaaacacaggaatggtcgtttgattggaccgcaggaaaaacgcaggaattagaggagagataaagactcaaaggaaagtttccaagaggttttacctcatgttagaattcctccaaaacttgcatggcattaggcaattcataggaatttcataggattccataagatccattcctttgattcagggccccattgaatcgtaggaatgaaaaaacagaggaataggaaaaacacaggattctgacaggaatacaattgcaaaacagaggattgcaaaacgcaggaaaaacacaggaatggccgtttgattggatcacaggaaaaacgcaggaatcagatgagagagagagagagagagagactcagaggaaatgttccaagaggttagatctcttgctaactttcctccaaaatatgcataggattacccattccataggaattttaaaggattcgataggattcaatcctttgtttcaaatgccttcataggattttttttttccataggattgaaatcctccaaaattcctacattttttctataaatcaaaggggccctgatcgaagggctatataggaaaaattcctatagaaaggaaatctctaaaggctcctttgaaacacaggataggaaaaacgcaggaataggaaaaacgtaggaattgaaatggcatgttctcctaatcctacaggaatggaaaacacatggaatatgaagagggtccctttaatagcaccataggaaacaaataaagcaaaggatagtttccaagaggtagagggccccttcgaatcgtaggattgaaaaaacggaggaataggaaaaatataggattctgataagaatgtaagtataaaacagaggattgcaaaacacaggaaaaacacaggaatgaccgtttgattggaccacatgaaaaacgcaggattcagatgagagagatagactcaagggaagttttccaagaagttggagtggatgttaaatttcctacgtttttcctctagaatcgtaggaaaaggaaagtttcctacgtttttccttttctcattcctacaaatcaaaggtataaatagtgtaggatttcaattcctttgtttttcctctatttatcctacaattcaaatggggcctgaacctcttgcttattttcctatgaaattgagctatatgaatacaatcctaaggccccc

SEQ ID NO: 59264 - DNA, 5233 bp, Oryza sativa
atgtttttcctattcccccgttttttcattcctgtgattcaaagggggcctaaggaaaatttcctatactttcctatgaatcaaagggtttcataggaaactttccttagtaaattaaatcctccaatattcctatgccaatccgccaattcaaaggagccctaaaattcctataaatttcctttgaatcaaagggagccttaggccccctttgaatcacaggaatgaaaaaacgggggaatagaaaaaacataggattcagataggaatacaagtgtaaaacagaggattgcaaaacacaggaaaaacataggaatgaccgtttgattgagccgcaggaaaaacacaggaatttgaggagagagaaacacaggtagaacctcatgttaaatttccttcaaaatttgcatgggaagaggcattccataggaattttataggattccataggattcattcctttgattcaaagagctatataggaaaaattcctatagaaattaaatcctttaaaattcctatgaatttcctttgaatcaaagggggccttaaggtggtagagacaaggtgtaggtagggttaaaaaagaaaaataagttaaatctcgccacctctattgttagtaaatggcttattttctctgaggttgtcaaaattattcatagtaaaatattagctaatcttatcaatgaaaatttcgtttatatggaaacaagacatagggcatgtttagttctcaaacaaaattttcacgctttcggacacatgcatggagtattaaatgtagaaagaaataattacacagttcgccagagaattgcgagacgaatcttttaatcctaattgcgccatgatttgacaatatggtgctacagtaaacatttgctattgatgaattaattaagcttaataaatttgtctcataattttctagtgaaatcagtaatttgttttattattagactacgtttaatattttaaatatgtgttcgtatattcgatgtgacgggcaaattttttttttccaactaaactggcacataattcccagcccctaagagatggccaatatggcctttagcatctagcgaacagacgcggccctatacgggtggcaggcccagcgatcaccgaaccagcctgcaaggtttttgtggcgctgcggctaacggcccattacatttacagtctgatctattttggtttggaataagttcactttgggtcccttatttgtcctggagtctaaaattcatccctgaactcgtccctcaacttctaaaaccgatgcaaataaaatcctaagccggtttagacagcagtttctgctgacgtagctgtctacttaaaataaaaaagtaccaagactccatgagacattgagacccacatgacagtgattgtccgattaaaaatagaaaattgctctgggacccacatcatcacccctctttccctttccttgacgacgcctttcctcgtcgtcgtccgcgcacgccgccgcagcggccgaccttgccgagcatggcacttgcaggttctcgccgccgtctcctagctcgctcgctcggccagctgaggtagtagctcgaggggcaggagacaccggcggcggtgaacgtacgggcacgggctgtcgacggtggtgtgccgagctcggtgacgggggaggctaactacgacctcgccaacgccgacggccaagcattcaagctgcacaggatgccaccgtcgtccgtccctgctgtcgcagcgcaccgccctacaacgacgactgcggcgtcagcatcatcgaggccaagtacgacgacgaccccgcccctggacgacaggcttcgtgacgacttccccggctgagtacgtagctagatatccaagcttgtgtggtattgcagtcgctatgaactggcaggaacgtaaaagttgattgatttcacaagattcatggcgcctgctgtactactagaagctaggctgagctgacacttgccggtgtccatatatacgctgctcgactcgttcgagcccatccatggcgtgctgctgtacagcggcgacgcgggatcagggctcttggcggagtagcttccacctgagcgacgctgccatctaccaaatcaaggactccatcaagctccgcctcgcttgccgagccgagcggcccaggagcgacgttgttaggaaggaaaaagtacaccgaaggtccctcaacttgttatcgggatacaaaatcattctccaaccgcaaagccagatatgcggggtccctcaactatacaaaaccggtcacaataggtcatcggcggttttaatcctggttttatcctatatggccgttgactcagcgtgggacccacgtgggtcccacatgtcagccacttcttcccctcccctcaccatctctcttcctctctcctcccctctccacggcggctgcagagagcggatgggcgcgggcagcggccggcgagggaggagctaccaccggcggcggcggcggcggctcttcgccggccggcgtccatcaccagtccgtggcgacaagccgcccgacgacgacgacgctgcccgacgcactatggtcccgaagcaaacaccccgcacgccgcactcccccacacacctcgcacggtggagcatgacaccgccgacatgccgccgcccacgaccgcgaaccgcccgtagcagagcggccctccgcccctcgtctgcctccttcgctggcgccggcgctctgcatcttgcggagcctctcggcgatggtgtgccccatgtgcactgacagggtgatgagtagcctcgtcgcggcgacaccgagcgcttcagtccgggagctccaggatggagtggccccggtggttctccttgacgaccgagaccacggcggcgagcgaattggcgtgcgcggtgacacggatgatgctgaggttgaggcgttgagctcgtcgggaatgaagcacttgagcatgtggacgaagtcgtagatggagtacttggacgtgaggacatggccttctttattcaccacggtggtatccgactatcccgatcaatgctagtattgacgacgttggcgaggacggcgacggccatggctttgttgcggagcggctcgtcgtctacctttcggatgtagagctcctccaccatgtccgggacgacgcctgcctcgacgagcgtcttgctgttggggcggtgagaggaaagctccatgagcgtcaccggggagctcgctgcggaggatgaagacgacgccgacgccgcacgcgaacgatagcgagatcgccgcccgcctcgctcgactgccccgctggccagccggccgctccccgcgccgtcgcctgctccgcccaccgctcgcccggtcctccggcaggccagtacgacgggcgcagctgccgcccgctgtccgaccggccgctccccgcgccgtcgcccgctcctctatctggccgctccgccccgcatcgtgccctctccggcgatctgcttggaggggaggggagagaagctgagaggggatagagagaagtggggaagaagacactaatgtttcgttgacatgtggggcccacatgggtcccatgctgactcagcagtcacgtagaataaaaccgagatcaaaaccgccgagggatatattgtgaccggttttgtgtagttgagggaccccgcgtatctggttttgtggttggaggacgattttgtatcccgataacaagttaagggacctttagtgtactttttccaggaaggaaaggcagggccggctctgtcacttccaacgcttggcccaagaggacagaaactacaaaaagaacagagcctgcacttccaggagagatcgatcgattgatcaaaccttttgttcccctttcctctggccccagaactctgttcgtccctagtagcattccctctttctcgggcgttttgatgaacgaaagaaacaatctggactcactagaactctctctctggttgcagttatctactagctttcccaaacttcaagtctcaaaaagcaaaggccgaactttaggtcacatgacctgcaccaaaaaggtggctgactgggctttctcctgtatcaaagcagatcagctccccaagttcttcgatcatcggcgaacggcaaacgtagggatgcaagtggtttgtcccgctacccacataaaaacccgcttgctagtttatttctcgcatgataatacaaaatttagaagaaaaaataaaatagaagtgggataaacgggataaaaaaaacccactaggcatccctgtgcaaacgggacaaaaaacccactaggcaccttgtcgatcttcttcctccctaccttctttcttcatgtaccttctagaagcttctagcatcttccaccacttgtatttccttagtacatcatcttttccacctttatttactgagttcggttgctattgcactgggtaggagttcgtccacaccagcctgcggtgtcaggccgatgcagtgggtagctaggagctcgtccgcaccgtcgtcccgtaccgggagttgctggccaccaccgccgccgccgtgtcgcactgcgcgctagtcttattttttgaatgtgttaatttgatccataccactgcaattttacctattcagaaaaataccattataattcgcctattcgtaaccgtgtcattccaattttactaaattaaaactatgccactgacgtcaccttttctatccatcctctccatttccgtcttcttccttccttctccatcttcttcgtggccatcgcgccatggccgacacagctagaggcggcgtgaggtcggcgcaagggcggtaaccggcggtggcggcggagaaggaggagcaacaatgggggcggcgcgagggcggctgcggcggcggcaattggcggcggcggtgggagcaacgacggggcggccggagttcgccctcatgccgccgtgcgaccgtttgccccggtcgacctcgacccagatccggcggccgctgtcctcctacgcgacgccccggtctacctctctgtgcaccgacgacagtgatgtcggctgtggacgaggagcagcaatgggggcggggcggcgggattagcgatgggggcggcccctggttgacctcgactccgatccggctgtggacggggagcgactggggtgaccggagttcgttgccactgcctggcacagatctcggtccgtgccgggcgcagccttgccgtgc

SEQ ID NO: 59265 - DNA, 1505 bp, Oryza sativa
ggatgggggagatgggcaggggcacggggaggggagccatggtaggcacggccatggtgagaatgacggcgggcgcgccatgcaatgcaccagcgaggcggcggcgcgggccttgttccgcgcagcgagcgggtggacgggcgacgcctccgccgccaggtaggccaagaacgccggcgccgagtagatccccgccgccgccagcgagcgccgcgtgccatacgtccggctcctggcgctaaccttgccgaagtgaacaacagtgaaagaagacggaaaaggcaggggggaggatggaaacgcgacggcagtggcatatcaccaattttgaaaaattctagtggcatggttatcaatacacaaattataatagcatttttctaaataggcaaaattgcagtggcatggatcaaattaaccctttttaataagacgaacggtcaaacatgtttaaaaaagtcaacggcatcaaatatttaggacggagggtaaaaataattgatctggttatagtttgttgcttcctaccgttagaatttaatgatgaaaattgaaaatcgagataaaatctatatcttaattaaaaaaagaacaccacctaaaacgtggacggaaacttttagattttccttctcaaatctcaacatcccctagcagcgtacaagactacgctagtatacaggataaaatacaaaaaatcaattgaagtgcaattgatctcgagaatttgcacaaggatctacaattttacatgatgatgagatgtttcgcttctctactcaagaatttgcacaaggatctacaattttacatgatgagattttctcttctctactcctacatggtctccacgatgatctcccgtagctggcgccggcacgcctcgccgtcgcggcgagcgacgaacgggtgcgcgagcagctgcgccaccgtggcgcgccgtctcgggtccttgtgcaggcacgacgccacgaacccgcggagctccgccgacgccgccgcgctcgccggcaacgacggcgcctcgccgtcgcatatcgccttcttgagcctctcccaggacggcctctcgccgacgggcaggatggggcagcgacccaggaagagctccaggacggtcacgcccagggcccagacgtcggcggcgcacgcgccgcgcggaccggcgtgggcgttcggctcgaaccgctccgggctcaggtaggccgtcgatccggcggcgaccgggacccggaggcgctcgccggcgccgccgaggaagatgcgtgacacgctgaagtcgccgatcttgacgtccccgcgggcgctggcgaggaggttgtccggcttgaggtcgaggtgcacgacgccgcgggagtgcaggtgcgccagcccggcgaggcaccgcgcggccacctcggcgagcgcgggctccgggaggccgcgccgcccttcgccgccgcggcgggcggcgaggacgcggccgagcgacccggcgtccatgagctcgagcagcatcgcgggct

SEQ ID NO: 59266 - DNA, 12975 bp, Oryza sativa
cgcagtagtgcgcggtcttgagcgcgaacacggcgctggagccacagccgcggagcagcaccttggcgaccacgcccgaggcgccgtcgccgaggttggcgatcttgtcgaagtccgtcagccgcagcagctgccccaaatccatcatcgtcgcctccggcgcggcggcggccgggcgcgccatcatctcgtgcggcgcggcgaagggggatgctgccgccgccaccgtcgccatgaggggtggatggatcgatggaagcgacgagatgaagaagcggagcttgcaatttatgggcgcaccgaccaagtcgagatggagctcgggaggcttacgctttgcttggcccgtacgcagttgtaaagagactcggagtcggattggcgggaacgagaaagcgcgggaaaaaaaatgggagtggcgggtaaagcgaaacctaacgccggtcaaaattcgaacgaaattgccatattagcgcacgcgcgctacttccgattccagcgaacacctccagataaggaagggaaagagctcatggtctccgtatatcgtgcggtcgccggtcaactcaaaatccaaaactttcaaatcaaaattcaaaacttactccagaatctgaaacttttaattccaaatttgaaaagctttcaactctaaattaattaggaaaaatactattaacattagcatcgggagagatggggacagagggtcgcagcctcgcagcgggtgtgacttgggaaagttgacgcagagctgcgccaactagcatccccaaattcaaaaggaaagttatgtgggggccagttgcatgcttccagccatcaaacagaaggtgcacatcatgacagaagtattaggccctatttagttcgcgaaaaggtgtcacatcgaatgtttgatcagatgtcggaaggggctttcggacatgaatgaaaaaactaatttcataactcgcctggaaaccacagacgaatcttttgagcctaattaagccgtcattagcacatgtgggttattgtagcacttatggctaatcatggactaattaggctcaaaagattcttctcgcgatttctatgcaaactgtgcaattagtttttgtttttatctatatttaatgctccacgcatatgtccaaatattcgatgtaacgtttttgggaaaaataatttaggaactaaaccagggcaccaggccttactttcgcagctattgacttctaaccatttcgatttatttaaaaatttagtaaaaaaaattaatgctttaaatacctttcataataaaatgcaagaaaataaataattcttaaaaatagtgaaacattatgttcaaaagaaaacaatatcatatatttaaaaatagaggttattttgttagtaaattactacaagatcagtaaccgcattgtgaaaaatttactccgctattagtcaaatctatagaacaatggaacaaaagttattctgaagagttgctgcaaagggattgaatcaacaaattttctgctttcattaattcgacaaaaatgaaaacattgaaggccatactttacattcatctgcatccgacatttatcagctagagctggtcaagaggcaggaagctcaacaagggttctttttcctagagaatcctactagatgtccgaatttttacatgcttgaaataatgaaatactagaagatgatctctataccatttacaggatagctaatagctattcagtagtacaatagaacgaatgcaaaaaagaatgatcactttctcatctcctctggaagttgaacttcatgatcgcaaaactgaagaggaaggcgaaggtcacggcgaagacgacgtgcaccacggccaccacccacaggaagttatgatggaagccaaagtaatcagtgacaaactgtgcaacagttctggtgtcgccttcgagcacatgttggatatcaccaaactgggaagcaactaatccatacaaagtccatgcaaccgggcaaatccaacagtaccacctccaccaaacagggattttctgtagagaaatttaaaacggttctaaaggactaataaaagcgacatttcatgagaaaagaaagggggcgaaattgagatgggagaataacctaccggtcgagggatcagatatcctgagaagaggttccacacattgtagaaagcggacgagatgattgctgctatgctctcatttggtgtcaaccctaccgccatcattccgtaaaatgtgaaatatagcagtgtgaagtacatgaagaacaagtaccacaagaacttggcaacagtccactcaaatccaatcattgagtataccagcacgccatatatcagagtctgaaccatgatgtatggtaactcaattgcaacctaaaaagggaaaagtggcattgttaggttatgggaccaaaagagcttgacagtgctaacgaatagcttattgcacagccatttcagttcaatcccaaatgcaagtcagaattcaggcatcagagtctttgaagtcatacattatatacatgagattagaactaggccaaccgagagtctaaaagacaaattacctgtccaaatgcatacgggaaagctgaatacatgccagctgctctttctcggtaaaagactgttcgctccaccaccaccactggttgaacagaaccagagttttgcactccaatgtagagaactgcagcatacattgatcccatggcattgaatagatcctgttgttttttactgcaacaagatatgatgagtaaaggtttagaagttatttgtcaaacagattaaaataataagaacatatgttagagacgtacgttctcgttccaaggttccagaacattgttccaaacattagggcaatgacgatagtgaagagtaatctcactgcagtgtaggatggattcctccaatatgaccaattctgcttccacaagcaagctaggcactgtgtaatgaacgatctagagtactgcgtagggaagttgagatcagtagagccaggaggtggtgtgcttagctcctcaataagttccttgttccttctgaaattgcaaatatgcaaaataataataataataattagaattgcagttcaaatacactattcattctattaatcagaatggcatgtgccgaagcttactgatatagctctgactgcctgtagatttcactaaaatcaacaccgagcatctcctcctgggctgaagaggtcacttccaacatccatgttgctggattatatccatcttttatcctactaacgccatcaattccctgaacaaatgaacaacggaatttccgtttgatgtgacttagtcagcctacgtgctgaagcatgaagagatgattgttatttatgttgattttccgttcttacctcaaagtactcaatcagttttgaggaattctggcccactggaccaacatatatctcttcacctcctctcttcattaggaaaagctgtagataaggtgaacagcaacgtagttaatatacagagttcatctaatgaatcaaaggataacttcccaaagaaacaactagtcacctcatcaaatgcttcaaagatgtcaatacttggctggtgaatggtacaaacaacagtcctgccagtgttaacggtgttccttacggtcctcatcacaatcgcagctgcccgagcatcaagaccagatgttggctcatccataaaaataattgaagggtttgcaacaagctccacagcaatagtaagtctcttgcgttgctcagttgacaggccgctcactccaggaagcccaacaagtgctcccctcagagatgtgagctctacaagatccatgacctcctcaataaacatctgtaatcatggttcagcgcgtaagatgtacagtcagttaacaaccgaaaaacatacacaagaaacaaatgttagcccataatctagctaactaacctttcttgcttctgaatcaacctccgagggtagccgcagccatgcagagaacacaagtgattcatatactgtcacatggggagaatggatgtcattttgctcacaatatcctgatatacgtgcaaaggtctcttgcttctttggatagccagatattctaatatctccctctatgtatcctccagtttttctccctgctaaaacatccatcagtgttgtcttcccggcaccacttacacccatcaatgcagtaagtacacctggcctgaaagaaccactaacaccctttagaagcaacaaacggtcttctgttatgccttgtgctttcattgcctgttaatataaaacaacataattgggttaaaaacctgtgttaacataatgatttttacgcacttgtagtcgttctgagcaaaattacctctggcatgtccactgagtatcttacgtcgttaaaactaatagatagtggtgcaaatgggagcaccattcccttcctgcttgcgctagaatcagcgctgttaattccagagttttggtcagcaatatgggacaattccaattcctgcttcctagatttagtgtccttctgtccctctacaacttcaccggttaagttggcatgcttctctttcaatgcgtcctcagacattgatgcatgagagtcagtgaatgctgcgaaaaaaattcaagtagccacagttattatcttttagctcgcaaatgttgattagatattttggagttctaaaaaatgtctttcaaatatacttacgactcaaaactgaaagagctacagtgtagagcaggttaaagaggagagtgtatccaagcaaagcaccaagtccaatccagtaccacttagcttcagtaaagataccacgagattttagtacactaactcccaaggtcacattttctccaggaagtatctgtgacatgcaaaatacatgttcagttttacagtttataacattgcaagttcaattgctggtgaagaaatgtggcactaacttggctccaactgtgacccaaaaattcatttgtcgaaatagcattttgtgcatacgatagcggggatatccagtaaccccaaatccaccatttcttcacgtcagctataaaagagaaacatgtcaggaacaattagcatttaaaaccatcaatttcaagtacatataagaacatgcaattattgaaagggaatccagtaacttacgtcttgcaaggataaagccacccaatgctgcaaaagccaacagtgataagggtccaaatgtgtgagacacaaccatgtctcttccgattccagcaatgaagcggaatagtgcagatgacatctggttgagtgcaagtagcagcagatactgcttgaagaacctatgcacaaaaagttattcagagtttcagacttcacagaatagactcatttattgtggaacatttctatcaatatactaggcaacaccttgcaaaataatagatatctgcatacaaaataagcttatttcttggattcttttaggcatgtagatatctgcatcaatgcatcttacctgcttacactgggatcaaatccaatgacatagtatgttatgaaaacataaacaccaacttcgagaaatgtgataggaatctgaagaatccatgatggtatggtgtaggcccatgcaggaaagaagagaagatccctttgcttgaagaaaacaggtagtttcatgacagtcatggcaagctctgcgaaaccattaaacatgactgtgtcaagagcaaagtacaatgcccccagatagatcattccataatctctatcatgtcgcatgctggtacggaaaaatgtggtcatcacgatcaatgccattagagttagctgcaatgaaagaaagtttcagatgatcagatcgatcgatcgatatcttgaatcaaaattagtgcaccagagatatgaacttacattaacagctttaaaaatgtacataaatgcattcctcttcatgagaagaagctctctatcgatagtggctttgagcaactccttcctgctgacaccatactttgaagtagccagagcagcagggtggctcctggtcctatcaaatggctcagaaagctcattctgtatggatcggcccacatggaaggaacggaacgcatctgcgaattgcttcactggcacaaaacggtatggtctgtcacgcctacaccagtactgcccctgatctttccttgatgtcacctttttcaacaaattcagagatatcagtactgtctattttgaaaaccttgtgcagtaaatggcatgaatttttacagatgataaacagcacatacctcctgcaagaaatcagcaacaccctttctggcagggcatctgaagcccatgaactcaaagaactcaagcacatgttcacggggaccctggtacacaacctgcccgtcagagaggagtataatgtcatcaaacaagttgtatgtttcaggtgctggctggagcaatgagatgacagcagttccgccaaggatgtggatagtctgcctaagggaattcacgatctggtacgtggttgagctgtccagtccagtggatatctcatccatgaacaaagctcttgctggaccaacaagcatttcacctgtgaacatataggacagttagagtttttctttaaagaacaacccccatcttgctaaagactgttagtcatacctgttgtgacacgcttccgttgtccaccagatataccccttaacatctcatttcctactaccgtatcagcacaaatatccaatcctaatatctgcatttatgtagcagagaagcaggaatgagatattatccatacacaaatgccacaagaaatcatatttgtagtactacggtttaatccacagctagcagactgtaccttcaatatgtagtccgtaacaacactagattcttgtcctcccatagctgaggcctacatgtatgaaatataaaaggtgttacttacattgctagtagacatgtatagtatatatcacatgtcctgttgaaatgattcgccaatgcaatcctggttacatatacaattccaagagagagaaaaaaaaactagaacactcttatgtgatagcatcatcaccttcatgtagatatcaatatcatgatctggcttgatgtttgctgccttttcccttcttgccaactcagtcagcatttctaaacaaagcaaaaacagcaaacctcagtactcatgtcaaaggcgtcaataagcattagatggtaggagtatcatgtaatcttggcattcaggttcataccatatctagtgccaacgccttggcaccgcgccgagaaggccaatgtctccctcacggtcatctccccgatgtggagatcatgctggctgatgtacgccgcggtcctttccgggacgaactcgtgcatcccgtgtccattgtaggtcaccttccccgagaccttgaggtccttgtcgagcttccctgccaacgccaggagcaacgtggtcttgcccgagccaggaggtcccagcagcaaggtcatcctacacagagagcaccaccatggatggatgcgttagcgcgagcgccatgaatcatgatgcactggtacacgcagaagaagatgatgcatggctggctgtgttatgggtttttacctccggggcttgatgatcccgctgacgtcatggaggacggtcatcggctgcttcttgttggggaggatgtggagcgcgttcccgattgcctggagagcacagcacggcaccaccaaccatgtcagcacacagcgatacgcagaaaacttacttctctcggcgaggcagcgcgccgtcgcgtcggcgagagaggggacggccacaagtaccgcgactcgcgcgcgcgcgccacgtgctcgacggaatgccgctgagccccgcccccgcgccgcgaccgcgacgaccacgcgtcatgttgttctgcgccgccgcgtcggtggaaaccccgtgagaactcattcgaggtaggaaaagcggtcgccgtctcgccgccgcggcgccgccagcgacggcggcggcggcggtaaggtgggaggtggcggggagagggtgggaggttggtggatagtggaaacggtcaactagtttggttgaacccgaaccagaaagagtctccctgcaggccgggcccgccatgggggcttttagcttagtgggctccactatatctgctccttgtttcccttcttttcaagaaaacgttttttttttccttcaccttttcctatcccaaaaaaaatcttaattttactatttgatctgttcatccacaacttttttttcaggatttaactattcctttaaaaataatcaataatggtttttttattaatttaagatatagattttcaaaacgggtacgtctcgtataaaaacattttatataaaaaatattttaaaataacaaataaatctattttatcggtttaaaataattaaaacttagttgatcatatgttaataattttcttattttatgtgcctctagttaatcttcatcacccagaatcgaacggtgccgtacgcaaacacacctcacacgacaagagtacacgttgcttgcttgtaattaacctgcacttgcacaagtgccaagtctccccggcaattgggccaactcgtcgggtagcccagggcacaaaactaaagctgagcgtagcaacagtaacccaacccaacacgtgcgtgctgcgttcggtggcgccgtggcgccggcgccggcgccaccgagtgcacgctctgtccgtcccaccgtttgaccggatgtagccaaagctagcggcgtccgcgcgcgacgccgcggagaccgtggccacgctcacctacctctggtgtgtttagcccacgctaaaattgaaaatttgattaaaattggaatgatataacgaaaaagttaaaagtttgtatgtaagaaaattttaatataatgaaaaaaattaaaaatttgaagaaaaaatttgaaactaaactcggcctctctctcgaatcgtttcatcatctcaaaaacaaaaagcgtttgccttctcctcacgttacatcgcggcatcgcgccgcgccatcaaaccaccacgaggaaaattcacgcggtagtagttacgtacgcacgtacctcgacggtgttggtgacggagttgaggagggtggggaggccgcggttgccgacgtggacgtcggcctccacctcgaggttctcgaaccgcacctcgatggtggggtagtcgatccccacgcggtccatccgctcccggagcttgaggaggaaccgctcgtggtcgtcgtcggcggcgcggaccagccgctcgatcagcgccctgctctccctcgcccccagcctccccacgtccacctccaccttctccccgccggcgccgccgtcctccgacgacaccgccaggatcccccgccgcacgcggtcgtacgtcggcagccgctccagcgccgcccaccgcagcgcctcctcgtcgtcgtcctcgtcctggaaccgcgacgacgaccgcgagaacacgtcgccgccgctcctccacatcgacccttccctcctcaggctcgccatcctgtgcacctcccgatccatcctgcttcctcttcctcttcctctcgatgttcttggtgatcgatcgagcaaactcctcctttggggggagttgtgctcttctgcctctgcctgcttggccttgcaaggctaagctacaagtttactagtgattaggagaggagacggggtatatataccaacccggggaagttggtgaggattaagcttcggcttgactgagagggtgagcttggactgggcacgaggggggtaattaatccgtgtaataataataataaagccatttgcgtaataaaacaatctgtcgcagccatgggatggtagggagcttcgttgcagagccgctcgctgatccgttgtgttttttcacgcgcgtgtttataccgaaagattaggagtttgggagcttcctagcatcagcagggggcagaccggtcagccgcttagtcagcacgagctactgtgtgtgtgcatgcatgaagctggaacaaaaatacaggagcatttttttttctttttaagttgtcgtcgacctcatgggctagaatcgaagtaatatttggggtttttttaggggagaggtacgtatgggatgaattattggaggctgctcggcttgttgtttgctgcggtaggtgactgaatcgattcgtgtgtatagtggccatttggtttatgttaacctttgattattggaaaaattagaaccataccattataattttgtaaaatttgagatatgccatcctgacccacatgtcattgacttatgtgggtcctacatgtcattgagataccgatgacatatctcaaactttacaaaattagaatgacattgtcctaatttattaggatcgagtacgtttgggggacaaacccaggttattttataatcaagagatggagtagtatagcatataggacatgcaggtgtgagttctttattagtttatcccgtgccttttgtctgatctttttgaaataaagttatttttaaatttataatcaacaaatgaacagtaatatatatatatatatagtacatgcatgtatgaattatttattagtttatccagtggcttttatctgatcttttttaaataaagtttatttttacttgtcgactgttttccagctgggttagagtggccatgtggatgtttggttgaggttgttgctgatatatactcgacgacgatgatgcaggcgatcacatcttgaccgtcgggacaccgattgaacggcccacagatcacagtgtgatttagtcaagctaagagctcgtgcgacgacgacaagagcatcaaattgaatttttttgtgatttggttgttcaatcatttcagtatttgatcattctgtgctacaatctgtcttaatttgccggttgcggtcttgttcattaaccttgcctgcgcttgcagtatccatggacagtatttttctgttattttccaatccgtagcttttgagatgatacacacacactaccgatccaagctgatcttgactgtgttctgctaccagctgcagtatcagtgtgtggttacggtcaagatgtgtttttacaaggcaatttgtgattcgttcttgcctagaaggtttattcattattgattgctaaacccatagatctgggtgtcaccttcgtcagggaaaaagacaattcagcctcttgaaagttgcaactaacagacagtgtccatatatgggacatttgcacttaattaaattaactatgccacttctataaactaagacgtactatacatgttttgccagcgaataatgcatgtttctcaagcctcaattagtgtctgatttgattaatcggttggtgggttttcggttagcaagagtgggttccacattgttttaactgtagtagctagatgttttatccttttttctcttagtttaagattgttccaatggagtaggtattgacactgtcgtacccctgtgatgagaggggctttttagtttggtctaattgcctagatagagtttaaaaagtctctccctgtgtaaaaaaaaatgagtcaaatgtttgtttttcaagctaggctgatcaatgacagagacaagagattttatcttctgtgcctcctgtttcaatgtaagctgctctgattccttcaaatttagttatcagtttgatccattcattctagttatatgattttccaccggtaactaactcttatgttcgttgtatccggcctaattgtatcgcttatgcttgtacctataagccaaaatttgaattctagaactcaattttgaatttgatttttttctcattgtagttttttttttcagtattagcttttgagtcactaaggatacatttataaaaatttttctcacaaataattttgtatatgctaataagtgattcggataaggatatgaataagcgaaacaatgaggcttgatatttgccactcataatgactcgaaagtgcttactttctgagattcatttaatttgttaaatttgatcgattcaattcagttagtttgttgactcggtttagttattttagttttatgcactgtaacgcacttatagttgagtccagtttgagatcatggcggcatgtggtgcacctactccatgtacgggaggaaacattagtgatcatggcaggaactcactatgttctgatgttaatattttatttaatattcagacttgaagacatatggtggaaaaatcaacattaaccgcagtgatatattccctcattccacttatatgttgattagtacatttataaatgcaaagagagggtatttattatcgctgttgggttagccagtttctatcgtcctcttttggacagtgatagtgttgtttttccttgcaggaacaacttattataggtaatattttcttcgtttttaatatacaaagttgctgacttttatatgtaaagatcaatcatttatctattaaaatatttagtgtaactatccaaagcaagagtcatacttaagtaactttaaatttatttacatagtattttttttcaataagacgtttgaaatcaagagcgttatatatttaaaaacggatgaatattacaatgaagcaggagctaatttataagtatttttaagtcttagctggtgtataattggactattattttagctatctttttctttttcatgaatcggataattaggtagtcgcagtctcacctccggagtgtagtaagcgaaagtcaacagttactctctccgtctcaaaatatagatttttttaataatgttaagccaaacattttaaattttgactattaatagaaaaaaataaaaaagatgaattactatatttaatgttaaacaaactaatattatgcagctctttttatttaaaacatcttactttatatatatatatatatatatata

SEQ ID NO: 59267 - DNA, 21348 bp, Oryza sativa
aatggatgtttccatagatgtgtgtctcatcctatgttttaacctacttatgccaacagtaatagctccgtagaaaaaaaaaagaacaactctcaactcgaaatcgcgagctttgaattattcagcacaaatatccgtaatatatacgtgtcattttcagaacaagacgacgacctcgaattaacttcttccgttggccacaatacatttccaccacggcagatcatcaaatttggacagatatatatgtaacggtgtttgggtgaagaccggaattgcagtacactttgacatgtacacggaatcatcagtgaactttgcaagtgtacacatattttccaacgcagggacggatcaagctgaatgagaagagagagtgagaggtgaacgaaaatgcacgcaaccatagatcatcacacgattgttcgttgcgttcttcttaattgatttggtttttcttgtaaaatctgtgttgaaaaaagaagtgtacacaggtgtaagaaacacacaaataattgaactacgtacaggtttattttttaggaaagacaccgagatttatttttttactaaaacaggtactcactctgttttttaatagataacaccattgatttttagatacatgtttgaccactcattttttaaaaattttttgtgcaaatgaatgagatataaatcacgcttaaaatatttgtagtggtaaaataattcatagcaaaataaatgataattatataaatcttttaaataagacgaatgattaaaagtgtatttaaaagttaacggcgtcatccattaaaaatgaaggttgtactttttttcagtaataaaagagaggaattaatcgtcaacgccagaaacagaaaggcgcagccgcaaacaagtccgaggagaaaaaaaggaggaagttatcgtacgcatgcaggcaaacgcggcaaatttctcatgtgatctcacgtacttgatcatgttgcatataatcacatcatatttgtcgctaatttgatctggttatataatgcgagtacacgtacacacggcgtactacgtgttaccagaaatgctcctgcatgcccaaaccaaaaactcacgtatatacaaatacaccctgtatggacaaacaggtcaaggcttccgttgacctggttaattacgcttaagaatccacttaattagctaataatgacatgcacccgcaggtactctccatatcgtgtgttcagctcagcgtttacgattccgacattaccttccgtttcggtcaggcggaatttggaatttcgtgaaatccggtagaaaaccggtaaattccgaacaaattttataaatcaaatttactgagtttgccgacaagttctcgaaaactggtcgattttggcgaaattctgatcgaaatcattgaattttcgatcagtaatttgtaatagaggtaatttgctgaaattcttttctttcatgatgtaattttcagtaaatacacaatgtatcatttttttcgaaaatttatatcccaatagattctgtgaatatcatagatttacatgattttttttcttttttatcaattcaaatttgaatttagatgaaactcctcaaaattttaaacggtttctacgttcgagccttgtcgaaacgtcgaaatttcgtgaaatccgaccggatttcatcggaatcgtaaaaacctggttcagctgccccatcgatcaccggaccgacggctcagatcgacgcagagaacgtcaccaaaacgaccctggcctcatcacccgtctctccaccgaggtcgattaatccgggccgtcgatttctgatccgatggcctttccacccgtgctagtgtcgcgtaaagctgcaactgttgaccccaacaaaagtagaatatgttgacctaacatccaaaaaagaaaaggaaaaatgatacattgaccattgccaagagagttggtcaaggtttcttgggattcacacgaggagggtttggtgatgcagccagctcgtgacctggtcaacgctaggcaagtagtagcagccgcaatgcaaagtctcattgtaaagtaggctgtgtttagatctaagggtataaatttttggcgtgttatacagaatataccgacacacatttgaagtattaaacgtagtctaataacaaaataaattaaaatccacatgtaaaccacgagacgaatttattaaacataattaatctatcattaacaagtttactgtagcacaacattatcaaatcatggtataattaggcttaaaagatttgtctcgtaatttacacgtaatttatataattagttatttttttcgtctatatttaatactctattcgtgcatcaaacattcagtagcagcatggtgtagacaaggcctgagtagtctcgcgtgcgtgggtgatggcatgcagattgcagtaggtaggttggtgatattgcaagatctggacacagtgaacaaccgagtgtatgtatgtccatggttgaaaatttgcgttcctttgagcaaatttttcaacgaacgcaagtttattttcgtcccaaaagtaaatcaacgcaaattttctcgatcaccatggcgtcgctatatggttatggttcttgagcaggaattcattaacaggataaaaaaaaaaggggtgtcggcacagacagactcgaccggaagtgacacatcacttgcatgttgcatcggcctagctaattccttctagtttctccaatgatatctcggtcagaacagcactcagaggagatcagcaacataaaaaaaggcaggttgttgttattgttattattatattattattgttactatttgcaagcccatgcatgacactgttcacaaattcgattgtgatttatacgcgaacatacagaacatatataccattcaactgtcacagagcaagcaaacaatatgtataatgtaatgtatcttgtatccatatgatgactgtattaactctgaacacctcatgttctttccacaacagttgatctggacgccaatcatatagttgcagtggatttcaatataaaggtgcgactaatatggtcaaaatctcctgttaatttgttcgatcgacatgaatagatcaacgcaggctgcaaattagcctctccagtgttgacacttgaccaattaggagtggtcaggccggtaggtagaagaagagtgaggagaagatgaggaggagagctaattatttctggtctaaaatacagtagttaacattatgtgctagctactcctacctcgcatcttcttgttttcggacagtttggcgcgcgttctcactacggattctgttatttgaacgagactgttatctggatccacctaaacagattaaagttttgagactcggaatttctcatggtttgactagaattcaactggcaaagaacagagagataatacaagcacacaaggaagaaaggtagaactagaagatgtgtatacacaaacaaccaggtcgtcatggaagtactccgtactgcatttccaaggtttctccaccttgttatcatcatccgactactcgatcagcgacagcgaagtactccctccgtctttccgtctcataataagatcatttttctcttttatttatctaaaaataaagagagaaataatttgcactagcatttgataaagtgaggttattctaattcttttattgatatgtgctgataagtggaaaataaatttattttgagactaagggagtaaatgatagatcaattctcttttttatgctcaggtattgaatgctttacgcggtgtttagttccaaaatatttattcaaactttcaacttttccaccacatccaaactttcctacacacatagactttcaacttttccgtcaaatcgtttaaatttcaaccaaacttccaattttgatgtgaactaaacatagccttactactactctctaaaaggtacttcctccatttacttttgatcgtcatatttcaaaacgaaaaacattcagtattgatcgtcgcattagcctagtccattcaatttcttctcgggtgggatggagtataccactaccaaaaatataaatataatggtagaaacatttagatattgttaagaaaacgaagaccttaattaaggattaataacaaatagacaacagcttctaaatgtctaatctcccctctctaacctcctacaaaaccatttgcctcttgtatatcactgctcagtgctcaccttgtaccaagccgtttttcaagaacatttgcgaattgttagtcgttggctcacttcattatgcatatcttgtttgaatctttgtttcattgtttggtcagccggtcgagttagccagcaaccattgccaagagatcagtgaaacctatcctcaattggttcctgaaatgctggccatggcgccatgtcgattatgtcagattggtcagtgatccggtcaggttaggtcagaagatctccgggttgccggggccgtggggcatggcgccgccgccaccgccgccgcggcgcaggtcggcctgccggaggtgcagggacagcgcgtagttggacgcctccagccgccgcacctgctccctgtagtcgtcgagctgccaccggagctcccgctgcgccttctcctgcgcggtccgcagccggtggtggaacagcaccgccctcttgaggaacccgatctgcctcgacgcggcgtccagcctcgcggcggtgccagcgccgacagcggccccgaacgcgtcgagcaccctggcgccgcgctccctggcgtcgtccatggaggcggcggcccacagctcgcgcatcatggtctcgacccagtacccgcggtcgccccgtgctgcaccgtcgactgcggcggcggcggcgacctcgggtgcgggcgcggcttgcggtgccggaggctcgggagaagcggcggaggaggcggcggcgtcatcgccgtcgaggttgaggttgagcatgcggtcgatcaccgcgttgaagtccctctcgcattgctccagcgcgagagccctcgccgcctcgtcgtcgccgggaggaggagaagccatgcgcgcgccgcacgagagacgagagacgacgcggccgcggccttcgcctgccatatgaagaggcgaaggcttctcctcgcatcggattcggagtcgtgtactccgtttccgtctgtgacgctggcggtgataaaacaccgccatgtatttctgtcaacggaaaaaacgtgggccgtcacatacatcggcccattaaccacgtctacgaacccgcacgcggctcccctactgatcctcgccgatggccgtcgcatgcctatcgtcctccgccgccgccgaaacctctcctcgtcgatcccatcttcctccattgttgtgcacggcgttcgctcgtcatacagtgcccgaagccgaaccatccgctgctcctccacctacacaggtagattgatgcgtggcagtgaaagtgaggcagtaaagtagcgatgtgtgtgtggtggcctggtgggtttgtttatgggttggcggactggccgcgaatagcccagcagatagtttgtgggtttgcaggctgcaacaaacactgctaacagcaagggtaataatagagcccacttcctaatattagcccatctcaaagccaatatatataatagattagctataaaattggctacaattttctttttatctctctatctctcacttatatatttaatgcatttgtcttggaccttatgataagctagctcttgcatgagagccagtatccttaatttttcaatatctctcttctatacctgagcttacagtaggcttatagctcactattatacttgctctaatgggttgcgggctgctgcaactcgccccgcctgcatggttaggtgtgatactttcgccgtatcatggtggtctgattatgatatatccatgacaagacatcatgataagtcgtagtatcataatatttgaatgtgacattggtttctggaggtggaatcgtcgaagtattatgatgatatcttgtatcatcgatgtttcatgtagatagtactccctccgttctagaaagaagcaattcctggatccctgatgcaaatttagtactaatgtaaaatgatgaaaataccctccgtgacaacatccatatattactgtcatttctctgcatctgttgattacatatgtcatttctctgcatctattgattacacatgccagaagcatatgacgcagaataaaaaatgccaaaagtttccattgccgaaagcaaatacttaaaaagaaaatctctccaattgagaaaatactagtactactggcaacagcataaacatggcaagaacccagagaaaaaagaaaagcagtgcatgaacatagcaagaacctagagaaaaaaaagaaatgcagtgttgtttgccttcaccaacgcggctcgtgcatcaagcaaccgcatcaaatcttccgggaatgataagcaattaggcatacaagcccccaccgccgatgaagctgcgtctccccatcgcctccaccgccgccgacaaagccgcgtctccccatcacctccaccgccgggatgtgctgggaggagtgggagggaggtggggagggggtcggaagcttggtgaggtctcgcatcttaccgccgctgcatcgatgcaatcgatttgggaatgggagagaaacacgagagaaagagtgagagacgggcaggagataagatttttgcaatgtgaggtgtgaacgagaggaggagaagtcgctgtccacctaggcccacaaatgatatgatagacttgaagttttcttgttttctgtggaggaatcgcttctttgtgggacaaatcctcccctccagaaatcgcctctttctgggacggagggagtacgggcatggtctattttgtaaataaatctcctctccctacttgttgctaaacgccttcttcttgtcacgctaaccgtcaggtgaactacaacactatatacgtgcattcccaactggccaacgacctatacccgtcgggcccactaaaggcgaactccttgcatgcttattcaacgatgtctttctccttgcaacgtgtcgacaaaaccaccagttcctcctccactcaaatatgctttgccactcaagaaaaggaggggaggtggatgacgatgtatcgttcgcgtgttcatcgccatgaccggagcgagcagcattccattggctttccccttatgccggtggaagaggaggggaagcctcgttaacataggctatgttctttggacaacttttccaactttactctctcgcgctaacactttttaaactattaaatggtacttttttacaaaaagtttatacatgaaagtttttttaaaaaatcatattaatcaattttcaagtttttttaaactaatacttaattaatcatatattaattaggtatctcattttctgtgtgaaggaaattagttctcaacacaagcaaatgaacacagccatggttgttaatagaaaaacaaattggctgtgccaactatccctatccgaaaccatggttttatcgaatcttatactaccaaactatggtttcagtacatgctattgacgtatgcttttctattttgtattgtataaaagtttttttttaaaaaaaccgagcctatgttttgagtccaactcgttcccgatcccgtgtgcccaatccacctgaagccctgaaccgtccatcaataaatcggacggaccacaaccacagcctctcgttgcccccagaccccccacgccccgtcccggtctcgtgcgaacaagaaacggacacacacacacatctcctcgtcgtgccatcgtgtgacgacgtctcgtctcgtctccctctcccgacccgacacccgagtcttcttcccttccccaatctcgcccttcctcctcctccgatcgatccagcccccgcccctccccgcccctcgccgcgcgcgcgaaggagagagagagagagagggagagagggagggagatcgcctcgccgccgcggcgtgggatccggaggtggtgtagcgaggatgtcgtctgattcgtcgtcgtgggcgcgcgcgctcgtgcagatctcgccctacaccttctccgccatcggcatagccgtctccatcggcgtctccgtcctcggcgccgcctggtgagttcccccccaacccctcgctcgctcgatcgatctgcgtcgccggatctgcgaaagcccccggttcgcgcgccgtcctcatcgcgcgttggtgctctttttgcttgcagggggatcttcatcacggggagcagcctcatcggggccgccatcaaggcccccaggatcacctccaagaacctcatcaggtgcccgattcttgcttctttctcatctgatttcgttctcgaccgcctggctgtcgatttcgtgattgggcggcttgctgatgcgatttagggtttggctgaatagctcgagtgatgtttttttctgttagtgcggataggggatattttgatatgagcacatgaaattgttcagagctgctgatatgtacatcataagtacttcctcgggcggattacttgagtgccagtactagttaataacatgaattgacttagattatcagataggtttctttctaggactaatcggatgccatcttgcaagtgtcccattgattttgacagtaatgagatccgtaaaaatgccaacaatacgcgaaaactgctggacatagaattccatgcattttgtatctagggagattgattaccacactgttcctctaggcagttggttttgtagagtgccctttcatcatggctttcaattattacgccttgtatatttaagttacatggcataatttatctgttagcaatatccaatttttagcattatgccatctcgtttgcttcacctttgctacaaaattaaagctggaggcaaatgttgcctctgctgtttccacgtttgctctggttagggtagtcaagttcttttaactgctcttgtgggatcagtccagttccttagccagcctgtatcttttaacccattgcttagcatctgtgttttacttgtattttcctttacgttatttggggcatgtttgctcgattataagcaatcgtagtggtgtactggtgtaactagaatgtgggctactgtactaatgataatgctgtcatatgtacttaagctattgtagtgctctaggacaactgcgtcatgcaatgtaacatgtgcagtggaacattaggttctacatccatagtatcatgtaggacaactatgcacatacgtgcgatttatgcgatgaacaccagtctggtgtgcaattaggagctgaacttttggtctgtctaatggtcacttcacaacttaggtaacattgcctgatcattatagcacgcttgaaaaatatggagatactgaggaagtgtttggtgctttctgttgacaagtcaaacctaaagttctccaattttatttggtccaccgcatttctcattttataaaccagcagcaagagagcgatagtactagcaagaatctgattatgttcccgacagatggttactgatagcagtgtgactgtcatgctttattttgcacattctgaaaactagatatggtgcttaactacaatcttttcagtcatttcaagtaccctgaatggctgaagaaaagaggcacacattgtgtgcttatctactctacaaacagtgtgtgcactctacagtaaatgacaatgcagcatgactaagggacttaacatttgtttgtctgctcaaagcaatccatcgtgcttcggtggatacatggtgcattttattgtgaataaatcggatgctacaattcatagaagtggccactgaatgttttataagatgtatagttatgttaactgcattaagtttagttttttgcatcagttgtacaaaacagttacatacatggcctctaggatttcatctgcatagcctttatttccaccattaatattaaaatatactattttgttaatttgctagttcatattctggaacatgtcttgaaagacccttttgaatcacagccgtgttcacttttaacttgcgatactgacatctatgcatctaattgtgctttacagtgtcatcttctgtgaggctgttgcaatttatggtgttatcgtggcaatcatcctccaaactaagcttgaaagtgtaccaactgctctagtgcatcatccagagtctctccgggctggctatgcaatctttgcgtctggtcttattgttggctttgctaatcttgtttgcgggtaagcaccaatccttgtgccttatttcttgtgtatcatggttcacgttctcagatggttaaatttgtgatcggcagggtttgtgtgggaataattggaagcagctgtgcattgtctgatgctcagaattcatcactctttgtaaagatcttggtgattgagatcttcggcagcgccttgggtctgtttggagtgattgtgggcataatcatgtcatctcaagcaacatggcctgcaaaagcctagttctattcatatggcaatctgtaaattatttcggggagacctatcagaagaatatctggtccagttgtttttatttctttttttttgtttgtgcatttttggcaaatcacgtatattgatgcttgatgcatctgacggtagagatactgttcctactgtaaagactacataactgctgcgtatcttgtaggtgctattgcttttgcagagtgtggtctgcgtattgaataaaaccattgaactcaggaataaaatacttcaaacaacattttgctcagtgccaagtgctgttgcattattgaacgagaaagatgaacaggctagcctattttaggtgatggtattgttgaactcagaatgcgagatgcgtgcgttgtgctcaattatgttgcaaatattcacgaaaagttattaagagatgtctgcagattgtcgttacattccagaccccgcagttctaaatctgaattcaccaatggatatgacttacggaaccaaatgatcgccaacatgtgaagggatacaaaatctttatattaaaatgttgcgaaatgatatactctcttcgatcataaaaactcaatatataggacaagataatttacgatcattaattgaatactataataagttaatgtcatattatagtattacttttgggggcaaatatatgtatacaacttatttttaagtaagcattaagaactcattgatggttaaaattttattttactagaaaaaaaacccgtgtgttgcaacgggtgaatgttattttgatagttatacggtttagttagaatgaaatttactgtggaaattcgcttaaatatttttttaagaaaaatcataagctgcaattaggagtccgactttcatctcaaagtagcatgtgagttattttaaagagatttcttatacgactccttttgtattttcaaaagcaaacaaacttaatatccgactcaaacacggatatgtgtttccaaaagcgaacgaacttaaaaaccgactcaaatacggatgacatacccaaataccggcaaaaacatctttaatttttatagagaaaatctacacaacagtatcccgtcacaacgggataaggtctcatctaccttatctccttcgatcccttcccctccacaatctctctctctctctctctctcgggagtcaggagaagtccaaaggcatggagatgaagccagctagaagaaaggggtcgtcgtcttcggcggccgaggtggacaacgacggcacggcgtcggcgaggtcggggcggtgtcgagggtgatctcgtcgtgcctcctcgacgccgtcatccgctcgctgcgacgccgcttcttctaccagcgctccctgttgctgccggcgccgaggcctctcccctcctccctcgcactcctcgccaaggtctccgtcgccctcgcgatccaccagtgccatcgtccttgcatgctgctcccgccacctccttgccggtgagtgcaggtgggtcctcctccaccaccgcagaagaagaagaagccggcggtctcagtgcctctgtcaccgcaacaccggcgacaacctgctctagaacctctacctcctctctttcgccatcaacttcaagatgaagttgctgaagcgcagttcctggagatggtcaccgccgacttccggccggacctcaccatcttctgcgtccgtgccacggccttccaatagagtttctaaataaatggcaatcccatatggcatgccaaatcatggaatcgatggggcctagctctccgtaccaattttcctaatttctattgtgatttatacggagagtctattggagtgtatgggaatatgttggagtatgtatatagagatggaactaaacgacaggatatggaaagtctgttagagcatgcctaatgtcgtgcctcagcccacggtctcaacctctagctaggctcagatgccacggtggaggtgcgagagggcttcatgggtgtcagagtagcccaatgaatttacgagtggcttagggggaaaaggtgaaaatggtctgatctggtcggcgaccatccaaagcgatagaggagggacgaagagtgcacctttctctcaccgtcgagaggaccccggccaccaccatcactaccatcgagcaaaccaacaactagggaagaagaggtcggcaaccttgtgcccaaatctagcggctaacagcgatcggagatggggaagggaaggaggcggtgtctgagcctaccctctctacattgcacggagctcgcaaccaagccgcctcaccagcacctgccaccgtccccacccaccacatgcctagtacattgagcaaggtcaagtccagaacgatggggaaagagggaggtgaaagcgttcaccaaagtgtggcggagtaggatagaacgggacccccagaggtatggctgacacggtggcttggcggtaaagggctaggatggtgtaacaccctgaaaattcgaccaacgaaatcaaagcaccaaaaatacggattttcaaaaactttttaagtaataaattgcatcatgccgattttattcgcctatttcattggattttgatctcagaatttattaatcgcgaataatgaataactaactaggaataaaccctaaaaatcaagttggctaaataaataattaaaatataaattaaaataaagattaggtgggattggaaataaataaaatattatcgcgaccatattagcaataattaaattttagtacgatggaatgagaattaaccctaattaaaaattcaaataaattatataaacaaaatatgagtgatattaaattagggtgaatttttagttaggataacacaaatatggagtaaacttcatttatgcaaaaattagaatttatagggctatatttaaatagaaaatgggctaaaatcgggataaataggaaaagttactgttcattgcggcataggtgttcgatcgtggtcctcctagccccgccccctcccctgccgcgtgcgccgcgtcgcctgcccatcgcgcgcgccgccgccgctgccgcgccatcaccgtcgcgtcgccgtcggcctcgcgctcgtcccctcgcgcctgcgccccgccgcacggccgtcccctcgccgtcgccctgcgccgctgccgcgccgcccgttccatcgcgccgagccccgtgccgccgcgcgcgtcgcgtcgccccgcctgtcacgccgctcgctcgccacccgccgcgtcgccgtcccatcgccgcgcgccgtcaccatcgccgcgtcgagccccactccacccgtcgcgtcgcccgtctcgagccccgcaccgccgcccgtcgcatcgccgctccgagccccgcgccgccatcgcgtcgccgcccgcgcgtcgccgtcgtcccgccctgagcgccgccgtcgcgtcgccattacgccgccgcccctccccctctccttttcccctctctacaaatacccccctctctccattttccccccaccccatctcacccttcctcccctcttccctctccactgcgccgccgctctcgtgccaccacgccgccgttcccgtgccgccgcgccgccgctcccgtgccgccgcgccgccgttcccgtgccgccgtgcgccaccgtcgccgccgccgttgtcgccgctgccgccgccggtgagccgccctcctttcccctcgcgtccaccgccgccgccgctcgggtgggagagagccgagagagagagggagaggaaaagagaggccgacagagagaaaaagagagaaagagagaaaagaaagaaagagagagagagagagaaaagtaagaaaaagaaagaaaaagagaagagagaatggagaaaaataaaaggaaaaataaatagaaaattaggaagaaattaaggaggttaatagtttaagaaaatctaaaataattagaatttaattatagattaattatggtcatagaattgcaaaatttaatataaattatagattattcttggtaatttctaaaagaaatcaattcgcggtagtagtttagatgtaaataacgactaaacaattagatgaatttttatagactattacagattagttttggataatctctataagtaatcgattcacggtagaagttcggatttaatcactaggaattttagacgtatattatatttaatcggttagtcataggctaaattaaatcgtataatattataagataatttttggatttcgtccgatatttagctcacgatagaaaatttctaacctattatatggatataatgctcgggtagattaaattaaaaacttatgctaacaaaatatttatacccgcaaaatagtttaggatgtataaatcgaaattggatttgccctagttcgcgaatagtaaagttaatataaaagaatcaactttcgcattcgacttccatttggatttatttggatctttatttgaattttaaccgaattcaaatcgtttcttcgcacgtaattttagagcccgagggagttgcagatccaagcgaggaccaagaaccgcaagactttgagcaaggcaagtcatcactatcccttgaacatgttgatcctaattgtgaaattatttcgtttataaataaaattacatgcaatgatgaacatcctacttgtgtttataccatgccttgattattgtttaccccttattccttcgtaaccatgtttacgtatgagtccctagtcaattatgacaattgcttagaaatgctattctagaatcatgcatactcatatttatcaaatactaaatgcttgggcaattacctttgggaaggtaattgagatgtggcatgtggagacatgagcgccacattgccatgaaattgatgacatgatttgtgaaaggaaaataaagtgaaaacaattgttttcgactggggcggacggaggatttgggtggtatctagaaaaggctagtaccgtccccggtcaattaaggaccgagccatgaagttaagcatgaaacgacccccgtacaaccgcacttctcgtatgggtatagacctagcggagtagatagccgagcggaggcagtatccctgcatagatggttcacccctgagtgaggcaggtgcgctacggtgggacagccgttgaggtaggaccgagaggcgtgccctacatcggtgtcaccattggtaggactgccatgagtgtgtgagagagagaacttaacttgaaccataatttaatatgtgtgtgagacttctcttttccgggagcgccagaactcctctcactgctagaaacatagacgcctagagtgcatgaggatttaagttcatggagcgggtactgtcaatgcgaggttatcgaaaagctttgccatgacgcgtctcatgtgttgggacgaggctcatgtgttgggcagtcgcggagtacgggtaaagtgtacatccattgcagtgtgagtaaaccaaatctattcgaatagccgtgctcgcggttattgagcaccgggacattattacacttggctagactctaaattctttaacttgtgtgggatgggatattacatgatgatttttatgctgatggagccacttcctgagaggcgggaatgtggacgtcctcagaaaaccatgacgactcaatggcgggaagctatccttgggatcacaatggatggtggacagaaccgtcattgtttaatgggaacactgatattaaaacttgatcagtctatgctaggtcttaggcttgtgaaaagaattacaaaacttgctttgtgcaaaagaaccatagccatcctttgaattcctctgtcatgtgcattattgctgtggtggcttgctgagtacggttggtactcacccttgcaatattcaaacttaattagtggccggagatgaagcttcggaggatccctatgcctattaccaggagggtgatgagaacgatggcgctcagtaggtcttagttacggtcgttgcctatggcaatggcgtgccgctgccttacctacttctgtttttggaatgtattccggaccgctcggtccgatgatttaagactgtgcctgcgggcttatgatgtaataattcgtactagactctcgtgtatgtgcacttgatatttcagctatgagtttgtgtgtaccagactacttgatccagggaaatggtactgtttacacgattgattcctgttataaaaacgggggtccacagatggtcagtgatgttgggtatggatggagttggggagaagacggaaaggaaatgaacatggtaattactcttggagttatttataatttatttcttcccattgaagtacaattcgtataatttgggatacatgtgtaaataatttatgtttttctaaattataggagtgaagcacaattaaaagaggccaaaattaaaaaaaaagttacataggcttgcctaggctatgcctacgtacattgtaaatacacggttgctttaatagtggtttcaattgcttttgcctaagtagaggttgaaaccactagtcgagagttgatacttttgtgtattgcccatgctattggagtgcacaaggatatgaagagataatcttttgaaaagaaaatattctccatgtcgagaactaaatttaacaacgctcttggttttttagatgctatgaaaaataaaagtgtgtagacctaaatatggggccaccaagcttgccccggccgagccatctacatcgagcctgaatccaaaccccatacggcaactcttcatcgtctctctcccattgaaaaaattgagatcatgccattttgtcaaaagtgtgtattgcccaaatgccattttactaaagggattcgataaaatattactctcaacatatggctatatactataatataatctaggacaaaaatgcctttgagctcattcttccccatcttctcttcttattctggctacccctcgctgaacaccaatggaggaggcttcctgagctgctcgcttatgaaggcttggtgcggttagtgctaggcgacgtgctaaacatggtggggttaggcgtcaccgatgggacgtgctactgctggtgtgcagagagccgtggagctcatccgcaacgatctggagatgtagggtgatgatgctcgtcctcttcggcggaggagacaatatcacgctgttgatagtgtcgacatgaaggatggccgggatgaggaagttgccactgatgcggttggtgctggtggagttgatgtgggcggtgagacatcaaaattgattgatcaagactgcatggcaatactcgacgtgctggcgaggaggtacaattttcggcggcgaatgaaatggatactcgagcttgatgcagttgtcaaaatgatttatccacctcactagaaatttctctcttaaaaaccattactatttgtcatgtcatgtatgccaaacttttcctattcactcgcagaatcggcgtacgccgctgtggctccgtcccggaggcagaaataacgcacgcgccacgcccaccatccgcgtccgtactgagacccaaccacaaaaatctcacctcctcctcctcctccctctcccaccgcggcctcctcctgctacctgggagccacgcgcccccggcctccacctcgccgccctcctcgccggcggccgccacgcgtgagtcctctcccctcttcctccccgccgtcccccgtcactgttccgcgctggatttcgctgcgcggccgcgcgtggttccgcccccaaccccccaccggggaccgcggggctccggtcgctggagagcgctccgcgtcgccccgtcgggctccggggccgctggtcgtggtcccccgcgcgcgcggcctccggttgcgcggcgcgggcgaggaatgccggcgcgcgtgcgggcgggcgggccgaacgaccccggtcgaacggctagggcgctaaattttggtgctcgaatggaggtgtccttgcgaggttttgggggatttcgtgtgggggcgtcgcacgttcggtttgcgtttcccccgtctagggtttggggtttggtggattcgtcgtcggtgtgatcgcatttagtggctctagctgctgttggtggtaattttagttctcatattatggattggtcatgtcaaaaccctagatgagttccctggaacccgttagctcacctcatgggtttgttcttcgtcgtgctggacaccctcctttgctcttgttctaaaaactaaggcatgcatgacgatccttgttgcggtggtactgttttatatatgcttatggttaatggtgagcctattagtaaggtgaaacagcggatacgaacatgtcagttgaaaaagcattcatgtttttatttcctaccctatttaagaacacacgtttgatcaaaggcgctaactgttgccttttaggttgaaaacagggtactccaagccattgttgagcctcaagttttatgcatgtactatgtagttactcctctaatggccttcttattcaccatgagcattcatgaaacttattacattttctttactcctgtttagtgagcatgtagaattcatgccaaccggaaaatgtagcagattgatttgtccaaaagataaaaaatcgaacgacttcctgtgggattttattccagcataacctaaaatgtaactaatcagcatgacagatttatttatcaagcagatggatctgtacttccattatgtttgcttatttaccgcgaatattttggaactttagaataaccacagcctatccagaaaaataagaattaattaggttggtttaaaatgcatcaccatgcagcaatcggttgcaatttcatatctttatatttttttatgtgttatctttgatgttcccgcatgcattcagctgtagataaaacattgctacattcagttgcaaaatagggttcagctgtgaaataggacttttcaagaagtctgagagaagctgtccctttctttgttgagaaaataacatctgctgcagttaatatttcatctttctcaattcattaaactaactaatgtatatacagcgtattagctaggttaactaatcttgcaaatgacatagatttgctaggttaactaaaatgttaacaactcaaattcaacatgtgtgaagaaactagatttacgattttcgttatgaagcgaatgtctaaattcacacttgatacggtaatagtactattagtttgtaagcatggtttgtatgtttgttgaccacctagcataaacagcacaattaacagacaccaccctttcgagcttcagaaactacgtatgttctgtgctaacattatcaatagtcaagtctgatgtgttgatattgcctaatttgatctaaagtttgacctgctgattttatcactctaggcttatggtgagtgcacagtgagctacaagttaccattatcagaatggatggtagtaatgagaatatccaattctcatgggggaagaagagagcaaaaggtggtattaagatggatacacagttttatgactccttcacatttgacaatgtgaagtactcactgtatgacaatgtatatctttttaagagtggtgagtctgaaccttacattggaaagataataaagatatggcagcaaaatcaggctaagaaagtaaagattctttggttttttctcccggatgagattcgaaaacatttaagtggccctgtaatggaaaaggagatatttcttgcttgtggtgaaggcgttggccttgctgatatcaacccactggtaagttcatatattttccccttcgtttttgaattggttttcttgaatatcattttaccttatgctttcttgcaatatatttaaatattttcattttgatcactcaatggacagataatcactattatgtgaacactatatcaaatttgtttctaattgtgaaaagtcattggatgggcaatagtgtcgacattttgttaattccaaatatctgttgttgagaagccatatcggtagctagaatcctagagctacaagttaccttatcaagttgtatctagtactagttgatgtgaggagatcatttcccacttttttttgttgggaatcgtccaccttgtatttgtggtatatttagttattcacgcatgacatgaataattcgaagttagagttttaattctcatgtataaaaagtgcatcacaattttcaaagagcaatatttaaattcacatttttggaagtgaaaatgcagtccaactgagttagacagagtaggcattagcgtgttacccatttgcatgacctgagaagagccagcttggttgcgacaatcaacttgaaaattgagatcatttctagctggtacagttaaacatccttttgagctaattggcataccattttagtagagcatggttaggtattaacagtcatgatacaagattgaaactttcctgctattgtgtattacctgtgaatgttaagtcatttgccttttccatccttttactttttctgagaactaaaatattataatacccttttgtttattggtcacccaggaagctattggtgggaaatgcactgtgctttgcatttcaaaggatgagaggaatcgtcaaccttcccccagggaactagcaatggctaattatatcttctacaggttttttgatggtaacagttgcacactttctgaacaattacttgagaaaattgcaggggtggaaggtcagcaatatatccgatttcatcagtgcattaaattgcatttttaatatggca

SEQ ID NO: 59268 - DNA, 1235 bp, Oryza sativa
ccgtcagtattcaagaagaaaaatgtggcttcagccattccctttccccagccagtggtcaaggagaaaagtgcggctgctgccattccccctccccatgtagcactgaaagaggagagtgtgtccaaatctacagagaacattaccaaacctgcacagaaagttctccctggggagaggccaccaaagagggtcaaattttctgaaaatgttacagtgcaaaatgtgccattagatgttcctgaaagaccaagtcgcactggacctttggaactagcaggtagacaagctgtaagtatctgaaccaacactgaggatacatttccaccttatcaatgaatagctttatgccattgatgttatgatatcatgttaaactttaaacattcccccaggtaactcagttaatattatctccacaactcatctgcatctaatctgttgtttgtatataagtaaaataaaacagttaacctggactggccctgcaatcttcccataaaaaaggccagaccgagctcctgggctgatcccctggacctgtccagcacaagggactatatgagcagttgacctgggaaaatctcagtgcaactgctagttttttttccccacctgggcaagtcattctatcctctatcgaccaacggtgcccctatgtggcatttggagttagcaaaaattacatgaaaggctggcctgggaacccaggaggccaggatgtggtacttaaagctctcatgtgaaacctacttgtatgcattcttaactaaggtataaagtactatatgtgcctcatgcattctgattgtcaattgagcagttttgccgactgcccagttacccaatgcattgaatgggttgatttacgatctgggtctaagagcaatgagtaaaagggccacatgttccttcaattatttctgttcaagaattttattcggctgaacatcatctgcttttactattaaggttcaaccaatttctaagaaacaagccataatcaaaatgttctggttctacaattttcctactgatagccgtgtttacttttgtgtgcttacacccttttctgctatttaacaggacagaagcaaatggttcaagattgtgagtaatcatttttcctacattgtctcttctctcttgcgtatatactatgattgtacagaagatttacatctatgcttcatgagtcaatgcttcaaaactattagaaaaacaaaaatatttca

SEQ ID NO: 59269 - DNA, 3166 bp, Oryza sativa
atgttctctgttgcacaaactttgcgatttgttttcaatgtcttacacctcttaatttccacaaggccttgtatatgagaatttgtacagggaaggatttcattggctcggaaagaactcccgtccgagtttccccagtgctgtagatttccctcttcatgcgataaacatgacgctaactaataatactaatatatatatatatatatatatatatatatatatatatatatatatatattgggcaccacttctgaacgggtgggcgaatggatgagcaaaagatgcaacaaagtggggattatcccgagtctaaagtgtcatttttatgtaacctatttgtttttttgttttctctgctctataaagtaaaaaaaaagatccacttttactatttttctctcgatgagacaatggtacatgtttctctattgagtgcgcctttacgtacgcgtttccgctacccactaattttgaaagatgtataaattggaaagaatgtagggagcagtaaaaaagagaaatgttttgtttacaggaacatatttgattttagaatctgttttaatcttttttgtgctttctgtttcctaatttttgccaattttcttgggctggtgtagttaacacttttgctataaagagattaaaaatattggttctacaacatcactttctacccctaatttcagtacctaagagaggttgagtaggtgtaccatactatttgatgcttccttgttctgccatacttggacaataacttctaaaatggatacgtgcatgtcccactctcttaggtgtccatgtttgctactttctgtgccttatctgctcttttttccagtatcatcaacatacttaatgaatatttatcttgattaccatgtttacaggagcttatacgtgatgctttacaactaaattgtatcgctaagcctattaaccacccaacttatgatgatccaaacaatggtgagtgagttttgtttgtaataccttgcaagtttgccacattcaggcaatgttctcgaatgcgatttaaaacaatctgcttccttgtttgtaggaaaagcatatgctatattcaaaacaaaaagtgccgcagactctgctatttcaaaaattaattcaggcttggtggtcggtggaaggtatctcactctgttgcttgcagatttgctggacgaaatttactactatatatgtgttcatgttgcatttattgtgctctgttttaagtggggtcactgtctgttatagttcacatgatggcatattgtcatctcattacaaccccaactgcagaattaagagatcttttctttaggaaagttaagggaaacttctattagcaattggttggttctatcttgataccacctcagggacacattaccacactgcaattgcttattaggcaatttgtcaacaaaattgcatgtgatgccatttgcactagttacttactgttattatttttcaaatttctaccgtggattaaataacaatatgttgttcaatatttttggttgaccctttatattctcttattgaattatttgcagacccctttattgcagcaaaggattgcttaaggttccaaaaccttcagaaactcttctcgggcacttaacaatcaacaatattagaatgggtataagacaacgagaagaacaggtgctgatgttgtcctatgaagtttgctctatttcttttctctgtcttaatatttttgcacaaccattattctttctccagaagaaggcagtttcaacctcgcattgttctcaacccaatacaatggagtatgatttggccttggattggatgcttgtccgagcaaagcaagaaacgaaatttaggacacttcacaaggtatgtgcacttccactggagatctctgtgtataccagctttcagttttatccatacagaccttaaattttgaatgctcaatttatatctatagaagcataaagatgagaggaagacctttgcgagtaagatgggaaagtaagtggcttccatggatttggttaagcgatgggaactgtcctgttccgtgcttatcttggagtcctctactgagtactgactatcattcctcggagctttatgcactttttgcctgaagcaacacttatctgcgagtttttctgctgcgcaagaatgaaatgcaacgaccatttgagggggacaactaactgcaccacactgactctgctcatgttccgtagagcattatttttagaaaggaaagaattgtgccatagcttaagaaaccaaagtaacattggtagaagtagcccttgcagcaagttaggaaagccagaggctgttttaggttaccccgcacatcaatttgatctcacatggacacatcagttagatctgttgctccatgttagatagcaaatcaacgcgtgccgtcatgaaatgtgtatgtatatatttttaaattcatgacctggctattagttcattcatgtgactgcttatgtgtcttgagttacaagttacaacttgactccgttccatttgtgatgatgaacaacagctcctgaatgcagccaccggcctcggtaggttaaaaattgacaccgcaaattctggtgatcgcctggtaggtattgttggtatagctaaagatgatcatgtcttcgttttggatgctcttggtgaaccatatgctggttcttgagatctagcttcatgagacatgcatactcattcttgaagtaaatcaatgtacacttttgagttgtcttggaccaacatgtgttacctgctaaagtctaacaggagatgccctgctttccttttctcccaaagtgaaaggaataagttcatctgaggtcccttaacttatcaacgaatccgattttcgttcttcaaccagaaaaccagattcaacaagtccctcaactatcaaaaccagtgcacatgaggtccctcgacggttttgacaaccagtgcacatgaggtccctcggcggttttgacggtggttttggcggacatggcaactacgtggcaaatttgacttggtctttatctgatgtggcattgacgtggcgcatacgtggcaattagatccggaaaaataataaacttcatgggaccttgttagtatcacacataaattaataaaaaaaatggtgggg

SEQ ID NO: 59270 - DNA, 32066 bp, Oryza sativa
agcggcaaacgagcggaaaaagggtttttggttgcgagagcgagacgcacccgccgccgctgccgccgcacatctccctcgcatcgcaagctcaccggagaagcgcaagaagagagagagagagagagagagagagagggagggtaagaggaggaggaggaggggtaggcgagggagatgggcgccggggaaggggatgccgccgcgggcaacaaggagaagggcggcggcggcggcgtggaccggacgtcgctggacggcgtgcgggacaagaacgtgatgcagctcaagaagctcaacacggcgctcttccccgtccgctacaacgagaagtactaccacgacaccatcgcctccaaggagttctccaagctcggtgcgcgccctccctcccttcccaaccttttccttgttcctccatccaccctccctctagcgcgccgcatccgacacacgccgggacgagctcgttgcctcttgccggttgtttcttgtattgggatgtattttatgcgttttcagccctcggatctgcggacagggtcgaggaaagcgagttcttgaggcggcatcgataagcattaggatttgtttggttaataaaggagatgcttcatgtaaatgtgatactaattagccatgatgataaactaggggtaggattgaatggtgttcgttagtgtgcccttgggttgaataaagatgcattttactgctgtcttggatagattgtatttctgctgctgccgttgattactgattgtttctctttttttttttcttcgtctgtatatgtagcttattacagcgatatatgcgtcggggcgattgcgtgtcgcctggagaagaaggaaggaggagcagtctgtgtttatatcatgacgctgggggtactggcaccgtatcgtagtcttgggatcggtgagaatttcccctttctgactttgttttgagttatatgaatagactattctgtttgctgttagatttctgatcagcattattatgtataagctcgttactatataaacactgctttttttttctatattagtgattaaacaacgatttacatgtaacagcacacatgaaaacaagtttaaaaaataaattgcttacagtaagaccccaattctgacaagccttatggttagctccaatggtcagtcgatgccttagatattgcaaaattatctttcgttattaggtagaataccttgtgacattacctgaacatgctcaatgtataatgcctacttgggtaataaggtgggatccgatattagttatggtgtttgctacaatttatatggtaagagaaggcattagcttggggagaagagaaagtattgttattttattcttatgggtaggcattatgcatattcaacgattaaacatcctattgctacattgtaagagtaagtctaaagaatcattgtgtgatagaactcttaccatccaatcattatgtagcattataagtttataactaactttgtgaaatattttccggtaattgatattttgtaagtagacagctttaggcgctgaatttgaacatacaagattagccttggttagctagtttcagcactaaaataattatctgttttgttcatgagtttcagagcctatgtcaattatataatgcagtcgcttggctgtcaaattccttttatgacagaagacagtttcagaatcaaacaaagtgtagcattgcgccaactatggacctcatgctacaaaatcttctgtcaacacttgagttcatcttaagaaaaaaaaatggattagcattatctatctgataataaagtctgtcacttttaaaaggttcctatttgcctgggttttaatcgttgtcaagtggatatgaatgatgggaggttgagcagagactgataaatcagtattgatgctagcatactagataagggtgcacctgcagcgtggcactgatatagaaggggctttttggttatttcttgatgtcaattgtgcagggataccttgtatgtaacaggtaggccacacaacgatatcttgacattgattctttccaccttgagccacacatgaagacccggcctgttggtggtgttgaatgccgtcgataaccgaattattttgagagaccattttaggaatgaaaacactctatgggccacttgtacttgccacttggaaatcgtcaaaatgctgaagtcaataactcaatattttgttttaaactcaattttaaaaaggacaaaactagaacatttcagctttgaacagcttgaaaatttagaatggggatgccagaatttaagcgaacaaatcagcaaaactagttgcacagcaactatgttctatgttttgtttgctactagcctactagtaccacacaacaatttgaaacctcactttttgtgaactacccatattgaaataacaattcaaaaacttttatagttttgaagttttcactctatgcatagtaatggatagtttgcatttggaaatatcattagcttttttagggccatagcatagaagatatgtgtcttataattgcttcgtttaattttcacaggatcgaagctgctgaaccatgtgatagatctgtgtgagaagcagaacatccctgagatatacttgcatgttcagacgaacaacgatgatgccattgctttctacaagaagtttgggtttgaaattacgaagacgatagaaaaatactataaaaacatcacgccgccagattgctatgttcttaccaaatttattggtcaggctgctacaaagaaatgagcaaccgccaacactctccttttgtgacaataccaccaccaccaccaagtcgtggggagatagttgtgatcttgtcgcggtttctgctgggttttcacttcatgggtgctaacattattacaaaacactcgagaactatagtagcctttgctacaagcactgaggtatcattcacattgactgtttcctttaccccccatgagcatgagtgtttttctatttgtttgcagattttaccccttgttcttgtgaaatcatctgtttgttgtgacttgtgagtgtatgtcaccacaggtaattcctgtgaacttatgtccatgctcacgcacgcatattcgactcgaataatccagtatatgtactctctttgcttcatggaatagctgggcagattatctcttgctactgttttaaacagtaagttaactctctgcatcagcattgtttaggctcaagctcttaagctaactttttggtttataggctctataagccgataaatttgaaaccttaagtttaatggtagagttgtatctacttggtataaaaaaagctactccaacctaacttttgatttaacagtgtaaaaacagcttatggctttaaaaaagccaaacaaaaaatctacttgtttgtttagtaaactttttggctcataagttggtttaggaactcaagttttttatcttctactttctcgtttcatgtgagcacgctttctgaatagctaacggtgtgcctttttttaaaaaaaaaatattggataagttcttaaaaacagtaatccatctgcgaagaaaaaagttactaaccaccactatagaatacagctttataattctaaacaaggagagcttggatactctatactctatagagtgtggcagggaagccaaaccattcgtgtataagaccatggtgtggtggaggcatggataaaatgaaatgtggtatggacttggtagtacaactacgggggagcacggacacagctgatgggattaccatcgatgactcgcactttgttcctaggaccttgttttggcaagtccttcgctgaagatgcagtagatcaacattcacatgactgtctgttcctctttgatttttcctgaatgtttagaccttttcataaataatatttattaacaaatatgttaaaaagatatatccctacttctaaaaccgaaccatttggctcctcctttaagtaatgttgtcaatacatactccttcttgaacaaatataagtatttttaggattcaaattctattactcctatatagggcagctctagctccacctcttctggagttagaggtccgccagataatttcagctccatttaaaatgggagcggagttaggtggagctttctcactccagatccaactcatgtagctaaatttaggagtataaaatataaacatttttaggacgctgattctaatgtataggaatccaagcattttcagcccatcagatgtttacaggagaggaaccaaagcaattcaaactttgaccatgagataagtgaagagaatctttcagtttatctttaatctttacttaaataacttaaaaatattatattagtaagaaatgcatgctttaccgctgcatgctgccgtatcttatccttttattcattttatttttcaacgagtttttttagggatatgttttcaacgagttgatagcatatatacgtgaaaaatgctaatgggtcaatttagtggaagaacaaggtactcctgtttagtgagaggaactcatgataagaggtatttcatccatttcatattataaatcatttttttaaaaaaatataagtttgattaaatttatagaaaaatatagtaacatctcaacacaaaaacaaacttataaaaaatatatttaatgttacatataataaaactaatttggtgttgttaattttttataaacttgagcaaataaaaaaaatgtttcactaaataaatcaaagcgagtacaaactcaaagcaacttataatatactccgtaaaacataaaacagagtactcccaagttatttttcgatgaggaagtaaccatcagttcatctaatttaacagttaattaaacatccaaaggcatctaaatactcgtcaaccaatcatcaattgattaagtggttaatcgttcttgccagctagtatttttcaccgtattagattattgaaacaagagccttgtatatggcattaaaccatcattgccaagccaccaaaaaaaaaagaagaggaaatgcacgaaaacgaaaatgatagcagagtacatcgcagttgcaagacgaacgatgagctgcagtcggtactgggtacgaatcggggaaaaaacatgttagtaattcatcaaggaagccagcgcagcgacatctccatttgtaattaattattaatctcaagtatggaacacaaaatggactacaaaaggggattctttaagccttaatctcgtaataatccatggacaagtcttgccattgtaatacgtctcgtacgctaacgaagcggcctttccttgtcacaatgtcacatgtaagatggatgtatacttggaaaattacatcaacgaatccgggagtaattcggcctgaaaaaccgtgtatccaatcctgactaatacaagcaagtatggcagttccctatacagttatcgtgaagaaatagagtttcagcaaaacagccaatcccaactgcaacaagaatatccctgcaacgatcaagaaccatcgctctccagaatttacaatgtgagcgcgcagattcatagcaacgaaggtagcagacataaaccccgcgacaccagcaatcacccacctgaatatttctattggcacaatagacaggagctgtcacatggaaagagtgttaaattcatgcagaagttactcaactttctcaacaaccaatagataatcactaaacaagagactatgggtttgcatgttaatagggcatggagacaacaacacataacagacaacttccttgatagagattcggtaaataacggatatttttacaacacaaactatggtccttggtaatgaattagttttttgaatctaaagtagtgcaacttcttagaaacggcaaactggaactgattgctttgtaacgctatatatccagcacacttacatcaaacccaaatggaagccttctaaacaagataattaaccataacaaaatcgacaacactataagaagaattaatttctattgtctaagttttaggattttccttaccgatgctggaatgaagatgaataaagagtatccatagaggcaccatagttgcactagtccagcaggtgctgagaagtacttaaggatgacatatagaccaaggggaacaaatgtcacgtagccatagaataagccagcagaccatgtaaccaggttaatatcatagttccactccttcttatgccatttgtgggataggtaggtgacaaatgtggcaatggatgcagcaacgaaaatcagggtggtgcatgtccagaatggcccatatctacaaaatttaattgaaatgaaaattagcaggcatataaccagtgcttcaattccttgaaagtgcaataacttgataaaacacttaaattgcagagctatttatttacaaggaatttatcattatctgaaaaaagaaataatacttccaaaagcagagtttccactgaattaataggttagctgatatcgaaacacaaagttctatttgcaaatgatcaaacagcacccattgcttcagatttcagacattgagaaattcaggaaaatgctgtttaggtaatataatttattgctatcatctcaatatattcagtcctgcatatttgccaagtttttcacaatggtatcccactgccacttacaaatgcctcttcacctaataatagtaacccatggtatagacttgtactgctaatctgctattttcatgacacatgaattggtacaaacattcaagtttacttagtgttgacaccatacggtgatgttgaacaaggcacaaggtacattcaaaaggcaatcttagaactgttaccataaacactctcaagataagttcaacagaaagataatggtgcacacagcaagacaaagtagatgaaacaaagctttgaaatgaaaaataacaatggaatgatccaagcatgggtaggacatgtcattgtaaaaataaaaataagtttaggcagtgaaggctaaaggaaaatcctagactcccttttagtatgttgttacaacaagtcctcggaattattcattctttgtcatagaactctcagcaagaagaacgggaaaacaacatacaaaaagagatatagaagtattctaccgacctaagacatgctaacaactaattacatgtcgctatgagctgaaattattgcgctactcactcttaaccaaatgcaagacatgtcatcgagaagactaggctattttgctggagcaatcaaattcctcctatcagttcattatcttaaaatccccatttcttacacctatgtgaccaactcctctgaaatacccagacaaaattatcacattgtgcacgcaaataagtatcatggactttccagcaaaacaacagaagacgttcatagtctgtcaatgctattaaccatatccgctacctgagcatatgatctctaggaacattcgaatgcaaactatagtactactactaaggtaaggaggagttaggcgatggagaggcatacaggtcggggttctcggaggtcttctcggtgaaggtgccgcggaaggggaagacggactcccagatcctctccaccacgtcggaggtgtccacgtcgaagtagggcttgtacgccgcgacggagaacatccggaaccacccgccctgcccggcgtcgtccgacccagcgccgccgccgccgccgcctcggccgccgcccccggacttggaggaagagaacgtgtctgcgcaggcagcaaaagcaccaaccacaagcaaggtcagatccagacgaagaaatcaatgggaggaggaggaggtgggggatctgatctgaccatccgcgtcggtgggcgggcggtaggcgccggagatcttgcccttggcctcggacggcgggaagatctggaggttggagtcggcgaacttgatggtcggcggatctggccccgtcgccgcctgcgaaaccccgacgaggagcgcggaggtgaggagggtgaggagaaaacccatcggcgtgggaggggacggggacggggaagcttaccgggacggatccggaggccttggggtcgtcgagggcggagtagccaccgccagacatcatcttcgccggcgacggcgacggcggcggcggcggcggcggcggacgaagcgtggaggaggagcaaagcggtggtgggttaggcaggaggggcgcgtgaatgcggctgcttcattcggatctctcgttgctttgcgtcagttataacctggcgcgaactgtgtcggtgttagtcactggctcactgctaatgtttgctcttgtaacactgtactccgatatttgttagtgtcaattttggtcatgccaaaatatatttgttacttcttctgtttcataatgtaatcattctaccatattccacatttataatgatgtatatatgtctagattcattaatattaatatgaatgtgaaaaatattagaatgacttatattgttaaacggagggagtagtactgaagttttaatactatcaaatttaataaagtaaagttggtactagtgtggataaacataggtatcaaaccaaacgtatgtttgttacttctaaagttgctaaaagaattggcagaataattgtttttctttgatatatagtacctccgttttttaacatgtgacattgttgacattttacaaacatttatctattcgtcttatttaaacttttatgcaaatataaaaatactttaattcatgcttaaagaatatttgaagataaattaagtcacaataaaataaataataattacataaattttcaataaaacaaatgattaaacgtatctttaaaaagtcaattgtgttatatattaaaaacatgaggtagtatatgtaatggttaattttaggcttttagaatgttagatatggagaatcaatgattgtttttctttgagtatatatgagtagccaatccagcctcgtttgtaaagactgatttaacttgaaggctgctttccgattgaatttataagtatttatgtgttaatatctcttgttattgtgttctaagggaacgttcacaagagaaaatcgaattagcaaggacttgttcgaggagccaatccagcctcttttgtaaggcccgatttaatctctcgactgctttttaattgaatttccaagtatttacaggcttccgccacgatggtgtaccgggcattttggtgagagagaacattttcatatttgtagaagtataattatcattttggtgagagaatacctttttatatttagccctgccccaaagccccaccataccataccatttgctccatgctcattctccgattcttcacacaacggataaaattacttacccccgcaaacatccacactcggaaatacctaaatactatgaaaattctctgttgacagcaatctatgcttcacagtagtatatattttgtatatccaagtcgtagataagaaagtagggtctgacaaggttccaacttctctatgtaacttcgagaccagcgagattgatcggtgaaggtttttgcgcaaataagatgatgttcgaaaccagcagccttgttgtgcaatcaggttcaagtaggtaaagattcaccaaacctccattattcaagtttcatgatttcctgtaggataggacatgacactcgacgaccaagaggcaagagcacagcaatagagtatttgccatctgatgtttgcttgggtgtccaaaagcccccatcgcaggcttacgcttagcttaaggtaagttagggtctccgattggagcatttaatcaaatagaattaaaaacatatttagttgtcgcctcatgtacaaattggaaagcatgccgataaaataaagatatgatgcgttcttctattggattagaagaaacaatgtactgctctatattgttaatgtagaaatggtcgttgatataggccccaagattctttttccctggggtttgtgctagggtagttgctgtttatgtaggcaggcacctatcgctggctccgaaggcaaaacccctctttgcctgtatgacgagcattattttgtgaatgctaattcacaaaccaaagcgatatgatcacttccccatttctgtcaagcaacaaaaacagcatggattagagttctgtcatgaagatataacaattattcgatgaaatttgtgaagggttcaatgataaaatatacgatgcacttggtgataccttggtagggaacccaattgtttgtttcagaatttcttttgggaaggtatctagcacttgaacagtctgcagatcttcggaagcccttcattacacaaagtacaagattgtatagaggtaattagatagttgaatgtcagtggcaatagcaaaggaattccaataatgcttatttaccatatgtagtccactgttcccataaattttctgttgtaacttgttactagaggctccttgttggcatcttttgtcccttcaaaatcctggttgaacaatagttaccacaatcacaattgtttcacatgattgcctggaatttattggttctagaaaattattctatataaaaagagtaaatttgcacttttgcactagctatttgtcctttatttcactctgcactggtgtttcaaacaatattttcactttgcgctgcccaaagtcaccaacagtattgcagtttgcaccagccaaatctcatgttggtcttatccaattgtctgtcgtcgttatgaatcaagcacctttggtgatttccaacaccaggctagactgctacagcccagtattgtgttgtgttagtggttatacagttaactggaaatgaactcggctactgaaaaactacaaccttcgttagcttagggtggtgcaaagtgaaaacattgcttaaatgaaactactgcaaggtggaacaaagaaaaaaatggtgtgaagtgcaatttattttgtttatagagttaagaactacacatattgcaacccgccaaaaattaggcatctcagaacgagctaacagttgatatctgatatatctaaataaagatgagtggtgaaacatgttgatttctcacatcaaagattgatggagaaattgtagctagccatgtgaagttagcggttacctccacatctgtgtagacacttcggactttcaaattatgttccacgaaggtgcaatcttcattcccagtagcagctttaatttcatctggtgtccacctgtatggatcataatcgtaatatcttttatcagaagtaatcacttgctgggcagatggtgaaccatctgaggttgtttgcagctggtcttcatcttcaagtaaaaattcattaacaccagaaaactctttaaagatggaaggatctgcattcacatctgagcacaaaacttcattggatgccccatcatcctcaaaagcacaagaacaatttccaagctcatttgaacatgaatgcgattttgaaagcctgtttatcacttcaggtgtacattgaacatcacaagtgtcagaaaaggcacaatctgtgtgttgcaaaggctctagtggtgatgttaactgagttggctcagtattgttttcttcttctagcctcagattactcatttgatgaagtgtatcagcaaacttcaggggatcactgaaacaatttgattttgattcactacgcatgcaattattttgagtagacaaaggttcactgtcttgttccttttcatcgggtctgacctttgatatatcaaacagtgtatctgactggacattgtttcgctcaaaatcacaagtagcttttccagaaatcacatgaccaggaaagtttgccagggtatttgaactgttattgctaccaccagctaattcttcccaagaatctttagattcagatgattcataagatggaagaagctgacttctatcaactatttcactcgaatctgactgaagggtctcatcatttactgtcgttgaagcagacgaaaagtttgtaacgttagtttcttctacagagctcttttttattactccatatccttcactggagttgttaaccactgaagtttcttcaccattagtggtgttggtatgtgcttcagcatcagatgtataggcttcctttgtaggacctttcacacagcccattaattcttgctcgtgaggatttgtagagctctctgggtttaagaaagagtctgaagcagtatcagtcaaagttggttctctgccagaaagacgagaattttccgttacatttcttgcttcaggttgaggcttatgatcatttgggtaacttatgctaccctccttactattcgtcgtgtgaaaaggcggatagaatctgttaaataccaaaaagcatcaaacaaaggtcagttaggttaaaatatgcagaaaaaattgtcaaaagagggtgtctctgataaagcagaaggttcaccgagctgtgttaggaccagtatatagtccctgtgcagtactagtttgctgccctgatatattactcttcacaagaccggacagattcaactgcatgattattatgttgtgtgagtttcagtttctcaaaaacagccattttcaagttaatacagaacactctttaccttttgctccagcataaaattgtacagagggctctgaatgaggaagaaatgggtcagacattttgaccttgttacatgtaagcatgtaataaaatgtccaagaaatacagtgaaccagatatgaatctttaatataaaatggtaaggtactgaatattgccttgggtgtagagttgaaatctccacaaattattactggagcatcattccatgtctttgatagagcatacactcgatcaagaagcgtccttacctgtaagtatgacaagaaaattagtattcaaataatacgtatgaaggtgcataatgtactgactattgatggtcaagaaagatgatagaaatactaggtaatgcagctatactttgtttcagtgatgaaagtataaaacaagataatagcaaaagaccacaacccacctagtcatctacaacgagagggtggaaaacaatgcacgatctcaaatgatgccatgaaagcatcagaaagcaacacgatggaagataaggtgtacattgttgctcagtacttaaggtctaacaaggtgttatttctttaccatgttatactaaaaacaaaagtgcttaggccaagaggctaattctggtgaaaaaaaaatcatactataaaagtctgaactaatgtaggaaattaagactcacgagtgaccacaacataatacctgaccaagtttgatgtcccctctctttggattgtaaagaacatgagtattgcatacaataatttgcttagcttgttgaggatggttagggctgtgaaacgaaagaatggttataaaaacatggatagataataccaatgtggacatgtgggttatgaaattttctcttcaataataaaggaacgtggaataggaactacacaagccagaaacaactaataaaaaggagacagcataacaccattgtcacaactcacaactgtgatgcatagtttagaaatcttgaagtttcaattacctagactcagtttgcacatttcctggaatcaccgactgaaaaatataatgaggaaacgattagcagatataggccatgcaagattggcagcataaagaaagcttcaattcaaagtgatcagtagtttgcccaacgatttcaagcccacctctaaaacacaaatctgtgcaacattatcacggagatcaatcttattgaactcgatatcctcttgatagcgcaactgaaacctacaagatgaaaaattttggatgactatgagaagtcaaagtagaagttttttaatgtaggtataacatcaggagaaataattttgtatcatacaaaaggtttctttctttaaaaaaaagaagaagaagggaaagacaggattgacacacctagctgttcgccaaaagatcgcacatccatcagtggcatttccagtccgcatctgtaccaaaggtccagcataatgcgtaaatcatacggtcaagcagattcaagaaaattgtgtttcctcaatggcaatcactaatgaaagtttcagttctgcgcatgctatgtaatcaagtaactgtaaatgagtagttagaagcactggccatttttgcacaactatattttgtccacttcatcaacagagtaattcctgtgatatatacccactctgtcgatttttatagggaatattttcatttaaaaaaacaaattgtagattttgaccaagaattagtcaaatgaccagtaaatttagtgtgtataaattataacgatagatataaattcatacttcaaaatgctttcgaacatcggtttaaaactattggatattaccttccatatgccattatatcctcgagttgccatttcttgctcaaggtctgtaaatttgtcaacctcctacaggcataaccaaggaatataagtctaacgtgtgtcaatatagatcccatttaatcattaatatcaaagaaatgtgtttatagcatacaggttatattcatcaagaagtgtcaaaaaactaacaaactttatcctttgtatgatttctagttgacaatgttatatgcagctattgaactagcagggagtgaccatgtagactagtggccttgcaattccttgcaattttccaaatttcaacttttcgagataacataactagctccacgaaggtattaccacttttttaactattgacttagcagcacaacccttctgaattactgcagtacagcagttataaattacctgaagacataaaatatctggagaccacaaaccaaactcgaacactaacttttccttccgccagttccaatccatgatgaaagatggtatgcgctcataaagaaactggtgctcctgggccagataatcagctagtatattgtatgatagaaccttaaacctctctgcatgataaaaaaagatctactcaatataccaaaggaaaacacgtggtaattttaaaacaagaacatcaattccacacacataatgattactcgactttaatactcttggtctaaaacacaccatgtccatgggtaattatctgactgaattattcatatacggaaagtgtctacttttacatcttcaatacttctgaaagtttagttttcacccctcaactgtaaaactgaatagattacaatcataagcttgaaataaggtgtttgctcatggataagatgcccatggacccttttctgtttccctctcccattctctttgcccattatcctgtcacagaacaagatagttagctgtgatattgatttagctgaggagagaggggaaaggtaataggagggaaagagaaactgtatcacttttccaatgccttgctgtggcatcagtgctagcatggcagtggatgtggcgctgaagtctgtttcaggcttgatcggttaggggtgtaatttatctggtatagaaggttcagtggtggttttcatccaccttgagaattgaggtgtgaacacgtaaacttttggaggagttgaggggcataaactaaatcattttccttcatatatcatatatcacataccacatggcacatctgttgtctaaaatcaagtgaaactataatccattactagtttagtacacaaaccaaattgaaaagctttcaccattttgacttcagagaagtgctaagccatcaaatattaagaaactccgatcattaataacctaaaagtttttccacacaaaaagtaaaaagcaattacactattttttacttcagagaagtgctccctggatggtttgctatgcgattctactactactgcagtgctaagcattgagacagaatatatcacagactctggaagatgttaccggcttggcgtggtggccgatgctgcgtgaatcgccaccgtcggcggtactccgctagccttggtgattgctgcggcgcaccaggcctgaagccggcgtacggcggccggaaccctgcatttgttggcccacgccagtacggctgcggatgcccctggacatacggattcggggtcgcgtatccgtactgaggatcctgtggctgcggcggcgggggcccgtagttgtacggcacggccccgtagggcgggcccggctgctgcgggtggccgtagttgtacggcacggccccgtatagcgccggcggcggctgaggcggcgcgtatccgtacagcgacggaggaggcccgcggccgccgccgcggcggagcgaatcgttggaggcacgcaccgcgctgtggtgggagtcgccgctgacgagctcggcgccggcgtcgtggtggtggtggggaggcggcgtgggtcgcccggagtagtagcctcgtcgcgggcgagcggatcctcgggcctgcaagagagagagattgaggagatggggagggtttagactctagaggcgaggaaggatgggggattcgggggagcaatccacgaggggagatgggcgggcgggcgtacgttgtagtaagcggacatggcggcggcgcggcgtaagaggcgcgggaggcaaggcgcatcgctttggcggcgctcacgacggcgacggcgggcggcggcggcggtggcggcgcggccgcgttcgacggtcgagtcgctgtgggggtttgaggcccgcgtgctgatgacgtaaatagtccttcagtacgggagggtcactttacgccttcggaaagcgatagcgcacatttgctctccgtgttcagatatcgaaggtgaaccatcgtatcggaattaagggctggtttggtttgatgtctaaattaggcttatcaatatttagcaatttcaatagtgtttagtgtctatttggtttgaagctaaattttggcatgcctaagaaaataggccatttcaatagtgaacttaggttattttggcttcaatctaaatataactttgccttaccaaaattagtcatgccaaaacttaccaaaatttagcattgacaaaatttgataaggtctatttaggccacaaaccaaaccaaccctaaacttttttggggttaatttcttgtgtttcaagggagccttgcaaatctctgggcctccctttctggcacacattgaacatggtttgaattctgatggatcctttcaattttccaacatgggatttcatataatatatagaaattcatataaacttttcaggattgttttacacgaatcagctcaattttccgttatagtcgaagaaattaaggtaggtaagaaggaattaaggaagaaactaggggaggttagccgaatagacgataggggaggagtttgtataaatcctccgttctacacgaggcctttcactaggagaggagtttgtagtaggctatcgtagagccggtgaatttaatttgaattgaaatgcagagggattagggaacaactgcacaatccatgtctatagagaattagaatgccaccattctgtgggcaaaatcacttaatactttaacacatcaacacaagcaaaaatatcactcagcatacatgtacgatgcaactaataagtacagtccagctgtagattgctgcaaccgcacaagtacacgcataaacttttgccaagcatggcttgctcgcatctataaacatatcccatggtaacgtatggtttgcttgtatgcctattgatactgcagcgagggtcgcctccttcgaggattgatgtgcctaaacatatcttcgaccatgcagcaattgtatatactaatctggggttctcgagtctcgactatgattactggaaaatgtttgtatcaacagatcctatgtagcatggcaatcctcggcacgcatcaagaggtttgttgcatcctattcgcagaaagtggaagctacatgagctgcaaagtcctcagacgctgctcttgctctggatccatctttggtggtgtataacacccgcgaaggtcctccaccacatattcctgcacatcatcaaacagtggaagtacagagtattaaacgagctgattaacaaatactactatttcactggttcagaggaaatgacaagtgatgacttcaagcagtgtttacctttgtgagctcccttttggtaagtatgtgatagtgtctctgcaagatcctctggacggctacggttgcagcgaagaagccatatgcaactccaagtatagcaaaaacaatgacaaatatcacagccagagcaaggcaagcttctattgaagcgggaaaatccagtatgccccacccatagcaacaattgcggcatccagccaggcatggatcattggtgttgaaagacgaacactgtactatcagtccaatgaatcctaccattacaaagaacaccactactcctgaaaaaaaaatgatttgacacagatatcagtaactagctttctagaagagggtgctaacgccttttacttgaggaagcttgtcagataggagtaataacttcaaaaattgtttatcaaataaaaataagttccaacgacctaaaattttgtgataattgaaatgttgccagaggtagagagtgttactctgggtgacatgtttgacctactatatagaatttctattttcagtgcacaagaaaaacatgagattatggttacagcagggaagcaagattgattttcattaattgtatgcttgtatgacacaatagacaagttgagtcatgagtcatgactacattataaatggtagtaatgagcatttaactgcagcagatcatgtcaaattatcaatcattatacgaactgcaatcagaactgaaggaaaagaattgcataccgacacagtagtaaaagggcacaggatgatttgataggatgtgttcccaaccatcagaaaaactgtttctaaattgtccatctttatccaacagataagccataccaccgatagcagcaatgacctgaaaagcaaggcagataaaaagtatgtcagagcaccataccaaaaacagaacggtgcaaaattgtagtaactcaggttcacagaggtttcaacaaaagaaataatatatgcagtcttttctgtgtttaatagagccagcatacatgtgaatgagaaacaacaacgagcaattagaaagaaaggtgttcttacagtctgtacagccaggaatacaaggaaaacatccctagcaacaaacaatcgaaacatcatcttgcgacacaggttgtcctccagacattcgacacggagatggaattgtgccttacatgttgtgcagtgagaaaaggcagttccttcctgcagaaacaagcgcaataaagcagtattgtaaaacaaggtctacaaggccacataacttgtaagattaagccacataaggggaaaaactatgccatataagctttatatggtggggtgaaagcacaataccttgccataaagtaagttaagtgtaataaagctaaacaatacactagtacattttaagaagccaactctatcaccatcaaaaacatctcactaacaagcatttgaaacagacgaagctttgtacactggacatataataagaataattcatcaaagactatgccttccaccaaggttacatatcatcggttcatcgcgttacaacagcagaggcgacactaggacagactagcagagctttttccggaaattcgtaaatccaatgttgggaatgtaggtactagcaactggcactttaccttaacagacctccaatgatcaaggcagtagcgatgcacgaactgctgcgtccctttgcacatacaaggagaaatcagctcatcacctgaagcagcacacgagcaacaccgatcagttaaacaggccccgcaccgcaccgtatcaaaccctaggagatttctcctcgtatgcattctcaggatcaaaaactcctccgcgtgccggcagtaaatataatctcaaacacctatgcgtcctggagaggtggggtggtgcggcgtacaagccgcgaggcgagggggtttaccgggctcggtctcggactcgaggcagatgcggcagcaggcggcggaggcggcctcgatctcctcgtcctctatctcctcgtcctctatctccgccggcgagcgcggcggcggcgggtgcgcgaggagggggtcggtctcggcggcggcagcgggatagccgccggcgtcgcggtgaatccgctgcggctcctgcatcgccggagcggagaagagaggggaaggattggggattggaaggaaggaattgccgaatgccggagcgcgcggtctgaggaggaaagcggagtagcggacgcaattattttctctttcctcggtcgtttgtgtttttttccccttttctttttcccggccggatactttggctgagctcgaggttcggggcaatttaactatttgccacttttaggtttatcaattattcaaatgtcttttttatatatatatgtttaataatttaccactgaagagaggtgatttcttaactatttgctacttttgcctatgtggggagccgtgcccgcatggaaagcgacgtgatcccacccgtcagcccctcccctctccttcttccccaccttcggccgtcgtatctcctccatcccggctcgcctcgccatgtacagctgctcgtgcgccgacgtcctcctgcggcggcagctggcgacccgcgacgacggtgtgggcggaggtggccacggcggcggggtgcgcggaggcggctgcgggttcttgccgccgtcagagctgacaatggcgcaggacgccggggcagcggcggcgcaggacgtaggaccacggcagcggcagcgctcacagctgagctgggctagctcaggggaaagatgtaggggttgcgacggccagaggtggagaagaagtagaggggaggggttgacgggtggggaccacgtcgctttccatgcgggcacgccacgttggttcgccacgtaggcaaaggtggcaaatagttaagaaatcacctctttctagtggcaaattattaagcacaaacctaagaagggcatttggataattgataaacctaaaagtggcaaatagttaaatttcccgagttcgggagacaggttctcaacttgcctcttgacacgaaaactaagcaaacaattagaacgagattagtttagtattagcctaaaaaacttgaaaataaattaatataattttttaaaataacttttctataaaaaaatacttttagaaaaatacacaccgtttaaccgtttgaaaaggcacacggaaaacgagagaggtgacttggagaaaaaaaaggggaaaaacacaacatttactctgtatccgattgtctcacttatatttatactccctctgtatatccatccactcaaaaaaaatatattatgttttgggacagagagagtatgtttttaagtcaaaatttaatttaaaaaatattttactgcgttttgttgtagtttattttatagtatttgttttcaccgttaaagatacaaatataaatttttcactcatattggaagcattagctttggctttggcttattagggcaaccaatgaggctcttaagccactaatttgctaatcaatatatctgaacggtctgatccaactattcttagctttggctttggttttttagggcaaccgatgagactgttaagccactaattgccaatcagtatgtctaaacggtctgatttgtgtctagaaatttgttccaataatggattgacagtcccaaccgtgaaatattaaaaacgtcaggtggcgtctagtcatcagggtttataaaactgtgggattatcgtggttatcacgtgcgataacctataaccttctcagtttttaaaaccacgatatacctcgagataactgtgcggttaccacgataatcgctaaaccgtagggtgacggtaaccccacccaaaacaatttgacgaacccttctagtcgtacgacttgataacagtgggactagataatatgttccgatccgagtcgtagctgtgttacaagcaaattgtcaatttgatggttgtaaccccgttcgtttctccaactaagagttggatgtcaaactgctaacagtgtgtttcatgtgaaaactcaattaatatgaaagttgttctaaaatataagattaatctatttttcaagtttgtaataattaaaactcaattaatcacatgttattaccacctcattttgcgtgaaacacttaaacttttatcttcatctgaagatcatcttcaggagatttagagagatgtgaggcggtcaacgcaaacgacgaactaagacacgcatgaattgaccagatgagataaaaaaacaaccatttccagcaagtcagcaactaatacaggcctaaaaataatgaacaaacttgctcctcggatttggaatgttaactttagcattcatttattgcaagtaaatggtcctctcaagaatacgcttccatcatgacatacacaaaaccatttcgtccagaggttctcctgtaattaacagacaaatttgttcttacatcagaggttgatatgcttatataaccattgattttcaacaaatagagaatgactgaataaccagcataaatggacgttgttgatcttgaagtaactggtttaccatttaattatgattggaaactaacaaaaaaaataaaattgttggaagctcctgtttcaaatttatgaatcgtgtactgactatatatggagtgcatgcaaatcatcactaacccctagggtgtgttcggagcttctagttccctaagaactcttgaaggcataaacactgagcaaaatccacaaacagggaggaatgcagaaacaatgtaatccaaagaccatagtaacatttaggcatacctcaagtagtaagtgtagcttgtaaatacaatgcccccaatagcaccaagccctagaagaagaataagtgctaccaaccaaccagacattccattcttcctagaatttgtttgctctgccatgtcgacaccacagctctgctcattgcaagcttcctgtcttgcaggctgccaaacaagaaatttaacaagtgagagggaaaaaaattaccagcacaataaagaagaatatatggcatatcgagaataaaggtactctatacttaaatatgatatgaccctgttttcaggagcttagctttgaaacagttattttttttaaaaaaagaaaaaaaatagtacatcaaacagccaattaaccgacaaggtacagcgcaggacaatgatttttttttcttgcaggttcattgcttatgcttcccagttgcctaccaaacaggcagtgcctgtattacagtagaactgtagaaaggtttggtcaatcttcattagatccaatgataaaacattaatttcaaagccacatgtattaatcaacatcagattcatctattctaaaacatcaaatatctgatcccataattgtggagttacaatgatttggttcaacttttgtgattgataacaagcttcaacagttcaacagtaattatcttgacgaaatgcaaggttaagagtaaatcagaaaagagatgataaatcatgcatgaagccaaacattaagagctattccagagaaagtacaaaaggcgatcggaaacattaagttaagaaataaatgtaccatatgtgaaaaagaatgaaagcaaaaaggcaatatgcactactatagaaacattatgaatttgaacagccctcactgaagtaccatttcatctgctgaacagctagcatcatctacaggataatgtttgattgtggcatcagataaatttccataacaagcaacatcacgataccgcacaccaccatcgcatggcgaggagcacttcatccatggtccagcaacccaatgatagatttctgcatatattagtatactaccaatcacttattctccaagtaatgtatcaacaattgacaactgaatcgcctgtgaacaatttcagcacaaattatgaacggtaaagaaaaactgcaaaatggtctccttgggtagtactaaatttgagtgcgactctagtgcaaagaataaaaaggtagaggaaacattttaatggtaaattgagcaagaacaattgaaggacctaagaacatgaaaagaactaggaacagccaaatatctgaaagataaatcacagaatattttgtaaacatcaaattattccatgcaaactgcaggattcacatgttcatgaacagttaaatataccgtgtggttttaactgcattgatagctcagcaccactcttacagtaacccatttttctatgcttgatcagaatggttgggtcagagcaatcagagcagcatacaaattctttgccaaaatccagcttgttcttgcaatgcccacatttgtttgttagctttggggtgcctgtccttcagaatataaacaatgtattagaacaccagagtaattcattacaatgtttctgtaatgtttgaaaaggatggtctagattctgcgcctacttatgctaaggatggatgcagaagactaatgtagaatatagtagatgattgagcaactttccaacaatacatatacccatgcacacacctgttatgcagcaatggaaatgtttgtggaatggaagacatggcgggctttttgactccgtgcaaagaccatcacaatcatctgattgagaatctaagaagtggccagcagaacacactctagaccatttgctttggcacccagtccagtagcaccctgcatgttgaatgttacacttctatcataatgcggtattgctgactttaccatgagtccatgaacatgcatgacacatatatttagcataacttaaaattttccatgccatgaccaagcaacttaaaaattcccaagaaatgccctgaaaggatattttaatagcataactgtcactaaataaagtgaccgttttttgttcaatttaccaatcaagtgagtcatgcagggtttataagtattccaatcatttcgatttcgttagctggacataatctccagtctttggaattctgagttttaggactacgcatcctggtttgcgaactgtgcagttattattagctcatcagtgtcacgtaacaaagtagatcgaagaacaccgctagtccactactcttcaagcaactggacactctaagcaatttggcaaatttaagcagtcgactcgaaacctgggccaattcgtccaggaaccaaattattcatttcctgaaaaataatactactaacgtaaagtcgaatctcgaaaagccccaaatccaaatccaagtgcccaactagagtcctccagtccccctagtcctcctaacaccacatttcgacttctcgagctctccggagcaagccagttcctggctgggcttccgaggcagatgcattcggttaccgtgggacgggacgtcgaggcaggcggcgacggcgaggaaggggagcgccagcgcgcacagccgcggcagcgccgccgccatctccggcggccgccccgccgtcgaggaggatggccaagccacggcctcgtttcgttccggggtggcgcgagaggtggccggtgggggttggtgactcggtgcggtggcgcgtgccggcccgcgccgcggtggggaggggaagggttagcgagtcgctcgttcgctcgctcgccgtgcgccccccgtgtcggtgtcggtgtcggcgccgggcaggcagctgttttcggggggggctacgggtgggttgggcggtcgccgcgtcgcgcggtgatcctcctgcttcgggccttcaacgcgaagccggcgagcttgggcgagtacttcttttgcctgggccagaacagcactgcgacggaaattcggcccatgcttgatgggctgggactggactgagacatacgtgcggcccatgtatattcgggccggaacggtattaccgcgtacgtgaggccgaacaggtttcggaaaagctaattcgtgtgtacgtgttggcggcgcgcacgccggcccactaaggcccatgcacgcacgagctgcgcttctctctttttttttctttcttttttagccgccgtttctttttttttttgctgttttttttcctgccgtacggataggagaaaaaaatcgtaattagtttagattagtttcatatttttactagggattagtttactagtaattttaaatattaactttaaaattttcaaatttagatatgaaaattttcaaatatcgagttgaaagtttttaaatatcaagttaaaagtttcaaaattttcaaatctagacttgaaagtttttgaatcgagttaaaacttttcaaatcttgagttgaaaagtttcaaatctcaagttgaaagttttcaaaattttcaaatatagacctgaaagttttcgaatctgagttgaatctcaaattgaaagttttcaaatctcaagttaaaagttttcaaaactttcaaatctggacttgaaagttttcgaatctgagttgaaagttttcaaatatgagttgaatgtcttcaaaatttgaatttaaaatttaaatctttaatcaaaagtttctaaatctaacttaaaaaatcgaaaagaacacgtaaatgaattaaaacatgccgaggagaagggacgtgaaaataggagaaaaatcaaggaaaaaaagagagaaacgtataagggggaagggcgtgggccgtgcgcacacgcgcaagtcaagaagccccaacaggtttggtccggaacgggaggccgacacgcgtgcggccatgtactatggcctgtgggcgtgtagctggctgtagccggttgcgacaactagctgttaacgaccaaatttggtaatcgtcatcggagatgaagattagactgaagcagaatccaaaacagagatcgtcctggaaacagagcgggaatcagctagatcagaatcggctgcggctttaattggcagagttcgagtcggacaaggttagcgattgagccgaatccgacaatgtgacacggtatacgttgtcaggttgagttaatgtgcttcatgaagattgccgtgcacggattgagtcctgagaaggcaactgtatctattaattaggatattttatgtaatttccttagagatatgtttgggcaaaagtctgccgcaaagacttgtggtatcttagagtttgttagagataagagtcgtgtccgacatggacgtattttgtaatctcgggtataaatagaccccgagccccatttaatcaatcgaacacacgttcaatacaatctcgacgcatcgccaccctttattttcgttttgtttcgacgagttcttactttcgggttgagctacatcggtttcgatcttcaactagaggtaaaacttattatggcggcttgcgttctcgggattagtgcttccatctttatgacactctaatattgtttatgtaattcgtcgaattatcatatatccaatataatctccggcaatattgctatctaacctccaatcggctaacgtctgttactagaaggcaaccgatcaggttaaatactgacgttgacttagattatataggatatctaccactctatgaaacatccaacggcttgattgtctagatattgtccttcttttcatacttatagctgcatcagttgagtttgaccttataagtcgtgattagaatctcaatctctagtctgcttttggttgctgattagggtagcatcggggtttcagccgatcttatctgatttaactacttttatcttatatacttgattgatatattaaatctgccctttatgttaaaatctcgttgcatttaaatatattaggcttttgtttggtatattccacttgctttgatatcttaatatggagtggtatcggagtattagccgatacatgctatatctatctgatcggctatgctatgaacatatataatcttgttgttaatatatatttcgatctaagtgatttatactatctcggcatggcgaccgatctaactcaatcacttgatttaagtatatatcgacataagaattatatattgctaatatctacagccgatcgagtagatttagttctttcttacttattcatgactgccgatcgatctacatatgacatcggctcaaagataaatgatacgtcatcggcaactagccaatcggctatcgtttatgaatttaaccgcggtttctttgtctttgtttattgttgattgcaggatcaaatcaactagcatgctcacacacctaaaggcaagcttttggacctgcattggagttaagcagatctcctaggcctcgtgtttttacatcaacactagcgcacagccaatcaacttcgagcatgtgcaatgggtatccctgatccgtgcccctactcatgccgtcggggttttactccggagctgtctcccagcagaggggcacaacccagctgcgaggcgccacgcgcctccctcctctcttggccccttttcgtcgagccacggaaccgggctccgcgttgggcgcaccgtggctaggggagtagctcgtgggcactgctcccaccctggatttttctcttccacccctcgccctagtagatccggcggtgaagaggagcatcatcggcgacggtgaagagagagaaagaggcagcgacgggcggagggagagaggcaactttgtttgtttagagggtgtttagattcaggggtgtaaagttttggcgtgtcacatcgggtattatatagggtgtcgcagggggtgttcagacactaataaaaaaataattacagtttccgtcagtaaaccgcgagacaaatttattaagcctaattaatccatcattagcataggtttactgtagcacccgtattgtcaaatcatagagcaattatgcttaaaagattcgtctcgcaaagtagtcgcaatctgtgcaattagttaatttttagtctatatttaatacttcatatatgtattcaaacgttcgatatgacagggtgtaaaattttaggttagggtctaaacaggcccttagactgtttgaggtaacttctctttaaacggtgtacttttttaacagaaaattttcaatatcatttggatcgaactaaacctaacgtcgtgtttggcagatcaggttgtgaacttctcttccacgtacgtaaaacggagtgattcattagcgtatgattaattaaatattagcttaaaatttttttaaatagattaatatatttttaaagcaactttgtagaaacttttctaaaaacacgttatttaaataattcaagaaccgtgtgtgtgcggaaaacaagacattaaaagttaggaagttacacttaaaacacagctttttaaactgctaaacggtacgttttttacaaaaagtttatatacgaaagttgcttaaaaaaccatattgatccatttttaaaaataaattagcaaataattaattaatcacgcactaatggattgcttcgttttccgtgccggaaggatgtattcccaacccaaacaaaagaaccgagccttagccatgatcaagacagcagatagggtgttactggttttctccccattcttcccaactgcaaactttcagccgaagaccatataatttgggaattgcaaagtcggttttaggagccagtcctcttccacacaagtctataatttgcatactcgagacacattactttgcatctgggccgcgatacgcgccccttcaacaatcaacatggcgaagctgatcatatctcagcgtcattgtttgactggctcttcgagactctctgtccacgccatgcgagtatgcgacgaggggcgacccggtgagatcgaagcttgagtctgttaccctgtaatgcccgaggcgccaagtgcccgattgagacgaatggtgatatatgggttcttgttctcacatctggtcgccgtaacacgacaccaaccatgcatccactctgccatcggtcgagccgagcatgagttctccctaatagtacattattgcttgtgaccggctccttaattcccaaatcatggctttgttcccgggtaaaaagcaccattccagtaggtaaaaaatattctaaactcttaagggacattcactccttgtttcactccttgtttgtacgtcatctaaatgattataatgaaactttaaaaaaatcaacaaaagatattaatatgtgataaatcactctagaaacatacaatgtcagatttaacttatacaagtaaaaaaccaattttgattgtgaatatgtgttaactagccatagtttaatttttttttcacagcgtgtagaatgaattttatcttgcatgtttgtggagtgatctatcacatattaatttatcttgttgaataattttttataactatttaaattacatataaataacgagtaaatgtttacttgaggtattagaattccctcctcgttcaagtatcgatattcgtttttagcgttattgtacatccgtgttagcttcttttatctcaggccttatttagttcgtgaaaagagaatttttaagtgtcaagtctgacgtttgaccggatgtcggaatgggttttcggacacaaatgaaaaaactaatttcataactcgcgctggaaaccgtgagacaaatttattaagcctaattaatccatcattagcacatgtagattactgtagcacttatggctaatcatgaaataattagactaaaaagattcatctcacgattttcatataaactgtgcaattagtatttttattttatctatatttaatgtttcatggatatgttcaaagattcgatataacgtttttgggaaaaaaaaattaaaaactaaacaaggcatcagtaggtcccccaattggctctattcgtcagatgagaaaaaggctaatcttgagctggcacggccatccatatcggaatcgccctgacctttcaagggcaatcagtagtactacctccatcccaaaataggtgtagccatgagtttctgcgtccaactttaatcatctgtcttatttaaaattttttataattagtatttttgttgttataatatgataaaatatgaatagtactttattcgtgatttatgtttttatttttttttaaaaaaataaataagacgaatgattaaagttaagtaaaaaaactatggctgcacttattttagggcagagggagtacttccagtagactactactcgtagcacaattacatgtaacatggtggatcgatctcggagaggggtccctactttggggtgatgatgacggactctttccatgcatcttcccttctagatctgacagtgacaccggtacactacaggtgcggggagagtgagacaaagacagcgaccggtgacaccgatcaatatctaacacacgcccgtccatcctccagtgccaatgccaacatttgcacacaagaaaaatgcaagtgtccacgcaccgcgtcaccgcgcgatggggcgcgcagagcggacatcagagcaaggataatggtgaactataagcaagctaaatacttacgtggaagagagagataaataaaagtggagagtgttggctctcatgtaagagctagctccacacaagttctaagaaatatatattaaattcatagagagataaagagagaggatgaaaaaataaagctaacctattatatatgttagctttaacattggcttataataagtagtgggcttactactaaacttgctctcagcgcactggcgcgatgatagcccgaccatttcgatccccgcgagtcacgccgcccctcgccaccgccggggctcgctcgctgcttggctcccgtcggtggtgcattggcgcgtgcgtgcgtgttcgtgcttcaaaaacgcaaggcgaagagaggtaggcaccgcgcgacggctttgcactgccttgtgtgtcggttgctgcacgtc

SEQ ID NO: 59271 - DNA, 8184 bp, Oryza sativa
accgccgacagcacatgcaggcgacgacgaccgttttcctgacggttgattgaaacggatcgtccgtttccgttcgttaattggtactactacctacgcgtagcgtgttgctccctaaacaactcccagatcaggcaaaggaagcatcgtctcgtctgcacgtactctaccaagaaaatgatcagcgccatggaggccagaacatgcacacatgcggtgcgacccctcacatggggcaacagggcatgctgcaaactgaagagtcgaagaccacggttccctccccatggataaaagatctggtcttttcagttatcagtgtccggcatatgtatggggatcaagtggtgggggcaaaaaaaaaaaaaaaccagtggcatgatcgggcacagctcgcgtcggaacaaggcatcgtgtcacatggaagaaacccatcgcttgttttatggaccgcgcggcgcgcgcgcgcatgcggaccgcgcggtgactcctgtccctgtgcaggttgacggcgagcacatgcctagctacgtcgtggtagccccctgcaacgtcccacgtacgcgcatgcaaattgcagcatcacgattggtctggaattgtacatttgtactctctgcaccagggaaaaattttgtccagattgcaggggagagatacggttggtgctgtgcgccgtgctgcgaatactgcgtccagtcaggcagactcgagctcggtcggtcacacgaacaggcgtgcatgcatgaggcacgcaggccggtcaatcgccttgcacgcacacacacatcctcgggtcgatctggccatctgggtcgcgtgctggtttgggtggaatcgagtttctagttttgtcttgcgttacgatttcccctgttcgggtgtgttgtaatcttgttgcggactcgcggagtcgcggtatatactcggtacatgtatattgcaatttgcgaggggggtttgggtttcctcgcgcaatcaagtgcgtatatacttaagacgcgcgcacacatgggcgccatgtgtcggttgagtatccttgtcagggtttgatccagatacatgatgctgtccggccttccagcctacaacatgatcctggaaatgatgtgatgacatgatgacacgatctgaacctacgatttccatgattaaactgagcttcacaacctcgggccacaagaattttcacgtgaagccgttcgaattgcatgcgagtatgcaacttactcctacatcacgaaaaatggtccataccgcaaagggaaaaaagaaagttccaagtgccatggtaaccagctcactcagtgacaaaagtggtgaaagattcctaaacaccggcacgccacagcgtccagccggtgcccggttgtgcgactacgatgcttgtcccctcgcaaaatcccatgatgaacgctaaccattaaccaacttgattacatacggcggcatctgtgttatcacgggaaccgcagaggcatacgtaaccgacgaaaaaaacgcggacgagatggcgaaactgcccctcgtcgtgcaccgcctcaccgggccgaaagccagtcgcgtgcgcgtgcagagagacggcgcgccgcacgtactgtacacgagccggtgcgcgcggtaggaaacggaagcggatcagggggccatgtgaccgcacgcagggcgtgtctcctacgaggccacgagggcagagggagcccatcatccgctcagccgaatcgccgatcggggacacgcgtacggcggaagatcccgtggcatttcgtggtagtaatcgaccaaccctaggcccgtttcgccggcagcttggtctataagttgctgctctgccctgctcggcctcatcatcccaagcggcacagcagcctcgagctgaactgaagcaggggaggggaggagaggagaggagagagcaacgcgttcaccgttgagagaagagaaggaagtaagacgagcgcaatgcgtcgcgtcacggtgctcgttctgctcctcgcctgcgcggcggcgcgcgccgccgccgccgtcgtcaccgacggtgagtgcctagcttgctcgctaactctgctcgataatcactgcgcaggctcagctctaatttcacttcaagcatccatttatgtagcatactgttaggaagttactgcggtttctgtataagctgttttgctgttctgatcgatcctatctatcagcggcaatgcggcatgtgccattagtgtctaaaagctcgtaatcaagctaagctgcctgccccgtgatgatttacgatcttggagtcatggagtgaatagtaggatagatcacccgggtccctccattatccatatactgacgaaatgtttcccccggtcgctgtcatagcatgaagccacgaactcgatcatgcgttgatcattggagtaccatatacagggtatactgtagtttggttaaccccacacggccaaatcgcattggggcatgcatgcataatcacaatctacatgttgcatggctggcaaagtaaactgaagtacacgtatagttaatctcctattaaggtgtcgtggtgtgcagcaccagatgccgaccgagcaaaagtagtagtagtacaactatacaagcattaaagcatatgcagctgcagcccatttgcaagaaactattcttgctttttagtactagtcgtgaacgtgttagatgcataatcagatatgttctctggtccagtgttctggactagtagtatgcaataatcagatctggagtatcatcgtctgccagcattaggcaacgtttgatgcgagagtgcttttgtgcgctctcttgatttggtttctcgtttgttttgccggccgcggccctggttgcgttgcatgtggtagatgggatggtagtgaatgcacctgggccctggccgagccagaggaactgacacggtcatacagccctactagctgccggagcccagaacatgcatgttacactaacatggaccctgtcagcttagcagtataccggtcgcagttccattaattaacagaacacgagatcagacagacagcctgcgtgcctgatctgatgctctgaatcgatctctgctaaccgcagcatcacctccaacaactttcttcagttgcaggctcgcagtgcagcggccgatttgaatatctgatttagtggattaatctgattaaattaatggtgactaaaaaaattaacgacgtgtgttgtgcagggctgttgccgaacggcaacttcgaggagggcccacccaagtcggacctggtgaacggcacggtggtgcgcggcgcgaacgccatcccgcggtgggagacgtccgggttcgtggagtacatcgagtccgggcacaagcagggggacatgctgctggtggtgccgcagggcgcgcacgccgtgcgcctcggcaacgaggcgtccatccggcagcggctcgccgtgaccaggggcgcctactacgccgtcacgtttagcgcggcgcgcacctgcgcccaggcggagcagctcaacgtgtcggtgagccccgagtggggggtgctccccatgcagaccatctacggcagcaacgggtgggactcgtacgcgtgggcgttcaaggcgaagatggacgaggtggcgctcgtcatccacaacccgggcgtggaggaggacccggcgtgcggcccgctcatcgacggcgtcgccatcagggcgctgtacccgccgacgctggccaaggggaacatgctcaagaacggcgggttcgaggagggcccctacttcctccccaacgcgtcgtggggggtgctcgtcccgcccaacatcgaggacgaccactcgccgctcccggcgtggatgatcatgtcgtccaaggccgtcaagtacgtcgacgccgcgcacttcgccgtgccgcagggcgcccgcgccgtggagctggtggggggcaaggagtcggcgctggtgcaggaggtgcgcaccgtgcccgggtggacgtaccgcctgtcgttcgccgtgggcgacgcgcgcgacgggtgcgcgggctccatggtcgccgaggcgtacgcggcgagggcctccatcaaggtgccgtacgagtccaagggcaccggcgggtacaagcgcgccgtcctcgagttcgccgccatcgccaaccgcacccgcgtcgtgttccagagcacgttctaccacaccatgaccgacggctcgctctgcgggccggtcatcgacgacgcctccctcgtcggcctccgcaagaagacggccggccggcggctgctcctgtaagacgaacggccgcgtggcatcgaacgccgtcgcattccctccattctatgaatatatgaatacaaggcgcggttaaacttgggggcagttggcacgaccaaagttgggtgctaaaatgggtagtattgctaggctcgtttttttggttttggtgtgtactctggtatatgtacgcgtgtgcgcgcgttgcatggttatactttggagctgcgctcgtttggtgttttgttgtgaagaggagaggtgatacgtggtgcaaggtctgtcacaaggggtttggttgatcaacttaaccggaggtgccaacctaaacgcaccatcagacattatgaatgggaagcattactagtgctcacttttttataagtcaattgtgtatttttaattctgttctaaaaagccagatcctttttgaaagttgagtcatacatttgagctatgctcgaaaatcaatcggaaacgaacttaaacatgtgtaaatgatgtatgaaagtaagagtaagttttatatttagccacattttcttattagaaaagttttaatttggatcgcttgtttagctatacttttacttcggaccagataacattttctttgtttgcatcttggaccaccttcactatacatctatttcatccccacccaaaacccgggtaactggaaacaagaggggacacacgccactggcgccgagtggcttgagttcagactttgcgcaagctccatccatgttgcactgtggtcaagcttggcttgctcggtttggttcggctctgcttggctccatcataagtggtgtcgatttttctatctcttcttatatgtaccggtttatcgtaaaagcaggtacaaatatttactacaccgttttgtcatagattttttttaataaaccggcacctataaagagctacatgtattggtttttaattttaaacccacatgtggtgttaggagttcggggaaggcttataggtgttgggtctagagttcccgacacctatagggccgtcccctatttgttgtttgtagtaatagatacatgaataacagaagtaggctaagtccctgtttgattcagcttaggattattataatctagtttattaggagtaagctgagacaaacaagtagattattataatctataagtcagattattataatctgataagctactctagaggagcttttttcagattattaagtggctaaagacccactacccctacatacttgagaaaaattacccacctatgccatcaaccgaacagatagctgagggcattatagactttagccattcaaacccaataatccatgccttcaataatccagacaaataaacaactcacagcttattctatgccagcttattataatccagcttatagtaatctggcttaataatctagattataataatcataagttgaaacaaacagggcctaagaaactttggattgtattatggagtaccagtttgctaaatttatcacaattgatttggtcctaagattttttttttttacttttgagacaattggtttccttttccgtaaaaaagagaaagaactatgattttctttagagagaatccactcattaccactgagttcggcatagttcaacaatatgccactgactttgtcgacatccataatataccatcgcctttcacttaacctctacactttaccatcaccgtcacacactgttagtttgcaacgaggaaaagacaagtatgcccttaggaacgtgaaaaccattagcactgagactatgccatgtagggcactgagagtgataataactatacaaagaataatctacaacatgaataaacatgtaaaaaatagggatagctcaacatattttaagtatgaattatgtacagcacgtgtgcaatataaaaattgtgcaactaaatcatatgagatctcacatcataggacaaagtagtgtatcagtgaggggtttggaaggaaaatcatccatggaaggtgcatagcacaatttgacagaacagtgcataaaatccaatgtccaagtttggcataaccaagttcgaccacaacatgttccaggacagaaaccaacacatggctaaataaacaagttaagtggcacagcaatcggcacgacctctttcgatgacgacgacggcaacaccagctcttcagaagggaagccgtcccttagttgcgagttgcgacggcggcgctgatgacgacggcagcaccaacggctgctctccacaaggggcgtcttctcccatctgcgacgacggctcttcagcagggggcggcactgctgggaacggtgctgggggcgtcgctggggacagtgggttgtggcgacgctggggatgatggtgggggcgacgctgaggacggaagtcgaggcgctgctgggaatggtgctgggggcgccgctggggacagtggtcggggcgatgctggggatgacagtgggggcggcgctgaggacggcaggggcggcgctgaggaaggctgtcaaggcgacactggcgacgacgaccgcgccgacgatggggacggcggtcggggtgacgctggggacggtggccgcgccgacgatgcggacggtggtcggggcgacgctggggacggcggccgcgccgacgatggggagggaggcggctgtcccgtaggattagggctggccatagcggcgaggggtcggtgggggcagccagcggatggggcgtcgcggtgggcgctgatgcggcatggcggcgggcggagaaaagccgcggcgtcgctgggaagatggcggcgctcgagaatggttgattggggcggcctggtcagtgctagggttagatggctcaaagggtatttcggtcattacgggaaaaaaataacagtacaaacggcgtataactgacagactgtggacggcgatgataaagtgtagaggttaagtgaaaggcaatggtatattatgaatgttgataaaatcagtggcatattgttgaactatgctgaactcagtggtagtgagtggattctctcttttctttatcctactatctctgtttaccttttctcatagatttttattcgcgcatacttagatcattcatagtgcaacaacatgacgagatcctcacaccccatctatgttgtcgctccacataggctaggcccatgtcccttagaggatcctcgcatcttgcagaggacacacgtgcctcatcaggggattaatgagcaacatgatattcacccacatcaaaccatcatccatggaaatttccttagttaccttattattagtggatgtacattagtttgtttatcttttttaagaacttatgtactttatttgatagcaagaagtttaaaataacatattatataagtgatggtaacttctcccatagaaagattagaaagatcgcctaaagtcaggcgactagggaaataacaagcatgcatattagtttagcccgatataatctcttaggtatttcgtatcaccaaaaaaaactatactctctttgtctcattttaagtgcagtcataattaaaaggcaacaaaagtaatgtactcagattattaaaaggcaacaaaaggaaaaacggaattaaaaaaaaggagaaaaaggcctccaaagaaaaaaagggaaaaaaaagaaaaaaaaaagccctttgacgttggaacagtccaaacgtcgagaagctactagccccgctagggttcgccgccgccttcccctcccccataaatcccaccaaccccccctctcctcgtctctcgccttcgccaccttcgaatcgaaactaatcccccacacctccgcgtgcctccccccaatctcgagcgcacggaagccgccgccaatggtgatcgccccgctcccctccatggcctctctcgccctatcaatc

SEQ ID NO: 59272 - DNA, 7657 bp, Oryza sativa
cgttgcgtttgttttttttttacttttttttaggcgctcccgaatcagcagacggtggactaccccagcttcaagctcgtcatcgtcggcgacggcggcacgggttagcctcgcgatcgccctcccctctcttacgatttttttcgatctgtttggttctaggttgcggtataggtgtggtgatgcttggttgatgcgaccttgataatggttcgctgaaccctagatagattgaacggagagatacagccacggttgttttgatttgtaaattaagatcgttgtagtggttgttttgatttgtaaataaattaagatcgttattatagttagagatagagaaataaggctgtgttattatagttttgatctggcaccgattaatctggcagactcgctcctcttcgagtacatagcattgggactcgggaaggggatggtggggaagggaggactgtgttagatttgatttgtcacggatgaatgtgaactctctggtttttattttcgaaaatttataggattaaaaatttcttgtttcctgtgctcgaaattgccaggctcgaaaatttctgtctgttctgaaaccaggcaatctttttgatttgcaggcaaaaccacctttgtgaagaggcatttgactggcgagttcgagaagaagtatgagcgtgagtatctgctcctattttgcattatcatgtattcttatggtggatcattgtgtttttcgtgttaatttgactgtggttgctgcagctactatcggtgtggaggtccaccccttggatttcttcactaactgcggcaagatccgcttctactgctgggatacagctggtcaggagaaatttggtggactcagggatggttactagtaagtattattacatcgattgaatttgaagtttgtctcattagttatttaggatcttcagccattttgtcattctttgctatgcctagcctagtacattgtaatttgtatgaggaatataagcactgttagaattttactattgtgtgagactatttctgtgattttagttgatcctttccaatcctgtatttaactattgtattctcatgacactttatgtgaatcctggattttgttgatagtgccttagtgggtgaattagaaagatatatatagttctttgtttagttcttgtgttctataacaatttgtgatgcacacgatgctgatatatgcttatggagagaattcagtttagctttgactcataatatgcatgaatgctggatttgagcatcatatgccatgcattttatacaactttagtactactaaatttgtgagaagacttcttatcttgtggcattctgctgtttgattgcactcatgggtaaagttactgtatgctgtgtgtaacaaagctctgaaattctatttattttgtactaactgtaatcatgtattccgcattgtagtatccatgggcagtgtgctatcataatgttcgatgttacttctcggctgacgtacaagaatgtcccaacttggcaccgtgatttatgcaggtatatcagtggaactgagcaaatacatttaccacaaactgatggttgaaactaataggtcttgattaattacagggtctgtgaaaacatcccaattgtgctctgtggtaacaaggttgatgtgaagaacaggcaggttaaagcaaagcaggttaccttccataggaagaagaacttgcagtactatgaggtgtcagctaagagcaactacaactttgagaagccattcctgtaccttgccaggaaacttgctgggtaacgacctcagttatcatcaatctttaattattcagcaacccaattactggattaaaccaactctgttctctgtctttgtcagcgatggtaacctccactttgtggaaacacctgctcttgctcctccagatgtcacaattgatctagcagcccagcaacagtgagtgttcttacgaaattgctctaccaggggtgtttaatttatgccttcaaattgttgaacgatttctgattgctctgtaatgtgcaggcacgaggctgaactggcagcggctgcagcccaaccactgccagatgatgacgatgacctgatcgagtagatttgcaatgtgctactttacatcgtcttgcgaggagccctgtttttaagcacagttatatcctaagagatcttttttgcctcggagaaattttcgtggtgtccaaggttaaatatgggagttttgtcggatatttgaccagttcagacaagttttggttatcgttgattgatgctataaggttacttcgggttaacatatttgcgcttatagctgtcgtatgatcaatgtgtatgatccgctctcgatatttggaggaaggtctgcgtgatgcgttagttttgagcaaatatttatcttcctttgccttcgaagcaaatattttatcctgtaaattcgggcgtcgcttatttatgctgtatggatcgcgcttaatctctgaagtataatcaaattctacgtggatagacggcacgattactgctagtctgctactactaattctgttcgaaggagttaacctgatgagaaactaatttgggatttctttacaaccgcacgtgtttgatgagtttgggggattcccttgcaatataggcgggagatgatcgatatcgagtgagaggtgtgtggactctggacgggagcccaacttggcaaaaccttttgggctttcaaagctgctcgacgggccactgccatcctctacaagtgatgaagtgaacacgataagagagaaaaaaaacatgataaccccccttaattaagtctcaaaacgtttatgcaatgaagtgcgatacgggcttcagcgagcttctcctccaaacccaataaccttgatatcttcgataatgctatcccaataagttaagtgttcggggtggggatggggggagtaagagggtaagatagtgttcggggatgaggagcttagaggtgagcacctgagcaaaggtattgtggggatagtagacagagaaggatggtggggtgagaggcacctcgtctgacgagtggttaggtggcaacaggtggtggtgacgaatccaggtataggaatcgttggagaatggaaaagagcctagaggtgagcacctgagcgaaggtgttgtggggatagtagacagagaaggatggcggggtgagaggcacctcgtctaacgagtggttaggtggcaacatgtggtggtgacgaatccaggtatgggaatcgttggagaatggaaaagagcgtagaggtgagcacctgagcgaaggtgttgtggggatagtagacagagaaggatggcagggtgagagggacctcgtctgacgagtggttaggtggcaacaggtggtggtgacgaatccgggtatgggaatcgttggagaatggaaagatggtagtgaatgggcatgagaagtgatagtggcacgcggaaaagctgctgctggaaggataatacggaatgggctggcggtagagatcgttgaaggaaggataataggaaaagggatggcggtggatgtgcccatcagcagggcggtggctagggttggctctttacatagcaaggtggagatgaaatctgggcggtggctagggttggctctttacatagcaaggtggagatgaaatctaggtttagatggttgatccaacggtcaagaatttgcaagatttgattgggcattttcatgtaaatgtactaaagcgtaaaacactatcgtaccccctttgtttttttaaatgtacgacgctattgatttttggtgcgacgtttaaccattcgtcttattaaaaaattatataaatgttatcggttttgttgcggtttgttttatcaataaaagaactataactttaacttatatttctacatatttaacttatatttctacatatttgtactatatttttaataagacgaacaatcaaacgttacgtgaaaaaccttcgagtcttatattaaaaatcggatctagtatatattatcatcactattctcaaaacttttcagagttaatcacaaatgaacccaacactatttacatgatgttcggggacatccccactccctgtcagcatgtagaaaatagatgggagagaattcatatagacatctatacacagaatctgcaatgcgaaactgctgataatggcagcttcaaacaagcaagcagcagcgttaattctcaggctttggaagccgcctcctgccaccgttgagggcccgtatcagctgcaggtgctcatcgctggacacgtggagctgcagccggagctgcgtcagcagctcctccttctcccacgtcagcgcgccggtggcgtggaacaccctcatcagcgcgccgtacgcgtccacctccaggcggtggatttgctcgcctaccgccgccgccgccgccgccagcggcggcggaggttgctcgttggccaggcgccgctgcattattggcgcaacggccggtcgcggcttcattgcggtggcggcgcgcgacttcgtcctgacgtcgtcgtcgtcggcgcgctcttctttgatgtgtggttggcattgcggctgcaatggcggcggcggcggctggttcgccgccacttgggcgtcccccggtgggctcctcggcgcggcgcggtcgccgttgtcgctctcgctgctgctgccgtcgctgctgctctcgctgatgctgctgctgccgctgccggccgacgagacggacttggcgtcgtcgtcggtctcctcgtcgctcatctcctgctgcttgttgacgaacacggcggtgggtggtggttcgttcgcgcgcaccacctccacgttgccgtatcctacagcagctccccctcctcttcttccatggcgcggatccgcttcgagttggcctcgaccctccggacctcgccggcggcgtcgtggtccgtcgcgtggcggctcctcttgatcttggcccattggtgggagggggccggcggcggggcgaactgatcggcggcggggcggtgcttcgcggcggcggcgggggcgcggcggtttgcggcggcgttggggcgcgccgtctgctccctggcgcccgggatctcctcgccctgcagggaagaaggcgcggcgaggtgtcaggctacggaagcaagattccaagaagagaagaagagggttgggtggcggcggcggccatggataccttgtaggtggcgacccagatgtcgccgtcagtcagcacctggcggacgcggaccatgctcgggggcaccgtgatggcgctgggcgagccgacgatcttgacggtgaactcgccctcgccgtcgccgtcgccggcgcgcacgagctcggccagcttccacatgcggtcgtcgagcgcctccaccaggtcgccggcctcgaggtcggtggggatctcgaggtgcggcggcggcgggcgcaccgagacccgccgtatgcggccggagacgacgtcgccgccgtcccaccggatgttgtactggtggccgttcccccacaccaccacgccgaggcgccacccgcccatcgacgggtccccgcaccacgcctccaccttgttccccaggttgatcctcatggccgccgcctccgcctcctccgccgccgccgctccaccaccggcttggttgggatcaagaagaagaagaagaagcccttgtcccttaccaacgcaagaacacgagaagaatcgatctcacgacgagtcgacgacgtccgactagtatataacgacgaatcggcgaggagacgggcgcggctcgatccgtcgagttcatcggcgagtcggattcgcgcccgcgtcgagtgcgtagatggaaacagattcgtgttcgagttcacggactagaactcgatcagggcacgacgaccgatcggtcgaggcggattcggcggcatcagcacagcatgaatccgagccgaggccaccccccgtctctcacatgttttttctttttttttccttcttttctttctgggccctaagcccaactagcagcgtgttgggccggtccaaaatttgttatgcacacaaaaaaaacttagggatacgtatgtacaaattttatagtgcaaactagcaaaattcccgtgcattgtaatggttattgtaatgggtgaagaaaattgtttcaatgagcatggtggctacgatagcgcaaatttcttgggagtatacattgtatattttgtaatattcatagtgtaggtggaattagagctaaaaatggttaagagcatgtccattcgataatcctctccagtctataataaaaatgtcatccgtatggtcaatatgataagcgtaacgttggggagagcagccaaccagccacgcctcgctctcgactcttgtggctcatgtagtaacggagctcgaagatcgggtcgcgggtcgatttacatggatgattataagaaaactattaataccactttaaaataaaattatttatcatagactaaagtttgaaaccatatatagtatttaattttatcatgtattattatgagtcggttgtaatgcatggttatttttttaattgatattaataaacagttttttcatatcgtaaagagtagccatagtagaagaaatgtttttcgctagctatcacagcaagctcactgcactcaaatagcagaatcgctttcactaaaaaaaatcagaagtaaattgtatgatgaatagaaaaaaaaggtgatcaggttaggtgtcctacgacaaatgagaaattgacgaggaaaacaatcttgatgcaaacacaattcgttttgttgatgattgtatttttctttaaaaaagaaaagcatgcttgttttattttttgaaaaagtaattcattttgtcggtgaatagcgtctacttttatctgatccctgtatgtgacctcctatttaagctttagtctataataaaaatgtcatctatgttgagtaaaccatttcgcatgcatgtataagaaccaacacgtgtatacagtatacgtgtagagtttgactggtcgtgtgatgtgtggacaatatatagcgtgcggactctaatataacatgtctcgtgaaaaaaatctattttttttcacaactattattctttatttcaaataaatattaaagtagaagtttaggctattttgatgccaacaataaaaagtcttaataaaagaaaatatttttgagcggaactgaatcccattgattagcacattctagatcacagtggcacttgacagtaattaattccagtctgaagctcctatttttttttttcaaaaaagaaacaaaaaagattgtactgttgtacattacgggacctatgtggtggttgagatccttatcctctcgctctcacggtctctctcccattttatccgtttacggggaatttaactatttgccactattagatttgttaattatttaaataacttcttatattttcgtagagagaacttctccactttttaccacttttgtatacgtggtgcactaactaggctgccccgtcatcttcttcctcccgacgatgatgaaccggatggtgctctgcgttggcggtgggctctgtgtgcgggttcctgatgatgacgctcgtcggtgttgtgtaggtcaagctcgtctaca

SEQ ID NO: 59273 - DNA, 1391 bp, Oryza sativa
tgattctgatctgttaactttatacaggtcaattattcctgacagcagttgcttgaatgcttcaaagacttctggatccaacctgaagcccttattgtttgaggtcaacaagttcagggaacaatgaagaatcgttaaatacttcttttcaaaaagaatagttaaatactaaaagcaggaaggtttcatgaaaggtttcaacgagaggggaaccatgaatgagctttggttgcttatatcagattgctccttctgacgtaaattttgttacagcctttccacaacgtattatgcagctatcaaatttgtagctataaattcgatgttgtattatatacaagtattgaaatgaggtatgccctcatcttgtttcttggggaggaatagaggcaaatggcaaagggcgaaaaattggccatcagtacgtcaaatatcattaatttgattcttttcataaggaaagttgttgcttcagttgaaagtttatgattggccgttatggcctccacactagactgcttgttggatcttttctataggtttttcatattctggtttactgcacatgctacgagaaaacccaataagtatagctatccatatgtttcttgacgaattcagccaatagtaataactcagtcttaactggataaaactatgttctcactcttgcatgataactatagggctaactgaataacctgaaattttcagggcataatagtatgttgcatgccggtaaccctaaagtagcaatgaagaaactcatatgttacatactacaaatcccaaattcacgaatacgacaactttgggtaactttgagaatttaatcaagaataagtaccgttaatgctatcctgtgtttgtcaacgacaattatatttctgaatattttttaacctctgagtatatatacaggttatgtaaaaccctctgctactctgcttttttaggatttatttgtggcttgttttccccattgcccacaaagatcctgatttcactgttgaaaaaccatggccctgtttagattctaactgttttcttcaaacttctaacttttccgtcacatcgaactttcttacacacacaaacctccaacttttccgtcacatcgtttcaattttgacgtggaactaaggctgtgtttagatccaaagtttggatccaaacttcagtccttttccatcacatcaacctgtcatacacacacaacttttcaatcacatcatcttcaatttcaaccaaaatccaaactttggatctaactaaacatagcctaaacacagcccatgttttccagccttacacctgcatgatctggctagaatggaaaaaaacgaaaaagggttaattggaatgataaattaacatggatctatgggcct

SEQ ID NO: 59274 - DNA, 1287 bp, Oryza sativa
gttcaaccctttgatgttcatgttccaatcctgtgctatattgttctagcaaattttagactcaaatgtgtagatgtgaaaatttttggatgcttgaacttatgggaggaggtttgcccggagccacaggccttctgaccgtgggtcagccgccggtctgaccggccggcaaccgtcggtctgaccggccaccagtgggcggtctaacttggctgatgccgtcggtctgtccggccaccatgggtggtctgaccggcctgatgccgtcggtctgaccggccaccatgggtggtctgacttactggctgcggtctaaccacccctccactggatataggcaaattttcacctctccaaattgtttctagaattattgctaatatcctatcatcctttgctctttttacaatgatgcctcccctcacttgccatggtcgtcgtgcgcccactccggatcccgtgagtgagcctaaggaatcgagcggagaggattacgctcacaatgatgaagaggttgaggcaaatgttgagggggctagtgaggtggcaagtggagatgatgtcagtcgtagtggggaggatgaggatgaagaaagtgatgatatgcactttgatcccttcatccagtttgtggtgaacatgaggaatccagtacagtataccatcttgaggcatcatgatcagttcttgaggcttcgggacactccggatccccgttttcacaccgctttccagaagactgtgtatgagcaggtttatgcagggaaagcatttgcagagcataagtggatttcttggagagacatcaatgagactccagagtttgagagcttgcattatctcttcaagactgttggcattgaccggattgtgacccttaagcaagactacaatgaagaattgattcgacagttttatgctacagtgtgggtggctggagactatagtgagatgaagtggatgtctgacaccctctagtgttctatctctcggaggtagttccggcggctcctcaatattcgcttggattttggagatgatttgcatgaggagcacactcacaattcattctccatagactatctctctcagttctatgaagatggagcacggtacacacatgggaaggttgccggcttgaggactatccccagtgtggttaacatgattgtgagagccattatcctccctcgcattggcaacaatgatgacattaggggggtggcttggcacgtcatcgatgcaatcattcagggtcgtcagttcgacattgtgtctctcatgatg

SEQ ID NO: 59275 - DNA, 704 bp, Oryza sativa
agatggaaggatctgcattcacatctgagcacaaaacttcattggatgccccatcatcctcaaaagcacaagaacaatttccaagctcatttgaacatgaatgcgattttgaaagcctgtttatcacttcaggtgtacattgaacatcacaagtgtcagaaaaggcacaatctgtgtgttgcaaaggctctagtggtgatgttaactgagttggctcagtattgttttcttcttctagcctcagattactcatttgatgaagtgtatcagcaaacttcaggggatcactgaaacaatttgattttgattcactacgcatgcaattattttgagtagacaaaggttcactgtcttgttccttttcatcgggtctgacctttgatatatcaaacagtgtatctgactggacattgtttcgctcaaaatcacaagtagcttttccagaaatcacatgaccaggaaagtttgccagggtatttgaactgttattgctaccaccagctaattcttcccaagaatctttagattcagatgattcataagatggaagaagctgacttctatcaactatttcactcgaatctgactgaagggtctcatcatttactgtcgttgaagcagacgaaaaagtttgtaacgttagtttcttctacagagcctctttttattactccatatccttcactggagttgtaaccactgaa

SEQ ID NO: 59276 - DNA, 6436 bp, Oryza sativa
ttgtatgacttgtattggcgcttctaataaagaaaatctagaaatgaaaaaaaataattcaaacttcagtttccacttaaatcattgaacggatcattgaaatttatctcaaaagggggttgcaaagccacatccctttaatttctcccctccttgagcacctagacaagcagcacccatgcataaaccatgatttgcatgatgggttttaaacaaaccattacttttgaattttgcataagtatccagtttttaatccatttgcataattgtgttcattatgattaaattaatagttcaagacccatatcgaaatagatggacaattgtgaaaaaagtaaacaatataaattatatcatcacatatcattccacaaacacatatatataactaaattgcatctacaatattagaagaaaactccaattgtatataatattccccaaaacatacttccttcattctaaaatagtgatatatcaaaatgataatgttagatttatatgaaaaatattcccatgcatcttatttttaatctttttatgaaaaatatttccatgataaatatatcaaaatgataatattgtcatgttttttatttctccagagttcccttgaagccggaacagatacttcagctgatacaattgagtgggcaatgtctctcctactaaacaacccgaatgtgatgagaaaagctcgtgacgaaattgatgcattcataggacaaccagtaggctaatagaggcgagtgacctcacaaaactacaatacctccagtgcattatcatggagacactccgcttatacccgccagcgccacttcttgtgcctcatgaagcgtctactgattgttcaattgctggttttcatattacccgtgggacaatgcttcttgtaaacacatttgccattcacagagatcctcaagtatggaatgaaccaacaagcttcatccctgaaaggtatcggtatcaatttctttcaaaaatgctatatatatgtacgggcgtattaaattatagcatattatgtttctatagatttgagaatggaagaagtgaagggaagatggcaatcccatttggcatggggaggtgcaaatgccctgcagagaacttgggcatgcaaatggtaggtcttgcccttgggacaatgattcagtgctttgagtgggaaagagttggagaggagctagtagacatgaccgagggatctggtcttaccatgcccaaggaggtgcctctgcaagccttctatcaacctcgtgcgtcactgatgcatctcctttattagctttaagagtaaattacattgacggttcttaaactggtaagcaggtttcatctaggtccacgaacttgcaaagtgtgtattgaagtctctaaacttggtttattgtatcattccggtctaaagtctcatttgatcgtgatcttgcctacatggcatgacatgtagacaacgacatggcacattattactattatttctttttttcctcccttcttcctctttcatttttctcttcttcggcctcttcgacgcgggggagctcgaggtggctcttgtggaggaagaagataaaagaatatgaggaaaaagaaaaggggaaatgaaaaaaaaacatcatgtcatcgtccacgtggcatgccatgtagataagaccacgatcaaacaacgctttggaccaggatgatacaataaactaagtttagggacctcgatgtgtgttttacaagttcgtgtacctaaatgaaacctcatgacaaatttaagtaccgctagtgcattttactctagctttaattaattacacaatactatatcaaacttttggatagttgatcgaattggcatgataaggtatcactttagaaatcatggaattgtttttgttaaaaaaatgaaaataagtgcatcttttcatctcaaaagccatatgtaagaacacttggtggactactaaggctgtgttcggatgccccttttccaacccctctccctcgtttttcacgctcatgctttttctaaatggtgtgtttttttgcaaaaagtttatataccaaagttgcttaaaaaatcaaattaatctcactttttaaaaaaaacttaattaatcacgtgctaataaaccgctctgttttccatgatcacattccagatggtaacttgttctagcgaacacagcctaagtaagaagagagagcaaactttcaaacatgatagtaataaatagtatgtgatgttggaaggattatatagcctaataaataatatggagggagaagatccgcggaatttggtggcattccatcttgaacttttttttcttaggggctgtttagttccaaaaacatcacatcgaatttttggacacatgtatgaaacattaaatatagataaaaagaaaaactaattgcacagtttgcatgtaaaccgcgagacagatcatttgagcctaattagtccacgattagccataaatgctatagtaacacacacgtgctaatgatgaattaattaggctcaaaagattcgtttcgcggtttccaggcgagttatgaaattagttttttcattcatgttcgaaaaccccttcagacatccggtcaaacgtttgatgtgacacccaaaattttcatttcaccaactaaacatgcccttagtcctttgtgactgatgtacgaggcctgttgttatcggactctgggctcagcttgtggttcttggcccaatcccttttactttcttatccatgtaattcactactccaaatgaatgaaaacggcagcccaccagccataaattaaaagaaaaattatatatcatgacactgaaacttgacagaataacagggatatccatgctgaattgttcaggtgtttcttttctctgtttcttcagtgcttgactatatttggctaagagtagctagtaggcaaaaaaacacacgagatccattatggactacttggtcggacttaaacacacagtatgtacttatcctatctacgttttaaaatgttttagattagacacatggaaaacagtatctgtatgtttgtctcaaaaagtaatattataattttattgggctctgtaaaaattttgtaataaactactccaaagttaagtcactgcaccttaaagaccatatccatgccaaaaacggcgtgtcttgggatagccatatccatatagcactccatgatctgaaagatgctctaagcagctactactcctatcaacctttgaatttaaggacaaataacgtttgctcaataccttcacagaacagccaacattatgccaaataatacacccaacattattgattcagtaggcctactgaaccaattttataccccaaaaaaatcgcatatcatactccaactagcaaacagccagttaaggcaccgaagcaagcaaaatgccatcactatatcagtcatagaatgcccttgcacagcaacaaatttaatcacatgtgtctaaaaaaaaagaaataattaatcacttggggacaacgtgtcaccgcctccaccggacaagatgtgtccttggctagccctatcgacagtgatgaggtgagccggtgtctggacaccggagagccccgcacggctcgcccaccgccggcgacgtcagccgctcgtcgccgccgcccaaaccggcgcggcacatgcacatgccgccggatgacttcatttattttttacgccattgcagcagtataaactcatgcacccaccctgcgagcaaacgaagcacacaccgcagtgcatgcactccaaccatatcgatcccgcgcgcccgatcagctaggtcatggccgtcgacgcgatgttcggcagcgtcgccgtcgcgctgctggcggtggtggtggctgctgcggcgctgcggcggtggaggcggcggcggcggcggggaggcgggaggccgctgccggggcccgtggcgctgccggtggtggggcacctgcacctgttccggaggccgctgcaccgcaccctggcgcggctcgcggctcgccatggcgccgccgccgtgatgggcctgcggttcgggtcccgccgcgtcgccgtcgtgtcgtcggcgccggctgccgaggagtgcctcggcccgcacgacctcgcgttcgccgaccagccgcggctgccgtccggggagatcctgtcgtacgagtggtccaccatgggcaccgccagctacggtccgtactggcgccacatccgccgcatcaccgtcaccgagctgctctccgcgcaccgggtgcagcacttcgccggcgtcaacgcccgcgaggtgcgcgccatggcgcgccgtctctaccggcgggccgccgccgccgcgggggcgcccccgcgggtggagctcaagtcgcggctgttcgagctgttcatgaacatcatgatggccatgatctgcgacaggaccttctacggcgacggcgacgacgaggtgagcgaggaggcgcggtggttcaggtcggtggtgaaggagacgatggagctgagcggcgcgtcgacggtgtgggacttcctaccagcgccggcgcgctggctggacgccggcaggatgacgcggcggatgcgggagctgtccgacagccggacgaggttcttgcagaggctgatcgacgaccagaggaaggacatggacgccgactccgacgatcacgcgccggcgaagcggcggaccatgatcggcgtcctcctctccctgcagagaaaggaccccgactcgtgccccgaccagctcatccgctccctctgcatcgtgagtaccggccgccgccgccgccgccgcgcgttatccccggacgaacaccttgctttaactacttcgtctctctctccggccagggctccctgcaagccgggacggacacgtcggcggcgaccgtggagtgggcgatgtcgctgctgctgaacaaccccggcgcgatggcgagggctcgcggcgagatcgacgcgtgcgtggggcagccggcggcgcggctactggaggcggccgacctccccaagctgcactacctccggtgcgtcgtgatggagacgctccggctgtacccgccggtgccgctgctggcgccgcacgagtcgtccgccgactgcgtcgtcgccgggttccacgtcccccaggggacgatgctgctggtgaacacgttcgccattcacagggatccccaggtttgggatgaaccagaagccttcatcccagataggtactgtactatttccccctccgataatactcgttggttttttttaaaaataacataatctaaaaacaaatttaatcactattttctattctaatatatatagaaaatataaagaaatttatggtttttattgaagtaggatatctatatttctaagacaatactttagaaattatttatatttaaaaattttaaagtttgatattaatctatatatatatatatatatatcacatataaatgttcttttcaagtttcatcatgttctttacatttactaaaattcattcacaacttgttatgaactactaagaatatatcttaacaggtttgcggatggaaaaaacgaagggaagatggtgatcccgtttggtatggggagacggcggtgcccaggagagaatttggggatgcaaatggtaggacttgcccttgggacattgatccagtgttttgattgggaaagggttggggaagagctggttgacatgagggagtgctctggccttacaatgccaaaggagttgcctctcgaggccctctatcaacctcgagcttccatggttgatcttcttacgaagatttagtcagcaccataaaaaataatttgttgttcaacttttgtaatgtaaggaataatcgggcaagtgcggtttcaaagataattgggctgttcatcttctttaaatttccaagattcacctctaccaattgtggctttgtcaactagaaaattctggcaagtacttaagtggatcctattatcgtggctggctggctgcatacagtatggataatctgtgttataagggggatggggtaatccgaatatgtcctgaacttatctaaatctgtcaagcacgttgaattattaaactgagatcgaatcactacagctcgcctcccttcctaggcttgagaaccttcctaagctcttcggtgttgcgccgatgacatcaacctttggtcgcacagatgcttggactgtaatgacaagcaagtgagcaacagcttgtcaactgggcaaacgaactctatgtaaagatggaaccccgggtggagtttactataatattaagtaaaaataatatgtaagattgcttaaacaacataagtttacacaaacataaaaacataagtttatatcattcgatgtgatttaaatttaaatagtatgtaagatgatgattcaaatagaaaaagta

SEQ ID NO: 59277 - DNA, 1473 bp, Oryza sativa
tatacttattttttgataaaaagtgttgggtattcccgggaatcatggtggctccgccaccgaaagtaagatgatgtggttttatgaaagaacaaaagaagaaagataatttagaccatatatctaagggctaaaaaattgagatgatatggtttaatgagagaaaaaaaagataattcgaaccatagattaatcatctaaagactaaaaataattaatgtgatataacttaatgagagaaaaaaaatagcataaactaagtgagaatgaactatataggtatataagatagcgaggacgctcagcaaccttctggtgccaaggagtgatgttgcatacacgaagaagaaagcagatcacaacatatgctgagaagcaagctacaactgaacctttgattgaacagcaacagctagcatcaaatagatgcatattagtattattattcagtatgtagaagtacgattgacactaatatagacatgagaagttgctgctactagatagatgcatggcttttgttcatctttcccttttgttcagactctttggagttttagtaagagcaattttctgtagctgaaaggctacgtgataatggtatgcttcgtcaggctgttcttggctaaacctcgaggattcttttttcgaggatagaggatttttttaatcgctctactttctacatgccgaataaattttctggatgaaagccaccaatttggagcgcttgctcatgagagaatgtagcattgttggtatttggtcacatataaattaatctgtaagcgcacggataccactataccaccactataagtatgccaacggtatcgaatcacaggatatgtatgtgtgtatatttaagaaataattcaaccaaagacaacaatgaatagtaagcttaggataaagaggattcatatgaattaattaactctaacaggagttaatcctatcgaatgcttcgggtaacggctctcccttggtctaccaagacgagtccgccatgtagctctatgatatacctaaacgtggagagatacaagggactgacagagctatcaccatctaccgcctacctcactttctatagagcacacaataaacgaaggtaacctttaacctagacactacgtatacgttattaattaattactactctagcctcgggcaaaaatcttcttccttatctagagtctttgttctagagcactcagtataaactaagcggcgaaaccacaacgatgagaatatatctgacttaagtaagtaaactaaatactaaaatgatatcacaaataacttatatcgaagaaacattctcgagatacaagattggagagaggaccaacaactgtggcgctccttcagaactatcccgaatgtaggccaacatctctagaacatcccagagagaaaaccgccattcgggcactccttccgaagcttcccctcactctcttcctatat

SEQ ID NO: 59278 - DNA, 1637 bp, Oryza sativa
caagacggtcgtgcgtgtcctgctcgctggtgagcgacgcctctgcgatcaggtgctcagtgtgtccgatgagctcagggaggagtgcttcatcgaatcaaccaaaggttgtattatgcagattctcagctttggggatgctgtggctgtgtgtccccgctcgccagaaaagctctcgcggattcttgacatgtatgaggcacttgcagaggtgatccctgagatgaaggatttgtgcttgggcagttctggggatggtgtgatcagcgatgttcaggcgaatcttgataggcttggggatgccattaggggtacacttttcgagtttgggaaggttttgcagctggagtcatcacggagggcaatgacagctggtgagatccaccccatgacacgctacgtcatgaactatttgaggcttttggttgtttacagcgacacacttgatgccctcttggatgacaatgccgatgaccaaattgatttggcaagagctgaggatcaggatcaggaacacttggagagcatgacccctcttggaaagcgccttttgaagctgatatcttatttggaggctaacttggaggaaaaatctaagctgtatgaagatagcgccctggagtgcatattttccatgaacaatttgctgtacattgttcaaaaggtgagggactctgagctcggcaagattttaggtgatcactgggtaaaaaggcgtaatggcaagatccggcagtattcaaagagctacctaaggatttcctggatgaaggttttatcttttctgaaggatgatggacatggaagtgggagcggcaacagcagcggcagtggcagtgggcattcaagttctcggatgtccatcaaggagaagttcaagaacttcaacctggcctttgaggaaatatacaggaaccaaacaacctggaaagttccagatcctcagctccgagaagagctgaaaatatccatatctgaaaatgttattccggcatatcgtgcttttttgggaagatatggtagccaagtggatgggggaagaaattcagggaaatatataaaatacaccccagaggacttggaaagtcagctttctgatttgtttgagggtgcaccggggccagccaaccactctagaagaagaacatagttcatatttggcaagccctgttaaaggtatgattttgtccaaggattgtaaattgctttacacttctttcatgtgtgttcttgctacctttagtagtcattgcaacaccataatacaatacaaggacctttcgttatgcacactgttgcaaggtgtgtactaaggaatattgtacatgtgttgtttctgttctatctcatgctgtttttttctgggtgttagctcttctagattttcagtactatttaacacatcaaaaggcccaagaacttgttcaattgggtagagttgggtttaccattactagtgcagccatttaggaataacctattaagggttatgaagaaatatgatgttcagtagcattggaagaaactccatgctaaagtatgcaccacaacccgagactttgtcggtcgaattttactgttacaaaatttatgttcctgtaaacttatttaatattatatatataacactgatactg

SEQ ID NO: 59279 - DNA, 753 bp, Oryza sativa
ggctggcttggatcgccgaatcgtcgggtcgggtcgggtcgcgtgtccgaccggtcgcactggtggtggactgagaaggcgagctcaacgctcaacagtggcgatgattttttatcttttggggttggggttggagttggacggccgggggagccatgccccaaagtcgtgtacaggggaccgacgaccactggttcactaccaccaacagtgggcgggcggcgtggtgccccctacccatgttgcgtcttcttctattcttcttgggtctcagtcttaaatatatctctcaactagatataaaacatcctccaacttaataaaccgtgtaaaagagggccttcaataatattgtacctggttttggctgacttgacgtctgcgtggctcctttgactttgactgggtcttcatcgtacgtggtgttgacgtgtcacttagtgacaattgggtccggaaaaacaataaagcatatgggcccacatgtcagttttacatacacaataataataaaaggtttccccacgtggccccacctgtcatactcactactcccctcttctctctatcctctctctccgggcattggagcggggcggacagtggccggagcgagcgaccggcgggcaggagcaaggcgggcggaagcccgatgaacccaccgtcattctccaccagcaagatggatagcgcgacgctcttgatgcccaacaccctgttgatgttgtgttggatgccttcccgcacacccat

SEQ ID NO: 59280 - DNA, 5233 bp, Oryza sativa
gccgctccgcccgctccgtgccactgcctcgctccgcccctgtgctctgtcccgtcaccacctgtcgccccactcctcccctctgccccgccccgttgacatcccgctccgctttgccagcctactccgcccactgctgctctagccactgcccgtcctgcccgtcgcctgctccagccactacccaccctattccactgatcggggagagaaagagagagcggatagagagaaagggcggagagaggatagaaagacaagggtagtgaggatgacatgtgggcccactggttttattattttttgggattcaattgccacgtaagcgtcacgtcaatgccacgtgaaacgaagacctaatcaaaggagtcacgtaggtgccacatcagccaaaaccggagataatgttgccgatggacctcgttagcattggttttgtaagttgggggatgcattatatccagttttgtggtctaggcatgaattttgaactcggtgacaaatttgagggacccaaagtgaactttttccttttcttggttccattttttttaggtgcagaaaaggaataagtccatttttccttcctcaactcatgcccctgattgaatcacacccctcaaccgcaaaaccaggtataagacatcccctaactctcgaaaccgtttgcaaatcaactccccggacggttttggaggcggttttgtcctatgtgccgcttatatggcgggttgacttgtcttcatccaatgtggcatcaacgtggtgcttgtgtggcataaaaataaaacaaacataaataggacccacatgtcagtgagcaaaacaataaaaatacatattggcccagagaggtcctaccctgcgcgcagcgcggccagccggcgaggtcctcccccgcgcacggcgctctggccggcgagcgagcgcctcccccgcgcacggcgctccggccggcgagcacctccccccgcccgcagcacagttggcaaggtcctccccccgcacagccgttgttgccgccctgcctctgtgcttatggaagacgagagaagaggaagagatgagagagagagagagagagagatgaggtggaggctgccgacaaatgcgtcccacctatgactcagcgaatcaactatcacatctgatgaaaccgcctacgaaaccgctcagggagtgattcaactaggggcatgagtagagggaggcaaaacagacttattcctacatgaaaaggggcctttgaggctcgggccttgggcctggtatgtcacctacatgtcatctttttaggttaagttcacttttaggtccctccatttgtcgctgagtttaaatgtcgtctccgaaccgcaaaatcgaatacaactgttaacaccaaatttagtaatattctttagcggatttggatatgtaaagaatacaatcagccaatgaaaactttatctaaaagagatcaagttcaagaattaatcgtgaagacacacggcagcttgatttatctattaattaggcagggcttactaattttccttttaatatttaagaaagtgtgtttagtgtcgaatcaggactctaaacagcctatgggcataaatatgtacactggggttattgtaaactatctctcgatcaatacaacttttggcacatcaccaccctctgttccgaggtttttatcaccggctgcatcgtttcgatctccggcgaagggataagtcctaagttccactggctctgttatcggttatattggtgttgttcaagactgcatcgcttcaatatcttggattgctatagttcaattggtatatttgcttacccgatatttcaattctatctttagttgcatcgtgtcagggttatgggtaaggtataccctctacccttcgatatatgtcacatatcgatatggtatacttgcgcgtatacggacgttttcggcatacgttaaggaaattcatcacggagttcacagatggaaggagtcctactcgtacggaactgggtcgtcattgtatcgtgtcgggtccgatgtctccgagtcctacttgaagaccagttgacctgcgatataaaaggaaccccccggaggacctaaggcatcgaattttatagccaacacattcaccacaggctacggagttgaagcctacaggagccaagtcgccgggagatctaatcgaacatgttcgattatgatctcgtcggtatcatcgagttccgctattccctttggaatatgtgggttccatcatataatcccatatcaactgaattagggctattacctatcaaggggcctgaaccagtataatttttgttttctgtttgcctgatgtcgtattacgtagatcctcgtaccagcgtaccccagtaccctttatatccggtctacgggtatcccccgtcgacacatcgtgtttagttgggattatctcggttaggtctaatcttctgtcttagccgacatatctctatacaatatctatcactttatacatgatttattgactttattcgatttatttgttgctgtaaacttaatgctgtatcagtttgtggtccgagttcgacctatgactacacgcacctcggccgcccaccggcatactactgcacgcactgtgtgtgtcatgagcctagctagctacggactgggagaaacgtactaccatctcccaggcgcttgctcatcgcactagtcgattgcttacatgctgtgttgaaagatcggttggtgtggtacgcgtatgtgtcgcaggggaaaacattggatcaacgctcgctcgctcgcacgtttctcgtaagaaaaaggtgaggtgtggcactggcaggaaagcggcgtatatatatatgttaggtggagctagctataaggaaagaacagctccatcttttcgtttatacctatacttatcagctaaaatttaaatttttaatcttaaatttaaagttgattttgagatttttttcatcggagtttatttttcagtctttgtttttatatcgctaagaacacatatataaaagttttattcacaaattatgtttcgtttgtaaatatgtcgtttgacttaataagccaaacgatgagaaccaaaattgtcgggaattatttaggttattattttttcgtggccgttttctagttccactgtgtgtttggtgtgggtaccgcgtgcagtgcgtgatgagacactacttcgcaagagttccatctttctgcccttttattttacacgcatatattttctgaaatgctgttatacagtactgttttttaaaagaaatacataaataatcactttaaaaaatcatattaaaacatttaaaaaattttaaactgatatttaattaattatgtgcaaatgagttagttagttttccatcctctgaggaacatcgttccatggactgggcccgatggcgagattaatttttttttctaggctgggatcgagacaagcaggaaaggttatcagcgtgtactcactaaacgcgaggttgattgcgtgatccatctttgcttagggcacccgtaatagttatctataagctctttataaaagatccatgtcaacatatttttctatttggaagagattaaataaagaaagagagtaaagctatttactaacctgaagatagtatatagagaaaaacgagataatggattagagaattgtagaaacccatgtagacatactattgagatgttttactattaatctagtctattgctaagatcatgttttataaagagcaccttactttaacactgcgggtgctcttagggcacccgcaatggttatctatagactctttacaagagatccatgttagcatatcttcctacttggaagagattaaatgaagagagagagagcgcaaaactatctactaatctggagatagtctatagagaaaaacgaggcaatgcattagagagctatagatacccatgtagacatactattgaggtggtttactattaatctagtctattgctgagatatacatgttttatagagagcaccttactttatcattgtgggtgctcttagcagctggagtattcactatccgcagtttgccaattcatatcttccatatagcgtggctgtgttcggattccgtggatgggaaataatctctcccgcacggaaaacggagcgatccattagtgcgtaattaattaagtattagataaatttcttttcaaaaaggattaatttgatttttaagcaacttttgtatagaaacttaaaaaaaatacaccatttagcaatttgaaaaacgtgcgcgcgaaaaaagatggagagtggttgggaaacttgggtgccgaacacacccataacgctgatcaccctctctctctctctcgtctcatctcaaacgcgtatgcgccgtggaccacatttccccttcctcaacagtcaccacacagatacacaatgcctccccccaggttctcctcctccagcaagtacgggcttcaattcgccagttatttccaaccatccatgaaattctcatcaaacaaacagagagaaaaaaaaacagaggagtaaaatggatgaatctaccgaagccattatgtgaaaatgatgctactctattccactttgcttctttttttcccgtaacagttccatcttcatcttcttataatgcctcctcttaaaatagccatcacggctccgctcggctagcacgattaaccgtccagacttaccgtcaaatgtttcattaaaattttaacagttaaaaggattaacaatataatttctataagaaatggttgatatagttaagttatgttcagatttaaaaatctttatgtcttcgcaactatctacaactaaccacactactagaaaacacatttttcccaacgtaagggtctttttttcgcaggcggacatgattcttataaccaaataaccgcctacaaaaatataaatcggggtgaagttcgctgtccacttaaacggcacctacgaaaatcattttcgctggcggactacttaagcggcacatgcgaaaatagattttcgcaggcgaaccttatgtgctccgactgcaaaaatcgtacatacccaaaaaaaaaaaccacccttattttcttctcccacccctcccaccactcaactctctgtctctctccctctccctccactgactcagtctcctctcctcttctctcctctccctcactggctctcct

SEQ ID NO: 59281 - DNA, 3694 bp, Oryza sativa
gctcccctcccctcccctctaagatccgaccggggaaggggggcgacgacggtacgacgatttttttttcgttcgtttttttgcattttggcaggcgggctgttgcctcgactgcgaaaatcatcgattttcacagtcgttgtattgcaggcggacctctctctcacctgcgaaaataagttttggccgcttgggaaaattggttttctagtagtgccacacatacggtcccaaccccgtaacgacgaagagaatacatatgtatggctataatatactgctctccgtgatcggaaccacgcaacccacgaatatgaattatatgattgagagtggatgaatcttgggccaaatctttgaccagtttcagagatcacacgaaggaaagaatatattgaaaccaatccaatatggatgacgaatccgattggaacggcaggaaagattggagccacggctattgagtattgaagctcgatcagtacgtcccctggttgtgaccttccttagataagagtgatatggggtctgtttgggggagcttataagatttgagacgcaactagttggtagccaatttctgagaatctgtaaaagctgggttttccagatagacccatgatatggtagcactgaactagtaggcagacgcacctggtttctactactactacaactacccaacatatcaacttgctttgtgctgatatcgtcgtgggcatacgggcgtatctaatatcctgatgacccagtggctaggcaggggatcaacgccgtcacacgcacgctacctgctttgctcaacggatccatccagacatcctgtgctgttaattccgcatgagagtgatctacatcgcgtgatatggggtaatttcttcctcctaaaatacaaaagagattttaactgggtagtatattttgaagtgtaaccataggatatatggtattgttttttatagaatcgagcaaagttctttcattcgccttaaaatgttttgattgataacattttgttagttttagggtgagtacgggacggcagttcattcgggatttgtatcccgtttgaatgggatgatacctctgagatatcgcccgatacgtagttaggggtggatagcgagccggctcgactcggctcggtcaagctcgttaggataacgagctggctcggctcggctcgtttgaaagctcgagctagctcgttaggctcgcgagccaacccatccaaaccatccagccggcagaagaggagggacctggcggctggcgatggtggtggtgggcggtggcttgctggcgcggcacgggcggagccctaagctgtgcgggtgcggtggcaaggtggggaggaagataccgacggaaagggaggagttggggtcgacttggaggtcccttggaggcgacgccgtggagaaggccacgcggcaagagaccccgaacgccgccgcgtcgtcttctcctcccgtcgccgcgcgagcgactgaagcttgtggtggaggagcttgaagcaactggagcttgtgcccgaaacgccgtcgcgtcgtcttcccctcccgccgcagatcacccagctccgtcagcgcagtgaggcggcggcagtggccctagcggctggtggtggcgaactggcgatgtgtcgtgtggtgcggccgtgccacgtgcggtggatgaggagtgaggagtaggaccgaggaggactagggttttgcttgcacttttgctgttgtctatttgtcttgggcttgggtctttcttttgtattgggctgggtctttgcggatgtctgatggagtcctagctcgttaaagctcgcgagctagctcgagctggttctttatctctaacgagctaaaatgccagctcaactcgttaggaaattcaaacgagccgagccgagcatgtcacgagtcgagcgagctaacgagccacgagctttctatccatccctatacgtggtaggtatcagctgatatcttgttcggacgggaaggtattacatgatacctatttggtatcggctaatacccaggtatcatcccgttcgaacgggataccgttctgtagcatttccataaatttaaaaataaatttatttgatttttaggaaacttatatagaaaacttttgcatgcatgaattgtattgtttaatgtagattacaaaacgtgctcatggagaataacaaatcaagtagccgtttcgagttgctattagaacttaaccgtagtgttgagctagtagtagatatactgcccgttcttaaattttttagatgatcaagtggattttggacaattgcatataacaaatatattatatattataaataacaagtagcgtaaaaaagttacctaaagcaacattgatgaagaaagtaaaaaagaaacgtcatttagaacggagttgcaaaaaaagatggcggcatattattgcgaaaaaaaatatatgtcggtttcttgacattctatagcccgggattcgtgctataaaacaatagtgaagcagcagcgagcggggaatgaaacccacgaccttaaaccatgtgtaccagggcagccagctcaatttttaacttacatacaatttacttttttttccagataatggaatataatcccggcctttgcttaaatagctacagccaattattacaccaattcaacaaaaactcatacctaaataaacaaaagcacacacaaactaataaaaactcacacaacataaaaaaatcacaaaaattttgaataattctatttgtgaatctacatccaaagttagcgagtagctgataaccattgacttaagattacgacatgcagctttcactgacttgatttcttcaacacactttagtagttgaacccaacatcagagctagtatgttgccttgaaaagaacctacatacaggatatagatggtgatttataaaaaccatatcatttctatacaatcatatagccctatttatagcagatgctccaacatacaattttacatataatgtgatgtaactacactatatttttactataattatatttggcatacatatttttggatatttccaatttaaagcatgacatatataaatgataatctatgaagtaaccacaagctaaaaaagaaaggtctgacgggatgatcacttgatcagctttctgtgtgctctcgtcaaagcatgataagcatatctcagaataatcagtcttttctctatgcgatagctacatcctctagagcctacgatctactagcttgttgaaaatatcaaacctcacaatcgaaggcagctgggtttcaagttaccatgggcgcttgtttggagacaaattgctaccgataatgcggcttgatgacactttgaataatggaacactgacagttatcttattctgtcatgcatatcacactaatcacttacacgtcaggagatatatataactggtctactggcttatattgtcttaccacttattgatgctgcgagctgaagctggtgactcggatacgccgtacgtagcaagcggttatccctccatgtgggctgaaacacgttttaatttgtatgacttttaaccttctaaattatttaaaaccttataaaaaattgtatgagctttctaccactactgcacaaacgattttcttggacagctacccttttaaattgcgtgcggacggtaa

SEQ ID NO: 59282 - DNA, 3220 bp, Oryza sativa
tttgatttttcttttgtttcatctttttattttcccatgcaagcggctgcccgcgtgcgggtgaggtacccgcatgcaaaaatcgcgattttcgcagacccttcattacagacgggcgaaacaaccgcacgtgaaaatgagtttcgaccgcacggaaaaatagttagtgtagtagtgtactatattgtttcctttacgaaacacaatacagacgcatacatcatataaatgtgtgtacactcacccatatataacacgcgcacacacatctgttgacattttagatcacgactacggtatttgcatgatatggggatcattggtaacatggtatatgcgagattgagataaaagaggcagagacaaggatttttatacaacttcgggccccttattcatcagaatcaggtaatagccctacttctattggccgaagccggtgttgctcttattcatcataatcaaacaagtacagcatttaggataacctatttagtcatcgttgacttggcggcatggaaaaccaacacgtagttgacgacggggtagtctttctccttgaatatgtactcgtcgagatcagagatagtgctaaattcctcttattggcctctgtaggcgccagattgggtatatctaggattatctctaatatcaatatttggaggcgtgcattggtgtccacgtcccctctcctcttatgaggtcttgtatttatacccatagatgtacccttgtccaagtagaactagggagaacaatatggatataatccgagtagtccttatagtttccaatagaactctttttgtaattttttatccggaactccttctatataagagatatgattccgtataagacttggtatatggtggtctcgccgagtttagtcgattactattgggtatgtgtgtatccataaccctgataacatcctacccctataaatgcctccaagaaccaggccctacgaacgcctacacgtacaccttaactttatgaggacatgccaatatattttgagattcatggagtcgccatggctgtaccttaaaaaatatagcagacatatcttgagattcgagagacattcgaggactagactgacataccttgagattcacgaagtcactatagataccttgttatcgacagatatatttacaactagtggtaaatgtaaacatccttgtcaagtctaaaatttaaatcatgatagcaggtttcatcatcagaaatctaacaagttgacactctcttgtagcaactattttaattccctttactttatgaattagtttgttaacaaagggtggggcatttattcaagtgaaatggccggtggttagtgaaagataaaaggatttttataatgactatacaaagttaattaaattaattaatataaacgagattagtctacctagaaaccttttaaaaaactgtttgttttcatacacgataacgtggaaaacatacttagggcttgctcagattgatgtcatttcaaatcatatcgttttttttagagttgtcaaatatgttcatccattattttctggccaaactttaataaatagataagaaatcctgctaaaattttagcaatttggcaatattgccaaaattttgtaaagtttattttagctacaatctgaacaaccacttagaaatcaatgaaactactcttttttttatcatatttcatatttgacctattttttttaaaaaaatcaacgattataacacatgggttcaaatttcttgaatggtggggaagcatcagtggtagttcaataattaagaatgtatgatccaaactaaaattaatatgtgattctacttcttatacagctactatataacgttttgaagtcctcactatcaacatgtgagataggcgcacaagtagggacggatctaaaaaaaatagtagtgaggctgaataaactacatcaatataaaccgaacctccagtcccatatcctatgaatctatggaaaaaaatttaatgggagcttaggaggatctccactgtcccgaggacggtagtccgcccccattgtgaatccgccgctgcgcacgaggaggtcaacataacttatttctttacaagaaaaaagaattgcaaaaggagtgagcaatgatttgtggcccgttgtccacgttgctgccgagtgtgaaaacaaaaccacaggggtagtacaatataaacaacacgtcagagatcagacacccacctttccacctccctcctctcctctcctatcgtccccacgcgcactccaacttgcgggcgatttgttttcccccgatttcctctcgtccgatccctccccatcacgaggccggagcgccaccccacactgcctccgctgctcccaaggtatccctcccctgccctgccctgccccctccacctccgccggatttctcagccggcgtagagcggagatccatcagtggtggctcggatttgttttttttttcctttttgggtggtgatttgactccaactttctcggaccgtgtcgagagctttgctccgatcttctttttgaatcgctttgggcgatctaagcgtagactgttctctctgtctagtccgcccattttgtttcggattggtttggttcgtgcctgcgtggtggtggtggtgggggtaggtgtggctatttgtttccaggagaattgggggtggttcggctgaatccccaagctctatgataggtggcgcccctgactggatgtccactaattcgcagtattcggatgcccgctaatttgttcgatggaatcacacaatgggtttttttacccactatcatgttgcttgttttggcacctggcaacgtttgttcttatcccttctgatttgtagactagagatccaaacattgtggttggtcagtggtcaccacacaaatatcaaagccctgtttttcaactcctccttgatcggtacagatttatgtctcctgctatttattaccaatacaaaaactacttcagtgattgtatttctctttgaactggtattacttcgggttaataagaagtatcatgtaatttttaggaattccaattcctgcttgataagaatcagtgattgtgctaaggctccagtgttgactgcaggtgattaaaaacacagaaaatggatggaactgttggctaacagtcgtcaaaatttatatggccataggtaatgcatatc

SEQ ID NO: 59283 - DNA, 2933 bp, Oryza sativa
tctgtagataattgtgcgatgtgtgtgggaggtaaaggtttctacctcaacagtaaggagacttccgacccttcaaggaaaaaccattccaaagtctctcagtatcggatggcatttgatgcaccaagaattactaaaacagagacatcaaagttgaagaacctcatttcagcatcattcaaacccttgtctcttaccatccccataggcgacggtttccatgaattgtttcctgtgggtcactgtcatttatagcagataaagtcttatagataagccaaagtttttcatttctgttggctaacaaggggaggcaaaaattgagttgcgctctcaagagtgtacaatgcttacacttgttggcacaagagattcttttgctcagtcacaggcacaactttgtgctggcatgcagctcaaggctccaacaagggcgaaatattcccaagcctttatgcccataggagaatccgacgcatactgtgctctaatacctggcttacctgaagatctcgcaaagatatgtcttgctcttgttcctcggagccagttccctgttatgggttcagtgtccaagaggtggatgtcattcctcgagagtaaggaattcattgctgtaaggaaagaggttgggaagcttgaggagtgggtgtatgtcctgactgctgatgctggatcaaaggggtcccattgggaagttttggggtgttcagggcaaaagcacagccctcttccacccatgcctgggccaaccaaagctggttttggtgtggttgttctagatggaaagcttttcgttattgctggctatgctgctgatcatgggaaggagtgtgtttctgatgaggtttaccgatacgattcttgcctaaacaggtattgttggcttttcataggcatcaataagtctatgcgcagacaatagattttgctaatttaaagacaatcattgcaatttgcgaagactttaaggcttatattaacatgctccttgtaatctgaatacaaacagtacttatttacagaccatgaaatgttcaaatgcaggataataaccagggttttgatatttcgaaatattggactgacccatttgtgttatttgtaggtgggttgagctttctaagatgaatgtggctcgttgtgactttgcttgtgcagaggtcaacggtatgatatatgttgctggtgggtttggtcccaatggtgatagtttatctagtgttgaagtttatgacgcagaacagaataagtggacattgattgagagccttcgccgtccaaggtggggctgctttgcgtgcagctttgaaggcaaattgtatgtcatgggcggtcgttcgcgcttcacaattggtaacacgcgttttgttgacgtgtacaatcctaatgacaactcctggggtgaggtgaagaatggttgtgtaatggtcacagcccatgctgttcttgacaaaaagctcttctgcatcgagtggaagaaccagaggtcactcgcagtcttcaacccggctgataattcttggcagaaagtcccagtgccactcacaggtagttctagtactcgtttttgtttcggcatacatgatgggaagctgctgctgttctctctggatgaagagccctgctataagacactgatgtatgatcccgctgcaccaacgggatcagagtggttcacatctgagctcaagccaccaggattatgtctgtgcagtgtgaccatcagagcctgatgctttctggcttgtatcgccttaccatcatccttgtaggatgccatccgataccactatttactgcttacaatcagagttgaactctcatttccagtgtcgtttgctcaggtattttgatatcaaataatgctccagggtgcttatgctgcattcattcgattgcagcgttgtgccaggatgcactttgtttcatgtattttactgctagttgtagttcacatggttgttgtcgttgtactggacgatgaatagctgataggctgatatgcaactgtagtgtttgtggcgggcaaagaggctaattgtcagaaaagatttgtcagctcttgctgtatgtaaaccttgttgtctgaaacattgtcattcgctatttctgatgctctgtttttccatatgaaaagtgggttcttgcttctgtttgcttgaggaatccttggacctcatttgaacgccttctgcatatcctctagcctttgaggatccaaatgactaactttcaattttttccatgggctgcttgtaccattcacgcaagtttactgctagtggagttcaataaaaataagttaaatttctttctgcaaaaaacaaaaagaacacccttcaagtgtgcagctgcagagcgtacaatacaatgatactgtaccatctacactctttctgtttgaatgaaaggtattagctgcctttgagctgctttattagtgtataaatcaaaaacgacttctattttatgaatcagagtatctctttcttcccaaagaagaaccctatatataaatgtgacagcatcatgcgttcttcgtgaaagcagataaccacgggccacaccaatttcagtaggcggacggttgaccatttctagcttctcaggcactgtaaccacgggccacaccatttcagtgatgccgtcccaataatctggctaatcagttccccgtttgaacatcaaatttggcacttcataaattcatagtagctacgtttgttcattcatcaaatagtaatactacaagtctaccgtagaattttgtaggaattgcagtaccttagcggtatatatttttcaatgatcgatctggtactaactgtggtagttttaataagcatttcggtttcaaacgtttcgaatgttagacagcacagatttttaacatcaaaagaaagaatgctctctccgagttgacctgtgct

SEQ ID NO: 59284 - DNA, 1266 bp, Oryza sativa
gggagcgtgtgctcatgcttctcgccggagcctcaaggccatgaagcgagagcttctggccgcggcccctacccatgaggcgacacggcgggcgcgatggtcggaggtggccctcaccttcgaccagaccgaccacccgccgtgcgttgcccggggaggacagatcgcgatgggggtttcccccactatttgcaatgtgaagttggggcatgtcctcatatacgggggtgcagctctcaacatcctttcccccgcagcctttgacgccatcaaggccccagggatggtgctccagccatcccagccgatcatcggtgtgacgccggggcacacttggccgctaggtcatatcgacctcccggtcaccttcggtggttccgccaacttccgcacggagcgggtgaacttcgatgtggcggatctcagtctgccctacaacgcggtcctggggagacccgcgttggtgaagttcatggcggcagtccactacgcctatctccagatgaagatgccgggccctggtggccccatcaccgtccatggcgacctccaagtcgcgcttgcttgtatggagcagcgcgcgaaccagctcgccgcggcgtccaagcccgagggtggcgacgagaggctcagcgcctccgtcccggccgccccgaggcaacggatgatcacgtgcgacgaggtcccggtcaagaaggttgccctgggtgacggcctgtctaagaccacatgaatcggtggtcttctgaacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtacggcggcaggccccggaacgtcaagccttcatccgcgaggaggtggcgcgacttctggaagccggattcatccgtgaggtcatccatccggagtggctggcgaacccggtcgtcgttcccaaggcgaacggcaagcttcggatgtgcattgactacaccgaccttaacaaggcatgtcttaaggacccttatcccttgccacgtatagatcagattgtcgactccaccgcggggtgcgaccttttgtgttttctagatgcatactctggttatcatcagattcgcatggctagggaggatgaggaaaaaactgcattcatcacccccataggaacttattgttatacgacaatgccgttcgggtt

SEQ ID NO: 59285 - DNA, 1030 bp, Oryza sativa
  unsure (1)..(1030): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaccacgtacgatgaagaaccagtcaaagtcaaaggagccacgcagacgtcaagtcagccaaaaccaggtacaatattattgaaggacctcttttacacggtttattaagttggaggatgttttatatctagttgagagatatatttaagactgagacccaagaagaatagaagaagacgcaacatgggtagggggcaacacgccggccggccactgctggtggtagtggagcagtggtcgtcggtccactgtacacgaccttggggcatggctcccccggccgtccaactccaaccccaaccccaaaagataaaaaatcatcgccactgttgagcgttgagctcgccttctcagtccaccaccagtgcgaccggtcggacacgcgacccgacccgacccgacgattcggcgatccaagccagccaacaccaagcactagcacactagcagtcaaagcagagaaggcaactaggcaaagcagcgtaacacccaagttacctccgctcccctccccaccgaatccccccgattggtcggcgatgtcggcggggcccccgcctccccccccggagtccccggtcgccgccgccgccggcggaggcgacaaggtgctcgccgcggcgcagcacattttcaagtcgctggcgacatccaagaacgccgccgacgacatgatccgcatcctctcgggcttcgacaaccgcctctcccagatcacctccgacctcttcccctcccccgacctcgccgctgactccgacgaacgggggaaccccctgtgggggcagatctcggccgcggccttagacgccgccgagcagctcatccaggtctgggacggcaccccggaggcgctcgtcttctaggcc

SEQ ID NO: 59286 - DNA, 3479 bp, Oryza sativa
tatatgattggtactccctccatccaaagaaaaaaaaagccaaccatgtgtcctcttctatttactacgaatctagacaaagggctgtctagattcattgtattagtagggatctcctcctaggttggttttttttgaacggagggagtaactctctatttatatctcttccttattaacttttgtttcttttcttatctacttgtatgtcttaatttggccggtatttttttcaaagatttaagtacataatcagtcctcttgacctagttactatgtactagaaagattatagtgtaagatttaaaattaatagtataagttttcaaaattataccatacatatttgaaataacaatatatatataaggtacaaattatacaatgtgaacacatgttgcaaaattttgatcccgacccttttgtgaaacatataatttggcatgtgaatatatatgtagaaaaacaattacgatgcacaatgagcggatgagctggtcggggcacgcgtcggggtcctgcctctgcaccgagaggagcacgccgatcatggtccgccggctcgccgccggctgcgcacggtcgccgccctgctcctgctccatctccttcctctcgtcgttgatcagcccctgcaggaacctcgttcggctcttgcgcagccggcacaggcggcggcccaccccttccacgttcacccaccggagcgccgccggcaggaagtcccacaccgtcgacgcgccggtcagcgccatcgtctccttcaccatcttcctgaaccacctcgcctccttgctcaccttgccgtcgtcgtcgctacacaaggcttacaaataagtgacaggtagaataagatagccatggtgaccatggtgatcatggcgatcgccgatcgatctttagcttactcgccgtagtacgtcttgtcgcagatcatggccatcatggtgttcatgagcagctcgaacagccgcgacttgagcttcactcgtacgcgcgccggcccggcgacgccatggcggaccgccgcgcggtgaaggtggcgcgccatggcgcgcgccttccggacatggacgtcggcgaagtgctgcacccgtcgcgcggacaggatctcggtgacggcgacgcggcggacgtggcgccagtagggcccgtagctggcggtgcccatggtggaccagtcgtacgacaggatccttgccgacggcagccgcgggcggtcagcgaacgcgacgtcgtgcgcgccgaggcactcctccgcggcgggcgccgaggacacgacggcgacgcggcggggcccgaggcggaggccgaacacggcgcccccgtggcgcgcgcgaggcgcgccagggtgcggtggagcggctttcttgagaggtgcaggtggccgacgagcgggaggcccgcgggctccggcggcggcggcggcacgttcccggcgcgacgctgcgtcccgcttcgtcgtactcgggcggtctccataagcgcgatcagcagaaggaggaagagggcaatgaggagggcgtccatggcggcgaggtgaactcgacgagcatgtcagtgacagtgtacatatatatgcttccgccactggtgtatatcgctttgctgaaatgcaggcttctggaaatctcaagtataatcaagtggtactagcaagttggatcaccaaactactaattcgtcaaacataacacgggacgcccaattgcccaattgcaattgtgcaagtgccaaagcgtgtgtcttggttttctcgaaaatgctatacgtccaacgatcgggtacgacaagggtacggctaggtcggccaagcgtacggttaagtcattggccgtctgccgtccgtaacttctgcaacgatcgctaattcaattgggtttacaccgtgtatttcgccgttgagtcgtacgctggtcgtacacgtccgtcggatgtatagcagagttgttgttttcttcgctaatcaaaaggtgtcgtgcacaatgtgtgccataacaaattttttttgttttattacttagttaattacagggcagcttgcattgtgattcagtactctctccaatcacaaatgcaacacgttttttgcatgataaaatctttgaaactttcatttattattcctactccctccatttcatattattaattgtttggcttttttcctagttaagtttgacaaagtttatagaacaatttagcaatatttaaaataccgagctagtttcaaaaaatttatcattgaatatattttgataatatatttgttttgtgttgaaaatacttatatatttttctatagacttggttaaacttgactaggaaaaaagtcaaatgacttataatatgaaacaaagagagtacatgtttttgaaagtttgttctctgttcttatgttcttatgagtagtccaccacaagagtgttcttatttatggcttttgagacgaagagatggacttactttcattcttgtttgtaacaaaaacaatcctatcatttgtgaagcaataccttatcatgccagttggatcaacgatcacaacacatttcgatattgcgctataactaacaaagcctaagaaagaagatgcatcactgaagcacgaggttgatagaaggcctccaaaggcaccttcttgggcatggtaaggccagatccttcagtcatgtccaccagctcctctccaactctttcccactcaaagcactgaatcattgtcccaaggccaaggcctaccatttgcatgcccaagttctctgcagggcatttgcgtctccccatgccaaatgggattgccatctttccttcacttcgcccatcctcaaatctgtagaaacataaatgtacgtaattacactttatataacatggacattcatgcaatagtataaaatttttggaagaatccatatgtagtacctttctgggatgaagcttgttggttcatcccatatatgaggatccctgtgaatatcaaatgtgttcacaagaagcattgtcccccgtggaatatggaaaccagcaacagtgcaatcagaggatgattcatgagggacaagaagtggcgccggtgggtataggcgaagcgtctccatgatgatgcatcgaaggtattgtagcttcgggaggtcatctgcctctagtaatcgtactggctgcccgatgaatgcatcgatttcatcacgagcttttctcatcacatcgggattgtttagtagcagagacattgcccactcaattgtatcggttgaggtacccgttccggcttcaagcgaactcttgagaaaataaaaaaaggggaaagtataattatatgtaaacaaaacatggattgtgggttcacataaatctcattcctaagtagggttcacaatttccccgcaaaaaaaaagtagggttcacaattttggttcaaaatttgtgaattttagtttgtgtctacacgtgggttgtgggtcccaatatgatgttct

SEQ ID NO: 59287 - DNA, 1756 bp, Oryza sativa
  unsure (1)..(1756): unsure at all n locations
aaagtattgtcaaatatagcaaaaaagacctattcaaagtcaggaaaaaagatgtgttcaaaattcaaaatgttttctttaaaatttctgagagttttcctaaataacaataattgtttgtgtgatgcatcagtacaagctcgtgaagagaagaaccctatcacaagtccatttgcaagtctgattggtagacgaacacaacgagcggcgactggtgcgggtgatctcggcgttagccacatgcgcagtcaacctcctcctgccaccctctctcacactgagccggcctcatgcctctttcactgatagcctcgcctgctccttcactcggctacagaggataatgggatgggagagaggaagagggtcgtgggagagggaaggagaaagaacttgataaaggatgacatgtggatcttatgggatatcttttatcttaatgactaggagaccacgtaagcgagaggtgactaaaactgtccgaggttatgttgagagatctaaaataaactatttgaatagttgatgggatgtgtagtgttctgttttgggtggatctagctttgggccagaggaagggctcattgcctttttcctagctcctccaaccccctactctcatttctctccccggggtaggaggaactcgagtccccctacatccacactggatccaaccctggtttgaagtgtgtggtggttttagactttctctaaagcttagggtgtgaaatagacttctaccattaaaaacgatataaaagtttgaattcatgagttggaaattagggttcccatggaaattcaaaatttttactagaaaagtttagaaagttcgagctgaaagtttgagtggtattgttgaaagttttacagtagattgctaaaggtaaaaaactcactgctcaattatccacagaaaataaaaaaacaatccctctatttatgtgttagcgatgctaaaaattaaggctgtcaaaagagaaactctaggctcgtgagccacttgagctcagctcattcaggcccagttcgggctcagctaaaacttcaaacaagcttaactttatatgacttacgctatttatttagcttgtttatttgttaattaaactaataggtaaaatatgtattagtactccctccgtttctaaatatttaacaccattgacttttttaaatatgtttgaccatacgtcttattcaaaaaataattaattattaatttttttcctatcatttgattcattgttaaatataatttatgtatacatatagttttacatatttcacaaaattttttttaataagacgaacagtttaacatgtgctaaaaagtcaacggtgtcaaatatttagaaacggaggaagtatatatgtacataatgattcagtttgtgttcgtaccatttttttattgatatgattagaaaaataattaattttatgaaaagcattcttaaaatatatgttatacacttatatactatatactacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59288 - DNA, 2861 bp, Oryza sativa
ccgtagtaggtcttgtcgcatatcatggccatcatggtgttcatgagcagctcgagcatttgtgacttgagctccacccgcacgcgccctgcagccgccccggtgccgtggcgctggcgcgacgcctcgcggcagaggcgtcgcgccgtggcgcgcgcctcgcgggcgtgggcgccggcgaactgccgcacccggtgcgcggagaggatctcggcgacggcgacgcggcggacgtggcgccagtagggcccgtaggcggcggtgcccatggtggaccagccgtaggacaggatcccggccgacggcaggcgggggcggccggcgaacgcgacgtcgtgcgcgccgaggcactcctcggcggcgggcgcggacgacacgacgacggtgacgcggcgggatcccaggcggaggcggaacacggcgccgtggcgggcggcgaggcgcgccagggtgcggtggagcggcttcctgaagaggtgcaggtggccgacgagcgggaggcccggtggctccggcggcagccgcagccgcagcctcccgcttcgccggcgtcgtgcggtcagcagcagcagaaggagcacgagcgtgagacctatgagaagagtggaggtgtccatggatctgggaactgacgattattgtagcagttgcagttgcagatgcggcaattttttcagccatgcagacacatcgtgcacaacccgccagacgaccccatgtggtgacctgccactaccggcttgattagaccagcctagcagcaaggcccaatgtccaatgggcaatgtggaccatgttctggttctaattttgtttatttctatttttttttaatttaaatagaaaaaatatccgtgcgttgcaacgggtgaagactattttaattgtattattgttagatttttttttgtctaaaaagtatatgggatttttattttgatatgatatccaattcgaaacccttgtttttttaaaagcaaacgaattttaaaaccaacttaaatacggacaacatactaaaactatcagcggaaacaacttcacagcggaaacaacttcagttttaataataaatcacttaatcctaaatggccgaacggaatcatatgttgaaaaaattatgttaaaaagaatcatgtgtagatgaatccttcacaaaataaacggacatgcatgcaagccacccatacaaaaattagtatgtttttcatttgcatgtgtacaaaattattgaaataacacaaacaaatctgtaataaatagtatgtaacatatgcttagaagataggcaatatttttcactgagacagctcgaaataggaagacagattgtgatagacgttgggcccttttacaattttaggcccatatgtgcaaaaacgtattggatgtgcagagaaaaaaaaaaaggaaacgtgaatatggtcaaaatgctaaaaacatatatgaatcggaacaagacggcttgttggaatgaagggacggcggacgaaaattcgatgagtataaaattatcttcaatttttataataggtaaaggttacgacggaaacattttgttctcttttgaagcatttttttgtttttttttgccttttattattttggatggatttttttcacggactggtggactgccttttttattgttgcatacaaaacaaatctttattttttgtttttttgaaggaacgaactttttttcgccgctctgggggaatcagacttttcttctgggggactttttcactcttttttaattttttttacggatggtttttcacctttcttagttcttacgaggaatcggacacgttttctttttaaggcggcccaattaattcgctcagatggaaacattaaattaaaacctatttaaacacgggtgacctactaaaatctcgataaaaacaccttaaatttttataatagtagagatagagataaagaagagatagagatatatggtttagttaagatgaaacacattgtgttaaattcgtttggatatatattttgttagaaaattatgagttgtaattagagtccaatcatctcaagttaacctgcgagttttttaaacagatttcttttacgattccttatatatttacaaaagcaaacgaacttaaaatcaactcaaatatgaatttgtatttataaaggcaaacgaatttaaaaccgactcatacacggatgacgtaccaaagtaccggcaaaaacctctttaatttttataatagtagagatttagagttttttcatctcatctctgaaatttcttttccctaacatttatttccttgttcatttttccttttagcgttcactcctacgcttggatatataatcctcatgtaccttgagatattacgtactccatctatcccaaaatatgagcagttttagctctaaatttaaacaataatatatttataggtaaaagttattatattttaggacgggcttagtagtcatggtcgatcataattgataagaagtactatcattaaaaatttacacatatcatcattggtatctaacagatatcattgttgataaattgatatttatcatcaccggtacctcacgtgtatcatcagtagtacgtacatgtatcatcgtatattcattggtgtttacatgtatcattaccagtacttcgcaagaatcattactgattcctacatttagagcgtccccagcagatctttcatccggtactccatccgaaatatagcgcatgagaggagaaaacggcgctccagcagatacggtatcaaggcctcaaaaaatagaggatgcaccaaatcagggagagttcggccaaatatggcgattctctctcctcacgccaaacc

SEQ ID NO: 59289 - DNA, 2177 bp, Oryza sativa
ccaagcctagttccgatccatcacggatatactcccatgcctcagcaacacttgcacatgaacacaactaaactccatatcggagtacaagttcgcactacttgactcacatcagcacataatagcatcacatacaaaaagaaaccaactagaaatcatatccatgaagcaatctagaaatcccacgagaacaacccgaaattgattcccacctagagtctgccggtctaaccgtcgggcaacacgatcagatcgctccaacactaccggtctaaccggcggcacctgcccggtctaatcggccacacaaagtcgagaaacgaaaacactattcaccttatttttataaaataattacttttgacaattgttcatcaccatgattaaatcattacatgactctacaatccctccgtgatgaacacattggcaaaatcctcaaaatgcaatttggtgtttttaaaaaatgaaaaacaaaaacaaataaaaaaaacacaaacaactcaaaaatcacaaaagcaaaaaagaaaaactctctcctttttcaaaagaaagaatttcttcccatattggcaaacaaagcacaaaatcgactattttttaaaagcaaaacaattcaaatccccccggtgacttggtaacaaaaaaaaattcaaatctccccctttgaaagcatgcattttgtatatttctccccctttgacaatgatttcatcatgcatttgcattttaattagtaatgttcaagagcttagcatcatacatagagcaattcatgttatgtgttgtaatagaaagaagatgaacccatcaattaaatagcaggcatgcactagagtataatcatgaatcaaagatattactatcaagttcaaatcaacaatcaatattcataatttcaaataatttataatgcaatatattcacaagcacataggtttaaaagtcaagcctacacatatctttctcaatattagctctagcacaaaacaaccaatagaatttgtaacatttatttgagcctttttgttttactcatttttttctctcatttattctggaaacgtccttgtcatcaagactatttttgaggattcggcacccattattttcgctcacatcgaatacgtccttgttgtcaagactgtttccaaggattcagtattcattttttttctctcatagaaattattttattctcttgcacgatgagaaaataaagagcaatttgaggaataacaattcaacaatcatatacataagcattcatcatccaaactatgtactagcttcaacattgcatttttttcttaattcaagtaaaagaattagtgccatgcaccatctcacttaaaagcaatatctaagcctcataaaaacactaaaatgcatacacaagaatatacaaaatacatggcaaaatattatgaaccttcataatattgctagcatgcacaagaatatacaaaatgcataagacaaagctctccttttcttaattttttttgttattttcagatttgcttgataacaccaagagcaaccccccctctcaaattaaccttcaattttccccggacaaaaatcaagaaggaacaaagcttttgaaaaagacacccaattgccaacaatatcaccaaggttctcatgaattgatatgtatctacttgtattaaccaaaactactacctcaaacactagcatacgaaaagctaataatcaagagagtagaacaatattaatattatgtcattccaaaattattttgatgttacctcgaaaaacaatcatcttcacaacgttgaacgcatatggagagtatgccgccaaaatacctacaaagaggaagatgtcgaggcctgtgtgttggggttaatcataagaaattttggaatacaacattaagtcacacgactggtagaaccaatagatacatatgcacacacaaaatcagaaccagacttacctgaaaacttaccttgtctcttcacaaaagtctaatttgaattatgcgcaaaactcccccgaggccagtctgatcgccgttgtacctgcagtctgaccgggcttggctaccggtctgaccaccggttcacctgtggtctgaccgagcatcgcatatgaaaagaaaccatctagaagttatatccataaagcaatctagaaatcccacgaat

SEQ ID NO: 59290 - DNA, 709 bp, Oryza sativa
tagctccacaaggtggtgggctaaacgacctgggttcgaagcctcaccccttctaattactaattatttgatattaggtcattctctaatgttcacatctttttaatggtaatgatcaccaatgatacaaaatataagtttcatcacaagagaaacctagaaaatttcatagaaaaaaaccttacaagaaaacataatcaaaactagtgttgtggaagacggaatgcggatgttggacagagtgggtaccgccaaacgattaatcggaatacggacgattaatcggaatttgacggaaatttaacggttgtgaatatgtaaatattgttatgcatattgtagactcatatattggaaattcactacatatataatatgctacaattaggaaaaggtgaaaaccatgagagctattatacagatatagaaatctgtctagtattagtgcattggaaaaatattttgcatggattatcttatgttcttcagagagaaactttaggcgtgcacatcctagaccaggttgcagcggcatcagatactctagaggaattcacgtactggtatagctagctttatactcctactagagaaaacaacaaatgggatagggtagtcgttgtgggttggttcagccttttgatcaggccaattatgcggccgattagacacaacggggaagattaatcggcaatgacgagattttttt

SEQ ID NO: 59291 - DNA, 3320 bp, Oryza sativa
gctgtggtggcggcatacgggtgctacagtggcggcatgtgagagtggcggacgaaagggcttcggcaacgacagtgcacgggtgcagaaatggcggcatgcaggagttgcagcgacgcgtaggtgcggcaccgacgacgacacgcgagtgagtgctcccgcggcggcgcgtaggagctgctcagctgcagcagcgacggcatgcgggagatggccatcgagctccatctggttagcctcctgggttttttttttttaagcctgcggggataccttaactacgttttgtgtttttcttggatatttgtacagtttgagattgatctactatctacttctacttatatatatatattactacttaaaattaaaatttttaagaaacgtttccttcgtccctttaataaataaaaaaaccgaaaaaaaaaaacaaaacagaaagagtccgattccccttggaaaaaaaagatcggatcccttaaaagggaaaaaatgtccgagaaaaaataccgtttaaataaaaaaaagcgaaaaaacataaaaaaaaatccgactcccccgatggaaaataaaaaggagagaaaaaacaaaaaaaaagaagagaaaaaaatctgtcgcaaaaaaaaagaaaaataaaagggcgttcgagtcttaaaaaagtccgactccccgactccccgttgagaaaaagaaggcgacaaaaaaaaggaaaaaaaacttaaccctaaaaaaagaaaaaaaaacgtccgactccttaaaaaaagtccgactccctcgaaaaagacttctcgaaaaattgaaaatatttttgccggtattttggtacgtcatctgtatatgggtcggtttttaaatgttcgcttttggactggtactttggtacgtcatccgtatatgggtcagttttaaattcgttcgcttttggaaatacaaatccgcaattgagttagtttttaatttcgttcgcttttgaaaatatagaaggaatcgtataagaattctctttaaaagaactcacatgctaatttgagacgatcggactcctaattgcagctcatgattttcaagatgtttttgccggtaccttggtacgtcatccgtgtatgggttggtttttaaattcgctcgcttttaaaaatacaaaaggagtcatataagaaatctctttaaaaaattcgcatgctaatttgagacgttcggactcctaattacagttcatgatttccaagatgtttttgatggtactttggtacgtcatcgtgtatgggttagtttttaaattcttccgcttttagaaatacaattccatatttgagttagtttttgaattcgttcgcttttgaaaatacagaaggaatcatataagaaatctctttaaaaaactcgcatactaatttaatacgatcggactcctaattgctgcttatgattttctaacaaaatatatatccaagcgaatttaacacagtgaatttcattttaactaaaccatataacaataataagattaaaatagtcttcacccgttgcaacacacggatactacttaaaaaataagaggtgcttccatcgtccgtctaaataaaaaatagaaaaaaacctaaaataaaaaagtccgattccccataagaaagtggcgaaaataaaaaaaaactaccgtatccgattcccatctaattttgttcgttttctttttttttgtttttttccgttttattttctttcacccattttccggttttctttgtccgttttcttttcccctttttgcatattttcttttcaccgttttttctttcaccaatttttctgtttatttcttttatcgctatatttttttttgcggttttttcatcgggccaaacccagcgttgccgccacgttgattttcctcctcatatgcttactcctcctacttactgcaataaccgatttcccactactctctcattattttccctatgaattctcctttcgattcagctttaattcaccagattgaatctccatttaatcatccttatttttttatctcaagttttgcagattgcttcgattttgatgaaccatttaatcgtcgtcattttttatcccgagttttgctgattgctttaattttgataaaaaaaagggaaaagcgagatcaagtggataaaaatccctcaataattttggatatggagaaagattcgaccggatttgatggagaggatcagcttcgttagtcatcgtacgggtacggaactatgcgagctcgagcggattaccgtatttgatgggaggatcggctctgtcatggtataagactatgggagctcgagcggattaccggatttgatgggaggatcggctttataatggtacggacacgatactgttcgacttgggcctacaactccatttgtggactgagccacagagagatagaccgagcagagggagatagcagactatactaggactagaggtgaaaaggacggaaggaatgtgcgttcgtttggtccaaaacgcatgggcattaaagggagtatagtgcgtaggataaaatatatttttacctattgcaacgcacgggtattttttctagataaaacgctaaattgatggacgcttgagtcagataggatccatcgattttttgccatctattacacggcttttatttcgtcatatattctcatgtattgggaaaaaaagcaaaaaaagaaaattaaaaaaacaagcaaaaaatgcgtgagaaaagaaaagcaaaaaagggagaaaaatatggtttttgtcgtcagtaaaaaaaataaaaaaaaaacatgctagaaagaaactgttagaaagaaatgcgccgtttataaaaaaataagccgctcattaaaatacaaacattatcattgacatgattatgcatgaaaaacgtatattatcattagaatttattcacccgttgcaacgcatggatatttttgctagtgttgtaaaaaatttatcaaatctgtgaataagttaactttgtcaaaaatatatcaaatttatgtcaaaattatcgaaatttatcaaacgtatgttaaatttatcaaacccatatcaaaatttctcaaatataacaccgctttgtcaaacctggataaataaacaaaaataataaaagtagggtcaaatgagcaagggcataaacaatatttttgtcatgaacaacgccggtagattgccttcagagaatagggtcaagtctgatctttattatttttggaaaagagggtcaaatgaacaaacttaaaaaaacaaggccatcaaaacagggtaaaaacacaattccccccccccccccc

SEQ ID NO: 59292 - DNA, 14815 bp, Oryza sativa
tagtactgttttgcttactaaattataatactctccgtgtccttagccaaacttgtttagttttgactaagtttatagaaaactttagcaatatctataaaaccaaattagttttactaaatgtaatattgaatatgttttaataatatgtttgttttgtgttggaaatatgataatttttttataaacttgatcaaacccataaaagactaaacagaggaaagaagtgggaagtaaagagaatttttccaaaggatttaaatactccaaattttctatgtttttcatttaaaaactgtggaagagagtggagcgacattgtatggagagagaaggtaggtgtacattttttttaattcatgtaggtgccttaagcttaagagatctaccttaaggcgggcttaccttctattgtcaacattgaagatgccataaggccttcaaaatacaaattaacctataacttggctctgaaatactatgccagatcgagcaacagatttggaaatatgcaacagatttggaaatatatggacataattcgaagacatggagattggtagacatactcatttttaactagtaccctgtaatccccctactgactccctctactggagcatgcccaagcagcatcaggacccaacagtagctaggctacaatcagcttgaaaattgcatacgatggaactgttcatgcacgaagctgactcgagtcctgtcaaactaagttgcagaaaaattaggaaaaagcttaaagttcatgtgggtatttatgttttattgctttaatcgttggaagaaatatattgggaaattctttccaagatccttccatctcgtgcaatctggcgaccagaagtgagcgcagtgaaagatcattcgctcaatatcaatatttctgtgcatttgtgcttcaagcaaaggtgaaacagagaggttcaagtgtacatggaaattctatacgatttaaaggactccaaagaaaggattagtgatagcagaattcagctcggctccagcagtgttcaggacggccttgtcaaccttgtcccttgccaagaacaagaactcgttgccttcaagtttctcaaatccacagagctggagaaactctatgcctccatgcagattgccaaccctctcctgcattgtaccgaaacagattataagtagcgtgttgttcttgaaagataacagcggatcattttaccaggtcaatatgtacagtaattattttcacctgaaatgtagcgttggtcagtctgatcttcctgaatttctcctcgtcaggatttttagctacattgccaatgtaggtaaggagtgtttgaaaagccctcttcactttagcatcgtcatcctgttgcaaaaacggcccataattgggtcaaattgaataccaaacatataatatgattatatcagcattgaatgattccactctaaaactacagggagaacacaatttttggtatagtttcaacaaacaatagaattctcaagtctttacagttgcatctgtattcacatgcaatgaaggatatgtgtcaatctgcctgacaaatatgagtaacatagaagatgatttcaagttaaaactacatgctaccttgttctgctgcttaagatttcttaagcaatccctcatgcgctcggcctttgtggctggcctgacaggtaatgccctctggaaatccatagaacagagttagatggcaataatgatttcaaaacattgtttatttatacaatctgcaattatattctttggcctactaagttcggatttaaaggcctctacaaaagctgttccaacaagaaatccattgactgatgtaaggcataagatctgaatgtttcctgagaaattcagaatcagataaaatttttgctcgcattcatctcagcgatttggttcagttaggcaattcaggttctcaagaccagtacagggtgcaagttcaaactggcagtaggttggtctaaatgactaaatttggatcaactgctaattatgaaaggaaattcggatcaactgctaattacgataggtgtaccttcttctcttcaaccggaggtggtgcgcttggtttaggagcagctggatcttccgggggcaatccaagtttccttctcctttcagcctggtaattagaaagaaataattgaggtctaattgccagagtgtgacacttacatgacaaccatacaaatatccccaggttatgtcgaagcaaatatgtaacgccagaaattcttatataaataatagaagaaatgatgagatggagaagatggaaaccttgtcctcttccagtttctgacggattttttctctagctcttttctcctcttctttctcaagtcttcgcagttctatcatgctgcaggtggtggtaaaaacagtcaaggggtggagaacagaatactactagtcaaaatacagaaaaatcaaaaggggaacaaagaaccaaccgtttcctttcattatcctcctcaattcttttggcttcaagaagctctttaccgatccgaatcctttcctaaaaatgtctaatatgtaagataaaatactggcaaaaaatgaacagaaatatatgccacatataatgtaaggaacaataatatgctattaattgtaatattggaaaaagatccaccaaaattataatattgcaaaggtgtaactggaaaatgccaagatcacatcacatcaaacataaaactggaatttgaggggaacaaccaatgattttcatgctttggtattagtgctcatcattatcttcaaatgaagggcatagcgtaatttgtacttgttgtctagtagaacggagacaaatgagagaaaattttcatctttgatatcaactctcatcagtattttcagatgaaaaatatagtataatttgcacttcttatccagcagcttatatcaaaataggggacagtaggctgaagtccctgtaaagacatgataacgtgacaaaagaaaacagcagataccatctataccttcaactctacatattacagcaacaaatttaagactagctcagtacttcagacataattgcacttccaagtaatcttatgcagatttcttcatacaaattgacaaatttgagatgagatttcatgaaacaaaatcaataagttccagcaaactatttgtgttatgttattgtacaagattgctggcaggtggaatcaaagttacatgaaaatacatcataaagggctattgattgtaatgactaagcataatgcatgtcttttttggatatgctgtgcaagatactgactaaaaacacatctaactgcacagaagaaaccagatatataaatgtgctgcaggtaatcttgattcatacatttctaaatacattaaataaggtaaaaagaagttgagaacaaaccttctccctttctctttccatccttctctcttcttcttctttctttttacgagcacgttccctacaaatcgagtgagtaaactcaatagtttagtaacaaaaagttaaaatcagaatcataacgccagatctgtggttgttccagtgttaatatgacaaacggagagcaaatattgaacaaagttcctgtttaaggcggtacgataaaaaagtgcacaatctgcatattgggggttatcatgtgcaaagaaaatacgtagggaatgtaataaaagtatagaacttcagggattaaatatgagaattctattgtcatttatattgagtttcaagtccaataaaaattatcatttttaaagcagtgaaaaaaattgtcgtaccaatgcatgcgattacaaagcccaaccacatacgacaaagcatacaagtacttaaatgtcaattgaactgatttcaacgaggaaaaggtagtgctacagacagacacaagtcaatgcaattttctgaagatatatataaaaccatcaactcattaaagataataagaaagcaataagttcatgaacacaccttaattcctgagctttaatcttcatttcctcaggagacaaagagggtttattagcctcagttattgtattagccggtacctgagagatgaaagaaggtaagtgtaaagttatgtactggagagcaaaaattttctggacaagtataggtataacacagaaagaattcatctattactcccattggacacaattaattgaacctctgaagtgggaggttagatatattcaaatgtgcaagtttggtcctagatacatgggcatacgcaggggaaaaaaaaccaaaatggacaacctatgccaatttttcaaatgtttgaaatgcgttttcattgttacagtaaatacattgagctgcacaaataataaataaatatagtaaaagttttgggtattactgaaactccatggatagaatgtcagaggtcagacagtgcaattcagtgtagcactacacaagcacgatgaaaataataccaaaataaccacttaatatccaaaacatattattttttcagcaaggggcaatttagcacaccagcataccaaaacaaataaaggtataatcaattaatcagcaacaaaaaatataaattcatcataccagaagcggttcgtcaatatctggatcttcttggtgctcggaaagccagttaatggcaccttcaatagtgctattacctagaggaaaattaaatgggtgcaaacaaagttatgaattaatcatggtttgcttactgaaggtgttatgtttatttaactaatatagatgagacaatcataatatataagtaagactgcaaaacgtagtcttattgacttctggtccactgagacagttttgtccaaaagcacagcaaatagttcagctttcaatgcatatataatgccttgttttttctgtcatattgtaaatttcggtccacaggcactacaatgcagaatgtatgtctaattttgcactcataatgtatcttgttgcaatgcacaagcactagcattatttgatctgcaagactcaatagcaaagcatatactttccaatcgaggtcgttcctttattcaccatatgctgaaatccttggtccagaatttactgtgataaaaagccttctagccgagactttcttagatcaaagtctcaaatagctcagtcgcacgagcgaacatatatacacttgaacagttaatacttttctactgcatctgcagtctactcctctgtcccataaaaaaccgaatcttagggatgaatctggacactaagattcggttttttatgggaaggagggagtactctagtaataatttgctaataaataaaatctaagttggagaaagaacttgacagcatggtacaaatgttgaactaagacatactatcttgctacaccataccagaaaaatgaagtgccctagtggcacgcgccgtcgtgaaccccatcgcctcgaggtccgccagcatctccttgttaacctccggcgccaccatctctgccggaagcaaaaagccaccaagattcaacactctttgccacccaaaggcggccacagatcataaccctttctatcatctcaacaacaaccacctcaccttgtggctcggcgcttgccgaggcatcgacatccatggcctcgccggccggcttcggcggcgccgcctcgagatcaattggcttggccgcctccatggtcttgtcagtgaactccgtgtggcccgtgcgcttggtgtgcaggtccacctcctgcgccgcgcaagatcagagatccacacaaccaaccaggtgagactaaaatcggatcgagaaccaccgaatccggcggaattcgatcgagaaagtgaaaaccaaagggaaggtggggagggggatggggggatctcacggtctgggagcggcagggcttgccgcaggcggcgcagactaggttgaggacggcctcggtggactcggagaagttggcgtggttggtggcctcggcgtgcgcctgcgcctcctccacgctccgcagcagcacgccgcagtcgccgcaccgcagcgacagccccgccattgccggcgggcggcggcaaagagggaggtgcttttgcttcgccgcggcggcgaggtttagacggagagagggggattccgctcgcggcggcggcgagaagacgaggagacgagaccaagtcgctcaggtagtccagatcaggtaattattaagcggaattttttatatttcttatagagaggaaattaattaacctgatttgttacggagtatacgtatgtacgtactgtattccgaacgggaagggctcatcttctcctcggattgaaggatctggtttattgatcaacggttgggattactgtttttaataagaaacatgatataaatcatgtatgcgctcacaatatacgtacactcaaccttataaacgcacgtaactatatttttttatactaaaaagagatcgatatatctagaaaatgttgaatttagtaagtttgatttcagtgttgacataaagtcacaatcatggtaatgaacacccaaatttcatggataatatttttttccttgtccaaaatttattacaggtttgttaagattgtactagtataaatggacaacaatatgatcatgcatttggctaaaaaggttatgcttttgatcagttccttgcaacaagttaagaatattccataccttttacagtgtttttttccttattctacgttgtgagagataggagtatttgatatgttttgcttcgtgtgaacaccttttagctagtgcttgggtgttttttttaaaagaaaggcaaaagctttgcctcgcctcagagctagtgcttggttggggcacaagaagaaattgaattagcatatttctgaaaagcaaaaatggattatcagcttgtttggtttattagatgacttgaaaaaaaatacacgtatgtagcaacgagtgaaggctaatttaatcatattattgttgaacggtttaactaaggtaaaattcacggtgggaactgcaattataagtttgatcatgtcaagttagtatgcaagtttataaaagagatttcttatacgtctccttctccttctttatttgtaaaagcgaacgaattcaaataccgactcaaacacggatttgtatttccaaatgcaaataatgaacttaaaaagcgactcatacacggataacgtaccaaaataccggtaaaaacatcttcaatttttataatagtagagactagctaaatgcatgtgtgttgcaacgggaaaaaaaataaaattacgctaaatattaaattatggtttaatttttttatctaagtcatattttttttattaaactcaaacaaatctgaacgtagggagcagtgttacgtaggaggagaagatgggctttgtattcatcgagagtatccatgcatctttcaaaagatttttatgatcatatgtcacggtctaagattatgtggagatgaatcgagatgaatgaggatagattggattatagtagatgaaataacaagaaacggttctgaacctaaacagcgcgacgctctctgtctcactgagaaggcaggccgatgggcactaagataaatcttgatctaatgcctaactgatctggaatagggtccctccttatatagatggaggactccttaatctaatcctaacaaaccctatctaatcctaacaaaccctaactctatccaataggcctaggattcccggcccaaagcccatgacattactcccctctttttaagcagctcgaggcacaccccgctagactcaaacaaagtaccatagcctaaacaaagattcacaagccttttacatctcggctgaaatatatactcctatataattaatactactgttgtgaacaaccctacttttacttttatgttgtcatcatagatatggacaggtggaccccacccagaagccttgaaaggaaagtgaggcccatgccagaatccaaacatatctaggccaacatggatcagctgcagatcgaagcccagcccaccagtctagcccatttaaattgcccagatgaggagaaaagaggagaaacccttgctcctcccgtagatagcgctgcctccaacaacatgcgcgtgaggagcgccgtccgcgagaagagaagttgggccacgccaaaagaaatcgcccccaacttcgacttgaagtccttgcacaactgccgcgtccacagttctcaacgcgcacatgccgccaggaacgactcagccgtggtcgagccgcaaacttcgtgaaccagctcgcggacccggcgcgatctgcgccatcacgacaagcgaatgccgcgcccacccgtcgcgctagtgaatcgcgccgccatacgccggctggctctgctccaaccgtcgccgtgttgtgtcgccatcgaagtggaactcaccgtcgtcttctctgactccgttgagggcgccaacagcgacggcaccatcgctaggcccagcggcgaggccgaggttgctcgcccacctgccgttcccgcaattcacgccgcatgtatgtcgctatcttcccgcgccaaattgtacctgccactctcggaacttgcgccgccgctcgaggaagcgtgagcgcctcgccgtgagtcacgccacccccgcatggttgcagaacgccattgccgacgaccccggacggtgggctgggctgcgcatgcgtgagtggcggaggcaagaggcatcaccgatgctaatcctagcagcgcaccacccagttgcgccatagttggtcgccgatggaacctgcagccgatcccgccctatggtcgacgaaatgacgtaaaggaggttgtcggcgatggcctgccatggagtggcgtcaccgccgattactgccaccatccgtgccgcttgaagacgcgccctcgtggtcgcaaggacgctacatgccagtatgatgattcggcatcctcaaggaaggccgccggctcggctgactgggctgccaaggcctagagttgcgccaccaagtccatcatcttcttcgagatctcggcaaggccttcgctaatgttgagaaccacagcgatctcggcacccatgggcacggaaccgaagctctgataccaagttatcacgtgttaggattatttgggatgaaaagggacgaagggaaatagattggattatagtaaatgaaataacaaggaacggtcctgaacgtaaacggcgagacgctctttgtcgcactgagaaggcaggccgatgggcactaagataaattttgatctaatgccaatctggaataggatccctacttatatagatggaggactccttaatctaatcctaacaaaccctaactctatccaatgggtctaggattcccggcccaaagcccatgacatcatatcacacagatttttaatctttagattaaaatccaatagacacagcaaaaagacaaaaagcaactaagaaacaccataatggatactaattgccatatcttcaagaaaaagaccaaacccaatataaatttcaaaacttacatacgaagattcaaaaattacactgtaacttacaaaagttacaatgtaagttttataaattacactgtaaattacaagaaaatacactgtatatttaagtgggaaaatcaagtgagagataagaaaaaaaatatttcgattgagatgtagcaaaatcgatcacaaaatagggagctgccaatctcgcgttacatctacaacgttctgaatcaatcacgcgcccatcatgttctcgcggactgagtcggacatctaccacgtgtgcattgcgaacccatatagatagagtcggataacaaacgaaagaataatgagtagataatcattattattattattattttaaaaaaagtataggtaaagatctagaaatcgtaaaaggattcggatgacaattaccaaaatcttgacaaaaacatctttaatttttataatagtagagatagagatagagaagaaatagaggtatggaacatagtctggttccaacctcttcctccatcaaaaatattaatttctatggataattctagatattctaagagtcttttttatggaggatgtacggaatctcttcaagatgcggtatgaagctataccgatttttcactgacaaaactgtctcctaagtcctaaccaaacgctagagagatcaattcggttctcaaaaaaaaaaaagagagatcaattccattccctcaatcaaatacccggcaagtatgaccaacttgtccaatggaatagccttcttactaccagggtttcccttaccgtttttagcgcggttaccgcacccccgcggtaaggtggttaccgcggtaactgcgcagttaccacgaaaatcacgtggtaaccgcaagacataccgtgatttcaaaaactgaaaaggttactgtggtaaccgcgcggttttgtaaaccctgtgttggcaacttttttgacaagttgacaagcacgatcgcagcaccttaagccttacggtgatcctagagtcgccaaccacctcgatctagcaaagagctaaacctagatgggttttgataactaaaccggctagcggagccgatttctagataactacccgcctcgtgggcaaaacggaaggttttcaggacaaacctacaaagagatgtcgcactctcgcagcggcggcggatggtttacggtgcaaaccgacaaagatggacaaactaagagaaaactaaaagcaatatgaaaaacgatttgattgattgattgtagattgatttttacaatgaaccggccatgtcccttatataggggttggtcttgccctctacaggcccttctccacgtccaactcggggtagaaactaaaggaaacccgaaacatgccttcccgagcaaggaaacctcgagacccgacgaaacacagtcggactcggacctgccagtcagaccggccacacaccgccgatctgaccggccctgaaccggcggtctgactgcccaacacacggcggtcagaccggcccactaaaagaaaaccggcagacttccaaattttggcaatctttcctattttaatcctaggtgctaaatttgggtgtaaacaccctgcttaccactctaacggtgaagaactttgccacaattccttcaatctttttcccaacttatgtgggcttattcggattaccagatttgcacaggattttggggagaatactattcactaagaaattttcatttcctcccattcggatcgcactaaccggccataggaaaatcgaaggaaagtttccctcacgaccgatttcacaggaaaaacacaggaaagccacccagatcttagcttcacgatggatttttggttggaccaatttttttctagtttgattcccctgtaaatttttcattcccacggccattttgtgattcagattagcaatactctgtcaaaataattagtatcagtttttactcctataatgtgtattgaacacattagtaaatacattactacatggtggctacgagaacatgggctatattgacaggaaggtggcaattggtttactcatagactacaaagtctaaacaatatttataacactggttaaagacttactagtgttgtaagctggtagtaatttttcggccatctaagaacagtgtcgaatgatgtgggagaattcatacaagtaagtacttttgaaggggggcatccatgtaagtaaatttattacttttcaaggtgcagagtgggaagctgggagcaaatagaaaactcagtaaatttgttacttttaaaatatggggagacactaggaaaacaaaaaattcaaaagaaaaactagatggtaaatattttactgaaataggaaaaaaaatctagagagaaggaaccagaaaacatgaaaaatttagatggttaatattttatcgggccctttgatgaaacacaaatgagaaaaaagaaacacataaagtagggtggtaaaaaacgaaaaaaaccagacggagaaaatgtggggtggtaaaaaaaaagaaaaactagatgaagggaacattttgtggtgctcgaactactgtttcacgcgctaaataggagtttattagcgcgtgtcaattaataaactcctatttagtccaagtaatactatatttctttctaattgaacaagtatgtgattttaaaatttaagggagccaatgtgaaatggatgaggactttcaaagtggtgtaataatatacattatgtggcccaaatgtcagtggtaagggatggtgtgagacagtgagaatggacatcaccactactacattttaagttgtctaaatttccatctctttttatacaacaccaacaaattgccatggcctttcaagaaaaaaaaaacattgttgttgctaatgaaaaccgtccttatgtggagtacattgtagtataaaattgaagatgttcccgctgatactttggtacgccatttgtatttgagtcggcttttaagtttgttcacttttgaaaatacataaggagttgtataagaaatcttttttaaaaaaaactcacatgttaacttgggatgagagtcggactcctaattgcttcagaattcttgcatgaccacaagaaaacaatgtacatgatatggctatcattccaataaaagttccaaattagatatcaatactatcattataaaaatcccatataatttttagacaaaaaaaatctaacaataattaatatgattaaaatagctttcacccgttgcaacggatattttatctagttaactataacaaatgcaatgcttcgtagtcacttttccatgcacacatagaattgttgtcaccgtgactgcaagtctgaaacccttagttcatcaggcaaaccgcaatacctcccggtcatatttacaaggttatgcagcaagaaacattagctgagtgaactgagcgaagaaccattacctactcaagaccaaattttaaataaaatgaccaaactcatgcagttaagatacaaatatttacaagaaaaccttttataacaggaatgtgtcaaaccacaaggtaaactcatgcaaacaaaaaatgtgaatacgatgaatgcaagggtagaaatattgagcagaatggtatttatcatagagtgaactataccaaaaccatggcagagtgccaaattaactgctggtttatgaaattgacattacagtccgtgaaatgaagtacacagtggattatgaagattaagaattaatagcttctccgtgttactgtcaccaggcaactgaactcaagctgtggttccaatggaattcctacaagagatgtaaggaatgcattagggagtacagaatgaactgtcatcaccttcggaaaatactgcttgaggtaacctagtgatccagtcaagagagaaaataaatggcaccacagatggaatcaacttaaactgttagactaaattttagctattaatctatgaaccatcttcatggtaaacatataattttcacaatatgcacctgcaacttaggtgaaacaatcttgtctagctaaccttatccggaaagccactaagccagtattactcttactgtttttaaagtgtgacgtactcttataatgattcactactttaccttttcatttttgtccttttcaattttattaggatattttcttaagaaaaaaatcattataaataggtacttatcttacattgtcatgtagagtactggttgaaatttaacatagaagtgagttccgagatggttatatttgatattaaaattctaatccatatgtagctttgccagaactgagaatgcaaagtacattcctagcaatttaggctaacaaaatgttagtaacaatcacaaaggtaagctgtaatgatgacagagaactgaaaagtttgagaaaactccatgcattgttcacatatgctctgctgtaccaaatcccattccatgtcatgtatcatatctcaacgaatgtcggcatcactgatatgtgcaatcttaacccaatcatggcctacatgtttttggcatctcttcttgagctcagagctgcagccatagatgtgcaggctggtaagagatgctggcatatctggaagtgtctgaatcttaactgcattgtttatatgcatggactgcagggaggtcaaggttgtcactgcttgtggtaaacattgcagatgagaagcattagtcagaactagttcttcaagggcatgacagttatgcaacagatattcctcaggtaagagtgctaggttaggtccaccagaaatttgaagcctcttgatggtagtgacgcttctcaatggctctctaagtaagattgatgggtggtcaatatcaagttcactgagattcaaagataggccagatgaatcagcatcctctggtgacagaatagatgaatcttcaacaagcttgtcacagctagcgattgtcaatgacatgagcgatgcgagaccttggatcccgataagtgaaaccagctctttgcagtcccaaatgaaaaggtattcaagatttatcaatcttgcaaaggcttccactgttggaaggtgtgcgattgagcaagcatttaacaccatatgagttagccctatcaaacctgcaaacagttgtaaagggagttttgacattgcacaaccatctaaaaagatccgtttcagatatttaagacctgtcaatgagtctagtaacgcaagttcagcattagcacacaatccaaaagtgatggttctcatagtatggggcaacatgatctgtcgtgcgatcaga

SEQ ID NO: 59293 - DNA, 8686 bp, Oryza sativa
  unsure (1)..(8686): unsure at all n locations
cagaaattgaagagaaggtaaatgcccaagatatggaaggcactgcatgctttgacaatcacgtagatagatgtatgtcaagttaatgagtatgagatcttgcagccaaaatggaggtcgagaaccaggatatccttcaagttgcaatttaaaagtgttggagtgtggttgaagcttatcgagaattgcatcagctttgcttggatcacatgagtcagatgatcctggagcccaaactaatgttactgcagatagatgctctttctggtccaacatgatttcagcagcctcttctatgttgcaaacattctcaagacctgaaacatgtaaatgatgaatgtctctcagattcttcagttcgacaatagtgtaaccaaccttttgttggatgctgaaaccatatagctcatgaagagaagtcagctttcctataaaaggaatcatgggccttattacaagagttagatgcaaatggcgcagattaaccagcttgcacattccttccatttgtccttccatagggactgcgggtctcggattattgaacttcattgtttgcaagtgatatagattgtatacaacttgtgggaaccaacaggaatgtgtcgtgtttccttcgccccacatgagagagagagacaaatagcgaaggtgcactagatcacccactgcatcaggcagcttaaagggataatttgcggttagggataataccctcaagctttttgtgacagccaacacttttttgagcatgtgttcttgttctgcctgatcttgctcttgaaaatgcatgataagtgtgcgtaatttctttgactgggagatctgttcaacaacagtgagacttatcacatcaaggcataaatggcgaatagtatttggaatcttttcagaacttatactaactctggcacattcgttcactgaagctgaccgtgccaattcatgcaaaagatcatgcacaacaaaccgttcctcgtaatattcttcaaataaacgacattttatatcacgactagaccgaggtcttgatttaatctcaaaaaaagactttttggttagtgcatctaaatatcccattccaacatcctctggtgtcatgccatctaccgattgttggattagtcctgagcccatccataaatacactaattctttctttgtgaattcatagtctttatgaaataagctgcaatacctgaaacatgactgcaaatgggttggtaaatgctgatagctcaactttaacactgtcataatcccttccttgccctgttgtatattatgaacacttgatgccaatattctgttccaagtgttactatcccttttgttgttcaacaatccacctagaacctttgctgcaaatggagaaccactgagtttgcttaccattttcttgctgatgtgttgcaagtttctataatcatcaggattaactccaaaaaaggcatgtctttctaacagaagaagaagttcagtttcttttagcccactcaatgataaagactggcattctccttgcatcgctcttgcagcaagattagctactgattccattcgagttgtcagcaagatcttgcttccggtcttcccatatcttaatggacttactaaagtctcccaaccacgcagactctcatcattccacacatcatccagtaccaagagaaaggttctggaactcagtttctcctgaagtgccttgtggagagcatctaggccaatcatacctatttctgttctagtcacaccttgaaggatctttctcgttagtgtttcaacatcgaaaatgtgagaaacacaaacccagacgaacaaatcaaaataatcttttaccttgttatcgttgcatataacttgagctagtgttgtcttcccaataccccctaaaccaactatacaaaatatggggatgttgccaacaatctgttcagatgcactgttttcacgcttggtcagccactgaactacaatattgctctcctcttctcttccaagtactaggctatgaggcaatgagcttgtctcacgcaaattcttgaattccacctcttgtttaaagttaaccttattgccaaactgattcagaacttggataaatcgctcaacaccagaggcaacatcagctaaagccttgacagcatttttcaacctcttcagtgacccagtgttaaatgtgtgattaaaacgctgaacaatcttgcccttatactgatgcagagagccactcaccttgctacccgcttgtatttttttggcctccctctcaagcttgtagtactccagttcatcaagcgcatccttagccaattcaacagcatctctgagctgccacaaccacgcatccagtgcatcactttggtctccgatatgctccatgtccacagcatccaagaccaccttgatctgagggaggagtttctccagcctctctctagtaggcttcagccctccagcttccttgttatccttcaagtagtcgaatgccttgttgatgacataggtgatgactgatgttgcaatagctttccctgcaaaaaccgcagcaacaccagccatgtttgagtccttgagagatcaaagaaagaaagctttggcacacaagctgaaggcctttttgggcagaaatggagaaatctacttagaaacgcatgtggatcctgctaacaaactagaggataacgctgctaaaccacacaggtggtgagcttgactagtactcctaccacaactaatagtacttgattagtgacaggagtattgactaaatcgacacattcgtgacccaccaaacaaacagttctttaactttggatgaaaaagaaagaatcacacttttcgcaacagaatccttctattctagtcgagttgggtaaattttccaccctgtgaattcgactgtggctggtgttaaagattgcattacggcactgcaggtctgattatcccatcccgttgtatatttgttgcaacaacgcaacatcccaaaccctattcctatttcccaatcatacaagagtatcgcagaaggaggaattaagctcaaccgtaccagactggcgtggcggcgcaagttatccggcacggaagattcaccatatgtcggcggtggcttggttgatccggccgagctcgagcaacacccgacggtcgccgcctcgccggcgtggtggtgagcgagcggcatgaagcccgctccggcatttcgccgaacacctggtaggtttgaggcgaagaagaagcacgcgccgtgcggtccgtcgctacgggctacggggctacggctgcaatcgatcagcgtcatgtccatctctgcataagttttgctgacagtgtatttgtaaaatcttaaaaaaggaccaggatgtacaaagccgatcgatccatagactggaggccagggcgatgcgacgacgagggttgcaggcttgcagcatgactcatcatttgttgacgacgccgcgacggcaatgacggtccagtgtttatatatacttaatgctcccgccgcccccatcaaccaatatactggtatttactcaatttaggccatattttcgcaccaaacttcccccaaactctcaattttccgtcgcatcacatcacatccaaaactttcctactcacgtaaactcccaattttttttgtccaaactaccaactgtccaaactaccaactttcctcaaacttcttcccaatttcaggaactaaacgcagccttaatccgaatatcttgtttcacaaattcacacccctatttgaaaaaggcttcaacaagttattacaacaagagtatgttgcagtttcagtataagactcgacctgcctttagcagaatctaagccttgtgcaacagtaaaaaacaatgagttgtattctgatctaaaactggcacctaggattttttttttcgatggaatgggtaggagtttttacatattttttaagcaccacctagaatttggttggttgttctttgatctaaacataacacagagatttttaacagatatttgtttgtaggttcaattgtatcttgagtgcaatttactcaaagttatattataaaatatgccattctcgtttaacagaagaatgcataattgcatagtcatttcaacttcacttgaatttagcgtctcatgtaggtggttcgatcaacctatgacgccaaggagcaaggaagtaagtggaaaacctaccataccatgcgaccatgcccatagactactcactactacttaacctgctaaccagaatgacacactgacactacagtagagacaggctaactgaaactgtacatgatggggtgggctgagatcaacgcccgttagctccagggtagaaggtagtcagacggtaacatcggcaagaagctcttgtagcattgtctacttgtcgccactcggcataactgtgctcagggcgccttcttgtagctcaaaccgctctcccagatcattcctaccacagactccagcatctcctgcagagaattcgcctcctgatcaacagcctggaaaacaacaagacttacaaaggtcattaactcataatgccgtttgctgcacagttgaccagaaattattagccacatattccaattctggttgaccccatgtcggtaaaatgggatcttagatattaacatgataattgatatgcagtacacagcggaggcggactttggatcatagccttattaggaatgtaaactgaagtgtaaatgctgaagaacagcacatacgcattaacttacgagcagattttacttacctccagacttgcagatatgccaattagtttaaaggtaacttcattagaaacctctccagttgagcttcgatggtcaaaccggtcagcatgccttagcttgagcctcaacttctcatttctgaaagctttgtagtttgtatgccacactccaactatgctgaacctctcatcaatcgattctttcccaagaggccatctaagtccacctttgacatcaggatcaataacagcagaagataccaagcaatttattgcatttttcacttcagcctgcaaaaaccaaataactttgccaaaaatgtctcataacataaaggatcagaattttcaaacaaaacccaactcacatctaagttcttaaggattcttttggtagacaacatcagcctcaggtccagatccttgaacagacaggatatatcttccaccaagtggcgtacctggttcaactgaacctgcatggaaaagtatgacagtgtaaacaaaacatgttaagccaaagagttcgttcttctattgaataatatatattttaaggatatagcaacgcacacaaagttttatttatcctacacgggtaaaatttgcatttaacaaacttaccaattaattatatgagatgcttttaacataaaatttgcagttcataaaaactgaagaaacaaaaaccactgtcatgaaatttcttcagtagaatagacataggacatgatcacattaacacaggcctgatttgattgctgtcaattcaatcgtcatctaaacaaaatataatgtaacctggtaatagttcaaggctgaatcaagaacggattacattagaactcagatacaaccatccaaggaaagatatgctaggtctactgtactcctagcaaaggacacaaaagatgactctttcaatgaaggaaaaaaggcaccagaccttttctactaatagatacaaatttcttacaattgacaaccaaaatattccctccgtccccaaatgaaggggccagaatctcttaaggatggagggagtatagtgtttggcattggctgtgtaccataggctatcgaattcaacaaaacatggaaaattgaatattactgtgcaatgtggcccataattaggacttgctagttactggttatatttcagcttttcaaaataaaaatttaagttcagaaagttggtgatgattagatagattttatggcacgaacatttcagaaatcccttcaaatatacatacttcaagtgtatgtacagatagcctcattcaaatctaaacctcttcaactgtacatactttgtaagtgcacatacagatgtattgtaagtacactgtacacaaacttcctaagtatccctgtactgatacactccagaatatgtactctccttctcacatgtatgcattgtaaatgggcctccaaccttttggaacgttcaaagcccacttgagcaactccttggcatctacagggcacttattctcaatgaaccaaacaaaaccacatattgcatcacagaattatagttagcatgaaagagttgcatagtgctactgcgaactgacaatgtaaggttcaattgtgagaagttactatcctaaagaagttccactacaggaaaaaaaaaaggctatgagtaagtgctagatgacaaatcattggaattttgagaggcacatagtatattatcttgcttactgatagtgtaggcttccagtctatagtattggaagtttgtagctaatcgagctaatccatcattagtagatttactataatgttgcatccacaagaccaatcagtaagaactagcgacctcaaaaatgattaaaggcatatattttgggaatcacaacacctggaaggacaaagtagctaataggcttcatctagtaccacaaatgaagtagacaagtttatatgagccagcttctcactttatcaaaaaactcatacgaatcaagatccctatgatagaccggagctatgatttatgccatacatctcacaaagatgaagcctcattgttcctatttctcatgggtacaagtcaaaatgctaacaatcccaacactctattttggggcattcagcaatcatactcagaaaaataatctacacaagtagagccaaaattaaaatacaatgtgcaaactactcatatgaatctatgatgcagaacattaataagacaaaaggtaagaggctaaggttagaacgataagcagttaagcacaccttatggatagcaagctttccatcttcttgcacggtgcatttgcacgttattgtagaatcactttgacgctngtcaaagacctacaattcatttacaggccccaaagttaatttcacccaactataaacccaaaacatcgtaattgacatgctaccagacgcgcaaaccttcacatggtagtgctctttggaggaatcaaactccagccccatcttctccgcagcggatcgctccatatcatccaagcactcactaggcacattggtatagaacgatttatgaagattgctcctcgagccctcttctcctgctttcacggcttcgcggagcgagttcatggagacgggtgatccgccgccgctacacaaaatcaatcaataataacagcagcaactctttgtgatcaacacccaatcattcttccacgaatccaacgagaaatggtagatgggatgggagaaattaaggagactcacgacgattcgaagagcaccttccccaccctggccacgacgctcagcttcacctcctcctcctcctcaggcacatcgcccgccttcgccctccaagccgcggcgaggaggtccggcaagaacctctcggtgacggtggatgcggcggccgccgcggagcagggggaggaggcttcggcggcggaggaggagacgagggcgaggggcttggcgccggtcctgcgctcgatggggtcgcaggggaagggctcgaggcggagcgacccgtcgtcgtcgccgtcgtcgtcggggaagggcgggagcgtggaccagcgggagacgcagccggcggcgtggacgatcttgctggaagggcgggtggtggcgccgcggtggtggcggccgcgtggggaggaggagagggagagcgagcggagggaggaggagagggagggaggaggagggcccggggtcggggcgggcgtgaaggcgttggagtggcgcttgtgcggcgggaggtaggccatggccgccggcgacgaggttttggaaagttggtcagtggcgactgccaatcaagtggagaagtggagacggctgaaggcaggagaataaacaattccgtagggttttatttaggatttttttcccctactttaaaatagagaaacaattagatacatatttttggaataaatttcacaaaacctacgtatatatcgtatatattttgactaaactatcacgaaactacatatttaatactccctccgtttcaggatataacacgaaactacatatttaatactccctccgtttcaggatataagactttctagcattgctcatattcatatagatgttatgtctgaattcattaacataaactctctccgtttctaaatatttgacgtcattgacttttttaaatatatttgacagttcatcttattcaaaaaatttaagtaattattaattctttttctatcatttgattcattgttaaatatacttttatgtatacatgtagttttacatatttcacaaaagtttttaaataagacgaatggtcaaacatgagctaaaaagtcaacggtgttaaatatttagaaacggagggtgtcggtgacatgggatcgggggtatcatgactagaggcttgggcagccgcagtcacccacgtggcctgaccccctcggggggggggggggt

SEQ ID NO: 59294 - DNA, 1539 bp, Oryza sativa
  unsure (1)..(1539): unsure at all n locations
cagcgagacgccgcggagtgaaaaaaaaccctaggctgagtccagatgggctttcatgggccttgttggcctttatcatagatggctgggcccattgactgtttaaggtgagttgaaatgggcttcccataaggattcgaggatttggatttgtcggttttgatgttcacagctcggcgatgacagtttaatgcaaaatttaagttttagcttgagtttttatatacttgaccggattttagtgaacttttagcttgagccggagcaataaagctgatgatacctgtggttttcgagcagttatcatcggttttgtgaatgtcgtatttcacgactatgctcgcactatcagaattgtactattgaagtacttacttgacaaatgaattgtggagatcatggataccccatacatacacggcatgtatagtttgactgggtatggagtgctatatatagatagaatatctttaaaatgacttgggttaaattctaaacttgtatgtcaaggtaatacccaagatcctagtcggttacgattgtattttatttgtaactacctattccgttagggatatggactgtattttgtaatacggaccccttctttatataagaaagggccaggtgcctcttggggcacgcttaatcacccagatcatacgatcaataatatactcggcagatcaatccccggacatgagtagggtactacttcttgattaaaaaggcctgaacctgtataaaattccttgtctcttaaaccatccacttttccagtttgatagccaccccctttagtattgtcgaaatcttgttttgacagttggcgcgccaagtaggggtagtgtcaagtacttcgccgactaatgcgatgggtttcgtttccgacatcgacgacttcgtcttccctcctaggcaggcgttccggttcggcagcctcgacttcatcaccaacgacctcgtcaagatttctctcctcgactcggattcgaaccagtcgggaagaagccagatctccgccccgttcggtatcccaaactcggccaagatctaccccaagatcgtctccaccgagtcggcttcaaaccactcgaacgagatccaatctactccaacacgactcgatcaagacgatggggcctatccgccaatcctgatgaaactccccgatgatttggctgctgtcttcaccacaagggcatcttctccccgtagatctaggcgggatccggcctctaccccgatccagcttagcaccagagaagtcggcatcatactccagcctctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59295 - DNA, 4315 bp, Oryza sativa
ctcggattcgaaccagtcgggaagaagccagatctccgccccgttcggtatcccaaactcggccaagatctaccccaagatcgtctccaccgagtcggcttcaaaccactcgaacgagatccaatctactccaacacgactcgatcaagacgatggggcctatccgccaatcctgatgaaactccccgatgatttggctgctgtcttcaccacaagggcatcttctccccgtagatctaggcgggatccggcctctaccccgatccagcttagcaccagagaagtcggcatcatactccagcctctcagcacggtttcgacggaacaactggatggctacctcagctcccccggcgtcgactcacggccaacggagatcattgagtacaacgacttcggctgccgctacgactaccgcaacctcgacgacttcgacgaagactttgaagataactacacgcctctctacttcggcatcttcatggctgacaacgagatggaagaacagcgtaaagcccaagaagcagaagaacaacgcgtgcaacaggaagccgaacgacgccgactggaagaggagcgccaagcacaagagcaagaataggctgcaaaagaggctgaggaccggcgatagcgcgctttggatgccgggtgacgagcacgagaacttatcgggcaacaagacgttgacggaacggcggtttttcgcacccctcaacagaacgcagttgcaacgatcaccctcctcgacaccctcctcaaggaagacgcactcaatcaagccaatcacgtcgtcaacatcttgaaccagaccaagatcatgatcgccgtctcggtcccggttaactctgcaagcgtccgcacgccgactggcagccgagttccccctcttcgatctcaagactatcaccaaccaagcctcagtgtcgtcggcgcgggatctagtcgcaggagcaggggtcacgacgagcgatctgtccactcgcctcctgaacgacacagggagcgtcgagttgaacgacctcgctccccacatcgcaggcgccctgtcgatcttcgcgatattatcaaccagcgccgcgcggcaagaggatacgttccccaccattcaccagatcgctacgacgacgacgtggatggagttgctgccttcacaagtgaactgcgtcgagtggattggccagccggcttcaagccgactggaatcgagaagtatgacggcaccactaacccggaatcttggctcaccgtctatggtctcgcaattcacgcagcaggaggagacagcaaagccatgacaaactatttgcctgtggccctagcggactctgcccgatcctggcttcacgagttaccccgtggcacaatcggatcttgggcggaacttcgcgaccacttcatcgccaacttccagggtatctttgaacgccctagtacacagtttgatctctacaatgttgttcagaagtctagagaatcccttcgagattacatcagacgcttttccgagcaacgcaacaagatctccgacatcaccgacgacgtcatcatcgctgccttcaccaagggcattcgccacgatgacctagtcggcaagttcgggcgcaagcctcccaagacggtcaagcagatgttcgaaaaagccaatgagtacgccaaagccgaagatgccattaccgcgtccaagcagtcgggcaccacttggaagccgaagaaagatacgccgactacaggggggagtggaagtaccaatcacaaggatcgcaagcccgaggaacttgtggcaactactacaccatcctcccggcaacattcacgggtcaacacttttgacaagatcatgaactcccaatgtccgcatcatccaaactccaatcacgcggccaaagattgcttcgtctatcaacagttcgcagaacaatacgccaagaatgcacgcaaggcctctgacggagatcaaagcacgtcaaagaagaaggatgatgaagacaacgccccgactggttttcaagaccatcgcaaggaactcaaccacatctttggcggacccctggcttatgaatccaagagaaagcaaaagctaaccgaacgggagatcaacgctgttcagcccgacacgccccaatatcttcggtggtcagagacaacaattaagtttgaccgctcggatcatcctgaccgagtggtccacccggggcggtaccccctggtactagacccagtggttcgcaacgtcaagcttcgcagatccctcatcgatggtggcagtgcactcaacatccttttcgccaagactctggacgacatgcagatccctcgcacggaattaaagccgagtaatgtgccctttcacggagtcatcccagggctatctactacaccactcggccagatcattcttccggttactttcggcactcgggagaacttccgcacagagaacatttgtttcaaggtcgctgatttcgagacagcgtatcacgccatactcggacgcccagcgttagccaagttcatggctgtcccgcattatacctacatgatgatgaagatgcctggtcctcgaggagtcatatccctgcggagtgacatcaagcaagccgtcacgtgtgacaaggaaagctgcgagatggcccagacctgcgagatcacgctcgcccgagaagaaatccaactggctgcgtccacagcaagcgaaggagaagtgcctgcgaccaagatgccaaagagcggggaaagcgacaccaagaccaagaagattcctctagatccctctgatcctactaagacagctgtaataggcgctgagttagattgtaaataggaaagcgcgctcatcacctttcttcaaaataataaagatatctttgtgtggaaaccatctgatatgcctggtattcctagagaggtgattgagcactctttacatgttaaggatgacgctaaaccaataaagcaatgactccgccgtttcgcacaggataggaaggatgcgatcaaggaagaattgaccaagctgttagcagcgggcttcatcaaggaagtccttcatcccgactggctagccaacccagttctggttcggaagaagacggggcaatggcgcatgtgtgttgattacaccgacctcaacaagtcttgtcccaaagatccatttgggttacctcgcgttgaccaggtagttgactcaacggccagctgcgagctactcagttttttggattgctactcgggatatcatcagatccgactaaaggaatccgactgcttaaagacttcattcatcacgccctttgaggcctactgctacatcaccatgccttttggattaaagaacgcaggagcaacttatcaacgcatgatccagagatgtttttcaactcagatcggccgcaacgttgaagcatccgcgcttttaggatgaaattaaatcctgaaaagtgcatcttcggagtaccgtcagggaagctgcttggatttatggtgtcccatagaggcatacaagctaacccggagaaaatcaatgccatcctcaacatgaaaccgctgagctcctagaaagacgttcaaaagttaactggctgcatggcggtgctcagccggttcgtctcacgactcggcgagcgggggatgccttttttcaagctgttaaagaaaaccaacaatttccagtggggacccgaagcacaaaaagcctttgagtacttcaaaaaacttctcactactccaccagtcttagcttcaccacatccgcaagagccgttgttgttatacgtgtcggcaacttcccaggttgtaagcacagtcctggttgttgagcgtgaagaagaaggccatgttcaaaaattccaacaaccaatctacttcgttagcgaggttttggctgactccaagacaagataccctcaggttcaaaagctattatatggtgttttaattaccgtcaggaaattatctcactacttccaaggtcactcgattacggtggttacatcgtttccactcggggacatacttcacaatcgcgaagcaaatgggcggatcgcaaaatggaccttagaattgatgtctttggatatatctttcaagccgcgaacttcgatcaagtctcaagctttagctgacttcgtcgccgagtggactgagtgccaagaagacatgcccgtggagaagatggagtattggactatgcattttgacgggtcgaagaggctttcaagcactggagcgggagttattctaatttccccgactggagagaggctgagctacgtattgtggatacattttttctgcgtttcacaacgtggcggaatat

SEQ ID NO: 59296 - DNA, 1708 bp, Oryza sativa
actcaagacataagcatgattgaagtcgactggagagagcccctcataagatttttgacaaaacaagaactccctcaagataaagatgaagccgagaggatctccaggtgcagcagactttatgtcatacatgagaccgagctgtacaagaaaagtccatcaggaatcctgcaacgctgtgtgtctttagaggagggaagacaattgataaaggatatacattcaggcatctgtggcaatcacgctaccgcacgaaccatcgttggcaaggcttaccggcaaggttttttctggcccacagccgtgtccgacgctgacaaaattgtgcgaacatgtgagggttgtcaatttttcgcctgacaaactcatctaccggctcaggagttgcaaaccatcccgttgtcttggccgttcgcggtttgggggctcgacatggtcggcccgtttaaaaaggtagtcggtggttatactcatctctttgtagctgttgacaagttttccaagtggattgaagccaaaccggttatcacaatcacgacagacaaggctagagatttcttcatcaacattgtgcaccagtttggggtacccaatcggatcattactgataacgacactcaattcacgggcggagtatttaaagatttctgtgaggacttcggcatcaaaatttgatatgcctctgtagcgcaccccatgagcaatggacaagtcgaacgcgctaatggtatggtacttcaaggaataaaagcacgagttttcgaccgactgcatccgtatgctggcaagtgggtagaacagctgtcattcgtactttggtccctgcgcaccactatgagtcgggatacgggccagtcgccgttattcctagtctatggagcagaagcgatgttgccaagtgaggtggaatttgaatctctacgatttcgtaacttcagcgaggagcgctacgaagaataccgagtagatgatctcaaccgactagaagaagcccatgaagcagccttaattcagtcggctcggtacttacaagggatgcgccgttattacaatcgcaatgttcgatctcgagcttttttagtcggcgacctggttttgagaaaaattcaaactacacaggatcggcccaagttatctcccttgtgggaaggaccgttcataatttttgaagtcactcggccaagttcttaccgactccagcgtgaagacggtactcatatcgacaactcttggaatattgaacatcttcgtcgtttttatgcttaggcattacttttgtatcttcctctttgactgttaacatcaagttgtcccttgatttatcagtcgggggctactataataataatggagtgtgatttttatcaattcaatttgcttacttgatttatcattgccttgtttgattttttggcttagccaatgaggactggaagtttttaaaaaaacttttgcgggttctaggctcaataaggtttgacaaaaacttttaagaaatctggagctaagtttaaatcatcaagcacagcataaatttatcagtattgcacaaattgtgcctccatcatcatcatcattatcatcagaatacacaatcaattagactcagttctttcatcatcagaattatcagactcagtcggcttaagattgttgtcctggaatctctcaactacatcagcggctatcttgtcagcagccttttgcg

SEQ ID NO: 59297 - DNA, 4264 bp, Oryza sativa
cattagatattcccatgacgccactcaaaagtagcatcggccattgcaacctcagccgatgtatccgcttgaacaatttcaacatcatcgccgtcccattgaattaaacattgatgcaaggtagaaggcacacaacaattggcatgaacccaacaacgacccaaaataacattgtagttaccttgcacatcgacgatgaagaaagcggttggtagcatcttatttcccacggtgagctccgccgaaaagataccctttgcctccgttggtttaccattgaagccattgagaatcatgttggtcttcttcaactcatcatcctcacgcctcaacttcttgagtaatgaatacgacatcaagttcacagcggcacctccatccactaacatcctagagaccggcttcccatcaacatggcctttgagataaagaggcttcatgtgacggtttgactcatcgggcttctcaaaaaccgcgtctttaggacctaatgagaattgagcaaccccggcttcatccatagcacaaaactccataggcaacatacataccatgttgatatccatatcttcttttggagatgattcacctttattaaccgattattcctccttctcctctacaacaaccgatttttccttctctacggacttacgcctccataccggtggtggtcgcaactcattaaacctcttatctctttgttcttcggcctttttctctctcatttcttggagatatttaaccatttgccacatttagatgtggcaattaactttttgccactggacccacatgtcatagatacatgtggacccacatgtcattgagataggggtggcaaatagttatttgccaaatctaaaagtggcaaatagttaaaagcccccatttcttgagcccgaagacgttgcaaccttctcttttgagtagccgtcaaatccttaggcatccacctaggattcggctctgttccaggagataaataatgtcctctattaaccttgcttgaagacgatgaatcaaatatcgccctttgcaaacctcctatcaaaccggcgctggagcccggtcaggccggacgtataccaccggtcaaactggccagatgcgccggtcagaccgacatttggcgcacggttagaccggcctgaggcgtcggttggaccgctatcgggtcggtggtcagaccggcctgatggcccggtcagaccggccgtatggctgcggtcagaccggccagaaggcctggtcagaccggccgactgcgatgagctggtaccggcttcggaccttttgcttgaggactctccaacatcatctctagaaggtattggcacatcatgaaaccccactttgatggtaattacttccgaagtccttgcctccaccttgatgcgctttccttccctcttttcttcattggcccggttcctaccataaaaccggccattgtgtggtgaagacaaacgctcatgaattggccttcttggtcctccccacccttggttgaattgcattggaggcatatggttgaacattggcggtgttgccccccatggtatataataaggataaggataacccggtggcggcattgaataagaaccccatgacatgtcttgtaaatgatgatatggaggtgaatgcgatcgtctcggtgaatgaccaaatcactccctaggaggtgatcttggtctttttcctttgttgtgagccttctcaccaccttgcttctcatacttctccaaaagcatatcaaaagtcactttggtcttcctaggggctttagaagttgaagcttcactcttattctgcttccaaacgccaatctccggcttctttggcactatcatcttaggtcttggctcgccaatgaccactccttttcccttagtagattcggcttgctccggccggatcaacaccttcttatcattgaaattaatcgtattcactggaaaaggatcatgatcaagcttcatcttagagccatcggtgaacttcaatcgtccttcatctatggccgattgaacctgtcgtcgaaacacattgcaatcattagtagaatgagaatgagaatcatgccatttacaatatgctcgacgtttcaactcttcttgagatggtatgacatggcctttaggtaatctaatttgtttctcttgtaaaagataatcaaaaatcttatcacacttagccacatcaaaactatatttaacctcactttgccgatctttgcgaggagtcagcattaggttagagcaaacaaaaggcttgtttttgttagtccatgaccattcagcaacatatatatcatgatcaccctcctcttcactatcactagcctcagggtaatcaatcataacattaggctttttgtcatatgatctaagaagttttttattatccttaacccggctttcttgagccagagccctttgcataagttgactaacatcaagaaattgttggccatctagtctttctctaagaggagcaattaaaccattaaaagcaagaccagccaaatctctatcagttatattcaagctataacatcggtttctaacatccctaaatctcttaatataatcaatgacaggctcattatacttttgcttaaccgatattaaatcacataacctaagctcagtttctccagtatagaaataatcatgaaatttttcttctaattgagcccaagtatgatagaatttgccggtaaagaagtaaaccatgtaaaatcattaccggacaaagataaagaaaacaagcgcaatttaaaagtatcactattagcctcaccacattgcgccaaaaattgacctacatgctcctatgtggtcttaccgtcctcaccactaaacttggtaaattcgggaactctataattacggggaaacgacacattatcataataatcaggatacggctttttgtaactctagcacgattcctagtttcaatcccgaatctattcctaataatctcactaattatatcctccatgttattaggtccatgttgatttggcggtggatttggtggcctaataggttgtgtttgtggcgcaatatgattatattggccttgtctagtatcgggaggataccccctagcaacatcattataagcattaggaacatgtgggggaacttggggattatttgcagcagtagatacagagggatcaaatgttctaagatgatacaaataactagcattagtcatcagatctatcccctgtatcggtataatcgcgtcagtctgaccggcccagggcccggtctgactggcatccaaaggcgcggtcagacctgcctgagtcctggtctgaccgcggggataatacccggtctgaccggccgtttggtcggtcggaccgacggctaggtcacggtctgaccggtcgtcaggcccggtcggaccgaccgtgtgcgccgctccatcggttctactacccgtttgatctataggaggttggttagcagtggtagaggctttatcttttgacatgtaatcggccataagagggccgaatttaacccttaaaaattcatcaaatttaccctcaaaagttgcatctaacttatctttaaaagcaattatagatgaatctattgtagatgctacttgtcgctggatagattgtgttatctcaccattacttaccaaatcgggggcgagcttaggacgtggccctgccttgatgatcaccccttaacgagtcctagtgcttgccctcatcaacgcctcccgtgtgagttcgttgatgtattcctccatagctttgcggtcttctccttcgaaatcatccaatgtgaccggtatcatattggatggctccacctccgtcttggatggcggcttcgtcatggcgaagtcgaagttgagttgacgatgaacggatctcgtccctagtggagtcgccaaaaatcgtgttggcaacttttttgacaagttgacaagcacgatcacagcaccttaagccttgcggtgatcctagagtcgccaaccacctcgatctagcaaagagctaaacctagatggttttgataactaaaccggctagcggagccgatttctagataactacccgtctcgtgggcaaaacggaaggttttcaggacaaacctacaaaaagatgtcgcactcttgcaacggcggcagacggtttacagcgcaaaccgacaaagatggacaaactaagagaaaactaaaagcaatatgaaaaacgattcgattgattgattgtatattg

SEQ ID NO: 59298 - DNA, 1409 bp, Oryza sativa
caaatgtccgaattcacaattaattcggcctctaaattgattgaaacgtgccccccagcgctctgcccagaactggtcagaccgaccatacagggccggtcagaccgctcggggtcgccggtcagaccggcggcatgtggccggtcagaccgcccctggtcaccggtcagaccggccacgcaatgccggtcagaccgcccctggtccccagtttcgccaatttcgcacaaagatttaaaagcaagcaccggctcctctaatatcagaaataatcccttcttcacattatagctagatgcttgttgtgccaagtcatttgctctagaattatcacacctagcaatatgtctaatagcaaaattatcaaaattggcaataatatccaaacatgaatcgaggtacctatttagtgatccgtccaagcatttgtagactccggcgacttgttgcaccaccaattccgaatcaccaaaagcatccacgtacttagctccaaccatctccataacttgtaagccgaataatagagcattgtattcggcttgattatttgtacaataatactccaaacgaaccgatgcttcataacacatgccattaagtgaaaacaaaactacccctatgccttgaccttctttgcaagaagaaccatcaaaataaatctttcaaggtataacttcaactaagcaaaccctttcctcataagcaatatctacatgatggtccactataaaatcacatacaatttggcctttcatagatttcaatggttcataagccaaatcatattctatcaaagcatatgcccacttgccaattctcccacttagaattggcctttgcaacatgtgtctaataacatcggcttgacaagcaactatgcatgtactagataacaagtaatgcctccatttggtacaagcatagaataagcatagacaaagtctctctataaagacatacctcgtttcggcatccaaaagacagcggctcaaatatgtaatgatatattccttgccatcttcctcttgcgtcaaaacggcaccaatgactttgtcttcggaggtaatatataaccgaaaaggctttccggctttaggcgctcacacaacgggtggagtagacaaatatctcttcaactcctcaaacgcctctttttgttttgccccccgggtaaaatcggcttcctttttcaagcgaagtataggaacaaaagcatcgattttactcgctagattagaaataaacctcctcaaataattcaccttccctagcaacttctgaacctccttcttgcatgtcggcgctttgaaatcacgaatcttttctatcttcttaggatcaatctcaacccctctctcatgcaccatgaatcctaagaacttccctgccgacacaccaaaagcaca

SEQ ID NO: 59299 - DNA, 1703 bp, Oryza sativa
caatttgattaccagatgaatgatttgaaacaataaaatgaaagaaaatgtgctcactgtaatatttctgcttgcaaattccctagcagttgtttttgttaacccaataactgcagccttggcagcagcataattaacttggccaagattgccagtaaggccaacaactgatgctatgttgataactcttccctatattgcaaatttgccgtattgaagttcagtacagaacagcgtgaaaaaaaatataaaaatattaaaaaacaatcaaatatcaatctggtaaagaaatgaactatatggagtacctttttcttcttcatcattacttttgtcgcagcctgcaaaaaaaacatttgcagtatgatgcataaagcattttaagtacaaaatatgagaaaatgtgtgattagtacctgtgtgcaaaggaatacgcccgtaagattaagatcaactacatcttgccactgagatttcttcattctcagcaacaatgtatcccgtgtgattcctgaatatcagaatggtcagggttaaaacttaaaagtaaaataaattgttttttttgtgtaaaaaaaagatataatattccactaggagtacctgcattgtttacaagtacatcaattgtaccccatgtatcaacagcctggatgattaatcgtggtcagaaatttgaagagagaaaaccagtatcacagagtatcacgaatggactatgcttactgctttaatcatagaatccacatcggcttcattagaaacatctcctcggaaggtaattgcctgaccaccaaatccttcaatctgtaaaatacggaaacctcagtatcttcttccatctatttaaggcagaacaacagaacaaaattttcaaaacacatgcaccccggaaacaacattcaattgaattttcctttgattatttatggttttgtgaaatttactctttactttagataagaacataacgcagttttagtttaaattaatgcttcgtggtattctcgtattacaaatcatctacgttatgctgctttaaaaaaaatatgaacaaagtaactagtcaacacaaagctttacctctttgcagacttcttcagcatctgttgaagaccgagcataattcactaagacctgaaaggtaagtagagtttttttttcccctttgattgtaaaacttgtgttatactcagggaaattattctagttcagcataacaactaggcaacagataaatatttgaacccaattttccagatacaatcctctttgtattgttctagatgcacctacatgattcacaatcatgaaacttgaaggtaaataaaaggtaaatttctttcacagggtagcatgcaactaaagttttcatcaattcatctattcagattgtcaataacagtcatttgggatactcctatgatcctattgaatatataaattaaccatttaagtttccagcctgctgtaactcagataagccagttgcagtggctcagataagcatcagcccttttgataaaatttctatagatgtataagcataaatcaattactaagtgttaaccttgcagccggcttttccaaaagccaatgcaatggctttcccaattcccctggaagcacctgtaacaacaacaactggagcctctgactgtgcaatagcatcttgtaccactgcttgttcaacagctgcaaca

SEQ ID NO: 59300 - DNA, 1398 bp, Oryza sativa
taacatattcaatatcagattcaatggatgttattgatattggcatattgctaatattttctataatcttaattaaactttaaaaagtttaaatagaaaaagaaaatcaaagcgacttgtaaggtgaaacggagggagcaaatgcttaccatgccggagccaatgaggtactgtatcgtcttctcgacctgcctcatgtcgaccctgccggtgaggtagaggtacttgttcatcaggtcgccgtgccggttctcctcggcggcccacgccctggtccacacggcccaggcgctgccgccggcgccggtctcgtcgcgcaccccgccgtccatggtgttgagcatcgtctggtacgtggggagcgcctcctcggtgaccatgtcgccgacgaggcacaccaggtggtcgtcggggagccccgccgcgcgctcccgcagcgccgccacctcgtcgccgaacgacggcgagcgcgggtccgggaggtggtcctgcggctgccacgactcctccacgggcttgaggtaggggaggatggtgtccgccgcccacccctccagggagtcgaagacctccttcttctccggcggcagcgtgtgggtcacctggggtggcacctcgcgccacggggcgaagggcttcttgcctctcggggtggggttgccgatgccgccaactcttcaggttcagaggaggaagaatattcagaaatggcgactgtatggtcaagatgatatatgaaccgaatgttttgcatctggatatgtgggattggattgttgaaacatcagtgaattttacgataaattaaatgcagtacagatgatactaatcattgctcgcttcgttacatacttttagttgttttgactttttccattcaaacttcttttatgattgattaagtttataacaaatatagtaacatctacaataccaagttaattagttttatcaaaactaacattttatatattttgataatatatttgttttgggttggaaatattgttatagtttttttataaatttgattaaattttaaaagaaaatcgactagagaaaagtaaaaagcaacatatgatataaaacgaagtagaacgtacagaaatgatggcaccgaggtaatctttctgtaaataaatcattgtcatgttgagatcacggttttccaaactgctgagtccggggttaccgcgtcccgacggtaagcacggttaccacggtaaccgtgaaaaaccatgcaaaatttattttttaaatttatttgaatttaagcccagtaaccgtggcatttatattaccgtacccccacggtaaccgcgcagttaccggtggtaacgtaaaccctggttgagatgctaagcaagtactctcttcaaagcacggctgcatactact

SEQ ID NO: 59301 - DNA, 1972 bp, Oryza sativa
cgcgcgcgtgcaggtccgggacgccgctgaccacatcgtccacagcttcgagggtacggccccccggctcgcgttcgccctcgactccgatgaagagggcggtgacggcggtgacgaggccggcgacccgggcgtgtcggaatgagctcccaggcccctgccaatctttatatagttttttctttcttcttccgaggccttcgggcccccttcttgtgtagactaacttaatctgcaatcaaataaagaggaaattttttgcgtcaattctatttgttgtgtgtatgagacgaggatggtctgtgccgcggtccttctgtgtcttggcttgaacaagggctcgtgcccaggtcccagcctcaaacggcgcgggtcggggctagtgcctggggagatccacatgtcgagactggccaggccgggagcgtggtgaccgagggttatgggtgacccgattgtgggcctttgccgattcccccccggagttcaccacgccccggggcacggctcggttctgggccccttttggcgattttagccggcccgggccaccgagggcaggatcgagcacgagcgtgctaattcaagtcaagattcagcaaaaggaaacaatggcacagacacagtccttaggaaatcaaaaatgcttttattgaaatacagaagagaaaaaagacaattatctgtatgtggtagcccccggccaactctgcacgcctgaggggggtgcggggttggcccgagcccgagacctgacacccgacccccactaggggtagaagcgacgaaggtgttcgatgttccacgagttaggcagctctgtgccgtcgcccgtggccagccgaactgagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcaatacatggtggcccgaggggacctcagggtgagctcagatgggagaaccgcctccgcgccgtagacgaggaagaaaggcgtttccccagttgctcggcttggcgtggttcggtttgcccagagcaccgctggcaactcctcgatccacgagtcgtcgtgcttcttgaggatgttgaaggtcttggttttgaggcccttaaggatttccgcgttggcgcgttccacttggccgttgcttctgggatgggcgggtgaggcgaagcagagattgatgcccatgtcttcgcagtagtcaccgaagagttcactagtgaactgggtgccgttatccgtaatgatacggttaggcaccccaaaccgagcagtgatgcccctgatgaatttaagcgcggagtgcttatcgatcttgatgaccggataagcctcgggccacttagtgaatttgtcgacagcgacatacagatactcgaacccgcccggggcccgcctaaacggacccaagatatcgagcccccagacagcaaatggccacgaaagaggtatgatctgcagggcctgggccggctgatgggtttgcctggcgtggaactggcacgtcctgcaccgccgaaccaagtcgaccgcatcgttgagagccgttggccaatagaaaccctggcgaaaggccttcccaaccaaggtgcgtgaggcggagtgggctccgcactcgccttcatggatatcggcaagaagctcgacgccttgttcccgaggaatgcacttcaggaggactccgttagccgcgcgctgatagagggtcccttctaccagcacatagcgcttggagatgcgctggaagcgttcactcccttcgcggtcctcgggtagagtctt

SEQ ID NO: 59302 - DNA, 7520 bp, Oryza sativa
gcctgcaggtcgactctagaggatcccctgaatgctcggcttgtctccggttacatggcgcagttcgtggaagacagcgacgatgacgatgttgtcgaccatgaccgcatcaagcccgatgccctggacgacgagtcaagcagcctcgtgatgttgtaccgcgtgtggcggatggcggagcacgggaacgtcaacggcctcctcgccaagcggccctcttcgccgccgcccattccgccctcaccgccgtctcgagcgacagtggctgccggagccctcttcgccgtcgcccactccgcccacaccgccgtcccgagcgccggtggctgccggagcccttttcgtcgccacccactccgcccgccatcgtcctgagctcctctagccgtcccgagctccaccgccctcgtcgtcgtcctcgaggtgagggagggagaagagtgaggatttgggagagagatagagaggtgaggggtaaaagagagggtgagagactgacatgtggggcccgctgatttaaaaagaaaagaattgctgactgggctgccacgtagaccaaaaccgcttgtaaagctacttgggggggagggggtttcgtccggtatagatagttgagggtgaaaaatgactggtttttaggtttaggggggtaattcgtactcactcaatacttcagggggataattcgtactttttcctaaatcatttgatttttttctaagtcaaactttttaaatttagccaagtttgttaaaaatatatagtaacatctattatattattaaagcatacttgaaaggaggcaccacgttcgttgtgggggctagaaattccaagattaatcagagaaaaagaaaaaaggagagtccaagtagaaatacaatttaaaaatagcttaaattcggaattaaaaataaggaatattgaaagaagagtcgaaataaaaacccaatacgagattaattaaaattcggaataaaaataaaacccaaaattagaaaaaaaaacaaaagaagatttcaagtaggaatacaatttaaaattagctgaaattcagaattaaaaataagcaatattgaacgaagaatgcatataagaacccaatacaagattaattaaaatttagaataaaaaataaaataatatccaaaactagaaaaactaaaagagaattcaagttggaatacaattttgaaacaactgaaattgaaaataaaaaataaaaatattaaaagaacacaatacggtattaattaaaatttttgaaaaaaaaataaattatgaaattagaaaaagaaaaataagatttcaattaggaatacgatttataaataactaattttggtgataaaaataaagattattgaaataaaaaaccatttaaaacacatgataagataaattaagtaacatgcctataaatgagtagggtggtggcggttgatacgacatataaaaactgttaataaaacaccaaataaaatcctaatgacgattaaaaggagggacgacaggcatgccgtgaagcaaacgtgcaaggcggttgccgggacttctagaaagtaaaaaaataaaccccattgataatcatattcgatttttaaaatctcaatgacaataaaaggagaaccagcgggcggggtgtataggagtatagttgcatagccgcggacggttggcgggatttctagaaaataaaaaataaattccaatgatagttatgttcgatttttaaaatcccaatgacaataagagtaggcgtcggatgggccgtagaggagtgtagtggcagcgtttgatgggacttctaaaaatcctaaaaaatgaaacccaacaagataataaaagataataaactctaaaaactatagtatccaatttttaaagattcgggacttcaaaaaatgaaaaaaaaacccagtgataatcatattcgatttttaaatctcaatgacaataaataaaggaggtggcggacgagccatagaggagtacactggcaaagccgctgacggtttggtgggacttttagaaagtaaaaaatgaactcaaacaatcactatgtttgatttttaaaatggcaatgataataaagagaagaaacagtggataggccgtagagaagtataatgttagcgtttgatgggtaaactctaaaagttataagatccaatttttaaaggttccaaggagaatgaatagaaatagtggtagatcgagcaagcaaataaagaatgagatgacggaagtaaggggtagtaactggtatgacttttaaaacctataaaattagaagcataaagatgataaggtttggactttcaaagtcttagtacaatgagatagctatttaagaaattttaagtaaaatcatattaaaaaatgtataattttgtatggtgctagccgcgcaattgtgcgggccatctagctagttttcaatataaaacaaatatatttgcaaaatatattcaatgttaaatttaattaaactaatttagtgttgaaaatgttactaatttttcctataacctggtcaaactaaaaaagtttaattaagaaaaaagtcatactaagaaaaaaagtcaaatgacttataatatgaaatggatagagtaatggatagagtagtatatatcaatatatgcatatacaaatgttcgtttcatcttactctttacatgtaacccattgtcaatatatttgtgtgtaagttgttactagtactaaaaaaagagcatcttaataggtttgcggatggacaaaacgaagcgaagatggtgatcccgtttggtatggggagaagggggtgcccgggagagaatttggcgatgcaaatggtcggacttacactagggacgctgatccagtgctttgattgggaaagggtgggggaagagctcgaggacatgggtgagtcctctgggattacaatgccaaagaagttgcctcttgaggcattctatcaacctagagcatgcatggttcatcttctttcgtcctaatatttaatcagcagttttccaaacataattggttgttgaactctgtaatcgaaagaaatgatgtagctcaatttggtgtgatttgcccatagtaattggtgcctctgttactctatatatgtatcctatgaaactttttatgaacctaactagttgagaactggtatgtgttttgataagaatatactagaaatattggcgtgctacgctgcgcccggttgacgttgccattgactttgaaggaatacccattataagtaatgggtctgacaaatgtctgaatttcattcacccgaatcacatcgatcgcacaagaacataaacatgtttgcttcggcatgtaatggttgaagtaggataaaagaacttctacagaatatctttacacaaagtggtgtctgaaatcaatgtcaacttgcaattacattggtattagaattaggcaaaattaactaatgtatggagagctcccgtgtttggccatggccaggacaccataaaaacaaaaggtaaatctttgctctattatccttccaatcgtgccaatatcattcagcaaggcatcacctatcatacaattcgatagaacatataccggtgttaccacactaatatattgaggatagtatcaatggagaaaagggaaagatgcaagtgcagtgactgattccgtaaagatgggtaaggtaaggtatatataaacagagaagatgttgacctagtgaataaagcaccaattattagtgcagtcaacaggagagaaataactcaacaaataaatgaattaatcagtgactaaatatagcagtttctttgtgtaagtcaaaactaaaacctatggatatgctatataacttatctatacaaagattaaatcatatgtaatcatgtaaggacttcacttgtcaaatgtcaatgcttagctaagttaatgtggcataaagatgtaaccaccatttgagagcatgaatacaacacaatagaacttgattacacatgctatttgggagctttgctcaacaactgattactaccaaacggttaaattctttatttgtactgtagtttggaataaactaatattaatatgaatatataatatggacatgtaactttataaagggtcgaaaaaatatgtttcaggttataacaaaatcctgaaatgcaataaaggtaactgagttttagtcaagcaaatatttagagtgaatttattttatttgaacactacaataaaaaatgtgtgtggtaagaaatatctacaactactgcttcaattggttgtgaccaaagcactgatgaagatgaattcagactttatgaattattgcatgtaaaggaattaagaccctattttatataacgtatttgaagaatacggtacatgcaaattgcgggtttaagtaagtatgttctctgaagtgatgtaccagttgtaagccttagttctggcaattcactgttaactgatcttgtcaagtaacaacaactttatagctaagttaatgaccatgtaggtaagcctaattacccacaagccatgtctaactgtactaatgcctatctttttactatttaggtcaaatgaaacacaccaattttggacatttgttatgagtccacatttttcctaccagcaggaaagaatgatgaaatgactgttgttgtttcatacagatgctgtaaaaaaagagtaagaaactataaccagaaatgtgataaattgacattaaagaatgctaagtataaccagaagaacatgagaacctgacactgttagatttgtgctgcagcagaacttgcttcagcaactgatacttgttgaatacatcaatgaggcttgacaaaaagaaattgcagttaggagcaactgcagagaaaaagcattgcagtcaacctaaaacttagtgccactgattgggataccacagttatagcgcgctcattggcaatgctctggccaatatgaaatgaagatgtaattatgagaaatcagttctgataaattgaaaattactttgtcaaatcctaaatcattgtacattgctccggaagaagaatgcacttctatgaacagttgctgaaggcgcttgtttgaatgaaacattgtgttgaatcctctcaaaagtgaaaatttttctctattgtgttaatgtaagataataattgacctaagaaaaatggttaacttaaattaataagcaacagactaactgagctttcaacgcattatctccatcatggattaatgataaatagttcatttaaatgtgcccatcttgtagagaaaaaggatgggcaaacaatcttgttatgaataaggacaaaccaaggacagtaatgagcatatacaaagaaaagcaattagaaaatctattatcttctacactgctattgggaagcaaaattcaatgtatatagtttagagtttacttaactttgtgcagaattggctacttgtgtagatcatgtgctcgagaagatggcgttctgagtctgtctgcatcctattttctctaacaaaaggaaatagtgtatgagaagctagaaccaaatgtattccatgccaaactaaacaatggagggggaagcagatctcactaaaagatatggctaactgagacagaaaaaagcaggaaacgcgaacacactatagaatcattgatttgaatattatacctgattaccagagcagttaccataccagaaaaggcaaggcagtaatgtattcagcagttacagctgcaattaagaataaaatcatgcacacacaaattagcatagtaaacatagaacattaaagataactatcaaagagatagaataggatgccaacaaaagtaggatgggtgagggtagcatacgaccaaaacagaacagagacctaatcagcatggcacaagcagaagggagagaagccccactcgtactgacctatggtcctctcgcataatagcagccatggctgttgcttcaccttagattgtgaggctaggtccccgtgccgtgatgcagaccctggttgtggctattggtcaaagatgcgaggatagcgtctaggaaggtacctaagggtggaggaggtgaggattaccatggtcaccaatggaagaaacgatttctagtgaggagggaggggaaaatcatatcagcggcacaccatattgtggattttggaggaggcgaaggctagatgagagaggtcggacggaaatagggattggagcgatgggatcggaggtaatctagaaggctttcattggatcaccttcgcagataaagtggaggccctagggcctcccgaccgagcgcacgcggccgaccaaaccgttgaggcaagtagctccgacgggaaggcaatgcgcagccgaacggtgaaggaaaccctggggaagaagaaaaaaaaagggagaaatcactggattagactgctactcagcaggaagaaagaggaaaaagaaaggaggagaaatcgccggcgacctcaccaagaaaaccgaagaggagagaatggggagaggagggatgtgcgcagcagccgagaagagacttcaccaagcatcctccactaccacgtacggcggcaggagacggtggccaatccggcgtgcgcttacacggcaaccggtgtttctagcgccgctccgtgtggaacagaagcacggaaacacggaaatagaacgtgggctgagcaatgagaaaggtaaaagcccatgtgtaaggaagggccggcacaggaaaatggcccaataggaacgcatctaatcctgtgctactaaaaccaattaaacagaatctaatatatcgctgcgcactatcgctgctaattgctaaatgcatatgcgctttaattatccgaaccaaactgatgacgtggcgcccctaatcttccaaagatcccacggggtttaagtaatctaatattagtataagttaaaactcgattggcaatggagcaacaacaagtattttgtactcgcgctggcttgacggttatccttgcctcattgtctaccatatttatggcttttacatcatgacaacatcatgacatgactgtgtttagtttctgaaattggggagaagtttagggaaagttggtagtttggaaaaaaagttgagagtttatatgagtaggaaaattttggatgtgatgtgatgaaaagttggaagtttaggagaagtttggtgtgaactaaacaagacctaaactatagtgcaaaaggttaaatgaattctgatcaaaattcgtccgttggcataccttcgcttcttcccaataaaaaaatttcgctgattaaattgtttagccaccaaatgttggtgataaacttcgaagacaattagtgacaattttgttaggagctagattttaaaaatagaattagttctaacacacaattgttacttctatttcgataaatacaaatatattttatctcaaactattgctctatttctgaaaaagtatatttattttatgtaaaattatatagatcagtttagatcgttctt

SEQ ID NO: 59303 - DNA, 2285 bp, Oryza sativa
tttatatgccgcgatgaaaactgtaactcttttacatctttcgtataaaactaatatcacgtaacgtaataagaaacaccgagggatcttccggttagctacacaaggtggtgagctagacgacttggattcaaatgctcatccattataattatttgatattaggtaatttcttaatatttacgtctttacataatataatataataggtagatataatcggtaagaacaattcataatactgattaaatttcataaagctacatatacttatatgctatatgtttaacctaatacttttcataaaactacagacttaaagtatcgtatcatattagaaaaatacaaatttaacattagttttatcacaaaactacaacttttatagccttaaatatgatatggataaaaactctaaaatctatagatattttataatttcatcagtaaatctgtagttttggatatgatgccttaaatcagtaattatatgagaaatttgatacttcctccatttcatattataagactttctagcattgcccatattcatatactccctctgacggagcgtggggctcctcaccgggagaccgcgcaggcccccctttgccagttcggccgggggcgctaagtgaggttcttcaccctcgatctgtggaatgtacgcgagagagcaaacgcacaagacacgggcgatgtagacaggttcgggccgctgagaagcgtaataccctactcctgtgttctggtggatatgtgtgaggaagagttacagagagtcggggagcaagagagttcaagctctagaacccctctttttccttctcttctggttcttttttctctcgatctcctcccccagctcaagtcttctcagagttgtccccccttttctttgtgggcaaggtcctccttttatatctcaaggggataccacatgcaccacttctacctactcttcttttgggtggggacccaccctatcttgaccaaatcttgacacgcacctccgcctggaagctaaatcaacgcctgtccttgagtgatgcccagcgccgtcactcgtcagacacaggggatcaccctgtcatttcttcattaatgggcggagttttgcaatggccgctgtccgaatgaccctccgatgggatgggtcatacctgcctccactccgctggaagctgatgcaacatgagagcacggttgtctgccgatgacgtgaccggcgtcggaccagtgacagaccggtcattcttgtccaccacgtgtcagtttagcatgccacacatctgcccttcttcatacagtgacttccttgcaatggttgcgatgaagcctggcatgaatcgagccgggactgatgtgctaactccaggagttaccacgctggctccagctagggacgagtgccaagaggctctcatcattccgacgggacggggcgaggcgtgtgacagtccgcctgctgccacctaacccgcgatctgaccggtctgtgaccgatcacacactgcgaccggtcacggaccggatatgcgtgcgccgtgctgcattaaatgcggcgtggcgcgcttgtccattccgcaataaatgtggtttggtgagcgccgctgtgcccacctaactcacaaacatggcgccaataccacagggggtcggggcaccccaaccctcggggccgaagcaggagcggcccgacccctcgggaagacaaaggaggggtggccacgtctccctcaggcccgacccccccccccccgagggggttaggccacgtgggtgactgcggctgcccaagcctctagtcatgatacccccgatcccatgtcaccgacagtagcccccggcgttatgccagggcgatcgcccccctcgagggaagcgctcgggcgtgacgccactccttaggtctggtgacaggtgggaccggtctctacaggtgggcaggaacccagcggtcgcaaatcgcgcgcatcggctagggaaaaaacgaccgataataatgagtggcctcttcaagaccgctacatttctcgaaatagcgcgcgaatcgggacgagccggttcatttcgcctggagatatgatgatggcgcttcggtcggcgagcgtagttaacgcgcgcacgatatgtctcatctcgactgccacggccgcacatccgcctcgtgcgccgcaaaagggcgagtgggattagtggaggcgtgggcgcgagaaacgagggggcgagatagtgggcgcgggaaacgaggagccgggaatagcgttggcaagggtataagg

SEQ ID NO: 59304 - DNA, 1033 bp, Oryza sativa
  unsure (1)..(1033): unsure at all n locations
nnnnnnnnnnnnnnnnnnnnnnnnnnnnnnnnnttttgcagcaaggtggtgcgcacgtcgatcgcgcgggtgctgacggtgatctcgcagaaccagagggcggcgctgcgtgaggcgtacaataagaagagcctcctccccctcgacctccgccccaagaagacccgcgccatccgccgccgcctcaccaagcaccaggtataagatttcataaaaccgtgcacacctactactgatatctaaaactcatgctgatagagattcacatggtgtcatcttccttcaaacttttagcttaacttgggctgttttgttttttttgcatgaaatgtgtacttactaccattgcagtagataacttagttaatgcagtgaattgttctgtactgctacatctgcatgctacaccattttgttaattctattagcaacgccattttgttaactgcgtggggtttcatcattgttggttgcttttaattgttagattgtacatgtaattgtagatttttattatattacttgctataaaattgcttttcttaacaaaattgtgagaaatacaatcagttttgtcagattgtatgcatccctcatcgtcaatcacttcacagcaactactaggaaacagataaaaaaatggggcatcattttttcccatgtagaatgtggaatacatgagccctgggatgaatacatattgctcacgcaatatcaagatatatgtagttactttttttgtttgttttggcagttggtacttggctgtgcttgtctgcatatgatatataggaagatattaagagagaagggtagataaaggacttgtttgctgcattctttgaaaaatgaaggctcacctttttcaattcttatagaaacatgaagtcatttgtcatcctaaacttatgttcaattttctagtgtcttgtaatgaatctagttatgttatacttgcatccgtcttctgacattttccatggttgccatatcacagctttcgctgaagacggagagggaaaagaagcgcgag

SEQ ID NO: 59305 - DNA, 1064 bp, Oryza sativa
atcgtgcaacgaatactacatatgcagttcaaataaaaaatattatatttatatctagtgctgttcagattaatgccattttaaatcatatatcattttttttaaaatgtcaaatttgtgcaccatttagtttttttttaccaaactatgctaaatacataagaaatcctgctaaaacttggtaatattgctaaattgtcaaaattttgacaccgccaaaatttaaaatttggtaagatttaaattaactataatctaaacataccatttatatagaatttggaattacaagttggcttatatcaattttaatccatcttgttaaattttataaaaaaaataataataagttactccctccatttcagattataagacgttttaactttggttaaagtcaaactgcttaaagtttaactaaatttatagaaaaaaaatattttcaacccaacacaaatttattataaaaatatattcaattattgatttaataaaactaatttgatattataaatattattatatttgtgtataaatatctactgaaggagtacttggtagaccgcatgcggtactttctggtataatgaatgcacattggtccggcagctagcgatcgagctgtgctagtgctaccgctactaggaggcgactctgcgccagctgtcatggtcgacgccatgtccggcggcgtcctcgtcgcgctcatggtgttgctgctggtggctgcgcctgcgctgctctcgcggctggagccgcgccggcggccgccgcctgggcccgtggcgctgcccgtcgtgggacaccttgcaccttctggggaggccgttgcaccgcacccttgccgcggctcgcggctcgccatggcgcccgcgccgtgatgggccttcggttcggtcccggcgcgtcgccctcgtgtcgtcggcgccggcttgcgaagagtgccttggcccgaacgacctctcgttcgccgacaaagccgggcttccgtccggggagatcctgtcgtacgaatggccaccattggcaccgccagttaggttcgtactgggccacattcgccg

SEQ ID NO: 59306 - DNA, 1437 bp, Oryza sativa
ccgccgccggcgaccactctccggcgccgaggcggcgaaccatgatcggcgtgctcctctccctgcagagcaaggaccccgacgcgtgccccgaccagctcatccgcgccctctgcatcgtgagtataccaaccagctgcatgccgcgacgtttgctcctctaacggacgaacacctgtgcgttcttcttcttcttcttctccggccagggatccctgcaagccgggacggagacgtcggcggcggtggtggagtgggcgatgtcgctgctgctgaacaaccccggcgcgatggcgagggctcgcggcgagatcgacgcgtgcgtggggcagccggcggcgcggctgctggaggcggccgacctccccaagctgcactacctccggtgcgtcgtgatggagacgctccggctgtacccgccggtgccgctcctcgcgcacgagtcgtccgccgactgcgacgtcgccggcttccacgtccgcaaggggacgatgctgctggtgaacacgtttgctattcacagagatccacaggtttgggatgaaccagaatccttcttcccagacaggtatccatcttcttagtgcttactctgttcatattataaataattgggaaaagtacgaattaccccctgaactattgcggtctaccgaattacacccttgaactcaaaaaccagacattgctcactccgaactttcaaaaccggacgaataacccccttgatccaatctaaagcggttttgtcctatgtggcaatccagtcagcaattcctattttaaaaaaatgtgggacccacatgcatacctccctttcccctcttcctctctctattctctctctctcacacacatatgcacgtgatgcagggggcaggaagtgggcgcctgggcggcggcgtgagcggcggcggcgcgagcggctggcgactagcggacggcggcgcgagcggcagcggcagggcgcggctggtggtgagcggcggcggacgggtggacagtgtgcgggggcgaacggtggacgacggtgcgcgacagcgaatgggcggtgcgcggcggcacgcggggtggacaggtggcggacgggctggcacacgcaatgagaggtgggggcggggacgagcgatggacagtggcgcgcgcgaacgagcggttgacgacggtgcactgtggcagatgaccagtcggtgcgcggggtcaacagcggaacgcggggagggcgctaggtaagacggcgtcgccgaaggtagcagcccgtggctcgcggtctgcttcccctcaccaggactccctctctctcgggcatgggcacatgtcgctcggcgcgggaaacgaaggcggcgggcctgttccagctcgttcgcgtcgtgacaagcgagcagcacgttcgcattcggcatgaatgatgggcttgtgtccggttacatggcgcag

SEQ ID NO: 59307 - DNA, 5463 bp, Oryza sativa
aagctgtaagttggtagctagcttataaaaatatagaaaaacttggtttttctagttttagttttcaaaggcgttttttgaattctataaatatatattttcagaatctaggtaagaatatgattgtttgaaggagttagagattttgggagaattatttctactagaagcttcttcaaacaaactaggttgagcaagcaaggtagaaggggataagaaaaataggggagttatccgaacagttcaatttagatcgtgatgtctaatggttagaatttcgtgaaattctcatgatccctaaaaagttcgaatattgcgtaggcattctggttcatttgtttactccctccggtttcattttaattgacattttggataatgacacggtctacgaaatatatctttgaccttatttttctattataatatatacaataaataaatgcatgtttacttttattatagtgctttgaaagataaatctataaatgttgttttagtttctttaaaccaaatatttttaaagttatttatggtcaaagttataaaagtttgacctcaaccttgtccaaagcatcaattattatagaaccgtagttagtactcttgtagctcatttgttttgttagttgagaaagggtcttttttttttctttcaacaaatgaaactgtggtagacatgaaaagcgatcactcacacattttttaagaagaaattatacatacatttttttaacaaataaaactgtggtagacatggaaaatgttcactgacacatctttcaaacctaaattatgagcgtgttaagaattaaacccgagacctcaggttaaaaccacaccactcgctgcagtgcatctagaaagttttactcaacacacccaaaatgtttggctagatttcaattcaatgttgtttgcttggttttggttgcaacttgcaaggatccacgaacggagaacgacccgttcatggggttcatctacacgacgttgcaggagcgcgccacctccatcttccacggcaacacggcgcgccacgcggggcgccacggcgacgccgccctggcccgcgtctgcggcaccgtcgccgccgacgagaagcgccacgaggccgcctacgccgccatcgtcgccaagctctttgaggtggacccggactacacggtcagggccttcgcccgcatgatgcgccgcaaggtcgccatgccggcgcgcctcatgtacgacggcgccgacgaccgccttttcgcccgcttcgccgccgtcgcgcagcgcctcggcgtgtacaccgccgccgactacgccgggatcatcgagttcctcgtcgcgaggtggggcgtccccggcctcgccgcggggctttccggcgaagggcggcgcgcgcaggacttcgtctgcagcctcgggccgaggttcaggagaatgaaggagagggcgcaggaggcggcgaagcgggcgccgcccgccgccgccgctccgttcagctggatccatggccgtcaggtgcagctctgattctgactgaatcggtggtaattattacagtaacaagtttgtgtttagacagaaagaaaatctgacaaccccagttgctgagaaagacataaaatagctttaagtctaataattgttatgtgatcttgcaaattaaaatgtgtatactttgtcctttgttgataacttgatatggtacatgaaagaaaaaaaatcatgcatgtggtgttggtttctttgatcactcttcattagcctccatgaatttctgaagtttcttcatcatgaagacaatactcatttctcacaaagtatcttacaactggcaaatttatgactgaaaattgtcgccagtgacacgatataaatagatacatgagtgagaatcaaaagccagattacaggtaaaacatcatcagcattcttcatggactagtgcaggatgctgagaaacaaagccaagataggaaagggaaactgtagaagctgatttatatacttagatatatatatgttacagacctgtatcgcattctatattttctatgcacctatattcaagcaaaggcaaagtatttccattatatgaatctcttcaaatattcaaatgtgcctttatatgtcaccaagaagaacaaaagggcaggtccagtgcaggatgtccagctcttaatctcgtcacaggatgcagcatgagcaggcctgagagggaaagagatcagtgattacattttcattatagtgttgcactgaaaattctgctgatgaattcagatttcccaactcagttgtatcaatctagtttatcactttgaaagacccaatgatataactaatcaaaagaatttaaaagcagaaaactgaaattgttcagattttaatctgccaagtacataagaaagcatcaaatattaagacttgttaggcaaaacatttcttttttagataatggaagcaaaccacttctggcatctacacccaaaggtgtacatagccaaaggtcaaacattccatggatatacaaactgcataactcaatttgcatctcttgtatatacctctgttatgacttctgggtgatcaaatattcaaatgaatttttgcatgttttgtagtgtcgatagtaattcatggctttgtgagaaacagagttgaactagaacaggggacaatgcataactccagaagtgcaatcgaaaagtaaaaccatgatatataaaattttcactatgttcattggtccttattatattccattagtgggacagcagaattacttactgagggactgcctaatgcatctttaagttacttcgctatatatctgtacacataaatctagcatattacaaaacaaatgcacctaaagatgccaagaaaaaatcaccatagtcgcggggaaaattgcccataactccataagtaatcttataacctgagcaagaatcatactacaaagtaatgctcccatatggattatgtgggataagtcacaaaagatttgtcgtatagttagggacagcacacagatacctgttgcactttatgttcctgtcttctgccaccagaaggagaagatggtggttgctgcttgacagaagagtttggggtcagcttatcacgcctaaccctgttaaaaatgccggtgtacttctccccagatgccgcattagcatcatcccaatcaccaaatggaggtacagtcacttcatctaaagcctgaaaaagaaaaaaaactcagaatgcaaatgcactttattcagaaaacctctaacacacaatgtgcacatcatttctgaatttgcaaatggagatcgagatgaggtgaagaactgtacaggttcaaagcctctgcctccttgcttcaacctgctccttcctggagtcactgggacacggccatcagatgaagaggccttcctatctggagtctgcatcccagctgacctgtacctggaccttggagaggcagcagcagcagctgcaacttctctgtaagggcttctgggtgagccaccatagccaccatggtccagatgatgctgctgcagcggattggcgtgccgtctcgccacggtttcgcggtggagaggcgatccggcaggccggggatggccggtttcgggctttctttcatacctctgcctttggttcagggcatcatgagaggatggatgcagtggtgacctgagaggaggaggaggctgatcaggtgtttcagtgatcacttcatttgggttggagtaaacaccggtagcagttttcttgctccttctcaggttctcaaacttctgcgtgtacggggtgtcgcctgcggctgaccagttcccgaatgtaggaactcctccttgctgtttggagaaatgaattagcaaacatttgtcatctaaccaaatcatggctgatacattgtcacagattctaaaaaaatgtacagttgattatagaattatacatttcaaattgataagtatataccccataggttgaataactttttgaagagttatcagtagtaacaaactaacaatactaaatcggtgagaaaacaaaagtctgaagggaaattactggaacaacaaaagggaaaaaaaatgatatgagaacaatactattccagtattctatcattaagaagcatgtgcaaacagttgtctccttgataataaatacacaatctattttacgaccccctgattttatcattatcctgtgttgtcaacttgtcatcatgattcatggatgtgccatttgcctttcatccatatcaagccaataaatccgtcgaattctttacaaagaaaaaaaaaacccaagaacatgaggtaatccagaattacattatactacctcccaaacacctgaaatttctgtcatagatctattgtgcaataatatatgtgttctaaataaaaccccagcaacaagaagatcgtttggttcaatactgtgatcggttttaactaaccaatatgaataagatcccctgctttcctctgtaactactaaatcaatcgtcggtggagtaagaaacatcaagtaaaattaaattgcatcatgctacaagccaaaatcctcaataccagcatcatgaatattttaattccgggagcaaaaatcggaaataagcaactcaccgacgtcatccacttcaagtttgatccgaacactgatccagtaggagaaaactgctggtgctggaggatgcaagattttctgtccaagaactgctaatcaatagtatttctctcacaaggcactaacaaattgcaccttctctcccaatcatccagagctaccaaaatcaactgtagcgatatggcaaacaaacactaaggtatctttcattcaaaagaaaactactcaagattcctcgtttgaagaaatacaaggaaaaaaaattgaaaacaacacttttcactcggattccttaacagaacaaatcgaaccaaaagatttcctgaaaaactacaattctcacaagaaaaaaaatgaattaacaaaaaaagaataagctccggcaagactaaaactacaattctcacaagaaagaagcaaaatttggggagaaagcaaactgaaacgcccgagagccagtggaagcaggctgcttcactcttgagacctagactgctagaacagctccaagaaaaagaaagaactcaaatttcttcaggaaaacacaaaaccactccccacaaaaagatcaaaccccctcaagaaaacggccacaatcttctcccttggaagaaaccaaaattgaacggtggtcttgcctgtgcaaatccctcaagaaaggacccaaagggccaaaaccaccttaaaatcaatcagagaaggcacatttctgctccattccgcagcacccgcaagtggtatatatacaaatacgctcataagtagtaagagaggaggaaggagaaggtcttgccgttgacaatgagacaacgccattggtttatttga

SEQ ID NO: 59308 - DNA, 5181 bp, Oryza sativa
ggccccttgtctcagtttgatttcttaattggtagattatgcaacttaacaagaaatcagtttagtgcatgcaaactcaatattgcgtacttaggctgtgtttgataaaagaagaaagacgaaaattgagaagatacgtaaaatgagctgagccattaatgcatgactagttgagtattaattatttcaaacttgaaaaatagattaatatgatttttaaagcaaattttctacaaaatttttttttaaaaaaaacacaccgtttagtagcttggaaagcgtgtgcataaaaaacgatgcactttatctctttctctcgcatgaatgaacacaaccttacttactttagtactcttttcggtcaaaattgtttgacattttcacctttcccttgtctttgaggtgcgatttttaccataattttgtttctttatagatgtagtttttaatgcaaacttatatatgcttagctttatgtgttttcaaactaaacattttattagaagccattgaaaatataagcttacaccattaacaaggtgtgtagaaactatgacatgtacaaaaattaatatgtatacatacaattaatacatacttcccttagttaaaaagaatgaaataatctaggtattatcactccaatgtaacctttccatatatatattgacagttgaaagaagtagttcagattcatcatttttctgttttatatttatacacctcaaaatggttactgtgctttccccttatacaccccgaaacaaatagatatatatttctttgagtaaaaaatatagatattttgaaatgagctaagtattttaattgttgtctatatgcagttgggatgatttgtgctacttgactttactgatcgtccactcgcattaatttagctcatctttattttctactccacttgtgacctaatctaggttgcctgtgctctaacgtaacgtgacttgatctaagtagaaagcaaagaaagagacagcacgttacctgagcctgcatgcatgccaatatatagctaactactactactataactaattctcaaaaaaaaaaaaactactactataacttaccgtatgctatgtgtttgctggattctcctctgactttccttgctagaggtttttaaattaaccagagctggttccaggctgcatcattaattgggtcttgttttcttgttttgctcagaaactgaaactgtgtctcatttttttataacaactttcttagtctcaacggatatgattataatactatctagggtgatgaatattatgagtactagaactgatttcaactgttgatttataagttttacgtactatcagtagaaaaaaaaatgctactactagtagttgaggtggtagtataaatatacacaatccattaaactagcaaatatgagcagtctaaattgatttctaatagagaccattgtaaaaacacttgattgtgttgtcgttacttgattgcttatttggtcgaaaatcttggtttctttctgtcatttctgaaagttttatgcaagcttacaataatgcggctatatatgtgccccatcagattgatgcagatgccatgagggacttttggtggaaaatctctataacaagactaaatgtaagataaatttaatagatacacacgcgcgcgcgcgcgcacacacacacacacacatatatatatatatatatatatgaatatctatttgaaaaaatatttggctttgtaccttcaatttagttaatttggaggtagaggccgggttttaatctattttctaaaaacatctaatttgaaaaaaatgaaaaactataattatctttcaattatgtattatgtttcttatatctagctagtattctttttttctctagaactcaataatatatgaagggtttggccaagggggcttaggcccacatttgcccctgttgggattgtcataattataaatggataggataaatcaaacattacatattctaaacctagaaaaatagcctacaacaagttatatatctaaaaattttatgtatactacctctattaaaaaaatataagcatttctagaattcaaatgttttactataatataagcatttctatattgatccccattattcgaaagccaattagatgcttagaaatggaatctctagccattcaaaatttaaaaattgacaattaaaatgaacaaaaggaatcttttgacataatcttaatatttgctaaacaacgcctaattgttatcctaaaataaatcaacttttatacgacattaatctaaacaaagtgatttgcttcaagatatagggagtaaaaatccttatattttagaacggatggagtatatgagtagactgacctggcgtcagcttatatacctgggtttgggtcttgatcatagtggtatgcaggttaatttagagcacgtggtccacatgagaaaaatgctttacttccttattgtcagtgtcttcgtttggtcaatgcaagccatagcagggaaaattacacaggagtgtacttaagtcatatatatatgcatgtgattgaaaagctgaaactataatatatcagtcggtgtcatactgtcatgcatgcattgtagaattaaatctgctatccgtggattagttcaaaaggccgcagcgcacagttagggattaattaattttagtattcatggctgatgttgacaagttagaagacatgcttataatgcgcgcactagaagtactactcctacttgtgttttggtctcgtgtctgtttgttactggagtaaaacttatttagcaactataacaacccatgctatgtgcaagagaggggatgatttcttttgtttttaacaatgaaaatagtttgaacgatactactgtgttttctattggtagtattataataccaatagaaatgatttatccatattaaggataaattagtaatttattaatataataattatgggtaactttaacattatgttttttcccgtttagatcgatctgtggtcattatattgcgctggcatcatttatattccatcgaaaaagccaaaaaaggagaaaaggaagtgtagtcactacttaatgacaattataccctatcgcatctttttttaacaatagtacctctctatgtttttactaccgttaactgaggtggtggtagtacgaatagatttgcatccttccatctattaaatgagatcaatggttcaaattgtttcctattaccagtagagaccaccgtagtggggctcaaatagtttacaccgttagcctctactggctggcatagaatcaataagtgttaaagttgagaatgacaaaaatatattgagtgataggataaatccttagctcctctaaaaagatgatcacttgaataaaaaggtaagacatatcacacatattctacctagtagttctattgtatcgatgaactaactagatgttccgtgttatttccttttttttttcttcgatattatactcacccttaagctctaagacatggtatttgatcccttccagctttcaaatatttggttttcaagtttggagatgagttttagacaaagcgaagagtttagaggtcaaatggatttatgattatgccatatttttttcaagttgcatgcatgtatggaaattaaacctcatgatcattgttttattgatcgaattgtggttagataaattatgtttttaagtctctctctctctctctccctctccctctctcaattgtttgatagtttcatgccataaataatattatccttaccaaagtacattagaacgtaaacaattcaatttggcaaaccacataacaatgttaaaacgttttcaccaaacaaagttatcataaccaatgcaatataataccaaaccaaggctaaaacatccttataattaaccccagctcccaggtagagctaggtcttggctaattaatttaggggaggaaaaaagaagtataccgtccaaatgtaatgggactttaattcttccagaaaatcaaacaagcatgtgataattaatatgtcgtgacgacgagtcgacgatgtgcaacatacgtgttcctatgtactatacgtttcagacaaacatgataatttgcacgtttctatatcgtcaacccatcttaatatataattaaccagtaaaaacacacatgactgaaacgatcgaaatcgagcacaaagtcttccggtaattaataaactgtcattttcatgctggaccaaaatttctccatgacatttatgatctccaaaacgttaggcaaaaaccaacgcttaactgatcttcgatctccaaaacgtggtcaattgttgagagctgcaactcaattgcgaccgtagggtgacttgctactgcagtcatgcatgtgtgtgtcatcgttggtggtgctgtcgaactacatgctccccaaactcctacagatgttattgagttacatgtaccagctagtttagtcaaaagattaagttgatgagtgaggaagaatataatgagtcaattcaattcaaacttatattgatgtggaaggacggacagcacatttatatttcaatcaacaacttttattgtgtgtccattcaacccaaagttataagtcgataaggaaagattttggcccatgtaggagccggttcaccccaaaagttcaagtagattttataattcagtagattttatacgctggttaactggctatatatttacaactctagtggacttaggggcctaaccgccctaggaagctacttagactcactggcatactacctctatcacataaaaagttcatttttcagtatttggatacaacgtttgatttttcgtcttatttaaaaattttatgattaatattttattgttattggatgataaaatatgaatagtactttatgtgtgtgactattttttttaaattttcttcttaaatttttcaaataagaaggcttaaaaataaatttattttgggacggaggtagaagcaaaatggtaggcatatatgttgttggtggtccgatcgatgtagtgagctttgcttcagttttggaaatttcctgtgttgatttagacaccaaaatacaaaagtacagtaaagctctactattttgcatccttcgctataatcc

SEQ ID NO: 59309 - DNA, 3734 bp, Oryza sativa
gggatggttctcccatttactccgctttcactcagctttgacaatgtcagatattctgttgacatgccacaggtaaaatatggaagaactcctaccaaatcaggaattgatcattagtttgcatttttctaactttcagcgtgaaattaatttcaggaaatgaaagcacaaggtgtagctgatgaccggttggagctcctcaaaggtgttagtggttcattcaggccaggggtgttgactgcactaatgggtgtcagtggtgctggcaagacaacactgatggatgtattggctgggagaaagacaggtgggtacattgaaggaagcatcaacatttcgggatatccaaagaaacaagagacttttgcacgtgtgtctggatactgtgagcagaacgatatccactcaccgcaggtcacagtctatgagtcgctacttttctcagcatggctccgtcttcctgaggatgtagattccaacactagaaaggtccgtcaaacatttttttttgctattcctacctatacttgatatagatagatagtagcttacctttgtgtatgcagatgttcattgaggaggtgatggagcttgtggagctcaagtcactgagagatgctttggttgggcttcctggagtgaatggtctgtccctgaacaaagaaagaggctaacaatcgcagtggagcttgtgcaaacccttcgattatattcatggacgagccaacctcagggcttgatgcacgagcagctgcaattgtgatgaggacagtgaggaacactgttaatactggcagaactgtggtgtgcacaattcatcagcctagcattgacatatttgaagcatttgatgaggtgagtgtgattctactttggagattcgtaccattttctcctcagatattaggatacattgcggaaagcccaaaaatcaattgattatggctgtgtttctaaactacctggatgatttgactaatatattttttgcttgcagcttttcctgatgaagcgaggtggtgaagagatctatgctggtccactaggccatcattcttcggagctgatcaagtattttgaggtaagtgatattacactaattctaatatacctcaatgacatttcttcaaaattactgattcaatcgcatctttgtgtatcatccagagtatcccaggggtcagcaaaatcaaagatggctataacccagcaacatggatgttggaggtgacaacaattggtcaagagcaggcacttggtgttgattttagtgatatatacaagaagtctgaactttaccagtgagtaacttgcttttaatcctaattgttgtttcatctttctgcaaagcaatttttttttgcaatatgccatgtaacactgattgctaccttattcaggaggaacaaggccttgataaaggacctgagccaaccagcccccgattcaagtgacctgtatttccctacccaatattctcagtcttctttaacacaatgcatggcttgcctgtggaagcaaaacctgtcatactggaggaaccctccttacaatgccgttaggttctttttcactactgtcattgctcttctctttggtaccatcttctgggaccttggcggcaaagtgtaagtaaaatgccactttctatatgcaaagagggtgtaccttagaaatcttattcatttcgtgcttcttaatccaggacgaagtcacaagacttgttcaatgccatggggtcaatgtatgcagcagtgctgttcatcggtgtcatgaactgtacatctgttcagccagtggtggccgtggagcggacagtcttttaccgtgaaagggctgccggcatgtactcggcgtttccatatgcatttggccaggtgaatggtcctcctgcaactgacattgagtcctggttgttgcatccttgagatccagatactgattaattcctctttcaggttgtcattgagatcccatacacactggttcaggctactgtatacgggatcatagtgtatgcgatgattgggttcgagtggacggctgccaagttcttctggtacctcttcttcatggtcttcacgctcctctacttcacattctacggcatgatggcggtcggcctgacaccgaactaccacattgcctcgatcgtctcatcggcgttctacgccatctggaatctcttctccggcttcgtcatcccccgacctgtaagtttcgcattcccaattgcccctcattcttccatacacttccaactccattgggtgctcatctctgtttgtgcctgatgatgtttcagagagtcccaatctggtggagatggtattgctgggcgtgccccgtcgcgtggacgctgtacggcctcgtcgtctcccagttcggtgacatcgagacgccgatggaagacggcacccctgtgaaggtgtttgtggagaactacttcggcttcaagcacagctggttgggctgggtggccaccgtggtcgctgccttcgctttcctcttcgcttccttgtttggcttcgctatcatgaagttcaacttccagaagagatgatgatgacaagggatattacattcattgagttgcaaacgctacctgaaatttgtgcatatcattggatctaaagaatttttttttgttgccattagaatattgtaaatcataccagcctttcccccttatttttatagaaagattgtactactgttacacctagtaattttgttattagtacccttctttttatagaaagatggtactacttttatttttaatttttatatggggttgtctagtgttcagttgactgaactcacattttgctcgatgtaaatgaagaacagttctgctgttcgtcactactatttttgttaattgtattgcccagttttcctcaacaactctgccctacaaaattgtgaaatagtgatacatagcctgtatatatacatccgtaagcatttaagctcacagagctcacacgtaaccggagaaattcggccgccgattagatgatcctaaaatcgttttttcttttgcggcacctaaaatcgtatttaacgtcgtgggttttggaccctgtttagaagattagcctcatgaaaacaaacagtgcccaaatataatgatttaatgatcctagagtgatatgtttggatttatgggctaattgagggctaaaagatagagagagagtagagagagaggggctaatgtttttgaggggggctaattcacttaagtcccaaattagcttacttgtttggattcttaaggactaatttatggctaaaaggttagggctaataattatcccacaaaaacaaacaggcccaaatataatgatttaatatgctgggctaatctgccttttaactttgtaggctattttcaaatctcatcaaacctacctccaggctccagccgcagtagtcattcatatacgatctggatcccataaattcgaggagcagacttgatttctgattttgctcggcaccgtgaattacttgctgaggttttgcttttgcctattggatggtttggtatactgtagtgcgaaccagcgtgtgattcaatatgaatactccctccgaaaatttgaccctaaaaatgaattaaattttcgaagcaggtcaacacattccacacgtgtcaaggaatgtaacagcaaccctggtacacgaccaaataaattaacatgagaaaaacagtgcatcaaaca

SEQ ID NO: 59310 - DNA, 2322 bp, Oryza sativa
cgagcctcccacacggcccatcacgagcccgcggcttgtgactccccccgacccaacccgttccattccgttccgttccaacggaacggattccattcccgcgccccgctacataaaccccccttcgcctcggcgtcgtcgtctccaaggcttccctcccatcccaaaaccagcgcaagcgaggcgaggagtacgtagtggtaggaggtggcacgccgcggcggcggaatcggaatcgactagggagatggatgcggcggcggagatgcagaaggtggtgagcctgaggagagggggaggggggtcgtcgtcgcggggggcggcgtcgatgtggtggagcgcggacaacggggtgttctcgcggtcgagggcgtcgtcgagtggggaggatggggaggacgacgaggaggcgctgcggtgggcggcgctcgagaagctgcccacgtacgaccgcgtgcgccgcgccgtactgccggtggtggaggagggcggcggcggaggggaggcggggaagaaggtggtggacgtgctcagcctcggcccgcaggagcggcgggcgctgctcgagcggctcgtgcgcgtcgccgaggacgacaacgagcgcttccttctcaagctcaaggagcgcatcgaccggtgcgtactgtgctgtaccacactgcgtcacgatgtcgccgtggcggcggacgcggttgcctgcagggtgtttgatgatttgcgcgtggtaattttgatgtgcagggtggggattgatattccgacgatcgaggtgcggttcgagcacctggaggcggaggcggaggtccgcgtcggcaacagcggcctccccaccgtcctcaactccatgaccaacaagctcgagggagccgcgaacgcgctggggattctacccaacaagaagcagaccatgcccatcctccacgacgtcagcggcatcgtcaagccccgcaggtgaaagaaagaaaaagaagcatcacgttttcaaaattgcttatgctttatataacgttacgtgtgtgctgctctcatggtttatttgcgattttttgaagcattgtaagatatttgcttgaagatatttttgtacgggatgccggttcccaggaaacgaaatgcttttcaattagacatgtccctgtaaactgtaaagttgatttgtctttgttggagcctagattaaccaagatcatttggaatttaacttctatgcttctcctataacacgttcttttgattatgcaggatgactctgctgttaggacctcccgggtctggcaagaccaccttgctacttgctttggctggaaggcttggcaaagacatcaaggtttcaaacaaattttatttacttattttgcaataactgcgatataacgatgcgtttgggcgtttggcaaaccagtccatattcccacagatgtgtgtacttcatctttaatatattgtatacgattagcgaaaatacagagaacatacttttagagaattaatgcataaaggcttacgcatcattgcattaagttggtagaaacaaacaaagttcgcatgaacagataacttttcttaggtgacatgtcccaaaaactgtataccttgctcttgagtgatattactgataactgacatacacaatgcataatggggggaaaactaatttgcagttctctggtcaagtgacttacaatggacaccagatggaggattttgtgccacagaggacagctgcatacatcagccagcatgatcttcatattggggaaatgactgttcgggagacactctcattctcggcacgctgccagggtgttggaagccgctttggtatgactatgtgcaaggaacaaccacaagtgcatgcattcttttctgcagaattcgccttttgagaaaatcgtcatgggttgactgatacttatagagttctcttgttatgtcattagatatgctgaccgagctgtcaaggcgagagaaggcagcaaatattaagcctgatgctgatattgatgcgtttatgaaggtaaaaattgcaaatcctatataaatcagaattattctggtgtctgtagatatgattttcatacgaggtatgagtgaagttttgctataaattttctgtcctaacttgatcaggcttcagcgatggagggacaagagaccaatttgattactgactatatactgaaggtacatgcatctctgagctacaatagctactacctccgtttcaggttatgagactttctagcattgcccacattcataaagatgttaatgaatctaggcacatatatatgtctagattcattaacatatatatgaatg

SEQ ID NO: 59311 - DNA, 6332 bp, Oryza sativa
  unsure (1)..(6332): unsure at all n locations
acatatatatgaatgtgggcaatgctagaaagtcttataatatgaaacggaggaagtacttacttcagattggattaagcaaattcgttttatttactactttacatatgtaacatgttgcagatattaggactggatatatgtgcagacacgatggtaggagatgatatggtgaggggtatctccggtggacaacggaagcgtgtcaccacaggttgaaaaatagaatttcactttcagaacatgggatttgctggacaatgttttgattgactgtttcttccaggtgagatgcttgttgggccagccaatgcacttttcatggatgagatatcgactgggctcgacagctcaactacatttcagatcgtgaagtcgctcagacaggccatccacatcctcggtggcacagcagtcatctcgctgttgcagccagctccagagacatatgacctatttgacgacatcatactcctctctgatggtcagattgtataccaggggcctcgagagggtgtgctagaattttttgagttgatggggttcaaatgccctgagaggaagggtgttgcggacttcttacaggaagtgagtgagtctactatcttcaaaaatgtatatgcacaaatttatcggttatttatcaacatggaaataccgaacaggtaacttccaggaaagaccagaagcagtactggatgcagcatgacaagccctatcggtacgtgccagtcaaggattttgctagtgcattccagtcgttccacactgggaaaagtatagcaaacgaacttgctactccattcgacaagagcaaaaatcatccggctgcattgaccacctcgaggtacggtgtcagtgccatggaactgttgaaggcaaacatcgaccgggagttcttgcttatgaagagaaattccttcgtttatatcttcagagcctgccaggttgttagggatccattcaaacaaatggagtattagtatatttgagaaaacaaacaacatcatacgactgacttcttgttgaattgctatggcagctgatggtggtgtcggcaattgcaatgaccgtcttcttccgtacaaagatgcaccgtgattccgtgactgatggagtcatcttcatgggcgcactcttcttctcagtgatgatgataatgttcaatggtctatctgagctaccgctaaccatttttaagttgccagtcttcttcaagcagagagacctcttattctttccagcatggacctacaccataccctcatggatcctcaagatcccaatgtcctttattgaggtcggtgggtttgttttcatgtcatactatgtgattgggtttgatccgagtgcaggaaggtgagatttttggacaaaatcttatttggtcagtataatttatccaatttctttcactagctattctttactcctgaactgttgcgcggcattaggttcttcaagcagtatctgcttatgttagcaatcaaccagatggcagcggcactcttcagattcgttggtggggcagcaaggaacatgatcgttgcgaatgtctttggatccttcatgttgctaatctttatggttctgggtggttttattctagtaagaggtaaaacttcatctctgtactatgtagttcttctcattgttgcattttttagtaagtcaggttcttattcatgtatgtactggcagagaaagtgaagaaatggtggatttggggctactggatctccccgatgatgtatgcacagaatgccatctcagtgaatgagtttttggggcacagctgggataaagtcttgaataattctctctccaatgagaccctaggcgtacaagcccttaggtcccgtggcgtcttcccggaagccaagtggtattggattggctttggtgcattgctcggattcatcatgctcttcaatggtctctttactcttgcactaacatacctcaaacgtgagttccttccgaattggtttgcttttgttttctttcttttcttttgaaagaaaagtgtggcaaaagctctgcatcatttcaagaaaatagggagaagataatgcaaacaaaccgaaaatatggtagagactaaacaataagacaacaaaaataaaatatgacacagcaacacaaaaaagcacctcaaatcatcaaagtttgttcattgttcttacctcagaacggttttatcttccgattttacattacagcctatggtaagtcccaaccatcagtatctgaagaggagctgaaggagaagcaagccaacatcaatggtaatgttctagacgttgataccatggcatcaagtactaatctagcaatagttgacaacacggaaactagttcagaaattgctgataattctcaacctacacaaaggggtatggttctcccttttgctccgctttcactcactttcgacaacatcaaatactctgtcgacatgccacaggtaacatattttaattccttaacttatattgtccaccagtgagtcattaatgacaattttgtcgtgaccttttgtatcaaattaaaattcaaaaatcaggaaatgaaagcgcatggaatagttgaggaccggttggagctcctcaaaggtgtcagtgggtctttcaggccaggagtgctaactgcgcttatgggtgttagtggtgctggaaagactactctgatggatgtgttagcagggagaaagacaggtgggtacattgaaggcaacatcaccatatcaggatacccaaagaaacaagagacatttgcacgtgtatcaggatattgtgaacagaatgacatccactcaccgcaagtaacagtctcagagtcactgcttttctcagcttggctacggcttcccaaggatgtagattcaaacacaagaaaggtcagtcaaaaaaaatatttttaattccttctctcagcttataatcaattgtttaaattgtttttatttttattttggagaagggtatttcttacccggcctctacatccaaccgaatatatgcagcctttttaaagtaggaacttagcctatcaaacagggaacttatctctcaaataacctaatctgaaattcgctcctatagagatttgaactcaggactttcgggtgctactcaggtcactgcaaccactaagctacatgccctttcaactgagcagagaagggtattgtttaagttgtttaacctttctctatgcagatgttcattgaggaggtgatggagcttgtggagctcaagcctttgagagatgctttagttggtcttcctggagttaatggcctctcaactgagcagaggaagaggttgaccattgccgtagagcttgttgctaatccttcaatcattttcatggatgagccaacttcagggcttgatgcccgagcagctgccattgtgatgaggacagtgaggaatactgtggatactggtagaactgtggtgtgcacaattcatcagcctagtattgacatatttgaagcatttgatgaggtgagcataccttggaatatctgctacaccttttggtgaactcttatcggttttgtaatatggaataactgggttaacttattaaaatttaacttattttggctgattttccaaacttttaatgtgaccaatgctttattgtcctaaactttagataatgtgcagggtcctaaatgttttattaattattgcagcttttccttatgaagcgaggaggagaagaaatatatgttggcccgttaggccatcaatcttcagagctgattaagtattttgaggtatagtaatgttataaaagttctaatatacctctttttggtttgttcgatactgttgttaatcttatattgtttcgtgttctcaagggaatcaaaggagtcagcagaattaaagatggctacaatccagccacgtggatgttggaggtgtccaccaatttgtcaagaacaggcattaggtgttgatttttgtgacatatacaggaaatctgaactcttccagtaagtaattctattatgttaaatcctgtaaatcaaatagttaactcactttgaatcttggtagtgaaagctagaatcaccttagctgctttatgtatggtggtgacaaaccaccaagagtaaataagtaggcttcaatacagttggtcagatttacatggcttctacagataatgcatcatactactgcaagtatgctactaacaatttagcatgtgataaaattcaagacaatcggtttgttcatgccattacatattgcagttttcggtagcattggactttcttttctccaaagcagttttgttgtggctgaacttgcatcaactattgccagcgtcttaacttgctggttatagaatgctagcagcattgtcaaggtttgatttcagaatactatgctatatagcaaatggacaagagctagagtggctccattaccactgcagctctacaacaaatagtggtagtgtgctccacaggtcaaattcatattactactgcaaactgttgtgcgacatgccgacatgagtcattttcacatttcatatgttcatatgtttgaagtttcaaaggttttaaatttcctgataatttcttttttttgcatttatgaataattaggaattaaactaagcctcttttttttgaacgaactggcacagagtgtgccagtttcattgaatatagtgggagtaaaagttatttacaggtgtgaaaggaaaaaaaaactatacaaccattatcgacaggacgctagatttacaggaggagctgtgttagcttctttgcatccgcgagtacccatgttttcccttccttgattttcgctaacagaattaagctaaggctgtacttctacatggataaagatttgctttaatatcttatcatcaattagattaccatatagctatgatacacacatgtttgccttttatgcgcttcatgtacacttctgagttttcagtggacatccaaaagtgtgaaattagaagtgggaagatttagtatgacctctctgaaaactttttaactaagtggtagctgtttccaacacattgctatgaaatatgataattgcaatctgaacattgattactgccatttataggaggaacaaggcattgatacaggaactgagcacaccaccaccaggttcgagtgaactatatttccctacaaagtactcgctatctttcttaaatcaatgcctagcatgcctgtggaagatgcacctgtcatactggaggaaccctccttacaatgccataagattatttttcactactgtcatagctctcctctttggcaccatcttctgggatcttggcggtaaaacgtatgtaccctaccttgtacatatcaagcatatgactaaaccatcttcaaaatgttatttatgcgccttttgcttcttgctccaggggcaagtcacaagacttgttcaatgccatggggtccatgtattccgcagtgctttttattggcgtcctaaactctcagtcagttcagccagttgtatcagtggagaggacagtcttttatcgtgaaagagctgctggcatgtattcagctttcccgtatgcatttggacaggtacgtagctctcatatcaattcggcaatgccagattctgctttgctgagaaacctggcagtaatcaacttctcccttacaggttgccatcgaattcccgtatacactggttcagtctatcatatatggcatcatagtgtactcgatgattggttttaaatggacggcggctaaattcttctggtacctcttcttcatgttcttcacgtttctatacttcacattctatggcatgatggctgtgggcctgacaccaagctaccacgtcgcctcaatcgtctcatcggctttctatggcatctggaacctattctccgggttcatcatccccagaccggtaaccgtcgtcatccttatgaccctgcctttaatttcgtttcatcatttctatagctcatttccattcccctgacccatgtgctcagaaagttccaatctggtggagatggtactgctggatatgccctgtcgcgtggacgctgtacggtctggttgcctcgcagtttggagacattatgacgccaatggatgatggcactcccgtgaaaatcttcgtggagaactacttcgacttcaagcatagctggctgggggtggtgcccgtggtgatcgtcgcattcaccatgttatttgccttcctctttggctttgccatcannnnnnnnnnnnnnnnnnnnnnnnnnnnnnnnnnnnnnnnnnnnnnnnnnnnnnnnnnnnnnnn

SEQ ID NO: 59312 - DNA, 9516 bp, Oryza sativa
agctgtagtctttgttctgactgacttaacaatgacttcttaaaagggcttatttggaagggacctataaaaattgagcctttctttccaatttccaaaaaataaaaacatagttcagaactttcagatactaaatcacttccatttactggtgagacagcaataataattgctttgaaactgttattttgatgaaattacaacagcaataagtagcattttaaatgaaaaagaagaacgataaaaaaaagttttggctttcaaattagaagtcaagattaatacgaaaacccccaaaatacagatcataacccgtgcatcagatggcatattatcaagtctacttggacagcatgggaaaatgacagcttgtctgcatatgagatgttactgtttgagcaaactctgaatacaaagtaaacgcatgactttctcaatccaatcagcttcaagcttacatatgtgcaccaagactattggcgcaatcatccactgcttagttagcaatttgtcattaagtaaattcagaagaaataaggttactgattcaaatgtcaactgcttacagcatttgcaagaaaaaccaaaagatgatttggtcacacctgcgtttcaccctggatttgtattctgtagtgtgtgaacacttgcatcggcaacttgggctatgacatcaaacatcagttaagtacaaaagttaacaggacttctcttatccctaatgactgtttatgtttgacattgtaactgaatagaataaagaggaaactgtcatgagtccaggtcgtattcataccgaagcatcttttaaacttggcatgttttcatggaaaaaagaacagacgaatcaatccaaaatgagtactatttctgatgaatttggataaaagcaaccagctcatgtttcataggccaggattttgtatgtactgtagcatgcgaagaccagcccattctctgaagattctaggcccatgtttcataggccaggattttgtgcagattttatgtccactgtattaaaatctcaacagctgatgctaacaagaatgtaaattaagttcaaccctgaccatgtagccgtcaaccatggactgaaataactgaggccgtcaaaattttgcaagttgtgacaggtgtgtgatgataaacattcattacattaattaatgagtagtaacttctaatccatctaccaagagagtgataactgataaggaactgattcacatctgatgcattgcattcttggtggatagggctggtatgaattgcaccatatcttgatctgcaatttgcatgatgcataagtgtacaccaatttgcagattaggactggtgcttatgctgtgagaagagcttacagtggcaatacaattatggggtgggcaattatcacggcaattatcaccaaaagcagagaaagaaacagcagcagcactgtacatgctactgaaagtctgcacatgttcagtgcctgtgatagctgcttcagtagttctgacacttctctgagtcatgcaagagaaatccactgtatgtttaattttaaatggtgaatacaacagtatgttgcatgagcatactatgtagtagctgagaagagaagtttgaaagcacaataattcaatgaaagatttctcttttttttctatggctacagaaaatgagagtgcatttacaaactggaaaaggatatagtcaggaaaaggaaaagatttctgatttttttagcaagtccaaacattacttgggaacatgatgaatcaggcaatccaatgctacactgctaactggtacagactagagacacaagaaaacacagaaatgaacaagaaaaaaaaatacagcaaaggcctacacaacctcaattaccgagcatgtttttattactaagcaatttaggtcctccagtttaagtgatgatgaacgtggtctagttatgaccaaaggaggacctattttctccagcgatgtatttacaccaaatgaaagttacatcatgcgctgcaagaaaccaaggaatcctcgtaagttcaattgtccacaattcttggacccatataagttgacccgacaagatgaaaattgtctggtggttcacactcctccagccatgcgtatccatcgtctccaggaaggggctttgaatctcctgttaaaaatgcaatttttataaggttaatcaccaatatttaccttcctgtcaagatgcataaaatgtatcatacagagaacaggacagaggagatgaatttataacaagtgtgagataggagtaaatatataacagctaactaattcagagtacagataatgcggaatattcctgccatataactataaccatttcagtaaataggacacaacaagcttgaatccattcgaatccagagtacagataatgcagaaaattcccgccatagagttatagccatttcagtacaaaggactattaggattatttattaatctataggctgtttatctcctagacctttactctcctagacctttggtcttatgtaactcactagtattgattgtatctcagcactagcattcattgtaattcagctatatatatgagagatcagctccccacattggtgaggcatctattctactttctctacaaggacaatacaaacttgaatggtttggaaaataacaaagattgaacactagctaattcagagtacagataatgtatgagactcctatcatatgatttcaaaggatggataattggatatgcacgaatctatgggtgagcagtttctatgcaagtcaaacagatgaaacttatcctgtgcatgagggcaccaagtgcctgagtgaatgcaatatcaagaaaaggcagaactacaagtacatcaataactgaacctactgcataactatcttagatcaacgaggagaaaattctttctacttaattcaagcaaacacatcctcgtatccgacaagaatagatttgtgaaatagcaattatatataaatgtaaaacctaaaagatacaatgtggaccctatatacaagcagatataactcggttagcaaatagtaccagcagaaggtgcagaggaagagacgttgtagtgctggcagtgcctcccactgccatcgtcatatggtgggccaaggacatcaagaacagcacaagcagtatgtgcggtgaagcagtgcaggttgccaccatcttccggatatagtaccgatgttgcacaaggtgcattcaaggtgccatcaaccttcacctttgctaagcgggctccttgcaactgagcatctatactcaaaacaaaaatgaaaagagaaaccccttggtaaaaattatgtaaggaagtttatatttgccaggaaaatgaacaaagcataccagttgaatcttgtgaggcatcagcccaatcataggacttcacacgcagctcaccaaaaagaagcttactgaacacagtcatgttggggtgattatggagaggaatgacaccccttggaggcaaacaaaagatgccgatctgtaggaacaagtatagacttatgtaccttagcacacaaaaacgacaaattttctagttggtaataatcaagaacaattttagttgctattgcgaataaacataccgagaaagcctcacactcataaaggtgtaagtaagtgattttaggaatgccattggaattaacacgccggaaatatgacatgtttcgagttaggctgacatctgccgctgaaatgctatctgcacggtacaaatgaagggacaaacatcattagaatagaaatatgaatgctgtagtaagtacaatccatagacatttgcaatctctctaggatatgaatacccattggacagagtgcacctgtaatatacgaaggtctaacacatgcagcaagcttggccaacaagataagcacacgatcctacaatatttcagattttcaatcgagagacttatcatgatgactactacagaatatagatagtgctaaataccaacatcgaagaaaagagatgatatcaatcttaattagagcttcgttagttgggtagaaacaacaattgccatatataagcaaaacatgctggactcagcattatacactaaattatcatatagcaggacttgaagggaaggaacacataagaataaggtcttatgcaaaaacacatgattgctgtatgtttgattggtacatctaaagtttcagagcagagtgtagcatttaccccagcttggtagttcaaaggaccatgtagttcaaaggaccatcagatcaaaaggtaagtactgagtcaatattgaaatgcgatcccaatatcccatctccatgaattttcagggtcaatctcattatcaacagctatttccatgagcttgaagttggacacaaatgtcaggcaagtaggcaactataacccataaatcaagaattttgcacatatactacaatctccagggtccagggtgatcaccgtcgaagcacgttacgttaaaagtaatccatatgcatgcatgtaggtggtacaggctcacagtggagttggcacttggcacaacaatcaatcagggtacgtccgacacaaggaaagaaagaaatactatcttagggacaaaacatggtacgacaacagattccaccattaaccttcctcaagaagagttcagcagacctgatcaagttgacctaaactaactatttatggcaactggtggcttttggaacgaattggattaaaaaaaagaaccctaacaccggtccaaaatgagcataatcttggccgtaccccctgcacccccaccctactccacaaaaccagcaaccacgtcatatatataccatgggcagtacatggttttgcttatcttttgctccattgtttatctttcaccaggaacagccagcacaagtcaggacctatgcatttttctgacaatctagcatcactacttgcaagaaaaaacatgctgcagatgatatttgtatcacagattcacaggcacacagcatggtatacattatttaaaaaaaattcacaacatggtaataacatcaaaaaccattttttccaacagcttatcagtttgttattccatcctctaacttatgatttgattacaaaaaccatcttttagggggaaaagaagaaataaattaacttacgcaagaaaaccattgttaatttgagtgtatcaaatgcacctaaagcaattgtacgtactagtcagactcttatttggtagacaccaactaaagaaaatcttgccgttttttctacgaggaactcaccaatatcgaacacttgtttccaccaaactgaaaatcttgatgggacctaaaactaagaagggatgaactgcgccacctaaatctaatgcaattatcacaagatcgaaacacgatgccaccaccccaagtacccaaccaatgatttcgattctctaccaagcgtccgccgtggagaagacaggcaggaatagcatcgaacacaaggcaggcgcgcacatgctgcttcgctctacaccgaacatcgattctttcgagaccccccatcgggtgcaagagacttaacggggggagggattacggattaccaagaacggacttgatcctctcgaccccggcgggcgagggcaccgcgccggcggaggcaccgaagacctcgcggcacgcctcgaagagcccctgcaccgcgggcgacggggctggctgcgccgccgcccccgccgacggcatcgccggcctccgctgctgacgccgccgccgctgccgccgcgcgccggcggggtccctcgcccccgacccaagctccgggaggcccccggcctccacccgcatcaacggcgggggaatgcggcggcttggaaggcgagctggggatcggagaatggccgcgccccgagcttcgcgtcttcttcttcttcgttcttgggttcttcctcgtcggaataatgaggaggatgcgggtgattttttatactcgagatggctagtattttattggcacgaggcttggaacggaggtggtgttttttttttctttttaacaaaaacgtttctcaaactattcaattcaagaattcgtttgtaatttgagatcgccatcatctcaatactaccaccatttagtacccccattgttctgtattacacgacattttaagtttgattaagtctatataaaatacacccttccttttaaaatatactaaaacatactcccttcagaaaaaaaaatgtgagtacgaggttgttttttactaagagagtaactgtttgtgttatttttaaaatctttcaccctaaaaatctctaattttattggacacatgcactatatttattaggatgatctaaataataattatttttttagtctttgggttaaaaatgattgtctttgctttgaaatggagggattatataacatctatagtatgcgtgctcgggtcctattgttgtagttctgcagctacaacactgccaacagctatagcactgaaacaagcgtaccaaagcactagttactgttgatacagctatagccatagcaaaactgtacaaacaaggttaatatcaaattagttacattattaaacttatcactaaatatatttttgtgggtattttatagtgtatttgttttttattaggaagattgatattttttttctataacatgagtaaatttgaaaatgtttgactcaagaaaaacatatataaaacgacttttgatatggaagtacccgatggagtattggctgtattgctcatcgatatctcaaactattattaaaggtaaggtttattagtctaactctccgcctaaataataattatgtatggattgcaaattttacgtgttttgacctcgatgtgacacctcatatgtatccctgctaaattctaattatcctttaggcgtatttattaaagttgctccctataagcacctttgaagtaaatacaaattcagatggatgtctccatttcgtccccaatatcacttaaaaacataaatattaagaaatgacctaatatcaaagaaatagaaagggtgatactttgaacccaaaaacggctaacccaccaccggtggagctagccggaagacccattcgtgttttttcgtccccattatcacttaaaaaaacatgtttatgatttttcatgtacatgttgaacattgtttggacatttaaaatcaccacaatattttggataatctaagtaattcagtatgttcctactaaatccatgtaagcatacatagtgatgacgatacacgctggtataatctataatatatgtcgctttttctctgcttttttatatgtgagaaaatggcattccatcatatcgaaattagcagcagaaaaaagtgagccttccaacaaaaagtttgctttagccgtccacattttgttatcgttgtttaccagtctgcacacaagccaggagaggctggtgcttttgaaaaaggaaaaaaaaatctctatgtttatacttatactaatactactagttagcttaagtgcaagtcagattaaaagaccaaaaaccagggaccatcacatcagcattcctgtgggctgaagcaaacagcctatgaagctttttgcaggaggacccctcctgccctttctactccttggtggcatgcctgatttgtcatttgcaatgtgcacctatgcaagaaccagtctgaatgtttgctgcaaacagagacagatgatgtacaccataggtctaccacctgttgttttgtttctgcagagattccttctggttctgaatatggccatcctgttcatctgatgatgatccgagggatggtgatatttgaagaattttgtgtacatccactcacacatttgaatcgtttatacatttatacacgcctaaggtatgtatgccacaacttgtcaagctttttccgctgaagtgtgacatgcatgtcacaatttttcgtaaagaaatcatgcgccagacaaaccttagaaataaattgtacccatgacagatagagaattaaggtagaattatatggcatgtcaaaggtattgacaacaaaccaagacacttatctaagttcttttttttacaaaacaaggttgattatattaaagtattacaacctcattgttgcacaaaaaaaaataagacatgacctatcaacaaagaacaaagatacctcacatattgaaaaaccgcaagagatacaagcatacaaatgcatccacgatgctgacaaacttcaccacacacaaaggtatttgaacaggtatcaaccataatcttcgctccttttcacaaatcttataagctggcatcaccaaataaattagtgacacccaccctaagctagcgttgctgataggatcatcggcaacccgacaaacaaaaacacttatctaagttgatcaatcctaagttgtcaaacaacagaaccacaagccagacatccttaactacaactcacaacatttcgaatctgtgggcaccttggctgttaacatatcgaagcagatcaaataggagttgaacgcataaataaaggggacccatatgtaccattatctccctccagcctccaggattgcgaagtccaaagcactgacacagcacacagcggtatgatgggttaacacctgcggcgcccacggtaatgcgacgcccagtcttcctccccttgtgcacaccaacgtcttacacaatgtgtttttcctgtcctgcgtgatgccagcatgagcggctccacttggcaaaagatgctactatttgatacagagcttgctcgaaaatatcttccagatgggatgctacctcttttcttctctgcaaatcatagcctctgttagccaaactggagagagcttgttggatggcacatcacagtatcaatggccatcatgccatgggacgctttggccaaaaatagcgtgactttgtcccagttgtagtgatcaaccaaatatttgtctaacaaaccgtgccacgggaaaacttagtccacgagccaagcatgatcatggtcttcttcgtcgctgtcatcctcgtcgttgctgtcatcctcgtcctcgtcctcatcgtcactgtattcttggggcccccagaacctggaaacctccttgctgttgccaggtaaagatacagggacagatgacatgagaaagtctcggtagtgaaccatgtcgacttcggcggagctccccgccatggcgatcctacacccgtccacagccatggctgatagtgtgcttctgtctgccgatttagcaggctcaccgcagctcagtgtgttcgcaaagtggcccgtctgtgtttcccagacatggacctgaccatctgatggtgctccagttatcaccttgtatggatccaagtgaagaaatgtcacgggttcgtctgattctgattgcaattctgccactatatttgggagttcttgagacttgcgtatgtcccacagaagagccctgttcgatacataaaaaaaaagatgatat

SEQ ID NO: 59313 - DNA, 6985 bp, Oryza sativa
  unsure (1)..(6985): unsure at all n locations
gaaccagaggaaggtggtgccattgtgtcccaaagtttaacctgtgacacaaaacaccaaaatacattcatttttttacttggatgcaatgaaggaaaataggaaattgtgtagtaccagttgtgcctaatgggccaagaatgggagcaaatggaaaagaaaaggccaagataaaaatcaaacattaccaaccataaggcccccatgtccccccccctatggttgacatataacagcactaactagagactatagtgtctatggctgaacaggagtgatggtcattacaaatttaggtgtagcatacaattctctaagtattcagacaaataaagaaaaatgtttctaaacattccacatacctttgaatctttggagcagctgaccagcagggagggtttgtgcctgacatgcaaggaagaaatattatgtttaaacgagggattgtgctgctgcattgtaacctagataccttatcatggcttgaataacttgtttcattaggttcatgaggaaaatatgcaaaaagtaactgccatgagaatcacttcataagagatttattgctaatttccacatcaactagtagaaattccaaaatttacgaattgttctatagaagaaaatggggctctagaaaggttttcatttataaaggttttctggcaccaaagcatagaggttcaaggcaacaacattgaaaagccacaatgagtttaaaaggatgctcttgtaatttgtaaaaggggaaaatggttaatgaatggcagtgagttttgtttagatggtttgacactatgtacctggcaacagatagaagtgacagtgctttttcatggccatgaaatgttgatattagagggtgatttttgcctcttgtactcatagaccagaggcgaacagtgcagtcttcccctccacttgcaagtagtttaaattcaccatcaccaagcaatttgtcagacagagcagtcacgggccctgaatggcccctaaaacaccgtgagtggccctaaatcacaacattagaaaaccatccataagtttttgcatccaataaagattaggaaaaaaaaacacatgtaagcaatttaaacaggttatacgctaacaaagttctattgttcaatgctatcaagcataccttccaacaaagacggactgtcctatctgcacttgaagtgactaatgccttttcatttgtttgagaatcacctcgaaacaatgggatatcaatcagtgggaataatctgcagacgaacaaaaatcagtgggaataatctgcatagctaacaaaagaacacttcaagattgtgctagtacaaaattgatgttatcacggcgaagcactagaagtttgcctcacaaaattcaaatatgcaatctagcactgaaactgattatagaacaacagtagtttccctaccaaaagaaagcaaagttaaagcaaaagtcagatttagtcagatgtagatctttttgtaacaaaataacaagagaaaagttgtaggcacgaattataccaacacaatacaggcactgcagtatccatggaatttgcagcagatggactcgagtgatatcaaccaataaagtggcaatcatgggaagaaattaactgtagaaagtattgtgttttggggtaatgaactcttttctagctttgcaaatttaccatacattaaaaatctaacatgatcatacattattgctagctaaagtgctaaacaaggagcactggaatagttcacctgagcacaagtgcataacttgtacatcaatacatggcatgtcttacataataatggaaatatcagcgttcatttgagacatcaatacatgacgtgtcttacataataatggaaatatcagtgttcatttgagttttgatattacattggctgtaaagattcatgaagctcaactacagcagcaaatggggataggtcctactgtacggacacacttgtaaagcaagattatggagcatttattgctttttacgacccttgacactgattctcctcacagggcaaaaattaatatatgctgaacattacatatgatgctcaataagaaaatctacaggtgcctgaataaagaacagtggctatgtgtttttgagttacctcatacaagtgatccttgcaccatgagacttgtaggtttccactaattcgatttctggacaatcaaccctcaatcttctgaccattagaccctgtgcagaacaaattgcatgatgataggttgctttgcatagaaatggacttcttatatagaatcaatactgcaacagtgctcaaccaaaaatgcacaactacagacatgctcaaaaaaataaggggcaaatagatcttggtgaatttctacttacttgagataaccatatgtagttcctatccagcattagatggcttggtgtcacttccgtgggatttggataataaaaagccgaaatgggatcaacaaatttcatctgatgtacttcagtgtgcctgcgaatatatagctctcgaagtcccaaagctccacgaggtacttgttgagatggccattggttcctgaatattcaaaatatcatgacagaataaatgtccaattaaaatgtgtgtctctattcaaagactcaaaaggatttggtggtctgcaactagattatgagttactatgataatttctaagttcggacccaggattagatcccttcaatcaactcactagaagatgtggaattgacgggtgaacatcagcgaagacaaataagcatcataaagcgtcatcaggagggataaacatatttcacatttgctgcctgcctttattgtgtcacatgtatcttcacataaaaatttggatgtgcacatacaggaaagcaatttagtgactccaaggacagaacaacttcatacatactaagttacacagctttaatacaccttaacaaaaccaacaatactatcgttgttactctaatctgtctaacttgggagcatggaagatagcaatgctacctctattccctgtcctcaaatcaattttcaaattagttgggggaaaacaataactaaaacacgttaatccaataggggctaaaatcatcattgatacaaaataagatgcagatgtatgaatcacaatcttgtttttttgtttccaacaatcgaaacaagagatgaagttacaaggtatgccttgctgcaatccatggaaaggcagaaccgctcatgtgcaagttttttttcgggaatacgctagaggcgtatttttgtattaagaggagaaaaacagttctttacaaccaaaacaaaaggcagcaggggacaagagagccggaacaaaggagctaaggcctaatctcataacagaatttgcgacctaagggggcctaacactacagacgcagcgccggcaccgcagcgttggccaaacgccaaagcctcgcctcctcagccggtccctctagctacctccgtccagcccctgaacttctggttgaacactctgttgttgcgttctttccaaatcgaccatgccgccaaagcaacaatggtgtcatagcctcgccgaagtggccgtgcaatccgttctctgctctcacacagccaagagtgggcccatgtgcaagttcacacaacttaatcgatgcatcgactgatcttcctgattattgctgtaatgctccatgcttgtctcttcctaaatcctaagaccaactgtcatcacaatggattacagatgttcttccaagcgttaattttgaagtgctcaccattgtcagcatgcaccgatttcactccaatccaatattccaatggttctatcacttcaccaccacaaaagcatcgaattccctaccattaccgaaaaatccctcatccaaaattttgtcaaaatttttaccccggaggctccgcaaattctggtccgtggtcaccaaatcacacctctaaccactcaaacatcactacgccgatcaaacgcattaaaacaaacacacatagctccatactgacaccctcgtatttgcccccctcggaagctagcgcaagaagcgaggatgaaaatcccaacgcataaacccccaatcccccccggaaccacagagacaaggacgagcggtgggatcggttgcaccctacctgaagaggcggtaccagacggcgtcgcagtaggcggaggcgcggagcgggcggcaggccacggcgaggctggcgacgtcgcgggcgacgagggagcgggcgcagtgggccagcacgtctccgtcgaggtcggcgagcgaccgcgctggcggcggcggcgccccggccatccccccgccgccgtacagggaaaccctaggccgttccgcggcggcggcggcggcgcgggaaggggagagccggagagaagaggtggttattagttagttaacgagattactcctcctgttatttttctcctttccttcgaaggtttgtactgtgtatatatatagagatttcaaattgaccaaaaaacaagaagaagaagaatcgccgtgtcatcggccactcagctccacgtcgttgcaacttttggtgtcaaaaaggctaaggcgatattggggtcagtagatttataagggtaaaagaactctatgccatgtaggaaggcaatgcaagtatgcaaccatttaattgaacaagttgtacatgcgatgcgatgagatgacaaaccgtaataaacttccgtcttctggctagtgcaactcaatgtgatgtcttccattcggttgtgatcttgaggagatacaaggtgtcctcatattttagataatacttacttttttaaaaatattgtaacccatgaccagagattcccatacagatccagatccatagtaatagaacatatttcatctatttttatattgttacatattccaggactgaggaagtagcacttgttacattgtatttatgataaaaaatacactagggtggaatctagtgaggacaacggcgctcgcgggaggagctggcaacaacgatggtgctcgcaaacacgaggggcgatggtagcaatggcactctagcaatggatcagtagcggcggctaggggtgcaaacggtatggaaatttcccgaccgtaccgataccgtttccgcaaaactaatataataataatatttttaccgatgttaccgttttcaaaaattaatttttaaaatttttatcagcgtggcattgaagttgacactaaatagatgaattcataaatatgaaaatttcctgaccgtttccgttcgttttcgaaaaaataataaaataatgtaccgtttccgactattttcatccctagcggcggcactcacggacggatccggtggtgacagcaacgacgcttgagtgttcttcaaccttctttcccttttcccatctggcaagatttttcttattccttataggtggtccttacatataaatataatttatccaaagagcatttataaggacttctataacgtataatgtaactccagaggcttaagatatcgtttttggctacattgccatatatttttggtgagatagatggactaaaagttacagcatatggacatcaaataatcaaatggagagtatatcttttcttttattcccatatcaaatggtacaaatattaaactgtctaagaacataactcgaatccgtattaaccaagagtaaagaaacaaataaatacaaacaaaatacgcctcttacaacaacatcatttttcaccagcatgtgttcccctccctattagaagaagcccttcacttcagctcacaagcagcagcttcaagtaacaaaagaaaaaaagctcatcacctcatttgctcagttcatggcaggtcctccttcatgccgcggacgaactcctccgagtgttccttggtgacgcagctggcgagcatccgcgtgccgtcgagcggcagcggcgccttgaggatgacgacggaggcgatgaagtcgttgttgacgagcgggccggcgaacttgggcgggccgaagccgtagtccacctcggcgaacccgagcttgctccagtcggagacgtagatggactcgtagttgaacgtcatctggaacgggtcctgctccgtctcctccttggcgaactggaagaactccaccgccatcctctccttcgcctgccggatcatgtccaccacctccatcaccgacgacgacagcaccgtctcgctcggcgctgacatcttcaccgggaagatggagttgccgtagtaccccctgtccagcttcagcaggtggcgcacgctggcgaagaagcagagcttcacggtggcgccgggctcgaggttgagtgccctggtgcggcattgccacagcttcgccgtcagcacgtcgaagccggagcagaacttgccgctgtgcgccttgtactgcgccttcaggccgtcgatgtagccggtggggaagtcgaggacgatgtagtcgagcgccagcaccggcagccccggcagggggccgggcttgatgctcgggttcgggaacttctccctgtcccacaccggcttcaccctcggctccgggagcccccgcgccatgtcgcccaccgcgttgatgaactgagccgcgcccatgccgtccgccgacgcgtggttgaaccggagccccatcacgaacccgccgcaggtgaatttggtgatctgaagtcatatgcaacttgaggttagctcagctctgaagaattcgatcagtatgatacattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 59314 - DNA, 7807 bp, Oryza sativa
aagacggaccaggcgtacacagtaaaacccaccgtgcggccgtgccccactagtactggcttgtgttgttgcggagcggcgtggaattcgtgggccgttgctttggtgggctgtgggagccagggacagctgcggcgagagctaccgaagggacctcgccggacgaaggcagcgacgagaggtcaggcactggcaggctgcgcgcgcagccgcaggtgcccaagcaacgggactaatcgatcggttaaggacaagtatttccttagaataaactacttgtatatgcagttaggaaacagcaggatattgcagtacacggtcaaaactagtttttcaggtgttgggctagcgagccgctacagaccaaagatgtgagaaaatctacaatcctttacaggagctctgttaattgtttgcgaaaataaatcttttagacgactagataaagttgaccacatgccataattgattttggggccaaaaacggtgaaaagaaaaaaaatacaaattcgaggaccccaatcccataatctaggctagctagatgaagcataatctagggcttacgggtcgtcagaccccaattaatcccatcgttccatgtcgttcatggcggcggcagcgcgggcgaagagcggaccatgatcccgcagcaagtcggcgaagttagggttctcccagtagttgcacctgtaacgcttcaccatctccagggagtcgtcccactccgccgaccacccctccgggatctcggacaccgccctcttctgccccggcctcgcgaacacggcggcggcggccctctcgtcgacgcccatggcgcgctcggcttccttcagccgccgtagcccgtcccgcagttccggaggatccggcgacatcgggcgccgccgatcccagtactcctcctcctccatctcggccgccacgtccggctgctgctgctgcggcggcggcggcgcctcggccttcgtctgtgttgctgatctgattgatttggcttgcgctactcctgaaagatcagcagcgtcctccatgtttgtgataccgtgtgtacgggtgctcgatcgatcgcgtacgccggtggtaggttacacagtttgatcgatcgatcacgtcgtcggccgcgcgcgctcgtatattcgatcgatgtggtgatatagcctggcttggattagtggcgtcctccggccggccgctgtctcgttatatgcaccgggatatgtccgactcgtcgtacaaccgacgtactggccgggacaaaatgtccgactcgaacttgagcacatagcttgcagccctgctcggttccggcctagcccatggtctcagcctctcagcctttctgttcggcccatgaaattgcaggctgcccatgttgaaaaacttaagataagtgcactgtgataccctcaaatacaggtccactctaattcgtatcccaaccgtaatacagtatatgatatctttaccctctaactattaaaactggtataatttaactcccttaagccttgttcagttaatccccatgagaaagggattggaggggatttattccacacctattatggtgtggaattattccctcttaatcccctccaaaccgaaccaggccttagcagtttcaatggtggtttccactggcgtggcacgttgacttagtccacttgtactaatatggtagtctaatcacaaatttgaagtgcacccacatgtaagagaatagggggaaaaaaattaaaaactatgggctcacttgtcctcctaacttcgcaccaaccgaatcccctcctccctccctcctcccctacaaagctagaaccattggctgtgaatgcggatgacggacctagggaggatgacagttccattccgcacggcgatggcctgaggcggagcggcaacggcgcacccttgagcggtgcagcagtggggtgaccttaaggtggaggggcatctgggtggcctcgacgcgttgtgaccttgaggcaaagcgacggcggcacaggcttgttccgacattcgagctcccctcctcggaacatagtggccgaggtgtgcacgcattagggatcaatctattgcaattgctattttttttcgtcgacggatttttggggagaaaacgtagaattttgaatcgttggttttgttctaagattcgtgtaggaggagatagaaaaaaatagcaacacatcatgggcaacctaggcttcacgcgcacacacctccctaaatggctaataaacgattgctcgcgtccctcctgctcccctcctgctccggtgtctacccccacaatcccctctatgtcaccatcctccttctcgggtggtcatggcaccccacgctgcagcaaagtgagatttgtagaggaagaaggaggtagccacttacatgtgggccccactttttttaaaaaaaatattttgctcactaggataccacattagtgaaaccatccctccatattatcgtgggacttgacttaaacggtcttgtcaagatgagatgtgaagatttctagtattacggtttagggatatctattaaactcaacgtaaagaggaggaacaacaggtgaacttcttccgagccttgttggatcaatgcagagcaagcccagaccacaaaaaaaaggatttattcgaagtcttctagtactaagatattttataaaaagacacgaatattagggaagtgcctaatatcaaataattagaaggggtgatgcttcgaacccaagtccgcccaccgccttgtggagctagccggaagacccctgagcgtttctccctaagacattttattgtaattataatttcgtaatatttttttgaattgttatttaagaaaaacaattgtaggcggtcgtattattgcagccgcctgcaaaaaataagagcaattttactatacaatatattgatggtatatactgacagtataaatgatccaacggtgtagattgattacctacccacttaattagatttgtagtataattccaacaaggatatgttggtctttttgttttatttcatggtggcaatttcgtaaattccagcatacaagccagctccgattccccattcccatcctcccgttcacaccaggcggcggagttgtgccagcagccacacagccgacgctcgccgtgccagccaccacaaacacatcgcaacactaacgctcaaaatcgattaggcatggtgatttagttctctctcagtcccataatataagtgattttaatttttttttcactgtttaaccactcgtcttattcaaaaaaaatttgtgtataaatataaaaaaaagttatgcttaaagtattttggataataaaataagtaaaaaaataaataataattctaattttttttgaataagacaaatggttaaacagtaccaacaaaatatcaaaatcccttatattaggggacagatggaatactaattaattctagggcacagaaccctagctctactggtgacgctccctgtaccattgccatcttaaggtcagattctacagattaaaattgcagagaatatttgcaagaacataacacgagaacataagagtacatatgttaatgcatgcattttcgtgtgcacagatcgcatgagacggtggtgggaggcggcgattggccgcttgaacaggaagcaggcgccggtgaatccagtcaccaaagaggactaatcgcaccgcctggctcgtctctccctcacctgaatcatgcacggcgacgccaaaagatagagattgaacctaagaatagattattaaaatatcatttacaatttttttagcaaatttgtattgtatccttgtaaatactgacagtatatactgccaatacattgtaccgtaaaagtcaagcggtgagcttaatctcgttatctacagaaatcaatagattttcgcatgcatacagtaaaaaaagagctcgatagtgattttctctgatctttggtccgtagcggctagcccagcacctgaaaaactaattttgaccgtgtgcaatatcctgcagtttcgtaaacattgcaactatacggctctaattaaacttggatttaccggaacaagcatatataagtagtttattctaataattacttatccttaacccatcgattagttgctttgcttggtcgcctgcggctgcgcgcgcagcctgcctgacctcccgtcgctgccttcgtccggcgaggtcccttcggtagctctcgctgcagctgctggagcagacggcgatcaagtagccggtgtccgggtcgccgcactgcttgcagctgcccggtctcctcgtcatcaccgggagaagctgctcgtcgccgtcgtcctccaccgggtcgtccaggatctgttccacgtaggggaaccaccactcggaccccgtgcagcgcacgcagtggcgcccgccgcgccgctcgacgcggaggacggcgtcgggcaagctcgggtcgtggtggtggcggtggtggtccgggcacgcggcggcggcgaaggcggtgccgcacaggaggcagaaggcgtcccaggggaggcgcgtggcgtagtcctgcgcggcgaggacgtcctcgacgaagtccgggtgaacccggcagccgtccgggccgtgcgtggcgtagactccccggccggcggcgtcggcggcgacggggaagaccatgtggatggtgggctcgtggtggaaccagcagcagtgggtgcagaaggcgtggaagcagctggcgcagaagcactcccgctggcacgtccccgagaagtcctccacccacagcgcctgcttcccgagcaccaaccattgctcgatctcctccggcaccgccgtcgacgacgacgacgacggcatcggaatttaatttagagagttcgcacgcacgatcagctagcgcgcggatagtatcacataaatgtcgatggactgttatgctgagtacgttcctcccccgtcttgtgtatatagagagagagatggccacatcgacccaacatgcatgtacaaagaatcgagttcggtttgggacccgaacccctgcatggccgagacgaaaaacgtcactagctagtatccaagtataggctgagagtcttctgcctgagaccatgggctaggccggaaccaagcagggctgcaagctatgtgctcgagttcgagtcggacattttgtcccggccagtacgtcggttgtacgacgagtcggacatatcccggtgcatataacgagacagcggccggccggaggacgccactaatccaagcaaggctatcaccacatcgatccaatatatacgagcgcgcgcggccgacgacgtgatcgatcgatcaaaccgtgtaacctatcaccggcatacgtgcatgcatgtacaacgaatcgagttcggtttgggacccgaacctgcacggccgagtcggaaaacgtcactagcagtatacaaaataggattgggagttcgagagtcgagaccggaggaatattacgagttactccctccgtttctaaatatttaatatttaacgccgttgattttttttaaacatgttttactattcgtcttattaaaaaattaagtaattattaattcttttcatatcatttaattcattgttaaatatacttttatgtatacatatagttttacatatttcataaattttttgactaagacgaacggtcaagcgtgtgctaaaaagttaacggtgtcaaacatttagaaacggattgagtattaattagatgcaatacaaggaaaaaaaattctcatgcataagcatgcgcgtatgtatcggggcatccctccttaaattttgacacctatagctgcacgaaacttggagcaactataccttctaaacatcccccgtgtttccacataaacttgattggtcggtcaagcaaccgctactcatacgcgctcgagacgggctcacaagcagctagggtacgcggccggccagcacggcaagctggccggccgccgggtaacatgcacgcagtggtcgtgccccacacgggcgtgcatgcagcgccgcagggagaggaggaggctttgctcgcgcgatcggtcggactgggacgatcgatggagtattaagcaaacaaccggcacggacggacgtgagcgacaagtggttggctggagctggaagtctggaaccagttacatattcgaacgtcatgcatgcgtcttatttgaaaccctgggttttcgtgtccagtttgtccatctgttttatttaaaaaaaatatgaaaaaaattaaaaagatgagtcacgcataaagtattaatcatgttttatcatttaacaacaatgaaaatactaattataaaaaaaatttcatataagacggacagtcaaacgttggacacggaaatccagggtttgtttctttttgggatggagggagtagtctttaaaagagggccattatttcttattattactctatctaacaacaaggtgtcgtcttttgcatgaaccgataaggagaacgaaagctttaatttgacatgctgggccggctcctgtcattctgtcaatgccaaagcggatggcaattcaaactggccactaattttctggtcggtttgcttaattttaatttcaaactgaacgcttgaatactcaactctatatatatgctgatttgctgaattttctgctcggtttcagtacgatcgcaatcgattcttccatcattatagatactcatgtcacgtggacatcacgttagccaaaacagctcataacgctatcgagaaaattcgtttgcatcgattttagaagttgtgggacgacacctgatttcgcggttgagggatgtggcacaaactcaatttgtatagttaagggacataaaatggactttgctattgagcggattgagtacagtgagatcgagagcaccagaagcgaagcagcacgtatcactcaatgatgggccttgaccgaaaacgacgctgtcagactgcgactgggccgagcgctacagtttcctttcagcacgcgcgcaaatcccacccccctggtccccttgcctccctcggcccatcccgccgcgcacgcgagacgtgtcgtcccaatccgccacgtcctcgcccaaagctccacgacagcagccagcagcaggtgaagcagcttggcaatttggcagtggtcgtgggctcgtggctggaaagtggaggaaaccaacctgcaaaacccaaggcggcgtgcgtccgtcggtggaagccgcggacgaatcgccacgcccaccgttcggattggccccgtcgcactcacacaacttgtgtgcagccctgacacacaaccgcatcagatgagagctcccccggaaaaagcaaagccaaaaaaacccccgagattttacagccataccccgcacaccacgccacgcagatcttttctcctcttcctcctcctcccttgactttcccccacggcgaggcgagggcgcgaggcggcgatcaccgcgtccaagccggcgatggagggcgcggaggcggaggagcggaggctggcggcgtcgctgacggcgcggtactcggactgggtggtggaggcgctggacgagctcccggggagcttcatcctcaccgacccggccatgccgggccaccccatcgtctacgcctccagggggctcgcctcgctcacggggtacccgccgcgggaggtgctcggccgcaacgcgaggctcttccagggcgccgacaccgaccgcgccgcggtggccggggtgcgggaggccgtgcgcgggcagcggccgcaccaggtctccatcc

SEQ ID NO: 59315 - DNA, 2470 bp, Oryza sativa
ggggaggtgttcgtggatgtggataagagaggtcagtgcgggctactggccgtgccaaatttaccagttacggagtgattaattttgttaagaccaaccgttctccaattgagcagtaaatttttcgaccattagtaatgaccattaattgcaaagtgagctgcattaatttcaccattgtaatctcctgcaatttatgtctatgaaatgagcgttgcaaacttgatatagcaatatggcattatcttgcatttggattccttttatgggtgattaaggttgcactgatctgatcttactattatctgttgattgacaaataagtagatgatagtttaagattgctcagtagtgtggtaaactttggttctgggtttagtaatcatgattacactggccctgccttttgcaagattgggcacttaaacaagtatgctgcatttcttattttattttttatagcatattcactatgttaaatactgttcatcagaaactgaattgattctgaactaatcagattgtcataattccccccatacaggcttaggtagtgaaacgaggaacccttaattagtctgcatttgccattcttactgcaagcaagattatgaaaactagaattgttttatacttgacctggcaatgtcgcatttatttatttattttttctactgcacgttaaacattcaatacaataagcaggagttgtgaatatattgttgctagcttgctgttgcagggcaggatgctgaggaaccgcgggtagctagcgaacatgagaaagaaaaagcactgagtacagctaacagcatcttctctgcgttgaaccgctacagcaaactcactggtctagtggtctgcgggaagagatgtgattctgttggcatcccagcactcagttcttcattaaatctttctcttggtagaatcaaacaaagctttgtattgtgagttatttgcataatctgtttgtattgttgttgttttgacgtatatctcgtgttcaaaataaatatatgcatttcattccctctttattaattgagagcagttttattttgaaatgattcacaggactgacccccatttgcctgacatgccgatcatctatgctagtgatgcttttctatcactaacaggtacttgaattttgttttctagtatataatatgcattatacagatatttgtgatgtaatacatttcagtgccatgttctatgactaatactagtattgtactcccttctgttattgtgaactgtgatgcccttggctcagtgagtctgtgaagctgattgtgatatatttatatttttgtttttgctactacaaactcaaattcttcccatgtatgttgggatgtttgatcttacaagacaaaaaaaatttagttcctatgtaccagacttaatcatggcgtacccttgagttgagacgggcatgagtgaattagtgatgttatgcattggttaggaatcattgaatcctggtatgctcttcagttaagaggggcatgattgctaatatgcggatatgccaccacacctctctctctctctctgaatcttcatcttgaaaatattatttgtatttcgattgcatctccttttttatgctaatatcatttacattcaaggcttctgttctgaaaatttttatcatccaggttactcaagagaagaaatcttgggctgtaactgcagattcttgaatggtcctggcactagtgtggaggttttagaacaggtgcgcaccaggattatatagcttgtcagactgcatgtactttatgaaatattctcaatttctttacattccttattgatttgggtgtgtagataaatcaacatatttgttctgagcaagcttgcacggttcatctactaaactacaggttcgcatctacacaaaatagtgtatagcaatttgcaggtacaatttatgccttgaacataacagaacattgtgttattgatactttctaacaggaaaggtggaagctcgttccgtgatcttctacatatatctcctatacgaaatgcatcgggcaaggttcgttttcaagtctctctggtctttccttaaaggcactgggcttctgatgcatcttgttttcatttagtaatgatgaactagatatctgcaacataactatgtttgtagtaagcctgtgctatgctattctggttcttttgaacttcgaagttgaatggattcaaaaccattctcgtgatacagttaagttagcatgtgcatctttcttacatcttgcctgtgcaggtagcatttcacgtgtgggttcaccttgatgagggtgcaaagtatgattttaatgggctgacccccgaggtatggcagcttggtgctgttggtgcggtgagagtggcagtcagaagcttgtctgcgtcaggaagcctgttgagaccgtcccaatagcattatctagtttcttgccattttatgact

SEQ ID NO: 59316 - DNA, 12241 bp, Oryza sativa
attctgtttttctttgaaattactccgtacaccctaggggcgtgggtggtcaccctgaagacgacgttgtgtgaggtaaaacaaactttgttagtacgatctcgaatcagtaattttggagtactcgagttcaggccaaagatcgaacaaggccaaagttcaatataataaagtggtccttttgtattatttaatccaagttctactccttaggctgtgtttagatccaaagtttggatccaaacttcagtcattttccatcacatcaacctgtcatacacacacaacttttcttttcagtcacatcatcttcaattttaatcaaaatctaaactttatgctgaactaaacatagccttagccacaatgtgctgcatcatgaatgtactggagtactctacttgacaaattggactatgaattcgaaagaaaacctgaatatgaaatctggaggcggtttgacagcgatggatatggatatttagctttagccaatagacggtctggtgggagtggataggcgaagaccttagtacagaaccataccagccggcctacttctattttggacgatatcttcttatctaaatttgatgacaggtcaggcgaacggtggcgtcaagaatgtcttgtcaagacggacacacgacgcggcggtatgcaccacaaaccaaccgatcgagctagcgtcgaatcgatctggcagctcatactgccgattgctactctcactcgttgtttgttgtgctctagcttcaactacgttcccacctaacgttagtatcctgatgtgagcgttctgcgtgcactgcacggacagggagatgatcttgtcgattgttaccgacagtgcacggggcaagagatcatacggccacaggtgttaatcagggttcagctatgcgtcgtttgttaatcagactcgctcaaatcctaatgtctttctttcttgtgatacatctgtaagcgatatgtctggctatacattttgtcttcggtctttcacaatttcagatgctttacatgctgctaaccgtgggggtatggttttaaccccgaaatctcatatttaatttccaacgcgctcatattttttaaaaaaaatgtttggaggaacatcctctccaaatatctttttgctttgaatgaacgtgctgctaagatgccgcagttcttggaaggaaacgataaattcatccctcttttcttctcgttttcttttcccttttcagatcaatcaacatatcgattgcgccgttgggagagcagagaacagatatgacggatgagcaaaagctgccgaggcgagcgaacctcccctcaactcacgttcacgtcgtcgtcgcgccacccctgacgccgagggaggtaacagtcgcgccgttgtcctgcgtccccgccagctgctgcggctgcgcccagcgcgatcgatcgatcgatcgatcgactgccgggtaggccacggcagcagacggcgacgtgcgcgtacgctcacccacgtaccacgcgcgcggcgcgccgcccgccgccaggtcggtcgatcgatcgatctagttcaggttggtaagggcggatctacggttgaagggccggtatcaggcgacaccaacaactttcaagcaaacctataaaaaattatttattcatatattataacaccatgatctaagggcctgtttggcacagctccagctccagctccacccctcctggagctggagctcagttaaacagtttcagctccaccaaaactgggagtggagctgggtggagctctctcacaaaatgaactagagttgtgaagctgggtttagacagctccacaactccactccagacccaactcctggagctaaatttaggagttggagctgtaccaaacaggccctaagtataattagtatgctatgataccgatatacacacgttatgaccctaacgaatttattttttgatcctccaccgggttggttgacacgtcgttccggtgggcgggcggctcgtacgtcggcgcctgtgcgcgcatgcgcgcgtgcggtgcggtggccggggacgtacaggacgggggatggatgcagaatgcgatgggcatcgagtttggcgcgcgggctcggttctagcggcgtctgcatatgcattttggcagtttggcacggctcgactgtgtcgtgtggctgggtgttggttgcggcaggcagtgtggtggccactgggcactggctggatcaggatttgatattggattggtctgattggagacacctggccacctgggcggctccagtttgtattttttctatttttcttacgggttaccaggggaagatgatggggaagtaagtcaatatcaaaatattccctttgttttgttggaactagtatgtactacctccatctaagaaccatcctagaaagacatttgttttgcgttgtttatattcaacatttgactgtctgtctaacttaaaaaaattgttatgattagtatttttatttattactagatgataaaacattaataatactttatggtgagactatcttttttttattattttttcatataatttttaaataagacgtacagtcaaacgttggacacggaaaatcataactgcacttaaaatgagacggaggtagtatccatgttgcgtgccgagagatccatgcttgattccccgtacacattcgatcgaattcgagtaggttcggtactttctatgttgatattgtctactactacctccgttttcttaatagataacgtcattgatttttgtcacacatttgatcattcgtcttgttaaaaaaaaatacataattataatttattttgttgtgggttgttttatcactcaaaatactttaagcatgatttatatcttacacatttatataaaacttttgaatagggcgaatggtcaaacatgtgtttaaaagttaatggtttcatctattatacagagcgagcatatatttacggtacgtagttggacttaagggaggagctcctgtataaactggaaatatctttctattgaatgaattaaacccattcacattacgttggaagaccctactgatctctcgaggacatacttgagactatacttccgtttgttcaaacactattcaaatgataataaaatgatctaaaaattagataatttttatactacatacatatataccacttcataaaatcacactaactccaaatccaactaacacatcaagagatatattattaaaaaaacaaataaacttgacacgaactcctttttttcaatatgtagattaaatttgagcttgactttctagcgaaactaatgatacataccactctactctacaacgttgatactaattctatatatcagtcgtctagttactaattaatgttcttgcacgagtcgtgaaccgggtgtaattttgctcattagtcattacgatgcatggtttgtgtatgaaacatgcttaattgcaaatattttcttcatttttattttgagttccggccactgtttgtatatgtactagcgtgcattatgaatcattgacgtgcttattacctccgttgcaggttgtaagatgttttgattttagtcaaagttaaactgttttaattttgagcaagtttatagaaaaaagtagtaacattttcaacccaagacaaatttattatgaaaatatattcaattattgatttgatgaaactaatttagtattataaatattgctatatttatctataaatttagttaaacttaaaacagtttaattttgataaaagtcaaaacagagggagtacttggtaagagttatcgatcgttcaatacactcgctggatcatccggaatccgccagcagcaaagagatcggtgcctaacgatgtatagtactgtagaccgatgtgtacttaaaaattagtccatcattctcaagcaaacaaaatgcacgttttcttgatggaagacggcttacaagtgcacgcatgtaaaggtggctacggcactggcttctccaacatttaatatatgactagttggccaagagcacaggtcgaaaacattgtatctgaacttgatcccagtttttggatgacgatcgatggcgaaatgcatattattattatctcattcctgtcattggtacgtacgtacttaaccggccgggaagtggaaaaagaggagagtttcttttgcgtcctccttatgatgatccactaggctagctaattaataaatttaacggtaatatacaatctacccaatcaattgagcacatgcatgcccaaaaattttaagctaaactcaaaattggctgatataataatatacgatcaaaagataacgtataaatattagaggagtctggttctcagtaaaaaaaaatatcaacgaatttcagtcacttttgaatggctcagatcattcgccgattcttacaaacacagtaactttatccttcccctcgtcctcccgccaatgcatacaaggcaagtcgtttatctacattaaaataacagaaattgctaaacttctgtcgacagaaaatacaatcttaaatcttgtaaattttggatcactggatgtgcttcacgattcgtgctcttcttctctaactccggcgaccacctcttcttctctggtgccggcgaacccaaactccgacagagggccgatgaattagggccccagggtagggtggggttgggaggggggaggggaatgggaagaggagggagttcgccggctttagagggatggccgttgtcgacgtttgatgtctcgactacggtatttggacagtatggggatcgtcggtgctagggtatacgcgagactgaggtaaaagagatggagacgaggatttttatacaggttcgggcccctaaattgtcaggtaataaccctacatcctgttggccggagccggagttgcttttattcaccataataacaccagtacaatatgtgggtagcttatcaaactgttgtcgacatggcggtctgaaggtctgactcgtagtcgacaacagggtagccttgctccttgaatccgtgtccggcgagatcagagatagcgcttttgtatctcctgacagtatccggagacaccgtaggggaatagccatgcctatcactgaagtcgatatccggcggcgtgtcttggcgtatgtaggcttgtatgttgtcgcgtagattgtggtggttgttgatcctctcatggtgggtgtgtgtgttgttcgtctcgtgtcccgtctcctcctagggggccttgtatttatacccataggtgtccccttgtccaagtagaactagggaaaccaatatggatacaatccgagtagtccttgtcgtttccatgtagaactctggttgtctttccttatctggaactccctcgaggtcagtttccgtataagacatggtatgtggtggatccttccgagatttagtcaactactattagatatgtggtatccataaccctgacaaccgtgggaggcagcaacccagcggtgggcggcgaatcgggcgggcggtgaggcggcggtggcgcagccgaagccgcgggatcgggagcgggtgacgggggcaaagcggaaagagtggtaggaggaggcggccggtggtggtgctcaccgccggcgacggggaagacgacgacacgggacagctcgccgccgctagcttgaggcaaaggagaggagagggagggggagggggccggccggggaggctcgccggtgccgttgacacctttcggccagccaacggtggcagcagcacaggaggcgcacggtgtcaagggaggaggagtgctcgaccgatttttgtggcggcggggaggaggggaaggataagtggtttgggttttgtgcggtttgcacgaatctcaaatcaatccaatgataaaaaaaattacaagatattaggaggggttttctgttaaacgaggagtacacaatcccttaaaataatgtcaatgattttcaggcacttctgaatggtttagatcattcgaagactcatataaacacaataactttatttttctttactctttttcccgccaacacatacgaggcaagttctcgcctacatacaccagtgcaccgtctaccggtgagtttcaccatcctccttctctctcaaaatctagcgctaggtttaagttaattgaaatttctagaatttcagtcgcctgacacactaagtatggttcacctatattacactgagtatgcttcacgattagagatgtaagtaggtagttccgctatctacataaaaacccgtttgctaatattaattttctggtcgttcgtatgtgcttcgcgagttcgcgtccccgtcaaacttggcctaccccacgcaaagtaaaatcgagaagaaaccagtgcgtggcaatgatcgagcgagcgatcagcatgcgcgcgcggcgcgtgcgctcgatcgctcgcgtcgtaggccggccggtaaatttctcgcacccgtagtcgcggccgaattgcccgcccggccgccgctgcagtgccccgcctgatacgtacttagattggacgcgcgcgcccctttttacaggtgtcgcttgcatttgggccaggtgcatcgtacgcacgcacgttacgttagtgctatccgtcgacacgaccgcttggactcccacgttaacttggactaccgtatatatatacacctcttccgatgatccgttcctataaggatctgtttggactttggaaagtattagattttgaaaagcgaatggtgtgaatccagctgataagaatcggaataattaagttaccaatttcttgcttctactttattttctgaattatgctgatatagctggttataatatggacaaaatgctgaattgtttggcagaaattttaattctgagagaaaattgagctgtccgaaacctcccaaacaaactctgagattgtttagcaaaaattaagattgaggtaaaagattctcccttggtcacctccttaattaaattttaaattgctcgattggattagcttgaaaatgtttggatttaatttccgtgtgtaatagtgaatactacgggaatctttatattgtgcataaatgcttatatttaagaacggagaaaatactgagggatcgatcatccaataaatcaagtcatggtcatcataatgcaatgtctcaacattgaccacaatttcagtatatatacttctctcttggttgatattacttatcgttctgaacaaacctattgtcaaacctgaaaaaactttaactataaaatataaaatagttatattagaaatataatgaccatatgtatagattggtcctaaaaactacttcaacaaaatcatatagttattgatatttctattatactataatgaaaaatagttatcaaagttactttttaagatcatgtcattgattgttcaaagcgataattattatcaaaccggtggggagcagtagattgttaattcatccctgaccaggggctaagtttgtgcggtcataaatgccaaaagtgcagggttagttagcgggggtgtcactgtcacggtaagaagtaatcacaatcgacatgtgacacaattaatccatctattgagaaccttctgatcatcaggatcgttcgtgtgaaccatccacatagccagctagtttggaccaatcgattcggcagtataaattgcagtgcttgacacgagaaattctgtcaaacactcaatcagcagcagcagcagctagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttacttctgtttttgtttttcttggttgcttgttagttgtaccgccgttcgtgatcgatcgatcggttcttgtatgcactagacttactacttaaaaaaaaaagagttaaatcttaactataaatctagacaatcatatgtttagaacttcagattcgtcgttagaattaatttttttctaaacggagtacgccgtattgttttagctataaaatcgtgatgatttgtgcataattccaatagcctcttccatctccgctaattaattagctttatcgtatattctaatgtaaaatcaagctacttaagatataaaaatttacattaaaaattttggtattacctcttgatatcactgaagtaaagtaaattttttcgcattgaattttggtggacaaacgctcatgctattctcaagttgcagagaactttttttttgacacagtaaacctctgctttcattaaccagtatctccaggcaaatcgccggagaccaaaggagatacaaacgtcggggcttggctccagaaacacttggagctagtggccacgatacccacaccaaaagaggccaaacaatcagccactttgttacaagatctagggaaaactgaaatagaaaagacatcaaagtttgatcttaagaaagcccttaattttctgaaaatgacaccatcagggcgacggttcagatcttgggaaataagtgctttgcccagcatctgtgcatccgttttaacctcaatttttgtcatcccctgttgagacactttttctagacttttcatcattgctaacgcctccacatgcagggcgttgcccatccacgataagcttccagcagaaagaaccctttgaatccattgccacaaaaccccagcctccagtgccagtctcagcgaagaaggaagcatcgatattaattttataaacatcttcccgcggcggcttctatttttccatcacttttcttacattttattccccattcttccttatcttctcttacaagttgcagataactggttgtatatctgcagagttaatcagatgtgccattcctcataagggcccaagaacagggtaagccggtaaggccttgcttggatgaggctcattgcaggcccatctttgtgtgtgggacccaacattcaggcccataaaaggaggcccatctaaacttgcaaatcgttcagtccaatgcaggagcacttcgactagctcagttttttttttctctttttgaataatggacctttttaagtccagtatcatccgtgaaatatggatgattttaccatctttaagaatataatagaatttggtacctcgaaatactttctctcaataaccgtaaaatttctcatgaaatattatttcaaattaagagggtgtcggacagtcggaaagaataaatctatttcaaggattagagtgagattttaccaaactaacaatgttttcagtgtgttccatctggtcttagtattcccaactcgtataatcactatcttctttttgtccaagtaatatacatatactgcaccatgtttttttcctttctaaaatccaagtatttatctacctacttttctattttatactttcgctggtaattcaaaaagggtaaaaaagtataaacgttatagcatatatatatatatatatatatatatatatatatatatatatatataagaaatttatttgtatcttgtgatcactgcagttgcagaaattaaagatcggctttgtgaaagcaagatttctgaaaataccaaactactctctccgttttttaatagataacgccgttgactttttctcacatgtttgaccattcgtcttattcaaaaaatttacgtaattataatttaatttgttatgggttgttttatcattcatagttctttaagtgtgatttatatcttatacatttgcataaaatttttgagtaagacgaatggtcaaacatatgagaaaaagtcaacggcgtcatctattaaaaaatggaggcagtatatattatcgcagcctagaatgatcattatttgaggacatcatttaatcagatactcacatataacttcattaggtccaatattaacaagagcacatgcacatcaacttaaaataaaccgctaaataatgtttgtcgtgtgattatactttagtaatcttcggttatatcaccaaggagacatatgtactcaaaatcatcacggagatcacgaagtgagcataattcaattggtttggttccttgttgtggaaccaacctacccgggttcgaattctagatttaatacgggtgctcacatttatggctatttattctttaagtagaaaatcaacacgggccaagtccagttaagccttctgggaccgtattggtttgaaacggacctagctgtttattctttcagtggaaaaccaacacgggtcaagtccagtccagccttctaggaccgtattggtttgaaatggacctagcatgttcacggcacctctggtttagattttgttagacttcacgaaaacctttgaatattggtgaaggagaggtgaagagagaggggagggtgaagaaagaacatggaactgacgggcaggttctgtgtttagcggcctcatcatttcgcttatacttatgcttatcaggcaaaatttgaattttcaactttaaatttggagttgattttgatgtcttttcatcgaagtttattttcgagcgtttgcttttagatcgctaataacacgtatataaaagttttacgtataaattattgttcttttgtaaatatgccgtttcgcttattcctccaataagcgaaccgatgaggccgtagatttggtattttggttcatgtaaaattaaagtaaaaaaaattccaaacatgtttgatgcgtacaaaatgacatgattttcttaatacaacaaatttacagtggcatgggccaaatttatctaagccactgttgttgctgaaggcaaactaaatttaggtttggggttttccaatagatttcccatcgttagtggtgttccaaattttaatatttagatgttgcctatattaactacattattagttgaaatcagaatattatatatactatgatatatatataggataccggtaattgttttttaaaggttcatcactgcccatctctggtgagcctctctccaccttaattaatgaacttgagcacaccaaactctagtttcctttataactagctatgtattgcaagaaaaaaatattttatttagttgatttttatccaagtgtgtttaatcttattcttagttcacgatcgtttagtcggtgactataaaagtctaaaatagttggtatattgatttactcgatcgattggattgaccacttcaataacaatcattcctatcgtgcttaattaagcacctattcataaataatatttagattgtatctaccttatttttgcagtgttttcttgtctacattagagattatcaaaccacacgttatgtttgatatgacattgcatcatagacttattgctggtagctgttttgtcaacatttcattcgatcaaatcaagagtttacgctcctaaccaaaatcaggccactagagatcgtcagtggttatcaccaaaatacactatcaattaatctctcatatatatggggagaattttaactttggtcaagttattttcatggatttttgtttccttcttgctttcctgcgcagtatatactccctccgtattttaatgtatgac

SEQ ID NO: 59317 - DNA, 15616 bp, Oryza sativa
ttctttaagcatgacataagtatttttatatttgcataaaaattttaaataagacgaatggtcaaacgttggttaaaaagtcaatggcgtcatacattaaaatacggagggagtatatattatcactccatgatcagtactgtttgtacaaaaattatgcttacctgacactatcacgcatgcatgtctagctccttgaagcctggaaatcaaaagcctcattttgaattaatttgtttccccccacatagtgcatatacaattgagtgatctcacgcttgtgcatgcttatatatactgtactctatgtacatcaatttgccaattaggagactaatacgtacgtatagcagaacaaatcaagcaattattaccatctaattgattatctaaacaaaatttagatcaattttatgaacttgcttcacttgttcggcgccgccgcgccgccgccgcgccccatgtaggacgtgatcgccgccgccaaaaccgactggaagctcgggtccgacgtgatcgccttcgcgatcgtgtccgtcacggccgccggcgcgacgccgccgccgccgatggctctctgcaggtacggcgacgtcgtctggccgccgaacagctgctccggcgccggcctcgccgccgccgccgccatgcccatcatgccgaaatgatggccgaacggcgacggcgcaacgcccttggcgtagtatggctgcgccgccgccgcgccgccgtacgccaggtacccgctgctccacgccgccggcagcgccctgctggactcgtaccccgcggcggcggcggcgtagggcgacgccgacgacgggtgcaggagcgagtgcggcgcggtgaggtcgagcgtgacggtggggcaggacgtggcggtggagatggtggtcgggccgagcagcccgacgccgccgccgccgccgacggccgaggcgaacggcaggtggtggtgaacgccgccgctgccgtgcatcgtggagttggtcgagccagacgtcagcatcgccgccgcggccgacgttgtggacgccatcgccgccgccgccggcggcagcgggtggctgtgcgtgccctcgtacgtcgtgatcaggatcgacatgtcgtccgcgcatctctgcacctgatccatcgattaacacaaaaccaacacaaatttaaattttcgcttcaatttaagtacgcatcattcgaatcatatacgtatttgtaaacgtaaatacgtatttatacgcgtatatacgtacctgcttgcgtacagggcagttgggtgcaacggtgcaacggtaataggcgcgcgggcaagggttcccctttgagattttctgcccgtatttccgccactgacacccatcgttcatctaatcataattaacagcgtgattagcacgggtaaattacgtaattattatggtttagagattgggattaagaagagtaatcgttcttctgtaattaattagtaccgtgggggtgtcgcacttgactctgacggaaaccctagccttcttggcctgctgctgctgcagcacctcgtcgtcggcgccatcgccgccgccgctcgagctcctggacgctttgttcggctgggtaggctcgccggcgccggcgccggcggcgtccccgctgctgtcggagctgaggttcagcacgggcatcggcggcaacgcgcggcggctcgcctgcttgtcgtcgtcgtcgtcggaggcaacgccgccgcgagcgcagctcagcccgagggacagccgcccgtcgtcgccgccgccgccggacgacggcgtcctctcgtggcccttccggcgcgtcgcggcggcgttgggcctcgtgcagaggctcagggagacgaggtcgtcgggctcgtcgtcgtcgtcgtctccggagagctccgccgccgtttgctccttgaccttgacgacgtcgaggaagtgcgtgtgcagcgacttgtagtcgctgacgatgcgtgtgagcatcgtcttgagccgctcgttctcctccctcacctcgcccatctccgccttcgctgcctccatcttctcctcctgtcacaataattaccacataattaatcaccaatttctgaattatcagaacaaattacgatcgattgatcgatcgatggatggataccttcttgatgatggttgaatctctctgcgtcgatggtgcaaaactctcaaagactattggaggcgcgcctccaatctgcacccaaatacaattaatcgaattcagtttgatcttgttcaagaactctgcaattagcatcatcacgtctcaaaaaaaagatcgtaattaaatccaatttatgttatcataccgcggcgacgtcgactttcttctcgtccctcaccggcgggctctcgacgacgacgtccattgcggcgttcgatcgatcgtcgttaccgatctcgaaatattaaaccaggcttagcttaatcacgtaggctctgaacaagaagggtatcaagcaaagcgatggctgaacaaagttaattgtccttgcaatggtagcttgccctccttataaagaaggaagctaaggggctaaggctaggaggtcgtcgtcggggcctgcagtttctgactgaaaacggattaaaatattagctttccccaccaaatcccggttaaatcccagtgattaagtgggtaattaaccttgagcgagagagagctcgaggacccaaaaaaatgtcaactcgagcatgggcaaatcgaatgagaaccaattagctggacggacgcgtcgacctcgattcagatataatatactccctttatactccattcgtttctaaatatttaacacagttgacttttttaattatatttgaccgttcatcttactaaaaaaataagtaattattattctttcctatcatttaattcattgttaaatatagttatatgtatacatatagttttatatatttcacaaaagtttttaataagacaaatagtcaaatatgtgttaagaagtgaacggtataagtatttaaaaatagagaaagtattcttcatcatcctcttcgccgtcgccgtcgtcgtagccgttctacattgataaattgcggctgcagccgcgttctctgtccggtttggtccacgcgtatgtgcaaactggactggataatctctcatctcatctccggcgacttggccggcggtggccaccgcaaacagagacaacgatcgatcttagcttgatcgatcggaattaaggtcgttaatcgatcgatgtggccggaggatttgactccgatctcgatgtgacctggcaaaatatactctatcttgaatacttctttcacaaacgcgcaaaaaaaattatacgccaatatattaaaagaaagaaaaaatttatttatacaacacaaacaaacggctagaagaatctattaacttattaaaggaatagaaaaaggagcctccacgttcgctctcacgacctagaaaatctcatattaatcggagaaaaaggaaaacagagtccatatagaaatacaattagaaatggttgaaatttggaattaataaaataaggaatattagaagaggagaatagagtccatatagaaatacaattaagaaataatagaaattcaggattaaaaaccaggaatattagaagtagagcatagagtccatatagaaatataattaaaaaataatagaaattcagaattaaaaataaggaatattagaagtagagcatagagtccatataagaaattaaaactaactaaaattcgaaataaacataataaaattaaaagtagagtttagagttcatgtaaaaatactatttacaaataactaaaattcaaaattttaaaaaaaggggaagaagagtctaaagttaatataggaatacaatttataagtaactgaattcgaaattaaaaattaaagaatattgaaagatgtgtttagagtccacatagagatacaattggaaacaataaaaattcaaaattaaaaataaataatattagtagaagagcctagagtttatatagaaatataatttacagataacgaaaatttcggaattttaaaaaagaaatattgaaagacgagtctagagtccatataggaatataatttacaaataactaaaatttgatattaaaaataattaataactaacacgtatataaaatacaatatgaatattacacattagtagttttgtaaagttagtacaaaatttaaaattatgttatcattttaatatatttgaataatacattgagaaaatatatatgctattatatgagagaatataattatgctagccgtgcaatttgcgtgggttattatactagttttatttatacaacacaaatggctagaaggcccttgtccgggggcggggaagaaaaaaccgggaaaagaaaagaaaatgaaaggatcttgtttacttctcgcagtcgtgattaattagcgttcaggccgtcaggcgtacgcatgcagcgagctaaatcgttggttttttaaaaaaattatttacgccgtcttcttgttgacttttgtactggaggttcgtacgtgtgtaagcaaagtcggagaagcaactaagtttgtgtttagatccaaagtttggatccaaacttcaatagttttccatcacattaacctgtcatacacacataatttttcagtcacgtcatctccaattttaaccaaaatctaaactttggatccaactaaacacagccctaactgagaattgttcagaaatatgtgcatgcgtttcaaaaaaaagaaagaaagaaaagagagagagagatgtgcatgcatggtgatcttccgatctctgaattctgaagcacattggtttaattacatctgtgttctgagaatgaatttatttttctgggcattttgcaagagaattttattaacctgtcaggagctacggttcgattggtcgtgaaaagtagcggcttggaaatgcaccgtaccattaattcttcatatgcatttacctgtttcatccttggctgaaataacggcatccagtgtacttgtttcagttttttctcccatccttattaaaggccggagtatcttatcatttactactaattaagaggtatcgcaagttgaattgattaaaaataaaagtgtacgatcgataatgacatgtgtcaagactatctttaaaagagaggggtatatacctcgtattcgggttaagatatacaatatggttagtacctctatcaaaagaaatatttacttttgctttttttttcgtaaacatgtaaaaaaattgcacgtcaatatgttggaagaaagcaaagttttttattacacaacgaaacggtcataaggctactgctaggggataggaaaaaaagaaaaaaaaacagagtaaaggaaggaaaaacctccttaaacaaaaacaactcctattgcgagggagggtgtaggtggagcccgactaaacatccaacaaatccacaaaagaaacagcactagcttccacggttggccttccagacggatggagtcccgcaccatcaaaatcgaagagagtgagtagtcgaaaaccctggtgttccgctccttccacatctaccaggaaaccaagaggaccagagaatcgaaacggtcatgaagatgctctggcatgcgtgctctagtagacgatcttctcgtcttggatcaaaaccttaggagaaattaatccaggcgagtagaaaattgaaattcttaacaaatcttcattgaatttgaactccctcttatcgcggttgcagtggtcttggagtccatcctccggaaagacccgcctatggtcttctgcagatgttgtggcttttgggagtctagtgggcccaactgccaccctccccatctttataggagcagttttttttttcagtttttttttgtccttcaatggtcgcctggccggttgcgtcgtgtaactaaaactctagttttttctaatatattgacgtacaatttttttgcgtgttcatggaaattcattgaatttgaagcggtttgaatggaattcaaccaactctgaacacaaatggacgccgaattttcgaccagcaaaatctcaggaggatctgagatagcgagatctcgccgagaaactaaaccatatatactggccgtgacagggccggaggtgttgaaaattctgaaattccatcgaaaaatttcaaacccctaacccgcaccggccggtatccatcagttcgtacttctaccaattttcctcaaacgcgtctgaacttgaacagtacatggtactgcgtgaacagtatcatcaatcatgtgcttaaattagagagagctggaagaccaaataattttaattatctttttttcctaaataaaaaatcatgcatgtgatgtgagtgacaatgtccaagtcgatggatccgaccgtgcaccggcttccggtgagatcgatcgagtgcgacacttccaagctgccatccaatcagctttaagtatcgcctaattaagcttgaattatttagtgatagtaatattaataatattattagcttgaattcattattcggtttcggttggcctacttgctgaagattccagccaggccccgttgaaactgttcctgcactgcacatcgcattgacacaaaggacagatctgatccctttttaatcagcatcatggaaagtgtgacctcacactggcctttgctgattcgtatagctttgtaatcgagcacgataattaattagcagagaaagatatccgatttgcttgtgttcccacaccccacccggcaccggtgtagggcccactggtgcgcgggtaaggtaaggattcacattctcgatgtttgacatcatcttataataagtggatgtgtgccagttcgtatataaactacttttgttgaaagataaacattgccgtaaattcaattcttattttattattgatctggttgaagactcgaagttttccgattaatctcaattttaaggggggatcgaaatccttaaattgtgcaagtgtatccatttttcagcgtagtttagagacttttcatcgatttggcgaacggaggaagaatccaccgcagggataggtgggtacggcgtgtaagggtacaaatttaaacaagttggagtttgaaaatggctggagtagaggaaaacggtggcgaataagataagcacatggcggttgggttcgatggacttagttcaagtaaactgcgtgattagtcaacggatgcatcaaggaggcgtctttcctacctaattcctaaatatttgttaattgttttccaaatggatacagctaagaaacaaagaaaataaaataaaattcagacagagaagagaagaccttctttgtatgatgcatcatgtgaggccaagcttttcaacgatttggtcaagactttggacctaaagtgggatcacactaataatatttccatcacatttttcttaaggaaagacctgtcactccttgggcccaaggaaattaagagaaaaagaaatatattttgttttttgttctctttaggtatttgatgcttggaaggcattgctacaccatcttggagagattttaaaaaataaatcgtttaatttccatgacgtcgctattgaaaattctgagtcgcgttatcgatagttcttgcgagttactccagaagtcagatgctgatggtagttttttttttcatggattactgagtcctgaaatgaaaaaattgcaaagtcagaaggaggatcatcttgggtcatcttgcacatggaccagatcaagaacttagccaatgggaacagtttctggtgtaatttagccacaaaggaatattgtatttggaacttcttgcagtttgagcatcaaaatactcgaggtcaacaatttgtcagaaacccatggaaatgtcagttcatggatctgccacgccaagacttaaattagaagtgatggattattgatggataaatacagtaaagtactcaactgacacagctcatacacaccctagttaattttcacagaagacctcctttttcagatttacaggttctgtaattttcacagaagactttgcagttaactgaccaatatcatcaagacttgtacggcaattcttggaacacatgaaaaaagaggaaactttcaaaggaaaacactagtgggaaaagtgcatgggcattttagtagttagtacgtgaactgctagttaatatttcactttctgcatggaaacttgacacaggtttggccttttcttggtgactgctaaaagagatgaccatgaatgctaatggttgtcaatgtgtaatctgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgccgggcgtggcgtggctggctggcggcgtgcgtgcgtcacgtcactatccttttgcagccactaacccacgttcccacgattccctccgcaacagcgcgtccacgttctttctcctgatagataaggaggccgcgagtccgatccgagttcctcgcttctttcccggtgttagtttctccttctccgcgtctgagttgctctcgcttccctgcttctgatctcttgcgcgcacgagagattggaagaagcagtgcctccgaaaccacaccttcgcctgagatctgcaccgggtaggcgggtgagcgggtgatcaggtttttggggagtgcctcctgcacgactgctcatcgccatgtcgtgcctcctgcacgactgctcatcgccatgtctggagttgctgccgccgctattggcggaggtggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgtaagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttttgacgccggcagtgagctgtatgtcatggagcagttctatgactacaagatggtcgatgaccgttctgtagtagaacaagctcatgagattcagatgctggctaaggaacttgagaacaacaactgtgagttgctggacaagtttgtggcgggtggcattattgccaaactaccaccttcttggtcggactttgtgtaacgctccgcttttcgtgaggcgttaaaaactaactcggcaaaatcctaattgcgaaaatttttgttctttgtgtgcgagtctaagttgtgccaagatctcaattcaaatcccgttgttccctctcatcgaaatcaaaatcctccgcctcaaatctcctctcccaattcaagtctccgaaatctaaatccgaaagtcaatcccttcctttgaatcctcgccaaatacatttccaaatcccaaaatgtccaaacccccgtttgtttcctttccttgactccaccccatgttcccgagaacaaatacccaagttttccttttgaatctttcccatgacttctccttgaatttcccttgatacatccctaaaccctcgagtttgaatatcaaatttgaattcgaatccaaaccctaaatctctccatttctctccaaatcaatctcctccgaaaaagtctattttgcctccctcggatttttgtgggccgttttctcctcggcccatctcctctcagccgctcctcccccttcccttcgcacgtgctgagcacgcgcgtcgtgcccgagccaagagagagcgccgccctctctctctcgccctctctgctttctctctccccggcgccgattcccgccaccgcctttggttcccgcgcacgcgccggtcgtggcagaccgcccggtcgccgccgccgtcagcgcctgcgtcgtgcgctgccgcccagccgctccgtgcgcgcgcgccatgccgctcggtcgccgcccgtgccctgttgccgcgtcatccttcccccccctgtgcgctcgcgtccaaaacacggagccagagctcgccctcctcctctccctccccaaagcagcatggtcgaacccctcctttccaccctccccttttcctttttccctcgggctcgacccctctctcgctctccacccttgtccctctgcgcgctgaggcagagcaccgctgacgccgcacgccagctcgccgcccccaccttgaccgcgccagcctgcgctcccgtggttcggattcggccgtccgatccaccgccttcgccgcccaaagcatccacgccgtcgccgctttcgcatcgcccacgaaaccgccgctgccgccagccgagcgcttgaccgccaaggtcggttctccccccccaaaccgacatcgcctcaccccgcgcctataaaacccgaagccgagctccccatcccatctcaatccctcccactacacactcctactccaccgcgccattgtcgcccttcctctgctctcgccgtcgccgtccgccgccgagcaccgggagaccggtgcgtgcgaggacgcgtgacgcgggactccgggcaccctccttcctccccttcctcggcccgaggccggagagctcgctcccgagccgtcggccgctcgtctctgcgcccgtctcggcttggtaatgccaccctccgttctcccttcttgctcgtcctctccctccctagctcgcgtggtagctcggctagcccccgaacacgcatggacactgccccaggtctcgccgccgaatcgccgctcgtcgcccttgcaccgcgcgctagctcgccggccgccatgctctgtcccggaggccgtctctcgtcgccagccaacctcggtgccgccccgtccaatccgacgccgggaacggattccttgaaccccggagatgctcccatccctttgaatcgaaccctcgtcgtctcgtcgtgttttcccctttttgctctccggtgattgccgccgccggccgtcgtcgcgcgtcctcttcctgatccgagccgtggaatgagttccccttctcctcctcctgccgccagtgctagccgccccttccggctcgccgccgttcgccggatcccgccgcacaccgtgagccgtcggatcagcctgcccggcctcctctgcctccccatccgacgtggctgccacgtcggcgccacctcgacgcgaccgggtcaaaagctgacctcggtcagccgcctccctccgtcccccaccctcgcgcgcggtccacggagagccgacacgctgcgcgtgggcccaccgcacaccgcgtccacccgcgcgccgcgcatggaccgccttccccccccccccccgaaccctagcgccgcacccgcgtgcgctctccccaccgtgaacccaaccaccgccatgtgggtcccgcgtggtggaccgcgcccaccccgacgggcctccctctctccctgcgcgccctcataggccgcctcctcgcgcccgcgccggcccatttggttcggccgagccgcgttagcctttgggccgcaccaatgccaccgaacaagtctaatatacatccctccatccttttctttttccagggatttaataaatcctttttcctttgtcccataaatcaattccttattccaaaattccataaaccatttcctttggccccacgcgtcagtgactgtcaataatattcttgagaatattatttctataaaattccataaaccatttctcctattccagaaactccaattaaacttccaaaattcatatcttctcaaccgctcatccgattgactccgttccacttccagtaattccgtaaaattgagatctatttaatggcactaataattagtctaaataggatctttcttttggtcttttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcgtgccaaaccgacggacctacccagtagtcgcactaatttccgtaggtcgtactaccctgattccttgtcactccacccttgtggtacctcggtattcgtgctctctgagcgcgtataccaaatatcccacctgcaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcgtgccaatagttgggaacgccggggcgaggtcggacaaaccgggttcctggtaaggcaaggacgagaagcttgctcacttaccgatcaaggtgattggagtttgatttgtgcacgcctaaaaaggcctatgtttatatgaggatttgatccttctatgtggcatgaggtaaccctgggtcggctggggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcaccctcgctctatataaatatatatatagttcctccgccctgaagagaagataaagtgaagtgaagattagggtttcgtcctggttcccagccgtcgcctgtggagttgggtgttagttcgttggttccgctgctgctgctgttgttggtgtttcctcgtccgtgtcgtcagttgcattctcgggttgttctgagctgcaacctaagttaaggtaaataagtcctctatttattttaaggatttgcaaagattcatatttgtcaccgtgggtaccagcactatgtcctgggactggtaccgagatcgcggtttcgtaggaagcggttcgcgccgtttttcctacgacacgctcctatcaggtgccgttgtacggcggtatcagattggggtgtgacactttgccacttctctaaagcacaagagacaagagttcagtgttcctgatctcattggctctttgggtgttgaggagaaggcgagggcaaaggacgttcggggcaaaaaggttgagggagggttctagtgccaatatggtacagaagaagaaccctcatgcatcccacaacaacaagaaagtcaagcgtgatgtcaaacccaaggctgcaaccaattttaagaagaaaggcaagggaaaggcaaagggagactgctttgtgtgtggcaagtctgggcattgggccaaggactgtcctgagcgcaaagacaggaagtctgccaacatgatcattagcgagggcggaggaacatcggggtacggtaaaatattacatacagttctctctgtttttcattcacctgattggtgggtggatactggtgctaatattcatgtatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgttgtatctaaatatgggacttttgttggaaaaggttatgacagcggaggcttgttccgcttttctttgaatgacatgtgtaataatcataatgctgtgaaccatattagcgagaatgatgagtctaatgtgtggcattcgcgactctgtcatgtgaatttcggttgtatgatgcgcttagctaacatgagtttaattccaaaattcactttggtcaaaggttccaagtgccatacttgtgttcaatcgaaacaacctcgcaagcctcacaaggcatctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccctaatcaggtggccgaaagaaagaaccgtactcta

SEQ ID NO: 59318 - DNA, 1693 bp, Oryza sativa
agtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcatgaatgacaccccaagaaccatagaagaggcatattcatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttacgcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacagctttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcgtacatctgcaggctttgtagtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggaaaaaccgaagaatagcaagggatcaactgagatactctcaaatcattggttcattgatgtacttggctagcgcaacgaggcctaacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgaaggaaa

SEQ ID NO: 59319 - DNA, 1307 bp, Oryza sativa
tcagttgtttaatccatcgtagtctgttgtatcctttgcttttctaacaccatctgatccgccaccaactcactttgaagcactatcattttccaacacagttacaatcacttctatctgctgcaaactacaagctgtgtttggtgtgctccttgatgcatgcacttgtttgaaaataactggttatgacttgtgaccaataacctgctttggattaaccatgcctaattcacataatacatctatcatgtatgtatacatgcacttgtgcaaaacatatttcgactcatttgaaaaaaaaatggattgttatttttgtaaattacttaatgtttcccccacactatgcagaacaacttctatatgattcataaccagctgatttgtacataaataatctaaaatatgactctggtggcatatttaattattgatgccaactttaggtaattagtagtcagtcgtagaggggtttctgaaccttattccatgctagtttcttcttcttttaattaaagtaccatgggaactgaaattcagcatgcttagctggtttgcaaatgacttgaggttaggctgctgagcactgagacaccatttgcatcttattattgcacaacaaatggtgtttacagggctataggcatgattagtcctagtaggcagtagcacacattttctactcctccccccccctcccccttcccccttctctctgctgcatgggaaaatggatgtagttgatatgtcctctgtccaaaatgttcttaaaatttacatcactgaaaaggtactttatttgttttcaggtcttcacagcagagtactctttgatttgtaagattcatgagtatacaaaaccttatatatgcctgatggatggtgtgacaatgggatttggaattggattatcagggcatggccgctaccgcattattactgaggcaagtttgaaatttctgtaactctgatttagattttatgttcatcatttgtattctcagtatttgaattgtaaggctcaaaatgttcgcatgcactactgttacagaggacgctcctggctatgccagaaaatggtattggcttgttcccggacgttggctttgcttacattggtgccaaagctccaggaggctggtgctgttggtaagattcttgactatcttgtttcagtaaccctgtagaaccatgtcttccgctactaattttttaataatctatcatcataactcattttgagcttgacaacataggaattgttctgtagttctgagctatgagttctggacattgcatattattca

SEQ ID NO: 59320 - DNA, 2306 bp, Oryza sativa
attcctgcagccctgcctctccatagtgataattagacacctcctgtgtctgtgggtcccagggccacatgtctagcacatgggttgcaaattacaaactatgaatgtcacattaaatagttgcttttgtggcgtatcatccgccagcttattcaacttgtaattaaacttaagaagcttaattgtttaaaatcaattgtttatttgccactccctaatatttaagccttgagctacttttcgcggagctatccactaatggatcgaaacttctgtcaatgaaattctgaagaacacttcgtactacagagtttgaacatttctctgagttgttaataagaagtaaaccagtagaggtagaccttagaattcaaccatgtcttgcgcactgtgcgacttctgggaaagagggatacagacattatagcatgtgtggcacggtgcaaagttcactctcctttgccttgctagacataggcacatagctgttctttttccatatacctagtaataatataaaaaggcacatagttacatgtgtggtgtgttttgtttaactaatggtgttatgtctctagagttaggattaatagaactagataaaaccccacgcattgctgcggagttttgtatgatattagtcgaaataacatgtaagatggctacactttgtataattttcatctatgatcgactattaaaaaagaaagctataaacaattaaaatgttgtggtttataacaatttaaatcatatatggattgatcaatcaaaagcaaaacttacgtgatgtggctagatgagagaaggaaaaaaaaaaagaaagtaacatagattaatcatcaaagacaaaactaaggtggtatgactttataagagaagaaaaggagggaaattatttggaccacatatcaattatcaaagggctagaaataatcgaggtgatgtgtcttaataagagaggagagaaataatatttactaaacttggtggagatgaactctatagatatatatttactaaacgtatagctaaatttccttttcaatttgtagaatccaaagtggaagccagcaactctggaagacgtggacaagggtgaggtggaatcagtttttgaaccattagctgctgaggctgagttaaatgtatgatcttcacagcaaacatgtaatattattggtaccggaataccctcttcaatttccctgttatgttgcaataagaaataacaaggataaaaatgatgattattgagccaataaataatatcatgattacagtatttgtgacttactgaagtactagcaatgtattgtcatttttgttaggagtaagtctattttgccttcctcatctcttgccggtcaaattgtatccctcaccagcaaattgtatccctcaaccacaaagctaggtataacgtatctctttactttaaaaaccgatacaaatcgatttcttcggtggttcggaagctgacctccacgcgaacaggagtattatttgatgtcgagcatcttcttgcaccgacggtgggagaagtgcaactggcggtggaggcgacgtggagtagagaggaaaggggaaatcttctgttttccctctcacgtgcgtgacagggcggtcaggatgaaattgtgaatgcagttgggggcaccgtattccagcttttccctacttttaatatctattgtatactagcaaaagtgctcgtgcgttgcaacggaaaatgtacagaccaaaaaattgaggaaaagttaagaaaaatttacattatgtaattaattaaaatacaaatttgctgaaatatttggtatttttaagtaggtaggtgtataattaaatcaatttacaagtaaagtaagtgagaaataaaatgacatggttaaatttaattttattaaattctccatgattagttacactctttgaaattttattggaattttcagagcttaattgctaatttaaataatacaaacatcatttaacaattatttaattggaaaaaggaatcaaaatcctcccttttaggtttgggccgaatatagaaaagtttatattccttcccttttatctattctaagagcacccgcaatggtaaagtaaggtgctatctataaaacatgtacatctcagcaatagactagattaataataaacaatctcaatagtatgtctacatgggtatctatagctctctaataaattgcctcgtttttctctataaactatcttcaggttagtagatagctttgctctctctcttcatttaatctcttccaagtagaaaaatatgctta

SEQ ID NO: 59321 - DNA, 882 bp, Oryza sativa
gcggctcccccaccaccggcggcggcgacggcgtcctccctcaccaccgacggcggcgacggcgtcctccctcatcacaggcggtggcggcagcgccctcccctaccaccggcggtcgatctagcgggaggggaggcggcgggcagggacggcgccctcgcctccaccgatccagtgggaggggaggtggcagtggcccgacgtcctggatccaatgggaggggaggggaggcggtggcggcccggtgtctcggcggcggtggcgccctcccctccgccggatccagcgggggaggaggcggcggcggcccggtgtgccagatacggcgggaggggaggggaggcggtggcgacccggcggcggtgtcctccccttcgccggatccagcgggagggaagctggcggcggaccgatgtccatgtgtccctgtgacggcggcgatggcagcattctccccttttcttcttgtgttcttgtgttaatgttgttcttgttcttgtgttattgtagtagtgttttctctatgatttgggtccaatttagattttgatgtggactcgtatttgtgttctgggtttttttttgagggggggggggtggacggatgaaaaagcgcacggacgaggtgacgattgttttaattagttaagatattaaatataattgcatatacgtaagcatgagctaaaagttgtataacaaatccgattcaattagcacgcgcaaaatttgctttgtgcggggaaatctcctactacttgcgatcatcaatcatcacatctcggaattaagaccatcctatttatcaccatacaggtgtaacatttatattgtgttctgactagtggcagccttatatatttattcggtgtaattacaaa

SEQ ID NO: 59322 - DNA, 713 bp, Oryza sativa
gccacggccacggccgccgcgaaggccagcgcggcgcagagcacggtagccaacaccttcgccatcgaagtagggtgggaggactagcaaaagtagaacacgagagcacgagaggagggaaacaggggaacgaggaggaggagatgatgctgtggcggccatgggaggcggatataaatagggtggtggagtggaggtagccgttggggtattcgaacgttcgggaggggaggcagtagagtagcatcgggtgccgcgaagacgcgtggcgacagcattcactggcattgggatgggatgggatgggatgggatgggatgggaggagtggcaggctgttgctggcttgctgctgctgcttctcagcactgggaaaggatgcttctgttttggaccttaccgttgctgttttggccttttgaggaggcactgggctggatgggatggcactgttctggtgtagggctgtcacctatggcccgtggggctggggaggcttgggaccagtggagtggggtccacagggaagtgagtgagaattgtgtgaaccttggagttaatattcctcctggaagaagtgtttgtgttgtggcaataaaattatcattttttttaaaaaaaaagtcacatgatcgagtggactgttgggttcagcctcgttatcaaaaccctcaccaaattagaccctgtttagatgggactggctgcaggaat

SEQ ID NO: 59323 - DNA, 832 bp, Oryza sativa
aaaacctgctttcaaaaaagatgaataaagtgttaactagcacaatctatcctcctacgtagacagtttgccagcagatgcagttggattctaaaacttctgcagtactctgggtgcttctgctggaccttggtgctagcatgcacatgaaatgacacctaatgcaatatttgaatacatgagaaggcaaatgagtgctgccaaagtccatggcaaatgtcacttcttggttgcgtagctggacacttgatccatatataagacaaatacatactcaaacttaaaaagaaaaggttaagcaagagcattgctacattatgataaaggtacacatcagtcacagaaacatcagagctttagggcatcgcatacctgcaaaggaaaaagactctctccaggaatagtctcatcaaatgcctgaaatcatcagagttgtgtcacttattttatattctcaaaggtacaggcaaaataaaatacatagtactattactatattagtgaaagcaataccgttccatcaatatcttcttccctcaaacgcatgacatattcaagaagttttccaccattcatgtgctcagtatcattttccttctgcttctgagccatcctagtcttgagttccttcgcgagatcattttgtgcaccattgtattgaagctcttcaccagtagtggatgttgaagcttcagccccatgatctcctcgcttcttaggtgggaataaatcatcaaaggaggcatctccaggtgtgcctatccttgtttttgttgcatctgttcccctttatctttggatgtaagtgttgctattatcattatgcttctat

SEQ ID NO: 59324 - DNA, 2684 bp, Oryza sativa
ccccctccaactgttttcgctgccaaaggggaacccttcagatttttttgatatcatttttccagtctcaagtaaattagcatgatcatttgctgatttctcatcaccaaacacagatgctttgaataattcccaaaactcttgaggatcaagcccttttagttgtattggactatcaattgttttaaccatttctaccactgctagaaaatgagtggtgactagaattatgtttcccttggtttgtccttttttgagagatgctaatagatatttccattcatcctcgtggccacaattccacatatcatccaagacaagtaaaaactttgatcccaagctttgcacaatcaaatcatgcggaccactgtttttctcatctttgagttgagggatcgacttggcaatgtcttctttcaatctatacacattgaaattgggagttacacaaacccagacggtaacatcaaagtagttatgtacttctttgtatatatactgtgcgagagttgtcttccctatcccccctggaccaacaattggaatgatggtcaggtccttgtcacagtaatcaccatgagtaatgtttttaatagttgtattttttttcatccattctcccataaactgtaggatctgtaaactctgaagtggtcataggccgactgatagcaaaaccgcttggaagaacaggtgcatgccctggtttcttggaaaactcggcattgagactcatggcaatgtactggccaatgctgcgatttgattccaacaactctagattgagtatggtagagactttggcacacaatggcttcagctgttcgacaatgcgcttcattctttgggacagatccaccctatcgaacttcagctttggtgttttcatcgtatcctccctctgcaataccctgccgcaggaacaggtgcagcggaggaactggcttcctgcatgtgcacatgacgctagagttagaaaacttgtacagtacaatatcctagcagtatatagaagggcatgttaggaatttggtagaaaattagagatggattttacagcaatttatagtttatatttaatccaattgggaggagtatttagtactggatctcatcgtgcactagggaagaacgttgctagagcgatttgacgagcagcgaggtggctgagcccggccaagaggttggcgttcgcggcggtctggcaggctcgccgtgcgctcgtccttttggccgagcctcacggctcattgctagacacggcgacgagctgatgtatatatggtcaagagcaagggctgtttagcagggtgtgttctttatttcttcactatttttttttcacgaacgcgcaaaaagattgcacgtcaatatattagaaggaaaagagttcttattacacaatgcaatcagctatataggcttatgccaaggggggaagagagaaaaaaacaaaacaaaaactgcagctaggtttactatggcggctaaacgcaactccgatcagcgggaaaggatagagccacactacttatttcttcactataatctggttgtttacccagagagacatatttgccttttttttcaaaaaaaaatgttttaaaaagttttactcattaaatagggaaaaggaatcaatctacaccgttaggtcgtcatactggaagtataaattagaattgaattgtactctagagttatcaccaccgtaccgtcatgttaaggtgcaaaagagaggcatggaaagtgtttaccgatgtgatgggtgttgccgcgagcactgggagagagcttgtgcatgcagcagttgctggcaacagcctcctcgtcggcggcggcgtggagagtgcgcgacggcgacgagccgatctgacggttcatcacttgaccaccaccagcacacgaggagccgatctgacggttcttgtcttctcccgaccgccgaccgtcagcgtcagggtgatcatcaccagcgcacgggaggagcactaggttgctcgcgacgctgagggctgtatggcgagtgttgaggaagaggttgtggacgacgcagcccttggcgtgctcgtcggcggcctcgcaggtgccgtcgagctcgtcctggatgcggaagtagtcgagctcgtcgagcacgtcctcggcgtcgacgcgtcgtgggcgaggccacgcagctccaggagcagctgcctcagcgcggggctgcgggcctccctgccgccggtgccacgggcgttgtcgagcatcccctgcgcgtacagcagctccatcttgacggcgccgacgttggggccgagctccttgctggccacccacgcctccacgaaccctccggacagcgggctcagcgccttgctgaccacccgccgcgccgcgttcacggccaccgactccatcgctcgatctcccccccggcgccggcgattgagcggccggagagcgcagaatgtcactgcttcgatcgtccacgatccccggctgccaccaatctccaagaatgtgcaggaacgaaagagacgacaatgcgcagagaatagtagtggcaaagcacaagcttaagctttcgttttgattccattctgctctgcacctttactctgatgaaagacaagcccccctggcactgcacgggatgccggcatcggcatctgttcgcttcgttcgagatggtccatgtctgggca

SEQ ID NO: 59325 - DNA, 703 bp, Oryza sativa
attcctgcagcccttttccgcaagaaccaagcaaaactgattcacacgaaaattctatacaaaattcatgctttccaaacgggtcgttttgggtggggaatgccatacttgtgttcttcctcgagatcacaaacttgcctaattttgcaatctccatatttccccagcgctatatgggagcaaagcagccaggtacgatttgaaactatgcggccacaggataatccagaaatttacaatgggctaaatttgctaaacataagatcctcagagtgatactaccacacatatcgtcaggctgtgtgttcatttgcagctcatgatctccagtttttcacctcttctcatcccatttgagcaacatggggggaagttgcatgttttcctccctcttttcatagctcgatatggtgagaatgattgggaacatctccttggttgtccaggggcatgtactgggccatgatggcgcggatctctgaatccatgtacctctgtacacaggcacaaccaatgcaaaagaaaaagcgagaatttagatgccaattcagagttatcaacagagttaacctgaacaaagttacccatatcatacccggatcctgtatttgtatactgcgtatcctgcaatgcctgctaccactaggccaaagaagatcacccacaagaagttccatcctacctctgttgctgcatttttgcc

SEQ ID NO: 59326 - DNA, 1113 bp, Oryza sativa
tcctgcagcccagaagtgatgatgggtttgcagaggtcacacttgtggatactgacaacaagactagaaggcatattgttgacctagacaaccaaaaatgctcctgtagggcttggcaaataacagggaagccatgcaggcatgcattggcctggatatgcagcagtggaggaaggatacaagattttgtgagcccatattatagtgtgcaaatgttcaggacagcttatgcaggcagagtaccacctatgactgataggacacagtggccagtagttgatttgggcttcaaggtgcatgtccctaagcagaagagaggtgctgggaggcctagagtacagagaataaggggatttcttgagcctggaagaaagagagtgaaatgcaagagatgtaaaagatttggacattttgagaaaacatgcaagctagctgaacctgtagatgcagatgatatgagcagccactgcaccccccaaaaacggtatattgctgtcattgtgcttccattcttaattagtctttgtgcaagcggtttgtgttctttaactccaacttgataaaaaaaacccaacttgataattattgttagttacactcctgatatattgtgctatgttgtagtcactaagattcaggcttgtatgcttgccatatggtctaaaaattctcacttttttgtaggaagagacaagtgtgcaggcaaggaaatgatccaggagtgtcaacaagtgaagcaagctgctctgcaccaaagaagaaaaaaacacctaggaaaaaaaagacaccaaaaaagaagaagactccccagaagaggaaagacctagcatcctcaagtgcaccaccaactagagtagttaggagcctatctacctatcttctactgtaatgccagctgcctcctctctaagtattttgctaattgccaatggctgtgatgaacttgtaatgcacgtgtgcctgtgaacttgtagtaacctatttgcagtgacaatgtagcctgccccatctcttaagtattttgctagtaaggctgctatgaaccagtaatgttgctcatgtatgtctatactgttgtatgcatatgttgagcctgaaaactgaaattatgga

SEQ ID NO: 59327 - DNA, 1498 bp, Oryza sativa
agaagtctagcacggctaaatttaacttcttccaactgcttcttcatcgctaaacactccagcctacactggttgagtgtctcaattgttgacttcaactcattttcctttgcatcaaggacctcacaaatcttcgctttttcattcttctcatcatctaaatattggcgaagaatgtcgattgtttcttgcatatgatcgtactcgccggcgtgacagtacgcaaccatctcctcagcatactcattcagcaggtcttcccatatccataagaagcaacagccctaagcaaacaactaagaattaagacaccgaaatgaaaccaacgaaactaagcaagttcttaccgaattgccgcattgtagccaccagcgtcgaggattccttggtgtgttcgaaatctgcacagtggcggaggcaccgcaagcacacttcagcgtggggatggaagaaggtgattccatcatcgccttgccgtcgcgccaggaaggaggtgattccatcgtcgccttgccgtcgcgccaggtcgtactcgccgccggtcgcctgcgccgtcgctaggagctccggcgccaccgccttcggccggcgtagcctccgccgccgccctgctccgccgtcgccttcacctgcgccgccgccctgctccgccgccgaagcctgcgccgccgtctgcgacgccgccctccgtcgccgtagcctgcgccgccgccctgctccgccgccttccgccgccatcgattgcgccggcgccatcgcctgcgccgcctccaagaagctagggtttcggtgtggggaacgaatggcgaccgggctgttcgagccggaccggagctggtctaagcacacgtgaacacgagggcataaacgtccatacgaaaatacggtaccctaaaacggtggcaaagcacgcgcagggcgtacattgtggcatggttccaatttgacgaaatagtagtggcatgcacccggattccggaataggtgtgtcatttttttatttgccacaattcgcgtggcatagatccaattaaccctatagagaaagatcctccaatccgtttaattttataacctgctttgtttatacgtgatttggtttgacattcatcgatctttgccaataaacccgtatcatatttgatcacagaaaaaaaaaacttgtcgcgtttggcgattttgacgagctttggtataattttaacatcgtcaccgttgcctgccctccaacctttgcagccacctgacagctcagtatagctttgcatatgaccccacttagctctatgcatgccccatacatggcttggcacatccgtgttattgttgtctcatcttctttttctatatatccagcctagcttgacaagtttttgccttgttctgtcctcgtactctggttttaacagttacaagcctaccgttatactccctccgtctcataatataagggattttgagtttttgcttgtaacgtttatcactcgtcttattcaaa

SEQ ID NO: 59328 - DNA, 2768 bp, Oryza sativa
caacaatcaataataaatctcatgttactgttttgacatcttctttatagcctttatgtacgttatatgcgtccattttctagcacgcacaagttgggagaagaaacttagctaaaattgcgtcagtgccgtaattaatttcttgtatcatcaacaagcaaaattttctccgagatctgaaaatgcacaccgacacactgtacgccccataacagatgccgcacgtgggagctattataccgttgaaattttcaagttaagaaatactagctctgtttcattttaaatgcaactatgtttttccgtacctaattttgatcgtttgtccatcttatttaaaaaaattttgaaaaaaattaaaaacataagtcataagtaaagtactattcatattcatgttttatcatctcataataacaaaaatactaattataaaaaaaattttaaataagacggacgattaaagttggacgcggaagcacttaaatttggacggagggagtaataccgagtctcttttatactaggtactataggagtaccattcaagtgcccatattttagatcaaaggtagcatcctaattggctgtgttttgtgatgtatggttgattgttgagacttgagacttgaggcagtaattttttttagataattaaacttgacgaactttgaagcacaatatgaaggaatttttatttcgataaattttcgttaccgtattcgagcctgttcctattcacttcgttctcatgtttaccaatcactaagtcgcgcgttgcgcaacaatgaatatacactcctaagtgttaacctgtacatattcctaagttgtcttgtaagtgttttatactgttattttagaaaagtagaaattagtggcacatcgttttgttgcccaatattaggatacaaccattcaagtatttgttgttggtgcatatgacacacccttctctcgatcactatattttcactcaacatattgaactttcatcacgatatatatattataagtatttctaaggcattttttatgctaatggaatataaatgataatttagataacataatgttataaaagatgcttttgagctcaactataaacacaacactttagcgattaataaaaaaaatcaagcgtatactccctctagtttttaacggacgacaccgctggcttttgaacatgcttttgactattcatcttatttaaaagccatgtaaatatgaaatatacatataagttattctgaaagtacttctaataataaaataaataataaaaataattatgtaattttggtcaaatatatatttaaaaatcaagagcatcatatattaaaaactgaaacaaaataaagcatatcgaagtccatctaatatgctagtactttgtactattcgtaaatacattttataattttatttgaatttgagttgtgccattcttttttttctatggctgaccatgtgcctggcagctttgagacttcctcgttggaagtctagaagtttcttgagggcagctcctgtgccttgaaattttttttctggttttttaatagaagtatgaatctaatgtttcattttttgcttgctgtctgcatccaacagtgttctttcgtgacctagctcgattgcaagaaactttagttctttaaatactttagattcggaattttcccctgagaatcatgcttattttggcccggaaattccttccgagggcccccacacatagcgtttatctggccttcttttcccatgacaagccaacaaggccaaatacggattccatctccatacgttcatcatgttacgatggaccgaaatccaagcccatttatgtgttaacaaggcccaactatgctaaagttgtttcatatctggcccatcaacacgttgcagttatgggtcgtcattccacagtgggcttgtcacaacaaaactcgtaggaaaaagtccaatttgactcccttaaatataggcaaaatctaattcgtacccctcaactggaaaaccgggtaggacgactcccctaactattgtaaccggtgcaattggactccctcggcggtttcggagggcggttttgctgacgtggcaatgttgacccggttttcgtcccacgtggcgcttacatggcattagaattaaaaaaatatctgtgggtcccatctgtcattaaaaaaattatattgtgggacccactgacatgtggggcccacatgtcatcctctcttctctacctttttcatcctccccctctctttctcttcacgagagtgggacgagggccagcggcagcagcggtgaaggacgggcgggcgagggccggagcaggggccaaatcgtcggcggcggcggcggacgggggccggagcggcggtggccggcgcacccacggcgctctggagcgcgtaccgaagcgacgcctccacgacatcatctcccttcccgtcaatctggaccacgccaagccaagccactgcgtcgtcgactttgcatcgtcctcctctccgtttccccacaaaaatcccggagaatggcgcaccgaggagggagatcgacttcgtcttctccaactccggccgctggcgtaaatcttcgattcccgccgctccggtgagtctcgcgtcgattccttgcgcatgaaccaccctagggacctcactaataacatcagagcacatgcatgtttattacatcggtggatcaagccgtcgccgttcaccccggaggttcttgccgccgcccagcacgat

SEQ ID NO: 59329 - DNA, 3805 bp, Oryza sativa
ttcatcttatgcttccaagcggcatagtccgtaccattgaaatacggagctttgccgctataggtactcacataaaatgtagatgtagttggatagtcataaggaaacataactcccttatcaccatctttgccttcccccgtttggcccgacatgatctctccaagtggttaagcctaattaggagattaggctctgataccaattgaaagggtcaattaggcctagaggggggtgaataggctaatttaaaactttatgcggaagctaaaactgagttagggtcggaaagtctgatccacagtcagactatccgaaaatatcagatagtctgatgttggatcagactgtctgatccactaaaggaacactacaagtagatctagtgcacaaacaagagtatggcacaaacagcgactagatctaaagcggcacaaaagcaaagctaaataataggagaagagatatcaccaacaatgaagttcaccgagttgttcccggagttcaaatccttgaggggattctactctacgttgaggagctcactaagagccgggtctttgctaaccctttcctcaagaggttgcactaagcactcctctttccactaaggggtatctctttccttgtggaggcgagatccggccttcacaaacttctcccggccaaccacacgtagatcggtggctcgggagtgacacctagccgtttaggagtcctcaacctccaagagtaacaaacaccacacaactcttggtcaaaccctagtgctcaagatcgagtgaaacacacactaggccctcaaacaccaaatccacaaccaccaagatctactacacaaagaacaaagagggatttgagagagggagagagagctcaaagatccaaaacactttagcaccaagctcaacccaaagtgaatgtgaatgaatgagttgggtaaccctagaaaagggttaggtggggggtatttatagaagcccctaaaatgtggccgttgggagagaatcttttcatcccacctcggaaagtccgaggtgacatcggatagtccgatgtttttgacccccaagcaggccagagacagagaacgaaattctggaggatttcggacaatccgatcgatcggaaagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcaattcaaaatagagaatgaagttctgagaaatttcagatagtccgacgtatcggatagtccgaccttatatcggatagtccgatattttttagccaacactcagaccgaagacagtgagcaaagttctgtgaaatttcggatagtctgagcatcggatagtctgatcaacatccgatagtccgacagacataaaacaggaacacttcaaataaatgattttgagcactagtgttctaccaattatatgcatgtggcatccctcttaatagtacggcatcctaatactcaagaacacaagatatacatggattagaagacaattaccacaaaagatgccgcaatacttattgtgttgacatccactcctttttcatccttgcatacatctcaacaaaaagcattagttaccctctaattgtgttgtcattaacaccaaaataaatgaggggtcctagatgcactttcagtcgccccctttttggtgattaatgacaactcccgagaagtaataaaagattaggattttggtggagctccccctaaatatatgctagaaatgaaataggagagctccccctcaatctatcactagattagaaatgacaatataacctcatgcatatgccaatgacaagatatttcacacatttgagcatggataatagataattgcacataacaagacacaaaaacccaagggtcgactagccatcacgaaaggagatagattagagatttttgatgataggtggttctccccctttggcaacaaggcaccaaaagggaaaaaatagaggatcactcatccttatcagaatcctcgccctcctcacttgactcctcagcatagtcaccttcctcctcctcttcttcttcctccataggagccttgccatgatccgcacgagaggagcttgcctcagctgcaaaagggtcctcaatcacatcctccccactgtcctcaacctcagaaccatcgggagaacacggcaaatgggtgttgcgaaggagggtcttgatccgtcgagtgtccttcttccttgctctgcgttccttggcttgccgaactgagatggtcttgcataagttgaagatggacttgaagaacctcaaggacgagttggagtccggcttggtgacggtagcggagggaccggcacgagaagaagcacgagtggttcgtccagccggcacagcagcaaccttgatgggacggacttggtaatcggtatgtgccacctccttgtgaaacttcttcttggacacaatctcaatcatcttcataatgtaaggcccatagccaagtcctcgcttaggcatcatggagataagccggatttcttcaaagatgaagtcaaaggcgtcaaagagctgtgggtgagccttcatcttgtaaagcaaatttcttgtataggcaaggacgttgctagcatcaccttccttgggattgagagttttgcgcaagagcttgttgagataggcatagaagggaaggagacctttgatggtgcctaactcatagtccacatcttggtacaagaagtgaagagaatttgtgtccatgggcttctcatcatgaatcttgacacgattggtgcgagagcgagtcggaaaccccaaaatggcagcaaacttagcatatgtcacggagtatatgatgccatctgtcatccaatgaataatcttttctttgttgggctcaaaataaagtgtggcatagaattgtgcgaagatttctttgcaccatgggtattgcaagcccatgagttccttcaagttttgccgagcacaagcttcaatgacttcatcaataattgaatcatgcaactcctccatatacttccaatcaacccactgcataagaataggccccttcttaggtgcattcactgtctcatagtaatcctgctgaaaaaggttccaaaaccgaggatcagtggacaactgttgaaatttgtagagatctttcttacgctctttctccacttcagtccacttgcggttccaccttatgactctccgatgataattaggatctctagagggagcagtgataaagaaaggcccttcttcctgagcggcttgctgagcggcaatgtcctcttctaaatgaatctcttcctcaaaggatggtgcatgagaaccactaccttgacccggctcagaagaatccgtaggattgcctctccttacttttttagcaggtgcacttgatctttctccactgactcggctgcggcgaggaggaagaggagcaccatgctccacattagccacttgagctgcttggtcagaggcttgagcttgcgcgtcaatggcatctttgcgagattcggacatacgccgtatagcatgacgagccttggaagcgggagagcgacctcgagaactcattgtcccacggcgagagtaaacttgattcttgaactgacccgtgatcatgaggatacactgatttagaacagaggataatgattaagaagaagtggaagaagaatatttaaatgtgaagca

SEQ ID NO: 59330 - DNA, 1226 bp, Oryza sativa
ctatatgcttggttcgggaatgttggatggggttattggctaacttaatggcgctctcattgtcacataagagtgggattttggacacatttaggccatagtctctcaaggtttgcttcatccaaagaagttgagcacaacaactccccgtcgaaacgtattccgcttcggcggtggatggggcgacggagttttgcttcttggaagaccaagaaacaagggacctacccaagaattggcaagtacccgatgtgcttttcctatccactttgcacccggcataatccgcatcggcataaccaatgagatcaaacctcgctcccttaggataccaaagaccaagattaggtgtgtgcactaaatatctaagaattctcttcacggccacaaggtgacactccttcggagcggcttgaaatcttgcacacatgcacacactaagcataatatcgggcttagatgcacaaaggtaaataagtgagccaatgatggaacggtataccttttggtcaacgtctttaccttgctcgttgaggtcgaggtggccatttgatggcatgggagtgtggattggcttcgcattctccattccaaacttcttgagcatgtccttcaaatactttgtttggcaaatgaaggttccttccttgagttgcttgatttgaaggccgaggaagaactttaattcacccatcatggacatctcaaaacgtttggtcatcatcctactaaactcttcactaaaagacttgttagtagaaccaaatataatgtcatcgacatatatttggcacacaaaaatatcattatcatgtcttttagtaaaaagagttgaatcggctttcccgatctcaaagccgtttttcacaagaaaattgtgaagacactcataccaagctctaggggcttgcttaagcccgtagagtgccttgtggagcttgtacacgtggttgggatacttcggatcctcgaagcccggtggttgctccacgtataccaactcgttgatgggcccgttgaggaaggcgcttttaacatccatttgatatagcttaaaattgaggttagtagcaaaagcaagcaatatgcgaattgactcaagtctagctattggcgcaaaagtttcaccaaaatctaatccttcgatttgggtaaacccttgcgccactaacctcgccttgttccttattacgaccccggcctcgtcttgcttattgcggaagatc

SEQ ID NO: 59331 - DNA, 12891 bp, Oryza sativa
gcatcgccatcacccaatccgggatcattaagagcttcttccacccttagaggttcaatagaagacacaaacgagtaatgctcacaaaaatttgcaatacgagaatgagtggatactcccttgttgatgtctcctaagatgttgtcggtggggtgatctcgttggatactttggtggattcttgggtgagctagatttatcggagagggtggcacttgctcgccttcttcaccttgatccaagcttgaagtggagggattgtcggcttgggttaatgtaggtggctctacttgtgttgaggaagaggccccttgttgtggctccctaggacgcacgtctccaagagccaatcttttgattgcttcgctagggtcctcctcttcacctaacacatgtgagtcgacttgctctacttgagagccgttagtttcgtcaaatgtcacatcacgcgcgatctcaacaataccggaggtgttgttgaaaacgcggtatgcgcattcatttgacccatgcccaagcaagaacccctcatcaactttaggagcaaactttgaggatctagccttcttattaagaatgtagcacttactaccgaaaacacgaaagtaagagacatttggtttgttaccggtaagaagctcatagggagtcttcttaagaaggcggtgaagatagaggcggttgatggcgtggcatgcggtgttgacggcttcggcccaaaaacagtccgatgtcttgtactcatccaacatggtcctcgccatctcgatgagagtcctattcttcctctcggctactccattttgttgaggtgaatatggagccaagaactcgtgcttgatgccttcttcatcaaggaaactctcgatgcacgtgttcttgaactccttgccgttgtcggttcgaatgttcttgatcttgaggtcgaactcgttttgggctcttcttgcaaacttcttgaagattgcttgtgtctcactcttgtcatgcaagaagaacacccacgtgaagtcatcaacaataacgagaccatatttgttacctccaatgcttagataagcaattggccctgtcggtgacatgggaccgggggtatcgtgactagaggcttgggtagccgcggtcgcccacgtggcctgaccccctcggggggggggggtcgggcccgagggtgacgcggccacccctccctctgtctccccgaggggtcgggccgcacccgtttcggccccgagggctggggcgccccgaccccctgtggttttggcaccatgtgtgtgggttaggtgagcacagcaggcgctcacctaaccgcatttatagcgggttagacgagcgcgccacgctgcattcaatgcggcgcagcgcatgcttatccggtccgtgaccagtcgcggtgtgtgaccggtcaaagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagacttcagcgcaagaatggcaaggaagtcgccggccattaaatgaagtttgaaatgggcgtcctccggaaaagctgacgagcggggcaggagacgagcgcactgcttgtcaagggtcacttccggctgtagactagccctcattgtaaaaagcatgtttcctttcttaggcagctagaggcccctgtggtgaccgctgaccagataaaaaggaggcccaggcctagaagaagggggattttcttgggggatttttgaggaggagcctgaactctctctggctctcgagctctctgtattccttcacatacagatccaccagaacacaggagtagggtattacgcttctcagcagcccgaacatgtctacgtcgcccgcgtcttgtgcgatccttctcgctgacattcctctgatcgagggcgaagaacctcacatagcgccctcggccgaaccggcaaaggggggcctgcgcggtcttccggtgaggggccccacgctccgtcatctggcgcgccaggtagggggcgcgcgtgtttttcgaagccctcgtcctctttcgtgtgcgccaagcttctcccgctcagcccaatggccgaacgggcagtggcgcacagcctctctccgaacgctagcggtgacgacggggagcagaacccgcgccgtcgggctcgcaccccaccgtccccctctcgccgaaatcttgggcggggggaggcgctcggggaggtcggaggatccgcgacatcgccgcccgcgggcgacgggggaggacggcgagacggggcgcgtcgccgcctcgactacggcgatggcagcacgccccagggcgcgctccaggctgcgggtgcgctcttgcgtcacccgcccgtcgtccccgatccagagactccagcccgacgttggctggatgacgtggccgacttggtcatgacggcgcagcagcgcctaggcgccggtgggcggccctccgcccccgaggcctctggcgctgccgccgccggctccacgtcgtcaaggcggagggcgcggcgagcggcggccgtcacccgccgttcgtccgccattccctcgtcaacgcctccgacccaagaagatgagcgtggggggtcggatgcccggctcgatatcgagcgccagcgcgacgatcgtcgcgccgcccacgcaacggagggcgctttctcgtccggagcgccacttcggtccgggcacgggggccggcccccgtgtccccggttggcggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcctgggaggatttgtgccagcagttcaccacgaactttcagggcacatatccgcgcccaggcgaaaaagcggacttgcatgcggaacagcgagggtacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggctctggcgtggcagctccggccgcccccgagtccgccgctcggtcagggcggcgggacaggaggagaaagaagaagtcggcccgttccgacgacgagggtcatgtactcgccgtcgagggcgcttcgcgggccccccgaaaggggaggcctgcgagcgacaaaaagaaggaggccggcgctcccagcagggagcgcccgaccggcaagtggtgcaccgtgcacaacacctccctccacgacctcgcggactgccgcgcggtcaaaagtttggctgagcggacgaggaagtgggaggaggagaagaggcaggagcgccgtgagggcaaggccccagcggctcccgccggcaaccggcgaggtgaggccaagcagaaggcccccggcgaggatattgacgatggcgactatgacctggggttctaggagcctgaggccaccatcgccaccgtcgatgggggagcgtgcgctcacgcttctcgccgaagcctcaaggccatgaagcgagagcttctggccgcggcccctacccatgaggcgacgcggcgggcgtggtggtcggaggttgccctcaccttcgaccagaccgaccacccgccatgcgttgcccggggaggacagatcgcgatggtggtttcccccaccgtttgcaatgtgaagttggggtgtgtcctcatagacgggggtgcagccctcaacatcctttcccctgcagcctttgacgccatcaaggccccggggatggtgctccggccgtctcagccgatcatcggtgtgacgccggggcacacctggccgctgggtcatatcgacctcccggtcaccttcggtggctccgccaacttccgcatggagcgggtggacttcgatgtggcggacctcagtctgccctacaacgcggtcctggggaggcctgcattggtgaagttcatggcagcggtccactacgcttatctccagatgaagatgccgggccccggtggccccatcaccgtccatggcgacctcaaagtcgcacttgcttgtatggagcagcgcgcgtaccacctcgccgcggcgtccaagcccacgggtggcgacgaaaggctcggcacctccgtccccgccgccccgaggcagcggatggtcacgtgcgacgaggtcccggtcaaggaggttgccctgggcgacggcccgtccaagaccacacgaatcggtggtcttctggacgataaataggaagacgcgctcgtctccttcctgcgggcaaatgccgacgtcttcgcctggagaccggcggacatgcccggggtccccagggaggtgattgagcaccgtctcgccgtgcggccgggcgcaaggccggtccggcagaaagtgtggcggcaggccccggaacgtcaagccttcatccgcgaggaggtggcgcgacttctggaggccggattcatacgtgaggtcatccatccggagtggctggcgaacccggtcgtcgttcccaaggcgaacggcaagcttcggatgtgcatcgactacaccgaccttaacaagaatgcaggtcctacttttcaacgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaagctgaaccccgacaagtgcgtgttcggcgtgcctgcgggcaagcttctcgggttcttggtctctgcccgaggcatcgaggccaaccccgagaagatacgagctatagagcggatgcgcccccccagcaagcttagggatgtgcaatacgtcaccggctacatggctaccctaagtcggttcatatcgaggctgggagagaaggcgctacccctatttaagctcctcaaacgctccgggccgtttacctggacggaggaggctgagcgggccttcactcagttgaaggcgtacctcagttctcccccagtcttggtcgtcccggagccagatgagccgttgctactctacctggcggcaaccccgcatgtggtcagcgcggcgttgatcgtggagcgcgacgaggacaaccctcactccgcgcatccccaccctgtgtcgactcgacccgggagagagcagggaagagaggcccccgagccgaacggcggcccgaggcccccgacggccggagctggccctccgcctgcttgtccgacggtgccaggcgcccccaacccccaggatggccccggggccactgcgggaaggccgcgcctgtcgccctctgaccccgaggtcgtcggcacagaagccgagtgcgccccgcgtggcctctcggacaaagagcgccctcgagatgcggcccctggcgaagaggatcggccccgccgaaaggtgcagcggcccgtctacttcgttagcgaggccctccgggacgccaagacccgataccctcaggcccagaagatgctctacgctattctgatggcttcgaggaagttgcgccattatttccaggcgcattgggtcacggtggttacgtcttaccccctcgggcaaatcttgcataaccgagagggtactggacgggtggtgagatgggcaatcgaactctctgaattcgatttgcgctttgaaccacgccgcgcgatcaagagccaggccctcgccgactttgtggcggagtggaccccagctcccgagcccgtctccgcccccgaggccacctcggactcctcgcagctgcctcacaccgcctactgggtgatgcagttcgacggctccctgtctcttcagggcgccggtgcgggggtcacgttgacctcaccgagcggagacgtcctcagatatctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccggtgctctgacccgcagatggacgcttacgtgcgccaggtgcggcgtatggagcgccatttcgacgggatagagcttcggcacgtgcccagatgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcggagtccaggcctcgggacccgaggggagcgctcccaactcccctagattgattgcttggatcactgagatccaggcatacctcgcagataagactctacccgaataccgcgaagggggtgaacgcgtccggcgcatctccaagcgctacgtgctggtggaagggaccctctatcggcgcgcggctaacgaagtcctcctgaagtgcattcctcgggaacaaggcgtcgagcttctcgccgatgtccatgaaggcgagtgcggagcccactccgcctcacgcaccttggttggcaatgcctttcgccagggtttctattggccgacggctctcaacgatgcggtcgacctggtccggcggtgcagggcgtgccagttccacgccaggcaaacccatcagccggcccaggccctgcagaccatacctctttcatggccgtttgctgtctgggggctcgatatcctgggtccgttcaggagggccccgggcgggttcgagtatctgtatgtcgctgtcgacaagttcactaagtggcccgaggcttatccggtcatcaagatcgataggcactccgtgcttaaattcataaggggcatcactgctcggttcggggtgcctaaccgtatcattacggataacggcacccagttcactagtgagctcttcggtgactactgcgaagacatgggcatcaagctctgcttcgcctcccccgcccaccccagaagcaatggccaagtggagcgcgccaacgcggaaatcctcaagggtctcaaaaccaagaccttcaacatcctcaggaagcacggcgactcgtggatcgagaagctgccagcggtactctgggcgaaccgaaccacgccaagccgagcaaccagggaaacgcctttcttcctcgtctacggcgcggaggcggtcctcccatctaagctcaccctgaggtcccctcgggtatccatgtattgcgaggctgatcaagatcagcttcgccgagacgacctcgactatttggaggagcgaaggcggcgcgcggccctccgagctgcacgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgattggcgtcccccggccgggctccgttcggctggccacgggcgacggcacagagctgcctaacccgtggaacatcgaacaccttcgtcgcttctacccctagggggggtcgggtgtcatgtcttgggctcgggccaaccccgcacccctcttgggcgtgcagggttggccgggggctaccacatgcatatacttaccttttttctcttccgtatttcaataaaagcactttcgattccctgaggactgtgtctgtgccatcgttttccttttgaagaatcttggcttgaattagcacgctcgtgctcgaccctgccctcggtggcccgggccggctaaaatcgccaaacggggcccagaaccgagccgtgccccggggcgtggtgaactccggggggggggggaatcggcaaaggcccacaatcgggtcatccataaccctcggtcaccacgctcccggcctggccagtctcgacacgtggatctcctcaggcactagccccgacccgcgccgcttgaggctggggcctgggcacgagccctcgttcaagccaagacacagaaggaccgcggcacagaccaacctcgtctcatacatacaacaaacagaactgacgtagaaattccctctttatttgattacagattaaatcagtctatacaagaagggggcccgaaggcctcggaaaaagaagaaaaagttattaagattggcgggggcctggggctcactccgacgcgcccgggtcgccggcctcgtcgtcgttgtcgttcgcaccgtcgtcaccgccctcctcgtcggagtcgagggcgaacgcgagccgaggggccgtaccctcgaagctgtggacgatgtggtcggcggcgtcccggacctgcgcgcgcgcgccgtcctcggttccgggagggaacttgtccagcgctgcccacggggagaagtcagggtccctggcctggtagcttgccagtacgagctccaccgccccccgggcaaggtccctcgaggatgacttgatcgtctcttcgagctcctcggggagccgctggagggtcccggccatctctgagaggcgctgggcgacgcccccctggttggcggtgaacttcacggtccgctcgccccagaggcccacctgccgcccggcgcggtctagacgggagacggcgtcccgaagcatgccgggccctacctcgttcgccaagcggagggcctcgacctccccggcggacgagtccagcgcgccctgcatctcggcgatggtgtgttcggcggctgcgaggcgggcgactaggtcgccgtggcccgcggccgccccaccgctgtgcgctctcgcgtccagctccttcgcccgcgcctcgagctcagcagcccgctgatccagcgcggccctctcggcgcgggcgccttccagattgcggcgagcctactcctcccgcgccgcttcgcgaaggaacaggctgtccgccagccgctgcgccgcggcctcggcttcctcgagagctcgcccccgctcggtgagcacgtcctcgcggaggcggagcgcggactcctcttcggcgcaggcggcctcgtgcgccgccagtgttgcctcccgggtggcgacagcggcctcgcggtctgccaggtccttctccttcgtgtccagggcgcgggcgcgctcctccagcgccgtggcgcgagcctcaagggcctcttcgcgctgccgggacgccgcctcgatctccgccgcccgccgttcccgggcagcggcggcgtcaaggactccccgggtggcgtcgagcttcttctctagctccgccgcccggctcccgtattggaggcagaggtcgtcccgcacctcctcaagtacggcggtggcgatgagggcagtctcccgctcctcctccacctccctggcgatctccgccaggtccctacgacgggcctcgagctcggaggcgtgccggcggtgtgccttgcggcccgcctccaccatggcctccaccgagcgtcgcccctcctcgacgcgcgcccacgccgcgtcgagctccgcccgctccgcctgcagggcctccatccgggcgcttaacccgtccagcaccgtgctgttcacggcgactaaggcctgcaggaggggctccgcgctcagtggggcagcggaagacagaggggagagccgcctcggtgtgggtgccgcgcggctcggcccgccgatcgacgtgccggacccgggggcgtcccccgaagctggctcgtcccaagcatcgcccgaggggtcgggcccgagcggcgcgtccgcggcctcgtcgtgggtggcctcggaagtcgtcgtcgcctcgggcggagtcgggtcgggggcttggcaggccgcctggcgtacgcgcgccgcctcctcctcccggacggactccccggcccggcggagtctggcctcctttcgagcggcctcctcagcctggcgaacccggacggcctcctgggcagcctcctcggcttcccggaggcggtctgcggcttctcgccggtcagcttcccgcctccgggcctccgcggtcgccgtctcctcggcctcgagcccgccggacttggaatggcggggggggggcgacgggatctcgctgaggcagaagaaaaaccagaagacggaaagaaacgggtgagtgaaaactcgccttgggagatgggagaatgaatgcggtcgcgatgggcgcggggacaaacctgcggggaggtcggctaaacgaccacctcgggggcgagatgaggttcccccggcatggctcggtcccccccatcttgcggagccgtttcttctttcgctccccctcgggctgcggcgtcggcacagcaccctccgggcgcctgctgctggcacgcaccgccccgcccccttggggaggagatggggggggcgtgccctcctgcttcctctttccccgggcgtcggcagggcggctgccccccgggcccccgtcgcggggcccagaagcgtgaccccctcccggggtagattgtttccctctacggctcccgcccgcgccatcgtggcctcgggggacccgctcccccgacgccccgactgcctgcatgatggtcaggatgttggcgcgatccggatcgctgcagagggggaggacaccttgggggataagggatgcctccacggagctgagattcagcacccgttggaccaccatcctgaagtcctcagggacccagtcccatttgcgcccctggtgggtcctcatgaagtcctcgggcccggtgtactcccaggcaccccgggcgcgccgctggagcggcgcgatccggcgacgaaggtagtcgccgaaaaccatggcccccgtaagcccttgggatcacagacccgccaggcggtcaagaacggcgtcgtagctgtctcccagatctaccgtcgcccgccagctggaggcctgcgccgggggctggctcggaagtcggaggcgcgcttcgtcggcgaggggggtgtagaaccaattgctcttccagtcgtcccacttcttgcggaggacgcagggaatgtagcggtgcagcacctgcccccgcggctggaagtagcagccaccgaccaccgtcggcggcgacaccggctgtacagtgaagaaccaccggaacagccggagagatgggcgcaccccgatgaacatctcgcacaggtgcgcgaagatggccagcgtcattattgcgttgggggtgaggtgcgccatctggagatcataaaactccagaacatccatgaagaaattagagaatggcgggaccagcccggccattgcgaaagagaggaagaagacggaccgccccgggtagtgtggcgccaggcatccctcgcccagctcgaccacctcccggccggtggcagattccggcatgaatcggcgcggcagcccggcctgcctctcgctcacgatgcgggaaggcggcagcacgctaccatcaagcggtgcggagccccgtgccatgacgccggcggaggaggagcttgagagcgagcaagtgcggcgagggtagggcacaggaaacgaagagttagagcgcaagtggcgaaggcaaggggaatagtggcgagaggaaggaaacgaatcccttcctcggcgtctttattcccttgccagcgctatgtccggctcctcgcttcccgtgcccactaccttgccccctcgtttctcgcgcccacgcctccactaaccccactcgcccgtttgcggcgcacgcggcagatgtgcggccgtgacggttgagatggggcagatcgtgcgcgcattaactgcgttcgccaaccgagaagagcgccatcatcatgtctccaggcgaaacgaaccggcttgtcccgattcgcgcgctgctcgagtaatgcagcggtcttgaagagaccgctcattattgtcgatcggttttcccttgccgatgcgcgcgatttacgaccgctgggtttctgcccgcctgtagagaccggccccacctgtcaccaggcctaaggagtggcgtcacgcccgagcgcttccctcgaggggggcgatcgccctggcgtaacgccgggggctactgtcggtgacatgggaccgggggtatcgtgactagaggcttgggtaaccgcggtcgcccacgtggcctgaccccctcggggggggggggggttcgggcccgagggtgacgcggccacccctccctctgtctccccgaggggtcgggccgcacccgtttcggccccgagggctggggcgccccgaccccctgtggttttggcaccatgtgtgtgggttaggtgagcacagcaggcgctcacctaaccgcatttatagcgggttagacgagcgcgccacgctgcattcaatgcggcgcagcgcatgcttatccagtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccagacttcagcggggctgcagga

SEQ ID NO: 59332 - DNA, 954 bp, Oryza sativa
ggagtcatcccttctaaatacggtcacatcaacatcggtaaaaagacaattgtagcccatggaacataattgagaaacggacaagagattatagtttagagattttaccaagagaacgttagaaatggaaagatcattggagattgcaatcttacccaatcccattacttttccctttccatcgtccccaaagactatgttctcttgcgaagtgccatttggatcaagggagcaaaacattgattcttctccggtcatgtgatttgtgcatccactatcaatcacccaacttcttccaccggagagatattcctacaagagatcaatttctagttttaggtacccacacttgcttgggtcctctcaagttagtgacaagtgccttcggcacccaaagaactctcttgatggaaacatttttgcccctcgggcctacatacttagcaacaacacgaccactaacattcttcttaagaacataagatgcatcaaaagaacaatgtgaagcataatcattaggaaggatacttttggccttaacaaaattgctaagaccttggggtctcttgatcatcacactcttgtccacctttccttttggtggaggaacatacccaagaccctcatggttgaagttgtccctttgataggctaggtactcttttagagccttactacccatatggcacttaagtaggccattgtgaaggagtcccataaacttctcattttgcttttgcaaagcactcaaagaaatagagttagtagcacaagcttcaataacaatatctttgcatctcacacatgattcattgcttgggacaattttggaacaagacggctcgctagggagagagacactattctttaaggtttcgaacttctcttcaagagagaggtatgctttgtccaagccatccactctctcttgaagttgagcgttcgccacttcaa

SEQ ID NO: 59333 - DNA, 2123 bp, Oryza sativa
agggaggaagaaaaaagagtaaagtgtattggtggttcttaaatttgttgggttgtgtcatataggtccctaaactctcaaaacacatatccaagtcccagaacctgtcaaagtgtatcatataggtcccaaatcaacacatcccctctaggatcctatgtggcgctgatatgacatgccacatggacgtgacgtgtcattttctttttttttcttattttctttttcttcgttttcttctcattcttcgttttttcctttcttctgctcgagtcacagagaaaggagaagaaagggaaaaaatagaagaaaaaagaaaaaggaaaaattttaaatgggacccatttttcagtcaaaatgatgccacgtcattccgtgtggcatgccacatcaacgccacgtaggatcctgaaggggttgtggcgatttgggatctagatgacacactataaaaaattctgggacttggatatgcattttaagagtttagaacctatatgacacaccgctacaagtttaaggaccacccgtgcactttactcaagaaaaaaggtcttccaggacgaaattacatgccgatcctctaatttgagtctttcgctccagagggacgcatcttcaatacacagcactaataatcgacgcaaagaggggcttcgtgcctgaagacaacccagtggtggtgattccacgggttccaaaagcattgcaagtagaatacccaaaaagtgcttggagggaactcgaatcggtgtgggaagagaagcaagctcagctaacgtcgcgtcattaacctgcatattcagcgtgccccagaaggccacagcaaaggggcactggaagcagaggtgaagagctgtttcatcggcagaattgcaaagatcacaggttggggtcggcactatggttttcctgtgcaagttgcgttttgttgggaggcgatccttagccaaaagccaggcaaaaaagaaagggttcaaaggagcttcggatttatcatcagcaagagcaattaatattcagccatttccatttccaaaccatataaattgaggtagcccttgctagtatcagttgctttgcaaagctgctctgatcagaaatcccaatggcaatggagaagagccctcctccggcgccgcacttcctcttcgtggtgagcgggatacagggccacatcaacccggcgcgccgcctcgccgcgcgcctgatggcgtcggcgccggccgcgcgcgtcaccttctccaccgccgtctccgcgcaccgcctcatgttcccgtccctgccgtccccggccggcgaggacgtcgacgacaccggcgtcgcgtacgtcccgcactccgacggctacgacgacgggtacaagcccggggtgcacgcgagggacgactacatggcgcgcacccgcgccgcgggcaccgagtcgctctccgccatcgtcgcggctctcgcggcgagggggcgcccggtgacgtgcatcgtgtacacgttcctcgtggtttgggcccccgccgtggcgcgcgcgctggggatcccctcggcgatctactggatccagccggcggcggcgttcgccgtgtactaccactacttccatggccatggcgaggccctcgcctcctgcgcgaacgaccctgcccgcggcgccgtcgtgcgcctccccgggatgccgttcctcaggtccgacgagctcccctccgccgtgtccatcgtctcgccggagcacaagcactacctgctgctcgccatgctgcgcgacctgttcgaggatctcgacgagctcaagcccagggtgctggtgaacacgttcgacgcgctggagcccgacgcgctccgcgccgtgcccgatctggaggtcgtcgccgtcgggccggtggtgcccgacggcgaagcgtctctgtcgagctcgagcacggacatgttccggcgagacgacgcgagcgcgtgcgtggattggctggacacgaagccggcgcgctccgtggtgtacgtctcgttcgggaccctcctgtcgatgagcaagcggcaggaggaggagatgaggcgcggccttgaggccaccggccggccgtacctgtgggtggcgcgccagggcgccgtcgatggcggcgcgaccttggaca

SEQ ID NO: 59334 - DNA, 2798 bp, Oryza sativa
attaaattttagatgttgccatatcatctacaaacagttcaataaagggagcaaaatttccctcttcgatctatccatgtggccatgtgcaacctccagattacgaggccttcacagtgcaagcacccaccaggatgacacataggataaaaagctacaaggaaactttctctacagggcaagcaccggtgtgggacccacagatactacttcaccgaatcccccacctccctcagtcaccacgcccctcaccctcttccaactccaccggctgtcccctcctctcctcgacgacactgcatttcccctctccccgccggcggcttctcctttctccccgccggtggcctctcctctcccctctccccgccggcggcttctcccttctccccgccggtggcctctcctctcccctctcctcacggcggcggcagcgaagtaggctggggacgcggcgaaggaggttggggacgcggcggtggatccagaaggctgagacgatggtgcttgcggccagcggttcctcccacgccgtcgcacctcctcgcctcccatgctgcggcggcacgtcggggatgccgccgtcgtgcgcctcgcctcgccgtcgaccgcgccgcccgatttgttgccgcttttgttgccgcgatttgtgtagattagttgccggcgcaagggcacgggaggcgcgagggcacgagctccacagtgcggaaaagcagccgctaccgggcctcgcgagagaaggtaccgcgtgcctcagtttgggtgcgaggtgctcaccatgggcgcacgccctagctccacgcaagcccaattcctacgtggctgcccatagcaccggtccagcatggagcactgtgagaggcctttaagccgccaatttgaatattcctttcatcccttgtctcaaatctgagggcagtaccagtgcaagcaacgcataacgtggctttagctcatccgtacagtgaaatcagtccaaagtcatctgtacagcaacgcataagccatgcagtccacaacgctcgtgatctctttttgatggctagaatatctgccgcacgcgaggcgaaggaaacatatgcgggggcacgctctcagtaacgcggacgcgtgagacgtctcctgcgccgcgcgtccttgcctgcaggcgaaggaactcgcttcccaactaaggcccgagcatctgagcagaggcacgcgttttgtcaacgtgtagatgattatccgagctggaaatctgaaggaactggccacgtcctcccactgtgaagggcctgacattgttttattgtcacaagtgagtatcgctcgaaagccactgtgcagatggattttgataaaatatcactttttaacgtgtggctagacgttataatactactccatttagaactgtatggtgacgacgaactcatcctcgtggcctgccacggtgacggttgcgggcctttcgtcgtcgcatcccacgtatatatatcacgggtgcctgctccatcctcctgttgcgggcgcccacgcggtcgctgcctgtccccacgcggtcatggcgcaacacggctcccacctcctcaccgacagctagtccagccacgtctacaccatcgcgctcctgtcccgtggcgacatctcacttcttgttataaaatcagccccgaaatcgacattggtagctaaacgcggaagaaaatactataggagattcaaaacgatgacgacaccgagacacgatatttggtaacggagttcagccgtagcctacatctccggagcactgattacgggcgctcctccccgatccagcatatacagcgtatcatagttacaatgactcacggccggtcgatgccggcagccgctccctctcgctatactaagtctccatgcggttacaataggcacgcccctctatttatgagggatcctaggatagagtccgactcatactctagtcctaatatcttttacaactccaagtcctaaactttaaccgactacgtacacatattcgacgcaaactctaacaaactctaccttggcgaatatgccacaccaacttgaatctgttacttgctcgaacctccgtgtaccaggacttgagttggttctgccgcagctcacaccgagccgctcgactagcctacgccaggcttgccgccttcaggatcgtgcacaacaacaccagcatacccatcttccatgactccacctgcaacagcactcccttgtaacttgtacaaacatgaacttgtcctctcaccagtcataacagtcttgccgtccttcatgatattcatggtcttcctattagaatccacctgatacaaccaacccgtctcatgtaggctcccaagcgaaatcaaactcttccttagtcccggcacgtgtctcacatttgaaagtagcacctcgtttccatcatacatcttgaacttgacatcgcccactccaacaacacgataactcgtgtcatcgcctaagtaaacaacaccaaaatcaccagatttgtatgaagagaaccactcccgcttcgatgtcacatgataggaactagctaagtccaacatccacgcttctccagacttctcgttagacactgtgagaatctcatgactgctgctatctgaatcatcaccacgagctgctaaacttgcaatgccacctttcctcttcttcagtaacaggcaattcctccttatatgtccaaactcatgacacttatagcaccgtgccctcttctccttgctctttgacacccccgcttcatgatcatgctttgccctgaccagcaaactctc

SEQ ID NO: 59335 - DNA, 3255 bp, Oryza sativa
  unsure (1)..(3255): unsure at all n locations
agcgtattgttgcagctgcctgcgccttcatctcctcccacttgccagcatccatcttttccggcatcgtctcctcaagagccttggatatcccctgttgagccaacagatccttcagcctcatctgccagagaacgaaattcccggtgccatcgaacttcaccacctcaaatctggaaaccaccgtcgccgccatcaacgataatcaactcaacagctgttgccctgttaaattgatctgccctgattaattgatcccaccgactaactcgaatagtaccagctggaccgaaccagttttttttctctctccaaaaaaccggaccggtttcttttacttggtcaaccaccagtcaaagaaaaacagatcgaccctgttccccttcttcctttggcttcctcgctcctcctagaaaccgtgcccacgccactttttcccgatgcgccgccgcctcctgctcctcacgccgtcggccctgcaagaagcactgcgccgcccgcctcagaaaccgcctggggcgccgccgcctcccgccgccgtcacttgcgccgaccctgcgaggagccgccgcgtcgcctgccttgggaagccgccggcctaccacctaggagcgcccgccaccgaagtccggcgccggttcctcgccgggaaccgccgccgccgccgccgcaagctcctgcccgagctgcgacgaacgccgccgagtaccacgccgccgtgcgccgcctgcaatgatgcgtctccagccgcccgtgacctcgccgcccaaaccacctttgcctctgcgaaaatcgggtacgaatctcgccctctgctagatgatttgtttcgactgcgttgttacaatcccgtggtccctttgctgcttttattggggaaaaacgtgtccgatttccagtctaaatcgaatccgtatccaactccctcctgtgtcgaacgcggtatccatccagcttgtcttcggtcgtgtccatgccgtgaccgacacatagataactccatggccgagtcttcctctacatcacgaatccgacaaccaccgaaccttgcacgtcctggctcagcccgctccttctcggcatcaccctgatctccgccgccagctcggcttcgacgcaaaacgcgcacaccgccgcgaccctgacctcctgggcttcttcgtatctccagcggaacctagcaccactgccaaacaccacttgccgactacaccaatgactagtgccactgatctgttgtcatcgtgattttcttgatctgtgctagaaacagtagaaccagacctctctagggttggaactagcacatatgctagtctagacgccctacgcttagttctgccatccaccgctaatacgccgcttttgaagcaattccagtgtggaaatacctgtcaacacctccaaaacagcctataggatccacccgctccgacatccgattgaacgccatcaatctagtcgcgagccgaagccgacaagtcgcatgccgtcttcccagccgccgaacgacccgagcgntacgtctagccatctccctgtcgaacgcaactcttcgaaaggcccgggccaccccgcccagagtgttcgaatccaccgatcgagaacgccgatcgcctccagcttcaatcaacccgagcgtgcggccgcacgtctccctgtcgagagtagctcaccggaaagtccgagccacccgcccgaagtgtccgacccatcgattggatcgccaatcgcttctgccgccatcaacccgagcaccacgtctagtcatctccttgttgaaggcagccatcgacggttccggccgccgccagaagtgttcgatccaccgatcaagactccgttgatcgccgccgtgctccaccttgcgccaatgcccctccctgggcattacagcaggctacgcggtgtggagcacctccatcgcgcctctaccatggacctcccgcaggctctgataccacttgttataaaaccagccccgaaatcgacatcggtagctaaacgcgaagaaaatgccataggagatccaaaacgatgacgacaccgagacacgatatttggtaacggagttcagccgtggcctacatcttcggggcactgattacgggcgctcctccccgatccagcatatacagcgtatcagagttacaacgacttacggccggtcgatgccgacaaccgctccctctctttatgctaagtcaccatgcggttataacaggcacgctcctctatctatgagggatcctaggatagagtccgactcatactctagtcctaataccttttacaactccaagtcctaaactgtaaccgactacgtacacatattcgatataaactctaacacttcttccgcgcccacaagcagcaggagaggcacgtggcggcacaccaccgtcgtggttggggagcatgagcaacagcaggatggagggatgagcagacaacggtggcctctttcgactcccacatcgccgcgacattcttgagccttggcgcggcagtcaggctcctccaactccgacacagcgaccggcatgccccaagtccccaactccgaggcaacttaaaggaggaaggtgaggaggcgggacggtcagtggcttgccgatggtatttatagagggaaatatgacattggagttgggagagaagatggggaaggaggctaaagcaatttgatcatgtatagtattctagcttgtagctatgagtaacgagttaagagtggtatttttttaatgatcatttataatacttttctttgtttttcatttataaaatttgaggtaccaaatacacttgaatattacgtttttcctatgctgtgtttcaaaaaatcataagctccaaactaactcttatactactattaattatacacttgctaggccggcaacacgataccgatgtttatagtgataagctaggccatgagctgaactgaaaacgacctatatcgatctgtggatacaggatagaaacagtaggaaagagtcaggccggtcaggtagataatcacagctatatatatgccggcctgcggctcatgttaaaatcttatctcgacggcattgcctccaagcaattaagttcatctgcaggagacagcgatctccggccgtcgcctagtaagccaggtagaaaaaaattcactacttcaaattcactacttcattcaggagttaagaaaaaatgttactccagctaggatctgcattaggttacttctccctctctctccgaaat

SEQ ID NO: 59336 - DNA, 824 bp, Oryza sativa
ctttcaggatcttaccttgggatgacagggaaaaggatatcatcacctgctgatgcccttttctttggtcttggaactcattatgtaccttcagcgaacctgggacctctcagggaatccctcttgagtgctaacttgtatgttccgaactgttatttggtaaaaacttactaaatgctagcaagatcattatgttcttttaattactactagctgaatgcccctgctttgctactgaaaataaataaaaacatattttccatgatatgtgttacccatcctttttctatagggaacatccatcttaatttgattttatatgtggctatccatttagattcaaggggcaatttgcaaaatttacaatgggagtaggtgggatgtcagattcactgcctccaccattccattcttttaaagaagtataaattccataatttttcattaatagaataatagtgacacattcaaaactcggttataattctgtttgatagtgtcttgacatctgatatcgtgttttttatttttgcagcacagatgatcctcacagagatgttgagtcattgctgacaaagttcaagaacgagccagagtcagggccccagctagataagtttttaccatatatcatttcttcctttggtcctgacaaatcagttgctgaatctgtggaagagcttaagaagtgtagtcaaagtgatgatgctgcaggtactctgcttttaagctaaggcgtcaagagaatgttgttatatttatgcacaagtgccaacagtgtttctatattgagaccgttttataaattcagtttagtactgact

SEQ ID NO: 59337 - DNA, 783 bp, Oryza sativa
attcctgcagcccaactcagaagtcacgagttgctcaagctcggctcggcttgataagtattcaaatcgacccgagcttctctcaaagctcatcagctcgatctaacgagccggctcgaaccatttgacggtggttcaaacttcaaacttttcaataggcgtgtgcttgcacattctttttcgctgtccattccaattatttctcccacactcaagtttcaaaatatcaccaccagacatcaatacttgagagttgagaccttagcctacaaacccaaccacttctaagcttcttttccatccctttatgcccagacctaaatcaatttctctcgtcggtctcctagatccccaatcctaggctgctcctctgccctagatctagttgagtcctatatttttcaagtcctaagtgacctagataaacgtggagaggctgtgttgctatattgtaaaatcaacttctttataagagcatgcctagttctgttagcaacaaaaaataatcttacacacaattaacccattgaatcgtgcttttcatttcatatcttcttattttccctagttttaactctagtttgtccgtctccactagtttgcgctataaaccgtccattcttgccgtgaaaatgtgaatccctttgtaggttaggtttgccgtgaaaatagtatatactacctccgttttttaatagatgacgccgttgactttttctcacatgtttaaccattcgtcttattcaaaaaatttacgtaattataatttattttattatgagt

SEQ ID NO: 59338 - DNA, 938 bp, Oryza sativa
attcctgcagccctgccttgacagccgtgcaggtctcctcctctattgtgcacgtttctttcgcgagatagctagagagagaagttgcggccgaaaagggaaaagaaaatggccggagaggacagagacaggtctagaacaacctttaaacttatcaaaatgaccttaccaccgtcaccgtcaccgggtgttgagctcgctagttggagctgtctagttccttttacgcggatctggaagtatacgacgcatatctagtatttaaacggtggcgatactgatgcaacacctacacagtggtgctcaatgattggatgaggcaacgccaacaacaatgatgcgtggaaggtcggagacggtggccctcgcctatgttcaaccttctcattgaccgcgcggtgcactaggcgagacccagcatcaactccaccaatcgccttcaactgccattgccattgtcgctgggttttaggtaggagataagcaccatggggaggggagaggagaacgatggcggtggaaagggaataggataggtgccagtcggagcccaaaggggatggggggacgggggaggggggaaggggcacgggagagctaataacctagagatggggtgctatgtgcaagcgtgctatattcaagcgcatgccccctattgcttgcctagctgcttaccaatagtacaagcgtgctacatgttagcttatgataagtgttgactgtcaaaagcctagagacaaggacaccgaccctttataattgactaaatggtaagatttgtttgaattaaagaccgtgttttttcatcccatcccagggcaccaaaacctaatggttgttctatactcaacttgtccaaacattcagcacatgtctctcctcacattacattagtgcttgagttgtttaactaggcaagaagcttaatagccgag

SEQ ID NO: 59339 - DNA, 705 bp, Oryza sativa
attcctgcagccctactattgtctacatttatatatatattaaaataaatctagatattttctagcattatccacattcatatatatgttaatgaatcatatatatctgcctagattcattaacatctatataaatatgagcaatgctagaaagtcttgtaacctaaaacggaggtagtacaagatatagttagaaaggtatacttcaataaacccttctcttttctctacctgcgtaagcaactagccaactacacgtaaaacacaatgtatcaagagaaaactcaaggaaaatcaatagaaataatttcaattctaggaaaaatctaataaaaaataacaacaaactacccctatagccagaaaattcctacatattccattgcccctaaaaacaaacaatcaagcgtaggaaaaagcacgcaaagtccttcaatatgactagctaactcaaatcaatgagcaaaactagcctgagaaatcaccttaaaaaatgcttaaaaaccacacggaaaactaataaaaagctcgccaatccgatttgccaccacctcgaaaaagcctcaagaatggcccctgcgatttctccacctcaagttgagttggttttccacaacagcacaagtcgctgttgaccacacggaccgatgaccacatggtgctcaccgctgatgagccatgatggtgagaggggggaaggggggg

SEQ ID NO: 59340 - DNA, 8082 bp, Oryza sativa
attcctgcagccccaattagatatctgggttgtgcagaacaaacatgctacgagcctacgaacgattggatatatgggtggtaatttctcccgtggggttggggttggggacccggtgagtacccgcccctacagggacgggtgggaattctaacccgcaggggaagcgggtgggggccctggtcatttctgggtgcgagggcagggatggtatattacccacgggaccccaaagtagaaagtacaccagagaaagcccatgttcccttacccaacaggtagttcagttcggtggtaataatttggcccaacaatatagcaaaagcccataaaaaatgagagcccagttggcagctactccctccgtccaataatataagggattttgagtttttacttgtagtgtttgaccactcgtcttattaaaaaaaattatgcaaatataaaaaacgaaaagttgtgcgtaaagtactttagataataaagtactccctccgtccaaaaaaagacaaaccctagtttccgtgcccaacgtttaaccgtccgttttatttgaaaaaattatgaaaaaaattaaaaagacaagtcacgtataaaatattaatcatgttttatcatctaacaacaataaaaatacgaattataaaaaaatttcatataagacggacagtcaaagttggatacgaaaatccagggtttaccttttttttgggacggagggagtaagtcacaaaaaagtaaataataattccaaatttttttgaataagacgagtagtcaaaccgtgcaagcaaaaactcaaaatcccttatatcataggacggagggagtagttcagtagaggttgtacatacaagtgaacaaacagccaaaccaacaagggaagaccctaggatccccaaatcgttttcaaattaaaatacatcttataacgttttcaaattatgtcgttttcaaatgacacttctggcaccctccacgaaggccgtcagattacgatccgacgaccctcctttccctagagcctccgccaccgctcgcttccacgccgccgccgagcgccgcacctccgccgcctccccgtctcccatcacctcctcgacccgccgcctcagctccgccgcgcgcagcacgccgtcgccgccgtccacctccgcgcgcacgccgacgcgccagtcgcgctcgacgagccgcgcgttcatctgctggtccgacatccgcgggacgcccaccatgggcacgcccgacgcgatgctctccagcaccgagttccagccgcagtgcgtgacgaagcaccccaccgccgcgtgcgacagcacgcgcacctggtcgcaccactccaccaccacgccgttcctgcgcgccgccgccgccgccgtcgcgtcgcccgtctccgccacggcggccttgttgtccttccgcaccacgcagaggtacggcctcccgctctcctcgaggccatggagcagctcgtcgacctgccccttcgccatgacggttaagctcccgaacgcgacgtacaccaccgagccggccggcttggtgtcgagccactccatgtacttggcgtcgttctgcttgaacagcgcggcgtcgtcgccggacgggagcaccgggccgatggggagcacgtcgtacgccccaacggcggcgagcgtgtccgcctcgagttcttggaacacgttgacgagcacggtggccttgggtgtctccctgtcgagggcgtcgaacaggtcgcggaacgtggtgaagatgctgtggaagtagtcggaggggtcggtggcttcggtgaggaaggacgggaggtccccggccgccatcggcggaaggcccgggaactccaggacgaacgaatggtcgcggcggtgctcgtcgacgacgccgccgaggccgtggaagtagtggcagtagatggccagcacggcgacgggctggatccagtagagcgcggacggcacgccgcggtcgcgcgcgacgtcggccgcccacggcaggaggagcgtgtagacgacgctcgacacggggcgcccccgcgccgcgagcgcgtcgaccatctccccgacgctgcgccggcccgaggcgtggaacgacgccatgtacgcgccgagctccgcggcgtcgccgcgcttgacgaacccgttctcggtgccgtcggagaacgggaggagctcgagcctgccgtcgccgtcgccgccctccccctcggcgaacatgcggcggtgcgcggcggcggcggtggagaaggtgacgagcgcgtcgggggcggcggcgagcaggcgcctggcgaggcggagcgccggcgcgatgtggccctggagcgggaacgtgagcacgaggaagtgcggcctcggcgtcggcgacatggctccacaggtcacgagtcaccgacgtgtggctctcggttagctagctgtagtgagagctctagctcagctcagctatggcgcataggcaaaatgggtggcaattggccagctattttttatctgttagtggtgtggcgtttcgtgtggcgagcgagaggagtgcacaagagttcgagatggcagtgtcgcatccacgaactcaaccagcgttgcttttagttacctttaaacttttaaaaattccaccacattaaatgtttgggcatatatatatatatagagcattaaatatagacgaaaaaaaccaattacacagtttgcatgtaaattgtgagacgaatcttttaagcataattgcgtcatgatttgataatgtggtgctatggtaaacatttgccaataatgaattaattaggcttaataaattcgtctcgcagtttaccgtcggaatatgtaatttgttttattattagtctatgttttatactttaaatgtgtgcccgtgtactttaaaatttttacacctaaacaactaaacacggtccagattagttggcgtcatcactgagcttaagttggattagaaaaaagacgagtaagactgttcttcctgaccttacccagtgtcgatcagattcggtcgagatcttgtcgtctgtttgccagttccgtcgtggagtttgagtccagcgacatatgtcccccccgcttggtcattgtctagactgaaaattttgtagttagtctcgtactccctccataaaaaaaaacaagtctaatagggttctcttttagcacaacgaatctggacaaatcttttttaggttgggtatttttaagacaaccttaaaggatccctttctagtacaacgaatctaaacaaactctttctaggttggttttttttggacggagggagtatgctccaatggcttgctcccgggctaatgtactattatttggtgtttggacacgcatatgcatctcttccatagttggaaaggaaaatttctatctattgaaggagggctcacactaattaacttagtgtttattcacgtcttaaaacaagacccaatctaattgggggatgtgacacgaccaacttggtataatggatttagatataaaggtatccagatttgttatactatattctttcttttgtttcataatgtaagtcattctagtatttcccatatttgtattcatgtatatgaatatatatatatatatatatatatatatatatatatatatatatatatatatatatatatatatatatattcattaacataaatatgaatgtgggaaatactagaatgacttacattgtgaaacggatggagtatgtcacatcccatttagattgagtttttttttcatgaatgaagtacttcacagtagcgagaggaatttttttaaaaaaaatctactatttttgctctggtttttgttgttagagtgatggtaaaaaaaaaagccaagtgagacatactatgccgccttaaagataaggtggtttagaaattcagtattactcagtaagtggctatttcagttgcttactgtagatgatgtttggaaacagctaatacaaaataagtatttgagttcacagccgctcacgcaagttcagtagaaggccggagacagcctaatgaagatgaaatgagatctcttttgtcttggatcctacataattaagaatggttactaaattaaattagattatggaaagacaaatgattgggagatgtaaccctacgagaacagtacactttcctctacagtgttgttaggtataaataggtaactattgcagatgttttagagaacagatctaactagatcaaaattactggcatggaataatttattatcacacatcactaatattgatttaattcaggagcaatattagtttatatggaacttaacccttaatggacggttgaatgtgaagtccatagtgacatcccaaatctctgaaaactaaaagtgcctttgaaggttaaaattttccattgatacattcgtcgcggagttgtgttaaccaaagataatttatgtaaacataattgacaaggcaattaaaattattgttattcacaagaagaagaagacaattaaaccctttttctttgaatgccacttagcccatttagtgtggagtaaggaattattccatctggtagtatttcacgcaaattcactagttggatttggggtgttcaagaagatctgcaaccatatatatcttgttaggggcgactgctatatgctggttgcttaagggggtgtttgggaactagggactaaatttagtccctctcacaaaagtatagggacttatatttttgtgagagggactaaagtttagccccactttagtccctccaaccaaacaccacctaagttatatgctggttgcttaagttatgttggagtgatatgtttttttgatagaaattttttttctcccatgcaggctatctatttaactatccattggctacgcacttgggttatactatagaaacccagcttgcaccttgcaggatttgattattgccggcatatctatgtttggagcatgtggtcaagagtgttttaacagggacatgtgtggtgatctaatattacgattgatagttgttagggaaattttactacaggacatcgtgacttcgcggttttagctgtaggacaccgcacgaagtgacttttagggaagacactctcaaaagttaaatatttactggtggacatcctactcattaaaataataatttccggtcgaagatgagagataaatcgcgtgaaatgtcaaaaatgcccttcagcccacatatcagctctcctatctctcttctctctctatcccctcctccatgccgctcggcgaagagcacgagctggccgcggccaagaaccgccgttcaagtgtgctgtcgagtagacgaaagacaccatcatcgcgagaaacgatgcggggaagaagcgggcggccgtggaggagctccaccggtgcgacgagctatgacggttgcggtcagaggtcgtcgcgttgaggaaggagaagcacacgctggagcagcgggtgctcgtccggcactaggccacctgcacgttgcagctggcgtggtccacggccaccgccggccgccgctactgagtaggccgcgctcttggcaccgccgcgtgcgtcgccgccgctgagtaggctgcatgtgctccgggctttgccaccaccgtcgagcaggccgccgcagccgccgccgagtaggccacacacgctgccgctgctaagtgggcatccgctgtcgtgtaaaagagagaatgaaagagagatgggaatagataaggaagaagagaggatcagaatgagataagaggggtaatttggtcaagctgtgtaaaaaagtgggccccctctcgtctagtcagcacgaaaatattaatttaatagatgtagtgtcccttggtaaattaccacatttacatagtgcgctccctcaaaagtgacttcgtgcggtgtcctacagctaaaaccacgaagtcgcggtgttctgtagcaaactttgcctagtcgttaatgctgcttgtactttctttcttttaaacttgttggtttctgttatagctacatacatcctagttaggcagaggccgagcgcattctcggagtaattattagttattactactagagaattaatcttttattgtggtacccaaaatcacaaatatcttgattagattaggaaccggtactaaatatgctttagtatcggttctaaaaatttaacttcatggaaacttttttagtcctagttggtgttaccaactagtactaaaaatgcatctttagcaccagttggtaacactaaccaagactaaagagctctctagctctttagtctcggttggtagctctttagtctcggttggtgtactaaagatatttttaataccggtaagatgtctacagggttagttaatatctatccaagttagatgtgtgtagtaggagggacggtaacgtaggatgaggtgagagatcttgagttcgaatctctcacatcccacatattttttttaacttgatatgcaaatttagtaccggttatttcagtcgatacttgaagatcgagatctttagtctcgatttgttggtcacggtgttataaccggaactagtgggggtttttaaccgggaataaaaatgagttctccaccggtctatattaccttggtgtaatcatcaagttcaataaaaaaaattacattatcttgtatctattactacttaaaaattttaagagatgtttccttcgtccgtctaaataaaaaaatagaaaaaaaaacctaaaataaaaaagtctgattccccataagaaagtggcgaaaataaaagaaaactacattttgttcgttttctttttttttcctgtttttttccttttattttcttttcccgtttctttttttttctttcaccttttttcctgttttctttgtccgttttctttttcccctctttgcgtattttctttcaccaatttttctgtttatttcttttatcgctatatttttttgcggtttttttatcgggccaaacccagcgccgccgccacgttgattttactccccatatgcttcctcctcctattcgttgcaataattgattccccactactctctcattattttccccatgaattccccttttgattcagctttaattcatcagattgaatctccatttaatcatagttattttttatctcaagttttgcagattgcttcgattttgatgaaccatttaatcgtcgtcattttttatcccaagttttgctgattgctttaattttggtaaaaaaaaggaaaaggaagatcaagtggataaaaatccctcaataattttggatatggagaaagattcgaccggatttgatggagaggatcggcttcgttagtcatcgtatgggtacggaactatgcgagctcgagcggattaccgtatttgatgggaggatcggctccgtcatggtataagactatgggagctcgagcggattaccggatttgatgggaggatcggctttgtaatggtacggacataatactgttcgacttgggcctacaactccatttatggactgagccaaagagaggtagaccgagcagagagagatagcggactgtactaggactagagctgaaaaggacagaaggaatgtgcgttcgtttggtccaaaacgcatgggcattaaagggagcatagtgcgtaggataaaaaatatttttacccgttgcaacgtacaaacatttttttctagtaaggaaaacatgtatctctttttgaccaaacgaacgtacgggggggccttgattggcagatgaagctatcaggttccaactaccgttttccaaaagtgagattggatgcaatggagctatcaagtctcgtctaatgattggttttggctataagatcaatgaacaccacaaatggatatgcggtagttaggcgggaatacactcgtgaagttagtgacaaaattaaaataatcttaaattgtacattagtaacataatttttagcattcaaaattaataaaaataagctaattaatttctaccctcttaactacgtcaacaaaatcgagaagtcttatactttcaatatcacttgggctgcaggaat

SEQ ID NO: 59341 - DNA, 9430 bp, Oryza sativa
ttccccattgcttcaaggagagtgggttaccactgatgacggaggagatgacaatgctcatgaacttgcgggtggtggtgatggtagtgttagtaagagagccaaatcggctgatggttaggaagatgaaattctgacccacggcaccacacaggcagaacaggagaatgtcccatgccacctctgggttctcctggcaaaatctcactgcctcaaaaccgttggcgtaaggccaattactgaatagtaatggagcaacaaacataatcacagcattgtatatggtcccccagagattcatgccaagcattatatcccatggattagtctttggatacctgcaataacacgacattactttccatgtagataagaagatgataaaatttccagaatgctttaatatggaatggacagggtgtagttacctagactttatcaaatcttgggtcgaattggtgtaaccatcaaaagctaagttgaggaagcacaatgtgtagcccagaggcgcattagggttagcaagcttcttgatagtcttggagcttgtctgatacataggaaacaaacataatactcagaaatgaaaacacagttaacatcagcacatcacacataaaattttattaggccatctacagcttctaataacattagaggtgcagattcctagttatagtgactttgatgtggctgttttctcttctaatttgtattcatcataatacaaatgactgtaaggaacaaaacatattcttttctactttcatactacggagtgaaacagtgccaaaatgtttctgcttttgctttaggctcgtgggatattggtgaataattgaaatagattaaatctttaccttcaacaacgcaaaggatgatacacccccagcaacaagaaaggtgcaaatgtactccggaaatgtgtacttgacaccatacagtatagttcccatcagcattactgtacatattaaatcattggtcagagatatgcgcacatcactatacagactatgaaacatgaaagggctactgttaaaagttattcttaacactgattgctctattacctacaccactctgaccaccaaatatcagcactaatggaaatgctcttgtcatgaaattgatatggttttgacaaaaaaaatgcaagtattgtcgtactaacagctaaagcagccaatattgtggtgccaaaccaaaatccaattttccagtgtacttttttttttacacagaaactgctcagatgagtatacccacccaagctcaaattaatgatcagaagaactattcagatgtagataatgttctgtaaggtacattacatagcatgcatagatcaatgcaactcacctggaatcatcttagaagattttgccaggacctgttaacatagagcaaataattccttagcggtaatgtgctatttaatcaaatcagcatatattattacggcacaaaaatgagacacaaaaatgatattcagaaaacacaggcttgttgcgactgttccaataagttcaaaagataaatcaaattacattgcgcttgagccaaacacattttgatgtataactgtacattggatggttcaaagttcaatcaaaaagtttgatgaggaaatatggttctgtcttcacccatccatgcgatacagcgataagagtatcatggataatcatattttggcatttgtgcataatactcatggcataaatgttttctacgtataaaaattgctaataaacaaatgatctaaacattgtttatatgttcagatatttctgaatcagcccataagccgtctgacttggtcagaccgaaccaaattcaaaactccaagtatatcagaaccagagagtctgaattcgtaatttcactcaaccaaacttaattttcttctccaataatcactcacacatcataaattctccaaatgaccgtatctatcgcatcaatcaaggcaaaaataaggctatagaacattccaaccactgatttacttagcacagttgaacaatccaaaaatagaacattccacttcgcaggcattatactactgcgttgcctatcacccataacgaaaatggaaacatctaattacagatacaatagctgcacaaaaatgcatagagcaacaaagcaagcgaagcgagacgacaaaagggcagctgcaaccaaacctgagctgggtagctgatgaacttgagcgcctcgatccccatggccgggccgacagtgttggtgatgctgacgccccagtacttccgcagcggcgcgcggccagcggaggagctcccaccactcgaccacagcttgatcactgcgcgagcaaaaccagtgtcacaaactcctcacacgatccgcattctgcgcaatggcatgcgatgcgaccgcactggattccacacgacaggggcaggggatgagagagggaggagaggaggctcacttatgaaggaccagacgaagcagacgacgttctgcgcgaagttgaggaacgcgaggtggtcgaaccgccgcgcctccggcccgaaccgcttcgtcgacctgaacgaacggcggggagagaaaacggcgaacaattttcagaaactcgccgaagcagagcccaattcccctccgctcccgagcaccattagagagagagagagagagagggagggagggagggaggcgggcgcttacagggtttcctggaggacgccctgggtgatgtacgccgaccagatcccggcgacgcagaatgcgagcacggccacgcgcgacaccatgctccctccgccgccgtcgacgacgcgggggcggggagggcctctgcctccgcggcccttgcgcgcggtgaccatggcgcggttcggttcggtcggtgcgccgccggcgaggggggagggagatcggtgccgcggggaggaaggcggaggcgcgtgttatagaagcgggggcgcaactggggagaaggagaaggggtcgcgcgcgtcagaggggtgacgtggcgtgatgcgattggggagatgtgccacgggagacagcttattggttgggttggcgtggccgcgtggcgggggaagggaagggaaagagatccgagcgtgctgtttccgtttggtgtttcatgggccgttctcttttggattaagtccaatttgactcccttaactagtggatgagtctaattcatatccctgaactacaacaccggatatcataaccctctaactattaaaaccggtgcaatttagctctcttgacggttttgcagagcgatttcgctgatgtggcgcctacgtgacggtgttgaactggtctttatacaacgtggtgttgacgtgtcacttatgtagcattagaattaaaaaaatatatgggtcctatttgtcattcacacaaaaaaaattgtgggatccaccgccatgtaggtccacatgacatgtgccaaccactgcgcgggccatggccgtgccaacgacgggctactcctctcgccgacctccatggacctcatcgccaacacctcctcctccactccgtcgtccctgacctatcgttgccatccccgaccacctcctctctgccctcgatccctcctccctactcaacaccttcgcctcttacccggtcctctcccccttcgacttctcctccgctacgctcttcttgggcctcgccgcatcccgcatcgagcaaattcaaagaggttatccgcctcctccacctagggatgacaattttacccatgggtccaggtatccacagatacccgacccgatgggcatgggtgtgagtgtgactttttacccatgggtacgcccacccgatacccgaagacgtcatgggcaacaggcgggtttcattttttacccatgggtaacccatgcccgacccgatacatatgtattagctaattttgactcatttcttaattcttataccctttctattggttcatttgtaatgctaactgatactaagttgtgatgtaattcaaattattgttggtaaccaataatttcgtaaattattgattttatttttctttcttaaattatatatattttaagttattatttatatgagatccattgggtacccgccggacatacccgcgcccaccgggcatgggtacgggcacggagttttgcacgctaactctagtgggtagggtttggacaggcaatattaggcatcaggtcgggcatggttttgctctacccgtgcccgacccgacccattgccatccctacctccaccgacacctccttgccgaggagctccgccgccacccgctcctcccattcgacgccaccgctccgggcctcggcgacggcggcgtgcaggcgaggggagctgggacttgggttgtgctttatcaggccggcctaaggcacgacggcccgacatgctagaaagcacggtctgacacggcccgtaaatgggctaggccgtacttgggctggcacggcacgcgaatggcccgtaggcacgatgatggcccgatggcccatggcacgatattggcccatcaggaatggctgctagcctgctagggcgcatgcgcatcgggccatcagcagaaaatctgagtggcactacagctccggaccccggcagcaagacgctcagacctccgaaaatgcttaggatcatatgttcgacgcaaccaataaaaaccggacggataaactactacctccctattcactccacaaatacatacatgttgtaatggtcttcaaaataatttttctcatgaactacttatccaatctacgatatgatcacaccattatatttgttataattaaatctttataacaaggtatcacatcattacattccgatgaaaaaaaaacatatgtttcaatccgttaaatttaatgtttcagatgcggtagcaatatgtttcaacgtgtgtttttgttatgtttcataaaaaaaatttaaatatttcaacaactgattttttttcactatatataactcaatgtttcaacaattgattttttgtttcaccaatatataactcatgtccctactctctctctctcgccatctattggctttctcccacaccatgcatgaatcatgatgcaagtatttagtgatattaaaatatttttccttctaaactacttatccgatgaacgattcgatcacaccgttgaattcattataattaaatctttacaacaagatatcacatgattatattctgatgaaagaaaaatatatgttttgacaataaaagcttaatgcttcatacgtgatagttatatctttcaccatgtgttcttattgtgtttcacaaaatttcaatatgtttcataggctcatttttctgtttcaccacgtataatttaatgttgcaccaacggtcaactgaaacatttgaccgtccgatttttttttacatcggacgtctgatttatagctctctcctcgtacctcagaggatctcctgcaaggatgcgatggtgtccggcgattcccttccgcattggcgcaatgaatggaggcggccggccgaagagacacagccgtggcgccgcgcagacgcagtcaagtgacgccgcccggccgaatggacgcaatcgagtactggggatggggacggcggacggccaaacggacacatcctgccatctaccactggacaaacgctcgacctagtattagggactaggtagtagatgcgtgtgtgcctgtgattcccttgcagccttgctctgctgctcctgcgccctgcctttgcctgcccgcatgtggcatgccatcgccattcgccgtaagcgtttgctattatggccccaatttcatattttgtatgtggtcacatgcacgctgtagctgataatacatgtttgcatgttgctgttttaacttgtgcagatgtgcacgtgcagccgcggagaaaaggcgcctgccttggattgagatggagatgggacgcctggcaacagagaatatgggcatggctaatggtgattggatgtgcctccgtggagcctgcaggcagcacgtgtattgtgtggtgtgtcatgtgtgtgtaagtgcaacgagaaataactagctcatgagggcaatttgttctataaattcctcctcctcctcttcttcccaacacaaaaaaatgcagcacaaaataaacagagcaacatagttatttccctcccacagcaaaaatgtggggtgatactcgtcggaggtcgacctcgtcgagacccccgcaaagacgccgccaatgctcgcctagtcttgaccataggtcggtcgatgcccaccaactatccccgggtatggacgactacaggatggatgaccgccatatggatggtttggagggagatggggatgatcctacggaacagcccatccctaaggccaacgatgacacagtcttgcccatgccgggaagcgaggccgagccatccgcaccatctacagagagagcggagtgttggcggcacttcgaaaaaatcagggtaatggtggactacaacattgtggaaaaactttgtctgcatcttctagttcaggaacaggacatctcaaacggtattatttgacgcacctcaaggataaagcaccggcaggagcaaggcaaacacagctgagcttcggacccgacggttctgtaagtacatggacttatgagccacaactagctcgagatgaaattgctcgttacatagtttcggaggacctaccgattaggatgggcgaaaggaaaaattttgagaggatgatccgaaatgctttttgtccacagtacacccaggtttcaaggaaaaccaccaagaactttattgtttcattatatcgttctaggttggatgagttgaaacgcttgttcagtattgttagcttttcttttgttgtgacatctgacatttagacatccaagcaccaaagaacctcttctgttagtgttgttgtgcattatcttgacaataatcgcacactaaataagagggttatagggttttaaatgatgtcgtcacatactagacgagccattgctgccacactactagatatactacaagaattcaatttacaatctagggtggtttctattactcttgacaatgcatcagcaaatacaatgggcatgacgattttggagccaaatctgcaaagctacattggaggttatgttatccatcaaagatgcatttgccacatcatcaacttgattgtgcaagcaggtattactagtcgttgagaatttattgaaattcattttttagtgcaaataatttatcaattttaatgcatatgtgacaaggaatttattatctatgtaggatttactgttattaccaatttacacaacaagatccgtcaagctgtttctatcatcgagggtcagtcagtgatgaaggagagattccgggactattgtcgagcaaaggataaacctgtgaggatgtttggcattgatgtgaaacatcggtggaacacaacatacctcatgctgcgtcaattgaaagggtatgaggaaataatttctgttttcattaattcattgcactttagaagtaatgataccgatgaggatggtgattgtgagattttgcttcttactgaggaagaatgggacatagcaacatgtctatgtatattcctaaagcctttttataaagctatagtcctactatctaggatttactatcctacttcttgtttggtgcttgaatgtctttggaaatcgtcccttatatttcaagaaaaccgacatgatagagttttagcttctgctgttcaaccaatgaaggaaaatttctcaaatacttcactactattccacacctttattgttttgctttggtacttgatcctcgtaaaaagttggaggtcgtggaggctgctttcatatcaataggtgatgcagtgggtcttgattattctgaagcttatcaacatgctagagatgagttgttcagggttttccgtatgtaccaaactaagctaagtgttgttcgttgggtgcctgaggaaaccccacaaaaaaagtaaagcaaatcaagtgcaatgaatttgtggaagaagatcaagggcaaggaacaagcttcctcatcaggtagcaggtcaaattggaacccagatgcggagcttaaccattacctcaacaccaatcgcacagaacatgatcgaacactagatggtgaaaatgttgatctgtttgagtggtggaaagagaaagaaaggactcttcctgtgctagctcactttgcacgggacgttctattggttctggcttcctgtgtctcttcagagcatgcattagtgaggttggaagaattatcgaagaatggaggtcatgccttgcacctgacatagttgaggcaatcttttgccttaaagacttgattgaagcatatgcaaggacgcaacaccggctagaggatccagagattgccgatgcagcggcagacgcgttggcggaatttggcatatccactgattgcggcggtgctaatcaaaattagtaatgtaatttatgtaataatgtaagcaagttgttatactatttttcttaccggggaaccctactctagggtgtaaggtttttaacgaagcaacaactttgcatccctattctgaataaatttgttttccctcaatttttacatctcaggttatttgcattcggtgtgagaacaaaaatacaatacatatttttagacgaggtaataaagtattgcagagccatctgggcgaaaaaaaagaagagtgtgaccatattgttttccctactcccaaaaattccctcctcttttcagatttccatcccaaaatttccctcctctatttcatattacaggctgctacagcagtgcagcatgaggtcattagccatcgctaagggtgcaagcggctacccacaaaacccacttataaactaaactaacccgcgaacttgtttatttcgacctataagtgggttcgcgggtgacccacttcacccatcacccatccacggtcaaaacttcccatgcaggcatgcagctagccgctagcaggtagcagcaagtagcagctcttcttcatcgcctcatcggtggcaggtagcagcaaccagcaagccagcaccagcagttggcaagattgttcgctgactgacgcggccacgtcgccgcgacgagccgacgaggaggagcagggtgcgcgtggccgtcactgccgcgtcgccgcgacgggacgacgaagccgcacgccaccactgccgcctacctgcgcccatcgccatcactgccgccgccggagtttcttctcagcgcagccggcctgctccctttcttttgggctgtgcttgtgccggcccggcacgaataggcccatcgggccattgggccgtgcttgggctgcgtccctgaagaggccgtgctagcacggcacgacacgacgagtgggccgt

SEQ ID NO: 59342 - DNA, 12566 bp, Oryza sativa
  unsure (1)..(12566): unsure at all n locations
gcccaagtccctgaagaggccgccggagcggtggaagcggcgtgggcgcggcagcggggacggcgtgtgaaggccgagggttgtcggccccttccgtcccgacggcggcggcgacagcgctggacatcgtggaggcacaactccgcgcgcttccgctcggcgggcgcggcgacggcgctggacgtcgtggacgaagacgacgaccccaaggtgcggctggcgcgcgtggagtggaagctgaggctggacggggcgacgaacgagctggaggacctcgtgggggagatggaggaggccgtcgaggcggagaagaaggcgcggtgctgggcgccgtggcggcagcggtgcaggggggcggcggaggtggtggccgggtggctgcggtccgaccctaggatcaaggtcaggttggagcttgacgtgggaaggctcacagtcaccggcgtgtacgtccaaggcggagagctcttggttcttggatgatgtgactagcgacggtgaaggaatagctgcattccagtgaagcgatggctgcgctcgacgccaaccggtcgccatgacaaccaaaacaaccgaaccgagggttacccgacgacgacggacgcgtcgtcctcgccgtcgccgctcgccacggaagtgactatgctagcgaggagaacttagatgacatgtaagtagcgaaattaatttcgcatcgcagagcatatgcatcgtaatttcgtcgctcgctgactcgcttgccatgcattgtaattaaccaaaccttaaactcttgtttgcatgggcctcaaatcaatcccgaattatccagcccggaatgagggccatcccgagaggatgacacgtgggtcccacacatatttattttaaaaggaaaaagtacgaattaccccacgaacaatcgcggtcgtccaaattatccccctgaaccacaaaaccggatattcttcacccccaactatgcaaaccggacgaattacccccctcgaaccaattcagagtagttttgtccaacgtggcgcacatgtggcaatccagtcagcatttttgtaataaaaaattgtgggacccgcctgccatactcttcttcctctctctctattctctctctcgctcttttctctcgcggctcgcgcagcgcgcacgacgaggacggcgcggggacgggcggtcagtgtgggcggtcggcgacggcggaggcagcgagcgcggcggaggaggcagcgagcacggggaagcgaggcggcggggcagggtagcggtggcggaggaggcgagcggcggcggggtgcggcgaaggaggcagcggcagcggcgaggcgagcacggcggcggaggcggcgaggcgagcgcggcggcggagccagcgagcgcggggaggcgagcgacggggcagggcggcgaggcagggcattggaggaggcgagcggcagcgggagctcgcattgctggaggcgaggcggcggcggtggggtgcggcgaaggaggcgagcgcggcagcagaggaggcgatcgtggcagcggaggaggcgaggcggcgcgcggacggggctcgaggcgacggcggcgacgggtgacggacgacagcgcatggcgcgggcggggctcgaggggagatggcgacggcacgcggcgcgagcgacgacgacaggcgacacgattggtcccatctgttcctccgcttcgttgcgggcgccgtcgtgggctggggctggttgtcgcgcatggcgtcagccgcctcgccgccgccgtaccccgccaccactcgcctcctcctccaccgccgccctgccccaccactcacctcccggcgctcgctgcctccgctgccacctcgcctcgccgccgcgcttgctgcctccgccgtcgccgaccgcccatgccgaccacccgtccccgcgccgtcctcgccgtgcgcgctgcgcgagccacgagagaaaagagcgagcgagagagagaatagagagagagagaaagaagagtatggcaggcgggtcccataatttttttattaccaaaacgttgactggattgctacgtgtgcgtcacgttggacaaaaccactctgaattggttcgaggggggtaattcgtccggtttgtatagttaggggtgaagaatgtccggttttgtggttcggggggtaattcggacgaccgttattgttcagtggtgtaattcatagtttttccattttaaaattctaatgccacgcggaacaaagaccatgtcaaaaccgccacgtagacgccacgtcatcgaaaccgccctttaaaaccgtaaagagagtcaaattgtaccggttttaatagttggtggtcgagatatccggtattgtggtttaggatacgaatcagaaataatccgtccgcatccgcactggcttcgaatccacttagaaaatatagtatagaatatcgtatgacaactatccatccgaatctgatctgttttcatccctctagacttctatcttgtttttatttccacgtccgccactgattgactataaagcgaaccaacctgatttgtgcccagtgaccatatgctgatgcaggctataaactttctgcggttcattcacggaatttccaaaccttcctgatgaagcatctcttggtgggggagcacgaatcgcaaagcactacttcctccgtcccataaaaaactaatctagtatcagatatgacacatcctagtattacgaatctaaatatacatatgttcagatttattatattagaatatgtcacattcggtgataggttcgttttttaaaggacggagggagtagaggagtaaccgccaagtttcctgggcttggtgggccggtcgccaacagtttgtttgaacccagtatcctttccgtggcaaccaagttcccgtgagcccatcctcagccacccgattcccccatacaactcaaatcaacggcccaaaaacaacggaaccacccctcccggaaccttccagaacaccctatagcctcttgaaccttcccgaatcccacctttctataaatccctccaccttctccgacctcctcatcgtcaaaatcacatacacaagaagagcgtggaagagagggaggagaggggagagagcaatgccgacggggaggttgagcggcaacatcacgcaggactgggagccggtggtgctgcggcggacgaagccgaaggcggcggaccttaagtcgacgagggcggtgaaccaggcgatgcggacgggggcgccggtggagacggtgcggaaggcggcagcgggcacgaacaaggcggcggcgggggcggcggcgcccgcgcggaagctggacgagtcgacggagccggcggggctggggcgcgtgggcgcggaggtgcgcggcgcgatccagaaggcccgggtggcgaaggggtggagccaggcggagctcgccaagcgcatcaacgagcgggcgcaggtggtgcaggagtacgagagcggcaaggccgtccccgtccaggccgtgctcgccaagatggagcgcgcgctcgaggtcaagctccgcggcaaggcggtcggcgcgccggccgcgcccgccggcgccaagtgaatccttcgtggccggaatcgcacctccgatccctcctagttaggcgttgatccgtttgtgaatgtgcagtttgtttgtgttcttggcttaattttggggggaaactatgatatgctaactggctcagacgcatgtgaagtgatgatggctagaaattgaatttccgttggatttgtgaacacatagtttagttgaagcgcttttcgatccggttgtgttcaatcgtcgttgtgctctgcttctagttgtgactagctttgttctctgctcatatttcattgattgatccaagtgattcttcctgggaatcgcaagttcgcaactccgggcctccctaagttcctagttataggcgttgatccgcgttgtgaatgtacagttcgtttgtgttcttggcttggtttggggaaaccatgaatccatgatgctaactaggcgtatgtgaagtaatttctaatagaaattaaatttaccggccgaatcgttgtgctctgcttcttgtgtgttgtgcggtgcctagcttgttccctgttcatgtctcatcgacagctcaggttgctgctacctgtccggagctttggcggtccgtaaaattgatcgagtcactaactcggtgggttcaattaaccaatgtttattcgttcatttttctcggcttgaaacggatgaactccagaagagcatttttcggcttacatatttgtaacaggcttcacggctgagtttttatcttcacttttccaaccaacatctctcgtttttaaactgctaaacgatataatttttttaaaaaaattctatataaaaattattttaaaaatcatattaatcaatcgattttttaaatttattttaaaatatttaattaataatacctaaatgttgttttgttttgcatgctaggaagtgaggttttcatccctcactttcgaacagagccttaaagtatgttgattacagccactggtggatcgctgctctcgcaataggccttgtcacttaattctgccaaattatggactagttatgttttttttttctttttggtacgcagaaaaatatgtttggtttgctacattgacaaaatatgactatgctaaattatgctaaataatatttgtgtattatttgtgcggtattggaagtattggtagtagtaaactaagcgttgccaaaaattaatgcttaaaatgcaaatattttggtatggcaagttttgacttccaaggtaaaaaggagaattttggcttccaaaggtagtataaaaaggaggagaacaccaactggcatatacaaggaaaataatggataatgcaacttattgactctctgtaataatcttccaccgttacaaatactccaccacccagcaaatccaacaacaccaacatgtgtacatacgcatggccgactcgatcggcgacgagatccagaaagaactcagaaccagggggagccatggacgggggtgacgacggacttgacggcgaggaacttgtcgagcgcgtgcatgctgtcgtccttgccgaacccgctcatcttgcggccaccgaacgggcagctcctgtccatggcgaagtagcagttcacccacaccacccctgcccggatcgacctcgccatccggttcgccacgtcgatgtccctcgtcaccagccccgccgccagcccgtacctcgtcccgttcgccctctcgatcgcctcctccaccgtcctgcacccaaaattaatctctcttaccactatagtagtttcttagataataaacattttgaattgatatgacatatcatggtcagatcctctgcgatcgaaatcacgtaactttgtcacttacatgtggatccgatgatccctggatccacaagttagtgataaaggtaccgtgtatttgactagagaggatggcgatccatatatatagctgggtttacttgaacttcatcaggcacatgacggggccgaagatctcctccctcgcgatgaccatgtcgtcctgtcgttcagaatcgcaagcgaatcatcagagataagactgtgaagacacatggtgtgttcgtggtaaattctaaaggttaatttattttttatctttaccttcacattggtgaaaatggtgggctcgatgtagtaccctttcttaccgcagggcttccctcccgtgagaacagttgccccttctgccttgccttgctcgatgtacccgagcaccctctcatactgagccttgtccacctgtatgaacatagtagcagggcaacacagtacggtgatcagtctctggttcagatagttaatcaggcctgaatcatcactgaattattggaactcacaagaaaaaaaatgctcgttggatggatgatgattcagatttttcggaatttaatttcagactcactcacctgtggtccttgattgacgcgaggatcgaaggggtcgccgacgacccagctcttcatggtgtccgctagcttctgctcgaaccggtcgtagatgccctcctgcacgaacacgcggctcccggcgacgcaggcttctccctgcagattgatcagatcacggctatggctctcatcagtcaattcaatcaagatcacggcaatgcatggcgctctgccaattcggatgctcaccttgttgaagaagttcccgccgatggcgagctcgacggccttgtccaggtcggcgtcgtcgaagacgatgaacggcgacttgccgccgagctcgagtgccaccggcttcaggttgctcttcgcggaggcctccattataagccgtccaacctcagtagatcccgtgaaagccacctgcaaaaaaaaaaaaagttgtaagaaaccgatcaatgttcatgtgctaattgacagctgaatgtatgatatcttaccacgtcaacatccatgtgagatgaaattgcagctcccgctgttgggccgaatcctgtcaccacgttgatcaccccatccggtactcctgcctgaatatcacattccgaaaaggtcagagatattcagagttttagactaccagcaatcacacagcacaaaatgcctgatgcaagaacagagctactactatatcgtttttcttttttcaattttgcgtcctgttctaaattgaagattggattagctactttcttgattttcattagcacgttttccaaactatcaaatgttatgttttgtatgaaaattttctatataaaaggtactttaaaaaaataaataaatttatttgtcaattttctataattaataattagttaatgttaatcacatttctcgtttgtgtgactaatcttacttgcttattttttttttaaaaaaaattcttacttgctttgataggtgggcgaggaacagggcgctgaggggcgtctgctcggcgggcttgacgacgacggtgcagccggcggcgagcgccggtgagactttggagaagaacatgatggccgggaagttccaggggacgatgaggccggcgacgccgaggggctcgcggagggtgtaaccctggagctgcctcgacatcttgagcgtctcgccgtggatcttgtcggcggcgccggcgaagtagcgcaggatgccgacgcactcgccgacgtccaccgccctggcggcggcgagcggcttgccggcgtcaaggctctccagtgccgccagctcatccgcgtgccgctccaccacctccgcgtacttcgccatgaccctccctctctcctgcatttgacaaatgcgccattgatcggtcactttccagccattttttgcacgattgagaggaagaagaagatgaccgtactgatcccgacatgcgaggccattcgccgtggtcgaatgcttccctcgccgccttcaccgccaggtcgacgtcctccttgtcgccttcggcgacgcgggcgatcacgtcgccggtgcgggggtccctggtctcgaacgtcttacctggagaagaagcacggagcacggcgaccttccatgatcaggatgagattatgtaaagataaaattaagtgaaaatttcagtaaacctcacatttcatggttaaagttatataaaatcctaggtatcataaccttgatgaagagagttagttttagtttatgactctcatcaagagcaagaagtctttaattttagattggactgctatagaatttgacccatcgtacaaaaagtttctgatgataagaatcatactttcatggaactccataggggcatagggctataggcttcaacacggtagatgttttgttctgaattattctgagcaaacttacgacccaacgatacaatggttttttttctattcacaaagaaaataatttggaaatcgcaatgcttctatacgcttccagaggtgacacataaccgaactactattgttttaaagtttttcaaaacaccacctctatatatatttagtaaatatttacttaaaattgtaaaatgtagaatatatgtggaatttttagttgttgatttttttattaaggttttcggtttaactcttcgctactttgtaaaatattatcttagatatgttaaagtcaattgaaatattgtcttggattttgttagcatgcttttacatttcattaaaaaactttctatataaaatttactctacaatatcaaataaatatattttttaaatttataataactaaatttaattaattatattctaatgacttcttgattttctgtgcactaacttcaccttaatgaggcaaaccccgaatttgatttttcttcagagcacgaaacgtgtataaaagtacacaagaaaataggatctctagtacggaagcatttatcttcttctgaaaattcagaaatgttccaaatctgaaacgtgctactgctagagccacatatgggcagtcccaatccataacactagacatggtttccataaactccacatcatcaagaaactagtgctagacactactcttccaatgcaaacaccactattccatactttaatttaatgctatttatctcacatgatgtcttagatgttgtgtagaaactatgtctcatacaagacatggttttcttctctttcctcatttattcacttgccacatcattttttgtcctaggtgacaacttatttaatgctatgaacactatcctagtcattgggttgggaatgccctaatgatttgatttgaatagttctttactacttagtactattagtacggagtactagctaatcattgagcaaaaaaaagatgtgagatgaaaacagcaactagccggggacgcgaagcacatggtataacacgggacgatgggaaaaatagatgccagaggttggtagagactgaaactgcaggcccgttcatgcttctttgtcgtgttactccttggcgaactgcccatgatctcatctcgccatcaaaccgtacgatgctaggagcaccacaagtttacggtaactcttcaaaatttactttctcggttataaaaattagcaatatagtactaaactttcttttttaaaaaaactatttttataggcaacacatgcagaaacaaatatattaaaaatgatgtatatggtttgctcccttcgtcccataaaaacccaccagtatgagaggtgatattttcaagcacagtgaatctgaacagaagactatccaaattcgttgtacttgtaaataccatatccaatagttttcagaatgagggagtatggcttatgaaatatagcaatatagtgaattgtttttttcataggcaacacatacagagaccaatcatattgagaacagtgtatgtatatggtttcatatagataaaacccatttcatctttttcatattatttttttcatatttaatgagaatggattttttagtgggagtggcctaagaattaatctaaactggctggtactaattaattatggagagaatcattaagagcaagtttaatagtacagcccactgctagctccaattcatctatatatagtcaatctaacagtcaattcatacaatagttgcttacgatactataaatatttggtcccacatgtcatacacatactgtgtcttggagtccgtgctgcagctggctacagatctgtagtccgctgctcttctctgttatcttttatctcattaaaatatatttatagctcactaatagtttgctattgtacttgctctaagaaacagcactgattgcgataaggaattgaatccctactagtatttggaagaaaggaaataaatcgaagagagcaataggacaaccacggcgattatgaattggatcccattactaggttttggtagagtacaattaagtcctccagtaattaacgcaggtgggctggacgtagctagataaccacagcccacggctagctagcgcgcggctaacacacacgtacgtacgtaccggaggccgcgtcgacgaagcgcccgttgatgaacagcttggtgtacctgatctccggcgtcgtcctgggcgtcccgccgccgtcgtcgccgccgtggaggcaccccgcgccgctgttctccgcgcgcgcctcgtcgccggcgtggtggtggccgttgctctcgctctcgctcgccatggcgcgcggcggtgtggctcgatcggtctctctctccgcgcgctgctttgctgttgcgtcgctaagcgagaagcgtagtcctactntnnnnnnnntgggggggggggtgatttgggcgaggcgatacgccgatttaaagagaagcgtgcgccctgccctggccaggtgctagttgggctagccgtccttcaaatttgacagttttttttcccattcacagatttgactggtctagctgactagctagtcctttaaatttatcctaaattatagatgattttataatctgaagatgatcatttattgcccatgtacccacccctccctcccatttcaagcgcaaacatgagttgtcaaattttaattgtacgtcttattttattttttttgaaaaatagtacttttaatgttttatcatctgataataataaaaatactaatcataaaattttttaaataagacagatgattaaagttagacaaggaaactcataactacgtttaatatgggacggagggagtatactttatgagtctattaggttgatgttattttaaatctttttggtaaaattgagaaatacgtggatacatttaatttattcccaaacattggtaatgcctagataattttggtaacaatacatctatcctatcctattaaaatttgataatattaccaactcaccaaaactttggcattaccaaaattctagaaatgtttattttggtaataatttgagccagccttatatctcgcttatccactcttttatagtttattcctccacctacctatttttactttacttaatcctcacctatcatctattattcccattcgttctaaaataaacaaacatatcacacccctgtattaggtttgtttattcggatgaaaggagtaatacattattttatctcctatcatcatttttcatcacttgtacttttgctatctccttaataatcattaaaaaagggaaattattctatttgagacgagggagtatttccatcaccttactttactccaagacggcaaggcctgacaggcacccgcacatgggaaacaaacggacgagtcaaggagtgtactcatgtagtgtggtcgcgcactcacgtgattacctgaagaacttgcaaggattgggatctggtctctttttcaattcatcatcgatatgtatatatagagaagggttaattggatccatgccacgcgaattgtggcaaatcaaaaaaaaaaatgctacacctattccggaatccgggtgcaggccacaactgtttcgtcaaattggaaccatgccataatgtacgccctgcgcgcgctttgccaccgttttagggtaccgtattttcgtatggacgtttctgccctcgtgttcacgtgtgcttagaccagctccggtccggctcgaacaacccggtcgccattcgttccccacaccgaaaccctagcttcttggaggcggcgcaggcgacggcgccggcgcaatcgacggcggcggagcaggcttcggtgccggagcagggcggtggcgcaggcgaaggcggcggcggagcagggcggcagcggagcagggcggcggcggaggctacgacggccgaaggggaggacctccaccgatgggaggatgagtgcgcaggggcctacgcctgcatcccccaccgcgttggcaatgtatttgggcgaatcccttgtacgggttgcttccaaaccgtgagtaccttcccccatgaactctttatgcagataaaattacgatttgagtttcgatttgaacttgtatgtgcgatttgagttattgttttgtcattcgttggtaggcattggttttcagtcgatgttagggtgcaaccctatgcgacagtagatgctgatggtaggaaaatcatcagtaaaggaggcactgggcattgggtaatcgattcagagagtttttcgtttgatttcctaatggaaagtttgagggttgagtttaagtggggctcgaaccagtctccctcagtgtggtattttaacaaaaatttgggtgaggatgttaggctcataggggacactgatttgccagatattttcgagatgtatgcaaccgaggccagtttccacttacttgtagcagttcttgaggaaagcatggatgttgcttctgtgtgttgtgtgcatgagcccattgctatcatcccactgagaacccttcccacaatgatggttctagacaagctgctactaatgatggttctgcacagcctacaacagtggaagcagatgttagagagcctgacatgtttgataattaggaagaatatgttggtgttaatgatgagcagttgtatctgcctccaaaacctactcagccacctgacacctctagccaa

SEQ ID NO: 59343 - DNA, 1118 bp, Oryza sativa
aacactaacttgggtacattgctcggcttgcccataaccaagggcgcggctattcgaatagattatactctgatcagaggtgtacatctttacccacaagacacatcttcctcacgtgtaaccatgtgccacataccaccacggtatacggacagaagacgtgacatagtttccaacccatcctagccatagacaagagtaccgacccaaccccacctacggccggaacccccgggacaggtaggcaggactgagcctctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtagaagtacggtagtgctttgcaacagaggcccgaagaccggtccttatatggccgaggtgctactatcaaaaccatgcacccgagcctagcctaaaaccattttgagggttttgaatagagggggaggtgcaaatccaattccacaataatccaaccattccatagtgtccaggtgatgagaatattcccaaagtctagagttataaaaccacctaatgttgcctaattaatcagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcggtaatgcaataatttaaatcaaaataattttataaactgggattcaatatgttcaaggatgatgtgacttgccttgctcgctttcccaaacgtcggcttcaacctccacgaagagcggatcttccgaagctgcagcgtttacacgaccaacggaaaagaaaaggattttactctaataaactccatataacaagcaggaacaaagcacaaaaatgggttcttgacttcttcaggaaaaattagagacttgaatggtccaattccgagttcaaa

SEQ ID NO: 59344 - DNA, 728 bp, Oryza sativa
gggagggagggaaaggggacctttagggtttttctttttataaaaccattttaactttgtttatttcttaataattattatttgtgctctgaaaattccactaaaatttatttacgcattttaggcttttaggaaatatacaaaaatcctccaagccttatttgacttttaactttgcacattttaatttttggaggctttcacacggattttaattattctaggcataatttagaggatgtattttagagtcgttttgggacgtgacagtttggtggccaatcctctcagcctgctgccataggggttagtggtcaatcctctcagactgctgccacaggggttgaagctcctgaggtagaagtcactgatgaagctcaggttgttagagtgttgcatgatccagagaatccaaatatagtgaagaatgctctattccctgacatgatatcttttagaaaagcagttaggcattatgcaattaagaaaggttttgagtttgctgatttgaagacagataaaacaagattcattgcaacctgtcgcgctgaaggctgtccatggagaatacgtgcttccctaatccatgataagaaaacaattaaggtataaatgtattattttagttaatttattttttcatctcctgaaagtagtgttagttttagtaactttttatcaccatgtcatgtcatgcagattacagttcttccctttgaacacaaata

SEQ ID NO: 59345 - DNA, 1292 bp, Oryza sativa
acccttcttcctcatgtacggttccgaggccatgctccctagcgagctatgacatcagagtacacgagtacagaagtattccgacgaggatcaggaggagtagtgaaacgtcgatgtgaatctactcgaggaacatcgcgaacgagttgccgtccgagcagccaattaccaacaggccctccgccgttaccacgagaagcgcatccgagcacgcatgcttacgatcggcgactacttcctccgacgggttcaaagccaagcagggcgaaacaagctctcacccaaatgggaaggatcttacacgatcacacaagtcttgcgaccaggcgcatttaaaattgcagacggtgatggtcgcgagttggcaaattcttggaacattgaccaactacgtaaattctatgtatgagtcaatgtcatccatacctgtaagacaccttacagcatcaataaagcctattcttaggaccatattacaatcaaagtgttcctgtccgatgatcccttacccagatgacacctaacgttgaaatctatcctcatgtccctttacgccgtcttgacaaggcctccgaggaacctaagggatcttcggctggggacgcccagagccgataaggccttgtcagatcctgtagagacgaaagaccatgtaagacctggtcgtgtaagagttctcgccgtgcgtattaaccaagtcgtgtaatcggaaattaactttccaacttcacggctgggggctaggatcagtgcttattcaaccaaggcaggtcaaaggtccaagagccttatcctctgagaaaactcctccggtgacaaggctgggggctagggagagtgtacgactcaaacaaccgactaaagtcgtgaactgaggacacactcttacacacgatatccggagtaagaaatattttctaaagatagatttcttttctatttcacaaaatactccttacaattcttacacaagtctaaggctatattacactttcccctaagatatctatcacagggtacaaaggctaccaggaaggccaacgccagtccacagattagaagaccttctccgccaatggcgccatcgacttcaccaggtggtctatctctgccagagtcctccgagaacgagcaaaaccttcatggagaaaatcgatgtccagtcgcgggcgatgatctcataggcaggccaacacgtgccccccggcatatcggctcgatcgacgacactcctacttcaaggcttcgtcaatgcgcttgccgacgccctcgagctaagcataggccccgtt

SEQ ID NO: 59346 - DNA, 2214 bp, Oryza sativa
gcgaagtaaggcgaaattgttctggctgtttgatcagacaacaagatagcttaccgagggggctgatgccttgcgacgatgtccgcttacagaggagaacttcctcccctttgctggaacattgccaccacttgtggtagcagcagcagcagcatcagacgcctccttggcgaccttctctttcaatgatgccaccacctgatggtccgcgagcggcccgatgatgtcagtcagaggaagagcctacgctttataaagtcacaaagcgatctcagaagaaaaacgcagaatgactactgagtacacttacattgatggcggcatcgcgttcggccgcccccttctcgcaaaggggaacgggaacattactcgccgtcgccgggccactgatcatcacctggccgacacgacgtcccacggcttcgttgctcagacctgtgaatcgagaaccaaatttcgatgagccaggaggagcgcgcacacaagcatatcaggataaatgcgagaaagataccccgaggagaaacccgggtcgcatcctccggtccagaatagtcaaaggctaggtgggcttgagcctggagtggctggattcgtctactaatgaagtcaacagcgacttcataccccgacaaaccacgcactcggagatcgtcgaccacatcgatgaacgactgaagagaaggggtcaaagggggttttgcggtccaagacgaaatcttgtctggttgttcctcaggaacaacgaagacaggatccgaatcttctatctgaagatagaacacctcgtctgccatttgctgcgagaggagggacactggaaggggatataacgcgattttaggccatcccgaagtcggaatccaacgcatccagataccctgttggattccatccaacgcaactcgtagtagaagcggaagagatcgagaaagggctctaccccaatgtaggcttcacaaagatgtgaaaaatactaaggctatagaattggggttcagatggagcaaagaaagaccatagaagtttaaaaccaagagaagaaattcagaaggtggagggagaaaaccgcagagaatgtagtcctcgatcacaaccatgcgacctaagatgggctggggttcagtacctcctgcttccctttccatggttccacgacccggaagggcgccgtcctcctgaagcttcttcagcgacacgctagtggaggatgatttgccgagatccatcgccgatcggagatcgccggagaaagggctgaggtcgacgaactagggtttcttgtgggagcggggaagacgaagaacgcttgcaggcgggaggttttcttcacaataggcgggcttcaaaatggatcccccaaaattcctttaaatagacgcactaccgacggtgcgaattccaaggaaaggagagagatagccgccggaaatttctgggtccgttacgcgcggcagtattttggacttcagtttaaattcactcgtgaccgttgggcttcacatggtgttctcgattacgtcctgtctccacggttctcgcaccgggaacaacaatagcctcgacacgagaagtcgcgaatggttacacgagttcatttaagcagaagtcgggggctactgtcagggttacgggttaggtataccctttaccctttgatatacgtcacatatcggtatggcatgcccacgcgcatacggatactctctacatacactaaggaaatccttcacagagtttacggacgaaaagagtcctactcggacaagactgggtcgtcaatgtatcgtgtagggtttgatgtctccgagttctacttggaaaccgcctgacctgcgatataaaagggaccccccagggaggacctaaggcatcaaatctcaaagccaacacaacccccacagatctagtcgaaccaactcgactacgatcttgtcggatccatcgaattccattgttccctttgtaacctgtgttttccatcatataatcccacgtcaactggattagggctattacctatcaaggggcctgaaccagtataatcttcgtcttttgtttgcttgatgtcgtattacgtggacccttgtaacaacgtactccaataccctctatatccggtctatgggtatcacccgtcgatagtggcgcgccaggtaggggcacttggtgctcaaggttctactactatgtcatccagcttcgtcgacaaca

SEQ ID NO: 59347 - DNA, 3643 bp, Oryza sativa
cacatcctcatcagggataaagacaaggaatgaggagcgacgccaacttcggatcgatttgttggggtaatcgacatcgatccccacgaaccatcagtcttgcacctcctcgaagactatggatcatcgacaacgagcgtgccacgggagatattggctattgatgatgtcggcacgtcacagcgcaccaatgcagaagcggagaatcaagtagccactccggcccaacacatcagagccgtcaacgctatactgagggaaaccccctacgatcccgttctgaacgatgatctcgcgcgttggacagaacgactacgggaatcagtgaccaacctcagcaacgcgttcgaagaggccgctgccgcagcgcacccagagcagccaccaactggcgatgccaatggtgaaaaccctgaacggagggaatcgcctcaacgagccacccctccacctcgcggcaccggcgatctccgtgatcacctcaacggcagccgagaggcacgacgcacacaagacaacgagaaccgttcccggcgtcatgtctcttcacggcgtcatgataacaaagatcgaggagaccgttcaaacgaagactgagaccgtgataaccgccacgatcacaacgatcgcgaacagcgggtgccaggcgatactggtcgaggacgtcgccataatgacgacgatgatggagaccggcgccgagacaacagcgggagacggcgacaggattctcgagagccaggccgacaacctcgtaatcgtacactggaaccaagcgacccatcgtcatcgtcattatcctcgtcttcctcatcatcagatagacatccatgaaggacacacgatcgccgataacccaccgcccccagcgctgggtgtagagctttcagtcgttccctgcatgatgtccgatggcctgagagattccgacctggagcaatagagaagtacgatgggagcaccgacccagaagagttccttcaagtctactccacagtactctacgttgccggagcagacgacaatgcattagcaaattatttgccaaccgcgttaaatggctctgcacgttcatggctgatgcatctcccgccctactcgatctcttcgtgggcagacctgtggcagcagttcgtcgccaacttctaaggaacctacaagcgccacgcgatcgaagacgacctacacgcgttaacacagaactcgagtgaatccttgagggaatatgttcggcgcttcaacgagtgcagaaatacaatccccgaaatcaccgacacttctataattcgcgccttcaagtcctgcgtcagagatcgctatactactcaggagttggcaacaagacgcatcacaactactcagagattgttcgaaattgttgagcgatgcgcccacgcagatgatgcgctaagacgcaagaacgataagccgaagaccgggggagagaagaaactagccacggacgcacctgagtcaagcaagaagaaaaatcgcaaaaatgggaaaaggaaagctcaagcggaagtcctcgcagcagaatacgcgaaccctcccaagcgcccagacccacaaggtagcgacgcaaagaaagcatggtgccccatacacaaaacggacagacattctttggaagattgccttgttttcaaaaagtcgctcgagaagcacattgcatttgaaaaaggcaagcgagtacgcgtggtcgaaaaggatgcggaagcggctcccaaggagtcggactcagcatatccagactctgacctccacgtttcacacatcttcggaggttccacaacgtactcctcaaagcgagaatacaagaaagtggaacgtgaagtctgttcgacatggcagggggctgcacccaagatgaagtggtctgaacagaagatagaattctcggaagaagaccaccccaagactgccgtcatcccaggacgatatccgatcgtggtcgaacccactattcggaacatcaaggtcacgcgggttctcatcgatggtggcagctcaatcaaccttcttttcgccggcactttggacgcgatgggaattccgcaaagcgaattgacaccaaccgattaaccctttcatggaattactccccagtcatcgtccaaaccattgggcaagattacgttgcctgtgactttcggccaagctaacaacttccgaatagagcagatcacctttgatgtcgctgaattcgatacagcttataacgccatcattgggagaactgcacttgcgaagtttatggccgcatctcactacgcgtatcaagtgctcaagatgccgggaccgaagggaataatcactatttaagggaatgcaaagctggcggtgcaatgcgacaaacggagcctcgacatggtcgagcaaacgcccagcccacccgccacgaccaagccacccaagaaagtgagcaagacaaacaagacgccgaaaccggacggcgcaatcaagatcgttccactctccagtgccaatcccgacaagaccgtcaagatcggggtgacactaagcgagaaataggaactcgcgctcatcaccttcctccgcgacaatgctgacgtgttcgcttggcagccgtccgacatgctgggggtccccagggaggtgattgagcacaaactcatcgtgcgacccgatgccaagccagtaaagcaaagactgcggagatttgcaccagaccgaaaacaagccatacgagaagagctcgacaaacttctcaagcctggcttcatcagagaagtactacatccagagtggctagccaatccagtcatggtgcgaaaggccaacgggaaatggagaatgtgcgtcgacttcaccgacctcaacaaggcatgtcccaaggatcacttccctcttcctcgaatagatcagctggtggactcaacagccggctgtgagctgttgagctttctcgacgcttactttggctaccaccaaatcagcatggcaaaagaagacaaagagaagacaacattcatcatgccattcggggtattttgctatgttaagatgccattcggactgataaccgcagggaatactttccagcgcacggttcagggcgcacttagcgaccagctcggcaacaatgtcgaggcatacgtcgacgacatcgttgtcaagaccaagacaagcgactcattgattgacgatctgcaggaaacgttcaacaacctccgacgatatcgcctcatgctcaatctagagaagtgcacgttcggagtaccatcgggcaagctgctcggattccttgtctccggcagaggaatagaagcaaatcccgagaagatcaaggcaatcgagaacatgaagtcgcccacaagactcaaggaaatacaaaagctaaccggatgcatggcagcactgaacaggttcgtcgctaggatgggagaacgagggcaacccttcttcgctctgctgaagaaacaagacaaatttgtatggacacaggaagccgaagaggcattcattgcactcaagcgctacctatcaaacccccctgtacttgttgctccccaacctaatgatgaattattcctctatattgccgccacgccatattccgttagcaccgtcattgttgtcgagagagagaaagtacaacgaccagtctattacgtcagcg

SEQ ID NO: 59348 - DNA, 763 bp, Oryza sativa
aaactagagaaaaggttcgatgggatcaaggttcgacacgtttaccgcaaggacaacatcgagccagatgacctagcatgacgtgcgcctagacgagaactgctcgagcccgacacttttctggacatcctgacgaagccatcagtaaaagaggttagcggcgaagttagcccggccgccccagacattggcgcggaggccacaaaggcagaacgcgccgttgccgatatcgagatcacagatgactggcacatcccacttatgaaattcatcaacagcgaggagttgcccgaggacgatacagaggccgagaaaataacccgtaaagcaaaaatctaaagtgtggtcagcaacgatctatacaaaaaagcgccaaacggggtacttctcaaatgcgtctcgtccgacgacggcagacacctcttccttgatatacatgaaggcatctatgggtcacatgccgccggtcggacattggtcgggaaagcttttcgacaagggtttttctggccaatcgccctcaaagatgcatgcgacatggtccagcgatgtgaagcctgtcaattccacagtaaacacacaaagctacccgcgcaagtgctccagactatccctcttacttggccattctcgtgctgggcgctagatatactcgggccattcccacgaggacagggcggttacaggttcctattcgtggcgatcgacaaattcactaagtagatcgaagcagtacccacgggggaaatcaaggccgacaacg

SEQ ID NO: 59349 - DNA, 8798 bp, Oryza sativa
  unsure (1)..(8798): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaataatgcggctagaactccgatgaatattgcataaaaacctatcgacttagtagaagtaaacttattagcaacaatctaatagatcggatctaaccgagacggtatacaataggatataataggaaaaacttatttagccgatagatctatacaaatgtgatggatgtaccagatcaaaccaagtgatcaagcaatgcagccttagccaaagctgatatgtcaagataggcaacgattttagcaacaaattagaatatatcgacccgaaccgagaaattaaagtcctagctacataaatgaccgtatttctaaatacctcattatctataaatagctcaatatctattgtacatatttgacccatagttggatcatccattttgagaacatagctgctaaaggagagagatatatagtttgtaatttacatgttataacttatagacttaaatttctgtgattacattatatagtcatgccatgaattatcacttttcaatccgtcttgtatatagttccgtattcgtttttggttttatcattaatttcgatcccattttctaggatatggaaatggttaaaggtgttttgcgaccatttctgactctctttttttcacaccggtgtgcatcggcaagagaacggagcggaccgaaccgaacgacgtgcgttgcgagcgtgcgtggtgtgccattgggtcatcggtggagcgagctaggtagtagcgcactagttgacctgaccccatatcttcgtgcctccaaatttttccgttctatgcacggcatggttgtgggcagccttgactaactggagaaagcgagcagcaccggcactaccatgcatatagatttctccatgtatatacccaaaagagcaaccgcactaaaacccaaaagagaagtgacgattgtgtgggtgatacaaatatatagaaatagactagacactccatagcattattatcactactaaaaacgatttttttcatggtgtcacccttttatttttattgacgggttaatgaaataaacacttgtaaaaatgtattgaaggattttaggtcatgaaccaccagcaaaaaaccaattttcaccgacgaatgcttaggaggtctgtaaaaaaaactctattttttgaagcagacttcttaagtatccgccaacgaaaattgatgtttcgctggcattaaaatcgcacagccctatggcccactatccatgccacccactaaatcctccgtctcntcagctccctcctcccttcaacttccccacctccaccgtgcctgcgtgccacacgatggtgatgatgccacggcagcgatggcgatggcaacgggaggcgggtggcggcggatcatgtgacgagaagggacgaggctggtggcaacagcgatggcaagccacggatcttatggcggcatattcggtggtgacggtgcctggatgccacagatccagcagcggaaggggaggaggcggtggcgaagatgacgacaagccatggaagcagtggtggcagtgacctcaggcatagatccggtggaggtgacaggtcccatggcgtgggtggcttcgatgaggctccgacagtggatccttgtccatggtgttggcgaggggagctcgtccatggcagcgatagacgttgtgacggcgacgaccactcctccttctcatcggcgatggaggaaagagactaggagagggcagcgttgctcggctcggcttgttcaacgcgattccagatcttgctgagctaagtcctccctttcccactccacctatgacgaccaccgtcggtgcaacgacaatgatgaacagcacggcgacgggtgacggcgatgctatttcatttgcatctgttattgttgtttgcaaattgaaaatggagtgaaaaatctatgtagtgctatttggatatggatttgaatatggatctgatgaggatttgaatttggatctctagatgtggatttgaatatgcaatagcttctcttctcttaatattgattaactttttattggaaaaataacctttttgctggtggtcctcctagtagtgctgcatgcgaaaatcgaattttgcaatcggtcgtcttaggggctcgcaagcggaccgtaaccgctagcaaaaatcatcgatttttactggttttaggtcgctggcggttgtgtcagcctcctatgaaaacatattttggctgccggaaaacctatttttttaagtagtatatgctcaaataaaagatactatgtaaagttaaatggaggagccaatctatctggccttttctctcctcctcgatcgagctgtctataaataccgacttggttctaagagttgtcataacatctcgatcagctgcgactgcgagcagctaattacagagtaagggaagttggtactatacctgtcttggccgtttcctttgctggttgtgttttgtgcttgcattcatggcgaccttcaccgaacgtacccgtctcctcgcggcgctgcttgtcgtcgtctccgcggtgatcatcggctgctccgtccacgtctgccacggcgcccaagagggtcagctacctagcttcttccttcccctaaccccctctctcagctcattttgactttaatttgcatcagtatcatactaacaacagcgtactactggacgtttaattttccctgtcctctcgtccgtccagctgacctgcaggctgctggctactaccgacgcggcggcagcatggatgatcccgacttcgattttccctttcccggcccccgccatgttgtgtgcaacgacgggccttgccgcaccggcccaggccgattacgtccctacccctttccgcgacctttgccgtaccgtcagacgccgccggcgccaccgtcgccgccgctgccgccaccgcagaacaaacagatcccgcctccgtgatgaattgatgatgactgttcatgccggccggccggccgtcatgatgccacttaattatatatgcatatggctaattaagtacgtgcgtgtgataaaaacgtacgcacaccagagattacatacgcatattgtacgtgcggcgaacggccgggcgctagctctcttgagcggggtacaacgctagctacagcacactattgtgttattactaattaaaaacgaataatgcccgtcccgtgtgcttgtgtttcattagctggaatagaacaggtgtgagcgtgtaactatgcggtctaaaaaggaaataaaagactggtgttgtcaatgctaagagcagtgtactcttccaatgctgatagtgattatggtaattaatggcctatcacatagtatcaaattagatgtggcaaagagaattactgagataggagaaaaagcataccatttctttgcaaatgaggcactaccaagacacaaaccaacacaaaaaataaaaatagtactaggcaagtaggcatcaaggtggtgtcaaactgtcagtgtacaaagtggctgggttgtttgaattggtcggtggcaaaaggggctattttggttggctcccacaacttgattagtattatcgcatcttaagtttggtacatgtttaactgattcaggtggttgtttggttcatagccatacttatcacaagatgctttctccatcatgtaagttccacatgccattgaggtaaaaaagagtagctcaagctagctaaactgttgttctgatattgctaaccacgtattacataagttagctgaaaacttatgtcatgctctggtaatttaaagtactcaaccaaacatcccttaagttttgccacaccttgctttgttaaaggtgtggtatatatcccacataaagtgtgaccctccaatatcgatccgtcaccctaatgcgataacagaaggtgggtaggtgcagcgcgcgtacgtgctcgtggcggggcacgctgccatgcgtaatgaagtagcttctcccgcgatggtggtgagtgagcggaagggggagatcacgaggagggatcggttcaggtctcattgtgcgacgcgaggctacggctatcgctcaaagtgcataaggggaaaacggacgtcacggctcggtgtctcctccgccctcttcaaatccctgtccctccgccgccgccaatgccaacgccttcctccacactgccgccagtcatcgccgcacactcccgcgccctatggtcggcgccgtgcaggcagcacagcaggagctcgctgccatccccaccaaaggcatgagccgactgcccgagagtggggacgtcgacgaggtggccaagcttctattagcgatcaagttgtgggggctcttcgcagtgaccggccacatcatgcggagccgttcctggacaagatcctcaccgcaacgagggagttcttccacctatcgccgaaggagaaggtgatgtacagcaacatggtcgacgccgacgtggcggcggtgagaggttccttcctgaggtctaccgcatcgaccacatcgacaccaacaggcagatcctcaactggtgcgaccggctatacctccaggtctagccagaggaggaacgtcggctggatttctagccagaacacctgctagcgctccgaggacttgaagaatacacaagaggaacgaacacgcgtggcgatggtgtctcgctcccctgaccagttggttgggtcacaaaagccattgccgatcctcatccctcatcctctgccgacgttgacgactttctccatgctgttgttggttgccgctattcgcaccctatggcctcgcgcgccgcatgcagcgtctgctcccatgccaactccctgttccagccaccaccgcgacaaaaactacagcgagaaacaaagagaggagaaggagagaaataaagagatgaagagagagataggtgaagaggacctaacatgtggggcccatgctgaaaagcatggttgactcagtcaaattaccacatcagacaaaattacccgctacactgccctgtgacatatgttgcaccggttttggcagctaaggaatcgttgtatctgctatttcggtttaaggacgaaaatcaaacttgctgtcaagttaagagacctaaaataaacttattcattgtgtgcgcgtgcgcctggcccatcaccctgcccgtaccaacaaagggccatcagcctcgatcccccggctcctgcgtcgtaggctcgtaaccatatctccgcaaaccccccggacagtacacccgccggccgatacctccgggaatttttttcatttttaaaattttcttttaaaatatttaattaaataatctatcgttggaaaaatttacaaaaatagaccctgccgccctagtggagggcggcaagctgatgtggcagacggcaactcgacgggcggtgacggccgattgaaaaagttgaattttttgcattaacacccttgccgcccactgccagggcggcaaggggcctccatgcaaaaaagacaacccgggaagggccatatcaacagagctggaaagaagcatttgatttggttttttttgcatctaggtcctttgccgatgaaaaaaaccagccaaatgcttctttccagctgggcaaaatgcattacgcctgtaaggacggcaaggaccaaagcgcaaaatgcacaagtgacgccgtcgagccgtcgtctgccacgtcagcttgccgctctccactagagcggcagggtctactttttaaaatttttgcgacaatagattatttctgtaaatattttaaaaaaaattaaaaatgaaaaaattcatacctccggtgggtccgcaaggtcgtcgcggcgaggcaggagggctggaggcggccgtgtcgtgtaatcccgtcatacgcataacgcacctacgcatcgatcttccagttttgctactcggccaaaccctttacccgtgccgttgtttcgaaaaacctgcatccaacgacggcatgatgtactttgctacttatctgttttgaaaaagctcacacgcacaagtgtttgggtccaaaagaaagtgcatatacacaaagcatgccatgctttctacttatttgttttgattaaataggggaaaggtccgccctcattttataagtggatagatttttttcacgtgtggatcaaatttaaccttaaattttatatgaaaaattataaaatccacctcataagtcagttaaaatttgacatttcacttgataaatcattttattcgaaatgctcaatctttagtcggttttaatataaaaattaaaccaccctaatacatatgagcttaaccgaatcagcatgttatcactaatgtagagccacccaagctaagctagccgagtcatccttgtccaaatgcttgtattagacttattctttatttttttcgtcatatagcgaaactcagtgcaacaacgcttaagcactcatcaaaaattctatttgagtactctcaaaaaaaaatatcaagactatactcctagaaatatttgattttggtataaaccatattgacacctcacagtttatgaaaacgtaatgatttggttaagcacatgtacattgggggtggttttaacaacagaactaagtagggggtaggcattcgcagcaaactaacttacaaggtaaaatgtcaaatttcaagtgatttctaaggtgatttttgtaatttttcctatttttgtaaagagaaatgtgtgctgatatgtcatacgtgtggctaattattattttggtggtatgaaacacgggtgctggtatgtgtgacaaattattcttttagtgataacctacgtactagttaataccaagatgtttatgttaactttatcaatctcaagatatatcagtcattctctcagttgtaagaataaggtgtacatgtatgttcgttgcacatttgacaaaaaaaacccttagatttgagagactttttacatggctagaactgtatcgagattcaagcattaatagtaactgtatactctcaacccctttttctcccacacattgcttggcaaaatgggaagaagcgagctcactggtgatgcccaccccacctccaaccctggtcggcgcctaatggcgcgaacggcacctgctaggcccgcccactcggcctcttcctctcccttgtttaccttgcccctatctccgaagccggctgcgccgcttgctcgtgtccaccgctcaccgccgccgccggtcttctgcctcgcacagctaaaccttgttggttgggccaccggtggaacttaaggagaaggagaaggagtcagcacaaatcttagcatggacccggtggcccaaaatcagatttctgacagaaatcccgtaaatttttgttgtactaaggcgcgattaaaaaaaagaagtgtatttttccagaactcttcatacgtaattatttagatcgtatatatacaaaaagataagcacacatgctgtcaagagcttaataagatccactcccttgactaataaagcaattgtcaaggtagaaagccaaaagacattggaaatttagtatccagatgcccttagatttagactctcgggcccagtttgcatggagagagacgatcgagtaacagtggcgagcagatatgcctataaatacggccacccctgaacaccatcgaacatgcagcaagaaagccagcagaatatataagctgtgtgtgtaacgactaacgactcaacacttcgagctgccgatcgatcgacccagctggtgatcagtaccgcgcgcaatggcgtccttcgctcgatctgcccgttccctggcgctcctgcagttggcggcgctgctcgtcgcctacgcggtgatcaccagcaccgccggtgatttctccttcttcttcgtccttgctgagttcgcttccatgcacctgattgtgcaataccctgattttgtcttcattttttcatttttgcagagatgttggtggatccaagcgaccctttccagcccaatgatccgggttcgggctggctcgaccgagttccccgtgcggctgccggtgtcgaccgcgttcctcgcgctgcggccgccggtgtcgaccgcgtgccgcgtgctgcggctgctaccgtcgaccgcgttcctcgtgcggctgccggtgtcgaccgcgtgccccgcgctgcggctggtaccaatcgtgtgccccgtgctgcgggcgatcacgaataagcgagtcgcacagccgtgatgcatggctgattggcttctggcccgatcgatcgcgttcgccactacttcgcgtatacaagtaattaatgaaaggaatagcacatatggggtaatcagatagtagtaattaagtaactggagagagtcagcgaggagggggcttgcatgcctgtcgctagtagcagaacttgtgagttgtgatgataagtacgaacaaaatgggaggcaatgccggctggctgctcggctatagctgccttctgatatgagtgagtatgttatattgtaattagcttcagtttatcagaatataaacttcgagtttcttacgtgtttctccatatttagccgtgtatagtggatatagaggccgaattcatttccgttataaaaagtaatgtgtttggctatatatacaaggctacctccttagactatgtgtttcgctata

SEQ ID NO: 59350 - DNA, 6844 bp, Oryza sativa
gcgtcatctattaaaaaattgagggagtatatatatcatgtccagtataaaccagacaatacataagtccagaaccatggacctgggcaacatctcaaaaatttgttagctgcacaatatctctttaagatttcacaatgacacatctcaaaatttgttagctacctttagaattacagcatcatgagtcatacatccaaatcaatctcaatcaatttgcctaagtgctaccgatggcaccttttccttgatgacaaaaatcaagattacagattcaatttgcccaatctcacaatgccaacaataacaattcacttccaattaggactctgtatcatcccaggaggcagggcaggaccaggcttcccagcggtagccctgacggttgcatttcacaatagagaaccacacagcctcaggggcatttccacaaacaccttgcgggcactggaaaatttgaagcattctccacaaacgacacagcctcctccatgtgccgtgctcgggctgggaggccgcctgcctgcaccagcgcgtcgtcaggcccggtggccggcgcctcacgcgcccccggtcgcagcggcagggcagggcggcctagcgcctccccggccgcctccacgcgccctcggtcgcggtggcagggcagggcggcctggcgcctcccttgccgcggcgggacgacagggccccggccagaaagccggacgcgggcgtggcgagtcgatctccggtcacggcggcggcgagcctcccagctggctcgcggcgacggctggacgcgggcgaggcgagcgcggacgcctcgcgcggtgctcgcccggtcatctccccactcgcggcggtctccggtcacggcggcggcggcgagtctcccagctggctcgcggtgacgggaggcaaactggcgaagcgcgtgcgcgatggatggatctgggatgccgtcacgcgctggaatggatggattgggtattattttgcacctgcaggtggacccaggcgcccaggcggcatatccgttggatttgtttatgatggtccagatttacccaatgtcatgttgtgacatagctaggcaatgtcacccaaaccgactccgttacgttatgcgaggcttccaagttcacatcgaatgtgataatgattgttgttcacatcctatatcataataagtgctattacaggcagtcaggcactaatgtgcaagcctacaactctacaagagggtgggaccaacgatagtgcggttatataagagaaacttcagccaaggcttcccttctcagaccttatttgaagaaatttaaggttcggagaagtaactgattggtctctaaagaaatttaagcttctgagatctaaagatgttggttcctagtttattttctagattccataattattaagaatctaaataatgatatgtactgtttgaaggagctaaagtttctcttcaattgctagaaactcttcaaacagaggaccttgctctctcccccctgtctgtagacacatgctatagcctatagccagacgcaaaataacacatccgttgttcaatatagagagtatgatataactattgcaagtttgcaacttcctccagaggcaggttctatcaattttgggttgctccgtgttcgagagtggctgtaagcctacaacagttagctcaactgtttttgtgaatgaatagatggtctgaattccatcgtccatggttttttttttctataacaccaggataggctgctaaaggctcgaatcgtttattatccagatgccttactggccagaggcatgaatcgatcgttattctgctggtttgctttctccatgtttgcacttgcaggaagttccatggccttgccttgtcatctcatttccggcaacaaggaagtatgcagtgtgcctggaggaagagagcagtattaagatcctaggacaaaatgtgtaagcttgcaagaattcagctgtagcacagacctgaaaaaatacatcattttggtttttgtggcagcgtctatgctgtcagtagtatccacagcttgctgcatatggtgcagccatcgctctgcagcctggtgggtaacagggaatggtcgatgccgtgctatcagggcaggatgtcctacaaagaaaaatcaaataggcagattttaggtcaacaagttattcaggcggttgtatttgatacatgtgctgatgtgcacagtgacagagtgatctagctgctattggttcgtaacagaggaaaatcagagaacacatccaaaatttactcaagggcaagttacgcgaaacactaagtacaagcacatattattgggcatcatcacacaattcttgcgccaatatagatcaactggcagattggtgataaatcagcagagccaattgaagagtgaacatctcactaaaccattatgagctcccagctagatgttgttgaatgctgaattgctgatcatatggatgtggtaaaagaatgagatcagaagaaaattcactggtgatcactgatcagtgctggtatacaattggattacagaacaatgaagatctttatacagggtctgctctcttgctcaaaaaaaaaaatcactgtactgaatctgagattcacctccggcaacggcaagtactatgaaaaagcaatgatactaaagtaaaaggagaacaagaaatgtaaatcatagtgagctaaattctaccaactgtacccaagaaaatatgttgcggaattgttgcggaacttggctattagcttgtaactagtggaattgttgcggaacttggctattagcttgtaactaaatctgggttaacttttctcaacaagtaaaacgataattttcctcatatctcaactctttcctccacagccaacgactagctgatgcacccaaccatcagtccctcttgagagttgagacatccgagcatcgccaccacatgtgcaaaagtacgagctgagctttcgagtgggagagagaagcagagtgaaatcaagttagttacctctcctctgggagaagagctgcgggccgcccatgcgctgcaccaagaactcgtactggttccggatcgcgtcctccttcttcgaccccgcgaagatctgccggaaccactcctcctcgtcctcataaaccctgttgactcccccaagaatcagagcccccgaaatcgcgagcaagaagaacgaaccagatcggcggcgagcgagcgaaagcaagcgagacctggtgtagaagttggtggagaggtcgacgaacggctgcgtggtgccgcccagcgcctcgaagacgttcccatcgtcgatggcgaacgcatcccccgccgccacgccgctccactccgacgccttgtcctgcagcgactgcatcgccgccgccgccgctccgatccccccaaccaaacgcttggctgccgtgaggttgactcgtgcggtcgcggtggtggtggcctacagtaggagagagagagagagagagcgcacacgccactcacttcaccgccttttatacccgccggccaatcgtgaggcgggcatgcgagggtgcgggccccgcagtggagtggggcccatctgtcggcaagtgggggtgcccaggtcatatatgtcgacacgattttgccatgggtgacggcatctgccggcgagtggtggtggtgcccacggaatccgggctgaaaccgtttagcaagagtagcacgcggtttcgcgacttgggttgcatacttgcatcagccacttcttttttttttctcttttttttttaagaaaaaagcattgcgcccagctttactggaagaagattgttttttttttttttactggaagaggatatggcgtggatagtcgaactggtgaaattggaggaactacggattattgagctgtactccatccatcaaaaaagaaattgacgtaaccaagtagaaagaacagggtacaccatatcctatcatacgtttgagaggagaaaaagaaaagatatgcaaaactagcatatgattaatggagtattaatctctactattataaaagttgaaaatgttttcgctgatattttgatacgttgttcgtatttgagtcagtttttaagtttgttcaccttttgaaaatacgtaagaagtcatataagaaatctttttaaaaaactttcatgttaatttgggacgagagtcggactcctatttcctttagaattcttgccaaatcataagaaaacaatgtataggatatggccatcatccccataaaaaattcaaattagatatcaatactatcaaaataaaaatccaatatactattttttacattaaaaaactaataataatatgattgaaatagcctttacctattgcaactaggggtggacgaaaagctcatgactcgttagcttgctcgactcgtgacaagctcggcttgacttggttcggctcattttatttttctacgagccgagctagcctttcagctcattagagataacgagacgctgagataacgagacgctcgcgagccgtaacgagcttttgtaaccagcagcagcaggcaccctacaaagcccacaagcccagtaggcccatcagattagagcaaaccctaatactgatgatgtctctcgagtctttgatctattctctcctcactccatcgctccgccgccacaaacatcgcgttcgcgtcgcgtttcgcgtgggatgctccagccgctcgcgccgctctccccagcgctcgagtctcgacgtcgccgtccgcccgcaacgcccgacggaaccagcgctcgacgtcgccgcccgcctgcagcgcccgacggcctcagcgctcgacgtcgccgcccgcccgctgcgcccgacgccgccgctcgcccccagcattcctcctcacggtccaagtgccggcggaggtcgagctcgtcccatccaccgtcgagcttcttcccgtggtcgccgacgatctcgagctcgtttccttcaccgtcaagctcctccccatggttgcagtgccggcgaggtcgagctcgtccaatccactgttgagctcctctcgtggtcaccagcaagctcatccctgtggtcgccggcaagctctccccgtggtcacggcgccggtgaggttgagcttctccctgaggtcaccggctaatttctctattgtccccaaagctcgcgagctaaacgagctagctcgagcttgcagacgagccgagccaagctaggtttctagctcgttaggataacgagaccgagccgagccagctcgacatccacccctaattgcaacgcacggacatgtttatagttattttaaattttaaaagtagattactgtaatttttaaaacaatttttatgtagattttcttaaaaaaatcctcgttcagtagtttaggatgtgtttgtgcgaaaaaagagtgacttttcagctctttgcccatctgtagaacgcatctaagtgtgatgaggggataagtatactacaaataacattatcttacattgtaatagaccagtctcatgcaagtagggataaactataaatgtgattagaaaataaaacattgaatatatatggtggctatgtatatagggattagctctacatttgttgtcaaattttaactaaaaaatttgacagatgtaattatagtataatcgtgatgtaattacagtgtgacttacatataactatagtctatagtttaacttatacgtaacttttaaaaatccttaggcgacatgaaaattcagtgaaaacggaggtaattgtaccgaatcacctcacatatgcgtgggttgtgattttttcctacctccattgcacaaattttaaagcaaatcgaacggtttaaaactaatttgtagttacaacaagttacaatataattacactatgattatgctatatttacattatcaagtttttagaaaaaaatattatcaacaaatatatagcaaaatcgttatacctatgttatactccctccatcccaataaaaattaacatagcaatggatgtaacacatccaaatattatgaatctgaacagatgtatgtactagattcgtttattttcgaatggagggagtacatgtgtaggtgtgctgcacgtggtgtgaggaggttggaagcatgggtgaaaacggtcagaatcaatggcttctcttcggaaacgacgcttgatcggctaataattgaccatatttattatttaaactactcagtgccgatattaatactattttagaaagaaattagaaaaaacacaaattttaaaaatagtacagtcagaaacggtaccctttatacgaaaaatgcactcgatcaggaatttcggtggacttaaaaggagtacgacaccgcttttaagctacagcgtcccgtaatagagatgagagaaggggagggtacctacgagtttggaaaaagtccactttgactcccttaaatataggtaaaatctaattcgtacccctcaactggaaaaccgggtaggacgactcccccaactattgtaaccggtgcaatttgactcccttggcggttttggagagtggttttgctgacgtggcgctgacgtggcaaaattgacccggtcttcgtcccacgtggcattcgaattaaaccaatatatgtgggacccatctgtcattcacaagaaaaaaaaatatattgtgggacccactgacatgtggggcccacatgtcatcatcaatctatctcttcccttcatcggtttgcaggggcgggagctagacaagcggcggtaggcaggcaggcgactgaaagtgcatctaggacccctcatttattttggtgttaatgacaacacaatt

SEQ ID NO: 59351 - DNA, 955 bp, Oryza sativa
ggctgtttggacggtttggtggaggtggagctgaatacggtggaggtggtggtgctggtccattactccaagaatttccgtcagttctgtacacagggatcttattagttcagggtacatctctcatacatttttacatgtttataagcaaagagaactcactgtagattgtttatcttcttaagttgactaggaatccagccagtgaaatgattgtttgcaacattcctataggaaagcaaagatatgagatgtggtactgcacgtgcaaataaaatattaattacttataggttgatttcttacagatcatcaagggggagattagcaaggacattgatataaccagtaaattgattgttctgcagatatctgagaagaacgagtatgggattacaggcatgtcactccaaaaagacatatctatgagagaaaaacaatcattttcttacaatttcttcaggcttgacaatgatgtgaacccttgtggtaggtcaccagcaagagaattaaaggaaagatccctgcatcacatcacatagggaaatggaaagtgaatatagacattaggaatatgaacaacaaagaaggattttacaatacacaagttaagacccgtctacaatccacgcacacaaaagtactcacagtgttgtcaagctatagaggctggaaaatacatcagttatatttccttgcaattggttatgatttagatttctgcacatacaaagagaaaacatttagctctaccaaattatacaaatttaaaagcaaaatcaacttgatgtttgcaaagatactcacaaatacttaagattagacatcgagaaaatcgagtagggtaaatttccagtgaactggtttcctgcgagattgctgcaaacaataaccacttagcacacagacaccagaaaagctgatgtactttctaaaccacaacttcatttgagga

SEQ ID NO: 59352 - DNA, 1295 bp, Oryza sativa
aatgctgaacagtcataatcatccagcacaaaatacaagatattcgttttatatctcttacatactccactgtacataaacttgctgttctccccatcaagccatcaatcttatatatatttacagaacaaatttgcacattagactgtggctaatcacgcttaacatcaacacaagctcgagaaaacagcatcgtggaaagacaagtggctaatcacatcagtttgccacccgcacgccatagttttatactacttccatcccagaagactgcagttttgcattggttgtgttcaacatttaccatctgtcttatttgtaataacttttatgattagtatccttattgttattatatgataaaacatgaatattactttatgtgaaactatttttttaataagatgggcgatcaaacttgaacacgaaaaaccacgactacacttaaattggggcagaggtagtagagtttagagtgatctaatgcattatgcatcgttgtctagaggtgacacgggccgacatgatgcccatgtccttcctccaaggagtagatgatgcgctcgaacgcctcgacgtggtgctccgccacggccatgaacacgtcgacgccgcccttcgccgcgcgcgacgggacgaacaccatcagcccctccacgggcaggtccggcggcaggaacgccgccggcgagccggtgccgaggtccatctggtggaacctgaacccgagccagctatccacctccaggtccgggcacaacatcgtgcccgccgccgccgccgtcgccacgagatccccgccgccgccgccgcccgccgccgccgcgccgccgaagtcgacgaacgactggatgtactcgccgtcgaccctcgccacggcgtcgcggatggcgcccacgacggcgccgtaggtggcgcggaggagctcgcgcgcccgcatcctcgggaacgcccagagcaccatgttgccgaagaagtccatgggcacgggcgggttggctctgccccggcagttcaccgccaccctcacctgcgtgaactcctccgggctcaggtccctcgccgccgtgatcttcttccacacgtgcgcgagcaggcactggaacgtgctgcaccggccgccggcgcgggccttgagctcgccgacgaactccgccgtgaagtgcacggtcaggtccttgatcttgtccagggacacggcggcgtaggacgacctgccgccaccggcggcggcggcttctcctccgtcgaactcgatggaacggtggtcgaacgccggcaccggcggggtgcgg

SEQ ID NO: 59353 - DNA, 3676 bp, Oryza sativa
  unsure (1)..(3676): unsure at all n locations
aaaatgactaaattcaaatcaatttgggaaataattccatgttctaaatggggaaagtattctaaactcttgagaagacaccaattcttgtttgcatgccactcaaatagttatgcaaaaatttgaaaaaaagatcaacatgatagtttaatatgtgcttgatcattacacaagcatgcaaaaataaaatttaacttcaacatgttgcaacgaaaaatacactaaaattcaaatcggtttaggaaataattccatgttccaaatgggtttagagaagaggagaacagaaaaaaaggaaaaagtacaccgaaggtccctcaacttctcatcgagttacaaaatcgtcccttaaccgcaaaaccagatatatcacatctttcaacttacaaaaccgttcactttacatccttttgtggttttgatcccggttttatctaacgtggcggatgagtcagcgtgagacccacgtgtcaggtaccacgtcatcactctttctctttcccctcttctatcccttccttctctctctaatttctccttcgtctgggcaagccggcgggcggggcgaggtgggagaagaggtcgggcggccggcgaccggcgacgggcgatgcggcagcggcggccgcggcggcggtggcgatgacgacgacgtgggaataggagggccgccccctatgccgccagcctccgtcgcctctccaccagctcccatggatgatgacggcggcctcctcgctctccccgttgcgctccccatcggctcctcatccttcgtgctccgtgaggacggcgtctcgcgcgccgctgacgaggctgccgccccgcgctgcttgccgctgctgttcgatctgaacctgccggcctcgtccccgtcggctgctgccgccgccgaagtcgacgagatggattggtgttgcgacacgctgctccacctctagcctgcacatcaccaaacaatggcagcaatcgccggcgaactctagcctacgacgacgacaacgacgaccaaccagcaagcaacaagaattggaaatttgttactgggttgctgcgctccaatccaaccatcaccattgttgctgctgctactgcgaagaagctctaccatctcctccatagacacggataattttctttttattttcgttttcctccatctctttttcaccactcaagatttcgtttacagcagcatatattgtgaatctctgtatccaaaggggatgctgctgctttcagctgtaccaatagctagaaaatggtagagaagatgataaaattatggttcaaaatttgtaacgtaaatgttatcggaagacgacggggacgaggcgggcaggttcagatcgagtagcagcggcgagcagcgcggggcggcggcctcgtaggcggcgcccgagacgccgtcctcgcagagcacggaggaagaagagccgacgggaggcgcaacggggagagcgaggagaccgccgtcgtcatccatggcagctggtggagtggcgacggaggccggcggcgtgggggcggccctcctgctcccacgtcgtcgccgccgccgccacgtcgcccgtcgaggtcagctcagccacgagagagagaacgaacagaggggcgggcgtcgattgctcacagtgtatcagaagcgtgcgcgcggaggatacggtgaggaggtcgacgagcgacgaccggaagtcgaacacccgcgcctgcacgacgatggcctccacgaatgacgcgtcccctgcgcgcgacgacggcctccacggtcgcgcccacaccctctcccctcctccatgcttctacgtcatcgtcagcgccaccggcagcagtagcctcttctccgccggaagcggtggtggtggtcaatcaccgaagcaagttagctagagtcgatcggctcggtatttgatttggcttcgattgcttcgccgcgtcgaggccgacggatgagggggacggccgccgcggccatccgcgcgacggcatccatcggcggagccgcccgtcgcatcggccctcctctctgccgcgctccttccccgccagccgccggccacgccggctctcctccccgccgcgtcgaagacgccgccaccatccacgcccagggaaaaatgagagaggaagggagagaagagggaaagagagagcggtgacatggacactctgacacgtggggcctaggtgggtcccacgctgactcagactgccacatgagacataaaccgggatgcaaaaccgacctaatagccttgaggttattgtaagttagagggatgatgatatatcatggttgttgcggattgaagtaatgattcgagtaagctcgagtaacaacgttgaggaacccttcggatgtacttattcccaatgaaaaaaanagaagaatgaaggccccgattacagataacggcccaatataagcagcccaatgttcaaactgggctgtacgatcagcgctcgtcggcccagatctaggcggagggggaacgtgcggggggcccacaggccgaagcagcgtcttctccacaagctcaggctcgcctcgccacgccatggccttgtcctcctcttcgcacctcctccccttctcccggcctcccgcgaccttcccacgagcacgccacgccggcggcgggaggggccgagccggcgccacggggaggttcatagcgtgctcctcgccccctcctcccgacgtcgtggtcacccgcgagcgcgggaagaacgccaagctcatcgccgcgctggtttggttcccaaatcgacactcctgcattgttcacttgtacctaacgcatagtttttttttgggtggggggtgaggggaagcgtaggggattaggggattagcaatagagatggagaatacgcatcttccatttttgttttgtgataccctgtgagatcgtcgcgtattttagtgttgtgattttaggtggcctggccgactgtatagagggaaatttacgggctaattatactgtttaggacccgggaggctcactaattggtgcgagatttcagttaatgtactgatttccatctaggaaaaggttggcgtgtgctggatatgagatatttggtgctaactcgttgaacatggtgccgcgtgctaatggaactcaccattcatgtcttcaactggtcggagcttggagtttagagttagttgttttgcaatacagttcagttttatctgattacaaatgcaatgcaatgctatgttatggaaaccatttgtcattttgttagtatcagtctttcatgtaagaacatatcccttctttcatccatttcatatgatacaagttgggcatatgatctgcattgcctattttattccattagcttagagaagttttgtggatggtatgacttcctctctttttttttatgatcattgacctaataactttaatctactattagtttattatcttggatcacagtatatgagatctttacctttattctcagctgttgtttagcgtctcatgaatcacgatacatcattaatacggagtgtgaagtctgaatttttctgatcatatctagccatattctaactgctatacgtattcaactgggccatagatggttgttactccaatggatttgagaacattcctacattgtaatacttgtgaaaaggtccaattgacattagagt

SEQ ID NO: 59354 - DNA, 5539 bp, Oryza sativa
tcacaaaactacagatttaagaacttatttcacaaaactacagatttagtgtctacgtttatcacaaaactacaggtactttgcacaatacatcacaaaactacagatttaagaacttgtttcacaaaactacagatttaatatcttcatttatcacaaaactacaagttcagtgtcttcattatcacaaaactacatgttttagcattgttaaaacctgtagttttgtgataatgaagacactaaacatgtagttttgtgataaaagaagacactaaatgtgtagttatgggataaacgaatacactaaatctatagttttatgaaacaagtttttaaatatgtagttttgtgatagattatacaaagtacctgtagttctgtagttttgtgataaaagtagacactaaatatgtagttttgtgaagcaagctcttaaatctgtagttttgtgataaattgtgcaaaatacctgtagttttgtgaaatttactcaaaaatatatctcacgaatttaagctagataacatttctcaagtacctgaagaccatgtgtacaataaatgatttattcatgtgcattagatatgctcagcagcagccagcaagctatacaaagaaaatatcacattgttcatacttctttgaatggcataactacgatatttgtaacagatagcagatgtttcactcactaaatcaacagtacatagaaaaaaaaaacatagctaactaactacttgaaacaactgtttccgaaggaaaactacaactaagcactgacatgatagctactaaacacaaaaggcaaaaactcaagttaaaatcatggaatacttatcacacatccataatgtattttttaatagtgccactgctaatttccttcctatttcattcgacctgagaactcaataaactaatgctgaaatagttaaccttccacaaatcaggcattcaaattcatgcaaaatggaaattgctcaagacaaatgatggaaactgctatgttattttacgaatatccagacaacgtgttgcagtgagacattaaaatgctatgcagattcagggttgccataattaacttcttctccctggtaagacctcgtcaagcaaaagccaatcaacatgagctgcatctgaattcaatcaacaatgttagaagcagttgtgttcgcctaatttttctgaagatcaatcttgttatctgttagagagtaacaatagacccccactaatttaagtagcagttaagaacaaaaataataaattcagagagaaatgacaactcccatctaactctgcttaccttgcagaagcacaatccaattattcattgaatcctaaacctacagcaggacactactattaatatgtagtttaaatcattagtactttgttcactggaaattatgcaaaatcatagatggattattgatatttattgaactaaaagcatgatacataacattcttgaacttgggtccacattcaacatgaattgctgtcacagaaaaaggagaaaaaacagagtatgcattctgatgtggctgccttgccttgccatctaatgtattctgatctggctaccttgcattgcgcctgacaccaatcaatggaaaccatgacactaagacagagagggccatctcttaccgacaagaaggaaccatatcggggattgcaatttctctgttcatctcgaattgcaacggaggagttgcaggtgaatatggcagcgactgtgccatttccgtggtccatccaagatctcatcgaacctagtatttgtgcttctacacctgccatccctaatcggcggaggagatagagctcagctgctcaggaggcatcagcaacggtgaggaggcagccgacagggggacagacgccagcgatggtccactgatccggcgaagcggccgaccgctcgaggggacgtaatgtcggcgcggggcttgctggtggtgacggagctgagcgtggtgctcggcaccgtggtcacgctccttggacccgtcaaccttccctccaccagcgggcggcgctcagccagacattggtgagccgctcgagttagaggcgggcctcttcgtcacgggcgacagcgccggtgcgaacatctctagccctagccatctttgacgaccccctccaccatcggcctcgctgtggaacgtcttttctagatctggacaccatgtctcctcccgatctgctcttcctcgacctcgcggcttcggaccggtgccatcgtcgtcacctccaccgccgtcaacctgggggaccacgccggcactccatctccgactcctcgccggcgatcgatctcctgacagaaggggatgtgcaggccggctgcaagagcggaagagaggcggctagggtttgggagggtggggtgaggggtgggcgccggccgccaggtggtagggttgttcgtttttacaaaaaaggccactcacttgttgttatttaaagtgcggcctatttttcgttttttttctcttcttagcataagatatttcaggtcttggagggccttaaagtaagaatacagaacacataaacgaagacaagggacttatcacagattatcaataatagcaagggctttttttgtaaaacgaccagagtcaacgcgggcctcccgctcgctcgtgaaattcggctgcctggagtttcggggccgacgtggatagcacgggaaacggccacgcctatgcaaaacgctatggaggcgccaatccagggcaggtttaaatttaaccgctgtctctaactctatcatattaaatatcacgatcaaggacaaggtcacaagggccatcaagattctaaaattttatacacgtatactagggcctatttgaaggaaatctacagcaattagttgcagtcttgtatttctagacaaactttatgtcaaaaatcatttcaagaccggaagcacaccagaaataaaactagtgatcattggatcagacacacagtttgccaactacaaacagctatcctcaccacaacaatcatggagattcactctaatgtagacatgtattgcagttcactgctgaaatgaattgagacaaaaatatcaatgtatcatgaagcactatattcccccatagaacatcatacccccccaaaaaataccatgtgcattcaatgagaacatacctggaaagctcaaagcaaggctagtgcaacaaccagctattccagcattaacaactgcaaatgaagaattcataattagtgctatatattcaactaccaagatgttacatctaaaaaactagcacgatgttaacagaaaatagggaactaaaacaatgcacatactgtcatctttgccacgcagccttctcaacaggcacacaactagacaatggacgccagagagaactgcaaaactttgatccgataaatttatgttatgagcaaggtgtctggatgattttcatgtacagaagaactgaattcacattatcaatagttaaccttggcagaggaccctgggtgctgaacaagcccttaaatcccctcttagtgaacaaaccttgtcctgaataaagaatccagtacagaacataaagattttacacgaggaaaataactagttgctacaaatggccttaactaattcacatgtctggtacttaacaagattaatagcatcttcattgacataaatatcaaaattcagatgaaggaaccaaagattcctcacaagatgtgctattatctacacattctagatttattacaaattcttacagccatactaggtgagtttgaggagaaggggattgagaagattgggaagatacgcaaaacgaggtgagccattaccgtatgattaattgagtattaactattttaaatttaaaaaatggattaatctgattttttaaagcaactttcctatagaaaatttttgcaaaaaacgcaccgtttagtagtttgggaagcgtgcgcgcggaaaacaaaacaaactatctctctttctccagctgccgaacacagcgtaagaataggttaggaatgaacttcctttgcatgacatggaaaggaacaaaatctaaaactagaaaaagttcgtgattacaacaacatagacaacatgggcagcaccggaaacacataaacactgaaacacaagggggcaacggagaaattgggataataccatatccaatggtagacaccaaatgaactgttggtagtggatgcatgagtgttgctgcactctgaagcacggtagacaaatcatgatgactaaaagcaactgcgcacattgaaagttttattagcatgcaatttgtttattacccagttagaagagatgcaaatagaaagattgcgttgttatctttttaaaatgaagcgtagagaaaaaaatcacagtaactaaagaatgctgggcattcataacccattctgtgcagttacaaaacagaaggtaggttattggtcatagtctctgccatcttcgtaggaagaaataccagtacgaacaaaaggtacattattgtgaagaacaaaaacaacagaggccacagaggtggtgcatcttttgtagctatacaattacttgaaggatggtgcaacaagaaatcaagcttacagaaaagggtaggtcttacttaggcctaacagtctagcagccaggtatttacttgctgtcactgtacaatatatggacatagcaaatagagcataattaggcataattactgaaacaggggataaaaacatttaaacataaaagggggaaaggtctatacatccatggtggcaaaacctgggaggtaattagaaattctcacacggtacaggggaagtattaggtggatttgtagtgcaattgataaagtaggcaacccggctgttcagggggtgaaatggattttttttttctgtgacagtctaaaactgacgctctgtatagattgttcatggtgtaaagtaataactattctctactaacgagcatgtccaaattgatgatgggttagaaataagaaatattacactgcccagcacaaacaataagctatcattgatgatgagttataatgcaggcaagaatagccaaaatatataccttcttacatagcttgaacacgactttgtccagaaggcttcactaactcctccctgtcaatcatcatcctaactctctttgcatcctcaaccattccggcctttgcatatatatccgacatagtcacaaaattccagggttacctggctccaattgaaccagcttctcaaaagcgatctgtgcatgatccacatcatggtgcatcctacttccagataacaaagcaccccatacaactgcatttggtctgattggcatctgatcaataaatccagcagcctctctgaacctcccagctcgtgaaagcaaatccacaatacaagcacactgctccatagtagggatgagggcagaattttccacaaaccgctcaaaaagcgcaagaccttcatcaaccaagccacagtggcagcatgccatgagcag

SEQ ID NO: 59355 - DNA, 1011 bp, Oryza sativa
tttctgttttaacaaacatcatgatcaatacatgaaaattcgtatacgtaggaatcacaaattgaaatcggttcctatcaaagaaaaaaaggaatcaacgattgaaattttcatattggtgtagttttgcattgtatcggatagcggggttgatgcgacaactgcacggaaatatattggttgtattatagtaatgttagtttcattttaaattaaaaaaatgttattgataattaagacttcaatcctaaccgatgaaatgggatgcaatatccttttctcgaatgcacgtgcacgtagtcgtaccaactctatcactataaacacattcaaaaatttaggttagaagtcaccgcaggtactacttaccacgaaaaaaataggctagaagatatacccgtctaataaaataatcactggccaccgcaaagcattgtttaccgagaaagacatgaccaatttattattgcgccatttcccaaaaactagtacagaaatcaccacacattaccatatgccgaattcatatcctctactcagcattatgccaaagttatgttgagtagaggagactcaaacattgtcagacatgttgcaccataagtaacctagctaattaattgatacttaattcattcgtagaaagtaatccatgatagacacaaagtaatctatgatagacacactacatgtaaagaacacgtaggccaaaatctcatatttctaattaacattttccccatatatatatatatatatatatatatatatatatatatatatatatatatatatatatatatatatatagtaaatttgtttggtgctccatggtgcccgggcaccattgttgaaattgagtatatacccaattcaaatgagcatgaaactttttcaattatttaggtattaatattaactactttactaactagttgaaagcaagtttgaactgaatgtgaacttgtttttgatagatttagattctaggtatatagcacccatacatat

SEQ ID NO: 59356 - DNA, 6445 bp, Oryza sativa
attaaaactcaattaatcacatgttattaccaccttattttgtatgaaacactcaattttaatcatcttcaggagattcgagtgcatgtcgaaatcggtgatacacgcggttctggtcgacggcgacgagaatcttggtgcgattgccgggttgctttcggcatcttttcgcctgggccggcggcggatcgacgcaattaagttaacaaatcggcgtccggcgagtggccggctagccgccagcttcaactgctcgttcagagtagagatcgacctgtcagaatgttgggtggagcggagcgagctgaggcgcgtcctgtctcgttctcgtctcgtcgccgtcgacggcgcacctgccgatctgatctgatcacgttttttttttttttttgctccccttaatcatgattgagttggcgtgatctgatcgcacgggaaaccgcgagcagtgtgaccggcgatctgactgacggagtagtggctactggctagagcttgatagctttgcagatcttgctgtcaatcagccaccggtgtgagtacgctgtgcttgccgttgcgacgtcccgtgtctccggccaccgcgcggaggcgagcttattcgtcatcgtagatttttacgtatccagcgcagcaagaacgaacaagatgccgtcgtccgcgcgttccgcttcgcccatcagaccgcaaccaacgaaaatcctgcgcccccggcggataggattttctccgaacgcatagcctccatgtctgccgccgccgccggcaagagattccccgtcgacgcgaccatctcggtcggggctcctacttctccgccgatggggagacgaaggcggcagacggaacgctgtactagccttgtttggagtgcttaaaattacgataatctactgcttggtagctaacttttgaaaatctggtttatggtttcttagtttattttctgtattcaaaatttgggtgataatttggactgtatagggtgtgttcggacccaatgattcctcaccctctccatcgtattccgcgcgcacgcttttcaaactgttaaacggtgcgcttttttaaaaagtttttatacgaaatttgcttaaaaaaattatattgatctatttttgaaaaaaaaaatagctaatactctctctatactagtaaaaatgacgtttagaacagcatttagcataccaagaagtgattaattatgggtatttttccctgtctacccctattaaatatggttgcgcgtaagaatcttggcagggacaagttggtttctaggttttgcatggcactgttttgggcaggcttggatacttggttggctgcatggcgctcgtgcaggtggcgtttaggcgcgttttttgtttcgcttttttagtttgggttcactgccgcgcgtgatgctgaaatttttttgcatggcgctcgttaccgctattcgcgcgcctatcccgtggtaattttttcgcgtgggcgtgctgagaatgccgacgcttaggttactgcttgcccatatttatacgctaacttgctttcacgtttggagtactgagccatctcatcttctagttctaggcttctagctagcttcctctcactattgcagtacacatggccgaagatggcgatggcgagtttgcctttgatctgaacgagcctccgttggagcacggcaatggtacttttcttctctgtttgacaggatttttcttctcttgtgcatgtttgtacggcaactgtgctatctcttcttctctatatcgtttctcatatcattgttttccattttttttaactggttttgatttgaacttgccactaaatgaatttggtgcagtcgatttcgattatgtacaacaccttgctggtaagccaacttctttttgatacaattagattttgctagaacatgccatggctatttgtactatcaatgaacttgattttcttccttttgctagaacatgtcatggctctcgttgaagtaaaccatcgaaggaaggaaagacatgaccgaagaagtgagaaaacaagtttatcaagctttgttggctagaagcaagaatgggaaactaggcaagaaagatacaagagttgttgcagatcagtttgtcaaccatctttcctagatgaagccaaggctactcttgctgcattgaacatttagaatgaagctagttaggttccgcactcaattaatagagacatccttgtaatgcgattattaagttgtgttatcttaccatttctttggcatcatccttcctgggagtgagctcacgttcgcgcttctcgtcaagcatcttgagcacaatgcgagcggcggcggcggcgtcgagcgtgagagagcacggccggtgagcgcgacgcaagcgacgagagcggggccggcgagcacaatgcaagcggcggcggtggcgagtgcgacgagagcagcggcggcgagcgtgacgagagcgcggccggcgagcgcgacgcaagcggcggcggcagcggcgagagcgacaagagcagggccggcgagcgcgacgcaagcggcggcggcgagcgtgagcggcgaggttgagcggcgtgctgcatgcctgcatgcgacgcttaaggaattaaacgaggcaagcgcgggcgtgctgcggattaattgcgggagcggctatcgaacagacaagggtaattccgtccacatagcctgctgcggttcagaatgtcgttaaaatcgcaaacgaggttatggctagaacgacgtttttttcctatacggagggagtatctaattaatcacgcgctaatggactgcttcatttttcgtgcttaggtgatatgttcctatccatcagcagcgaacacacccttaagagagttggagattatgtgagaaactgtagctgctagaagcttatgcccgtaaagacaaagaaggtgctagttcaaggcgccatgctgggccgacccaggggatcagcccaatcaagggctttctacaaaggaataagtccgatttgactccctttatgtataggctcaatctaattcatattcctcaacaacaataccacataataccaggtaatattttgacatctcaactgttaaaaccattgtaatttaactcccttagcgattttaaatgtggtttcctaacgtactctctccgtttcacaatgtaagtcattctagcattttccatattcatattgatgtcaatgagtctagatatatatatctatctagattcattcacataaatatgaatgtgaaaaatgctagaatgacctacattgtgaaacggaggaagtaactcgtttcatacgagacccacatatcagcatccattcttcttcgtcttcctctcctctaacttccttcccgggcagcagttccttcccctcctcttctacaagtgacgaatagcaccacgagctcgccgccaccggcgatggccccccctcttcatagcgaacctccactcaactctcgttttctttctccggttttcctcctctttgcctctttggtttcccctcagtcggggtctttggtaaactcttgcgaggacggtggccaggagtggcaaatatgcgtaccatcatacctgtacacagcgctgaatgttggtttgcacagggaagtaagaacatgtatcatcagtaattcagtacttctcaaaattcgcactttacacaccatgaacacaattatatatggtcattttacagatgttggatatcattctgcaaaattggtgatctttcattctcaatatcatgatgggagtacatgtatgtacaatggaattatggcaaaaggaatgatgggctttgcatcattctcatcttgtggcaaacataaacatattactcacattgcaaacaaacagttgccagaacacagcaacacacacaaaaaaaaccattacacaatatgatcaaacaataaatctaccatgttgtgagtgatcgatcctattattcttctaccaagacagactctacagagttcagaactatactactaaatcgccaatactaactcatccagttctcattgactgcatattcaaccagatccactcttgcatgccttactctggagcatctttccttccatcagcttttgtggaagcaaacagtttgtcagatggaacaacctgcatatatagaacaaaccatgtcagtgctactgatactctgattttttttttagtgtgctgtcttcatctcaatatttgcaacagaataagctaattaaaatcctgagaaattacttggtaattccgtgtaagagcacttcttaacttccttctcttgcatgctttgcttgattctgcatcaacctccgcctcatcatcagcaaaattctgatcagagacctctgtataaaaggaaaatggaagaaaggcgttagagactaggttcatcacattacgctgttttggagcaaccttagtagaactttaacttttttctgttctttctgttcttatgacaagagacatcacccaaaaaataaaaactatacaagctcccgggcttaagaacaatggatttggcatgccgcataaaaatcagtagtgttgataaaacatttgtatgaaatatgacgcaccaccatttgatcccaggaaaagccattgaaagctattttagataaaccgcattaaatcataacctatgaagtgcatggctattcagaacaccttatatagttataatgtgaccgctgatagtcagaaaaagatgatgaaacaaggaattcagacttttaagcattcttcaatgtgaactaatgaggtaattgagttaaccacctgtactttcaccaacagctttttcttccttgcaagcctcccactcccttccatgtgacaacggagtcctcccttggatagtctgaataccagattcatgatcacccactaaagcctccgccgcatcattccttgcattgctactgcattcgcgcggcctgaaatgctggatccaggggcttgcgggcaggcagtattttctcccgatccgtgagcaagcactggtccgatcaaatttgagtttctcccacaccccaccacggagaaccttgaatccgttgccagcatcattttgttcgtgattgtagagttgctcaacgaaagaagcctccattgagcttatataatgcatgtgccgctcatctgtccaccctgacgacatcatgtccaggattcgattgccctgtcaaagaaaaagagacaaccattttattcttcagagttcaggtatttgtaacaacgtcagataaaagagggcctgaactagtgaaattcatgtcaaaaatatcagagtagtgttgattgcatggcttaaagttatactccacgagcagagtaattatgtgtcttcactgcaccatgggcggattatattactatttcgacatgacagacatttcttgaacgattgcatgacaaattcagataaacaattaactgtacaagactaaacactttttactaagaaaaagaagctaatggcaataattcaaggaagcatgcattctgtatgacagaatcatgagcccaacaattgctacctgaaattaagaacaaacacgatggtaaaaagaaaaaactttctgttctaatacctgagcaatgccgcctgcagctggctccgccttgatcggtcgattgactgacacatcacccatttgattcttctcaatgaaccaaggaacccacaaggggaggaaaatccgaagaaattgccaaaaatcttctcgaaccgtatcagaaaccagcccaaaatttcctctcttgaaatatgtacagctacagagaagtagggggaggtctagggatctggaagcaaatcggcgaacaaaccaaagtaaatctcctcgcgaccggatgattacgaagagggaaaacaaaaaaaaacaaacaaacacggacaagatttcaacttcaagaaacaaacaagagaaacaaaaatcacacctctcgctcgatttcacccgcagatcgaacaacccgcctccctcgcagcgagaaagaagagagaacgcatccaagatttggtctgagcggctcgatctatggacagacaagaggaggtgaagaagaggaggagagagagaagcaggagagagaggagaatggaattgcaacggaagaagcaaagggagacgaagaagaatcccctcctgtttaaggagcaaataaatgcggtgcgagagagcgagcaaaaaaaaaaaaagaaaagaaaaagaagaaggcgcggtggctttaccgcttttaccgcctacgtgtgccagcgcttttccacgtggcgaggcgaaacgtggcgcgggggggaaagaaaatatctcgcgcgcgcacacgtgccgggccgcctctcagatatttcgtggccgctctggcgtgggcgtggcgttgccaaaaagatctctgaagctgggccccacctcc

SEQ ID NO: 59357 - DNA, 1592 bp, Oryza sativa
agaaatatctgagggataatccagcaggtgcccctgtttttctaattgcaacttggtgaactgaatataatagtacagtatgacccatgttgacgcaaggacaggcaaactgtttttagactgcccatgttttcttctctgaccctttctgactaaacctttggttcagtgaatatgtttatactattgtttacttaacagtacaactatgcgttattccctgagtatcaaaatataaggattgtgtgtctgttctaatccaaactattataagttcaagcaactttataaaaaagaaaaataatatttatgatcgacaccactagatcaattatgaaaattattattttcagaattcacttcttgggtgtggtaggtgttaagactcttctctacaaaactgaatcaaatttaggataatttgacttgagccctatttgatatagctccatagatccacactggatttaaagtttgaatgctaaattacaacggtttaaatctttatatttcaactataacaggagcaaaatgatacatttgaatgttatcaacagattgaagatctatggatttgtagagttagaaatacctgacttcaaaaaatcaagaatccggataaatacaaaatatcttctttttttttagggaggcagtaacaagacaggtggtggattgttgattcattttaactgaaacaaagtgggcatatctcccaggtgtgacataagcaaccagtgagtgcaaagggagataaggtctcttaatcccttcacatagaaaaaaaaggtcgctttaccccttttgccttttgcaaaagtctaagaattactatgcaggtcgttttacataatgttctttttctccagcatggcatatcggcatcagctctcagtcacaaatcaactttacagaaatatgataagaccaaaataggcatctttcaagttccatcatgtgtaaattggtggagagttgggcacccactaaatagaaaaaaactgactaggggatgatgacacacacaccattgggaatagtcctgactacaactaggaggcaacaggaacttcagactgcagacttttcaggctcctacgagatagcattttataatcctgaaatcagcaagtgataactcattagcctacaaaactgaatcattgtgaactgcaccaagacaacaatacaagtctgatgcatctatgtacaaacagaaccatggagagcagcgtttacctccactacagactgagcacaaagcttcccagatagaactgcaccctccatcgaagccaaatatttctgctttgtgtagtcaccagctagatagaacccttcaatcggtgatctttgcagaggtcggcaaggttcacagtccgggatagtcttgtaaacagatctgtaacagtgagacagaaaagaaaggaacgtgagagaagtgtgcatccaactattagacctacctatgatatatcagatagggggcgctcttgcaaaatgtcctcaccttggtgtcttcacaacatgatacttcagaatctttgctttactctgatcagcagcaatttcatcaggaaatagcttggcta

SEQ ID NO: 59358 - DNA, 1890 bp, Oryza sativa
ctgtccaatctgcaagataaagagagaaaactctgaatgtttatattgaattgttagtttctttctttttagttgagaattaatgatttggtgtagcttgatttgttcttgtgttaggaatttcagtattgatatgctatgttataggaatcagatgttgagatgtgcatcagtacagcctgattataggtggaaaacaaaatttgcatcctcgtgtgctctgaggtttctggcatttttatgttttcatcccatgtctttgtgagcatggaacctttggcccttcaggttttcagattgcaaactcttaatatatgctattgatgttaagataaaagatctcatgggggaatgagttatgttatgcacctgcatgccagttatgcaataatgcagttatgtctaatggattatcaagaccttggagttggtaaatataatttattttccttgatggcttggtgatctcagctctcctataggcaatttctttttttgcttgctggcagtgctttttcttcagcttatctcttctttttttcccctatacatgtagtattatgtttcatgcgcatcttaatctagcaatgtaggtctattaaaccatttagattttccagttctggtttccttggactttaacacaatatgagttgtttgtacctaatatattgccctcctgttaatacagaactcggaatactcttcattcaatgtctcagaccattctaaaggaaggagcatgcttgttgctgcacttatggacatcatcacttccaactgcgataatgcggattattcatcatttcagcctttattgccttcagatgctgatacaagagatattgcggcagccatcgaagtcattgagcaaggggggatgcattttgatgaccatgatgataataacagtgatgatggtgacagtggattaaaaggaatagggattaaggtacttggtgggactactgtcttgggattctctagagaaataaactcattggaggtgggcaactcggatgatggtattgttggagcttcgaatagtagaatattgatgcaagaaactgctactgattctccactagtggagaagctaagttctgctgctgctccaggcctctgggatgatttgcagagggagcatgtagctgtaccttttgctacttgggctcttgctaattgggctattgcatctgatttaaaccgttctcgtattcaagaacttgacagtgatggacatactgtcacaactgcactgaaagcacctgaaagaactgtcaagtggcatggagccatggtggcgcgagctcttttggaagaccagagcttgactttggctccttctgtccctgactggtgctcaagtcttcttttgacagcttctcgggctgctgagaatggtgacatggcattggctcaaatgtcactatcaactttcctattatccatgataaggtgtaatgagtcaaaatttgtgatcagacagaagggtcttcatcttcttcgtagtatcgcaaaaaagatagaaaatgagaatgctcagagcaggatgaaggaatcattagcagtggcactgagtttgctctatgctggtgaagttccgttgtcacttgaagaaactcaaagatggtccggcattcttcttcgttggctctttgataaatctgtttcagaaactacaaatctcacagctattaaaatcctttcatgcattcttgaagactatggaccagcttccgtaccaatttctcagggatggttggctctcgtgctttctgagattcttggagataacaagacacagaatttgaaaggaaccacccagcctcaaccagagagagtgaaggtaagaatcttgttattgtttttaataaatatatatttgaa

SEQ ID NO: 59359 - DNA, 12542 bp, Oryza sativa
ttctcaaagtaaatgaaaggtagcatgtgtattcattatcacattagtcaaaaggtggaaatgcaaagctaagaaaaaaaagccttaaaatctgtcatgacctcatgaacagaaacaattgagcatagaagtattcctcataaattggaggccgtatagttcttaatgttagtttcagtttttatgttaccgtatttcccctttttgcttttgaagttatttcgagggtgatacaggttggacatttagatataggcaaaattctgagagcttacttttcttgtttacactattcaggttctggccgtgaagaaacttgatagtaccgtgatgccattccattcatctgatgattttgctgaactggtctcagacatttcaaaactgcatcatccgaatctcaatgagcttgtgggctattgcatggaacatgggcaacacttgcttgtttacgatttccacaggaatgggtcactccatgatctactccatctttcagacgaatacagcaagccacttagctggaactctcgtgtcaagatcgcactaggctctgcccgtgcactggagtaagtgaaaaatctctccatattatgttgatctgctgttttggcattatactacatgttattaattttgtacgattttagccatcatgtgtgtccagattgaactaaacaagggccttgtttcttttcattcattatccataaaagttacaaaccaactgatttattactagtttcacaaatttaattagcaatccttttgttcatggcaattgaagtaagaatactgctgtcaaccatatcgtaccatcagaatctcgctaaacttggaaatatcctttgcatgttgtgtttatgtgtagaatgacagttgctagtttcatgctttgtttgaatgtggatgacagttatacattatggaataatagtccttttatatagaattctatgctcattttgaaatatgatatgtgacatcttatcatttcctctgaaaatataatctgtagatatcttcatgaaatttgttctccatccatcatccataagaatttcaagtcatccaaccttctactggattcagaattcaatccacacctttcagatgctggacttgcaagctttatttctgatgcagaattccaggtatggctcttgctgatatatccaagcacccattttaagaggacaattgtttggacagttgtgtgttaattaaaaaaaaatagcactgagatgaaccttcgcttgctaaactaccaagaaaactgactactggacttacagaaattgttggcgaattgatgtagtcatgtagaggctgtattaattttcttaattgaaaagagaagtttatggcaatgatgtcacaccttttatacatcttgattcactagtgattgtattaatgttcgtcacggaaaaaaaaaactatgcaggcagcgcaacagagtgctgggtgcactgccccagaggtggacatgactggtcagtacacactgaagagcgatgtctacagctttggagtagtcatgctagagcttttgacgggacgcagacctttcgataggtaacttgatcttctcatcagtcgtaaccagtttccagcttgcgcataactataaatttagtgctaactgatgaacctcggtataatcgtgtgactttgcattacagcactagaccgaggtcagagcagtcacttgtgcggtgggcgactccacagctccatgacatcgatgcattggacagaatggtcgatcctgcgctgaagggtctgtaccctgccaagtctctctcccggtttgccgacgtgctcgctttgtgtgtccaggtaggatttcaccatcctatgcagatgagctatgcaatactaattacctaatacatggaacagaatgtctgaatcttatgaaacaaattcatgttacagcctgaaccagaattcaggccaccaatgtcagaggtggtgcaagcattggttcgtcttgtccagagggccaacatgacgaagagaatgctcgacggagatacttcgtcgcgccgaacagacgaccaagaacaagatttcatatgacaaaaactacacccctagcttttcctgttacatctcaaattgtatttattttgttcgcctatcgcctattggagagaagaatggaaggagaaatagaaaagaaagtcagtttcatcagtacataatcacaggtgttgcttgatatattgtaggaccaggtgtgccattgtatcctgtctacagaacagtattctgaattcctgattgttcattaatgccatcatggtagtagattatttggttatatcatctgaaagatccaaagaagcatagtgctgctaagtatagcatcaggttcactggttgttaacaagaccagtagtacaactacaaagcaaatgcttcaatggaggttacaagagactcaatcatcaggtacaagctcatatatcatcacttgtcatttaacaaaaattcgacctgttccgtacaagtttctgacattttgcatgcaaaaagctatggtaattttactctgaaatctgaagatacaacgtcatgatgctaaaacccaagcaaatcaaactgtctgagccgatcgaattacgtcagaatccacacgcttcagtctcatcacagattgcacatgcgctctcagcatatgtgcatctcccaatctgcaagccaaccaaaaaaaaaggaaagacgaaaaaaaacattagcacataattaattaagttttaatttttataaacttgacaaatggatatatttcatattttaaagtaacttctatatagaaagttttcgcacaaacacaccgtttagtagtttgaaaaatttactaccgaaaaccgaggtaaaatctgaatcttaataaggaaagaccggggaatcctccagtttttcaaacagttcttgtacctggcgatttctgcccgtcgcttggctcgctccgcgatccgcgtaggccgccatccgctgctgaggagatgatcggaaagcgccctccgttgttgatgatgatgatgatgggagcgcggccacctggtctccggccgccgctcgttgccgccgtagtctctcctactcgcaaatgcggcctgaagaacgaacagattcattattcatccatggccggcacagatctgaactgaagccatgggcgagctctgaatgaggaaggaatccaactacccaagaacagatcatgctgctactgtacccaccttcctgtcgaacagcaggttccaggcttcgccgctgagcgtgtagcggacggcgatcttgatcagatcgaggggggcgtagaacaccaggctgtacagccatatcacgcccgcccatccccacccgatcgcgctgatcgacgcgaagctgatcgttgcgtacacggcgatcagtgtagccacctgcagatcaagaaactcatcatccgttactgagaaaaattcagaaaccttctactagcagcagaagtttttttttgattgtttcagagttcagaaaatcttctgcagatttaccaattgtgctaggatgaaagcacaaatcagcagggctccaggtctctcgaggaaggacaagccctgactgcgtgtgacgaatatcagggcctggctgatgatgctgacttgcaggtacatcgctgacgagatctcgtcggaattttgcttcagagatctcaccttgaagtgagactgcaattcatacacacaaaagcttcggctgttgatttaccaacaagatgttctcatgttcaggttcagattcttcagaggttgcaagattttacctcaaagaaggttgttcttgtgactgtccagtagaacagcacggttaccaatgcaaggtaggttcctatgacaactccagctgcgaatatctcattcagtttccagctatctgggcttggtgatggcttcacgcgatcctttgatattgtcatgatagttcctgatcaaagtagatgcccaaccatcaagtactgaataaatcgagtgtctattcctgcttttgatgcagtaaaattcagagaaaaatgatcatcaccgtcatttagtatggctatgatcagaaccataaacggagggaagtcgtactcccaaattgatgccagaagaacaaatccaatctgcatccaaacaagacgatcaatgacgagatttttgggagaattttgtgatgatgaattccagtttcgcttaccactatccttatagtgatggacactgcataaatctgcagcgaagaagaactctgtgagaatgtgaatcaagcaaaagagaggtgaatttttacaggtgatgaggtgagagtgtccaagaactagctcaccgtgtagttcttcatccgctggaagatggcgcggctggtgaggacggcgctgacgatgacgctgaggccgggctcggtgagcacgatgtcggcggcgcccctcgcggcgtccgtcgcgtcggagacggcgatgccgatgtcggccttcttcagcgccggcgcgtcgttcacgccgtcgccggtcatcccgcacacgtggccgccccccccttgaatcatcctcacgatctcgtacttgtgctccgggaacacgccggcgaacccgtccgccttctccacgagctcctccaccggaacagccgcgccgccgccgtcgccgtggcggccgaacagcgacgccgacgggtacatgttggtgcccatcccaagacggcggccggtctccttcgcgatggccaggtgatcgcctgcaatgatcaagaagcttcttggcgttgctccattgacgatcaagaagcagtacgatcatcgcgtgattataccggtgatcatcttcacgcagacgccaagatcaagcgctcggcggatggtgtcggcgctgtcgtgccgcggcgggtcgaacagcggcaggaggccgcagaacacccatggtccgccatggccgtgcttcgatttctctggcacctccttcactcaagccatcagatcagatgaactcaaccatcagacagatattcattagcaacaagtaaactgaactgaactgaacttgatggtgctacgactacctggtaagcgacggcgagtgaacggaggcctctctctgcaaatctgtcgatgattagctgcaccttttcagagatatcatccttgttgtagcataggctgaggatctgaagatgagagacatcagatgttcttcctatctgatcaaggtctgtattactattttctgaattctgatggtaacagcagtgagatttacagtgatggattgaaaagttcctacctgctcaggagcacctttgctgactctgaaccagttaccatcagaatcaacgtatgttatagccgtcctcttatcgacaggattgaatggaaggaagtgaacttcagtgatgctagagcgtgcctggcaatgcaaagatgatatccatgaaccattctgaaatatatgtaggatggtcaaatcaagcaaagatgagttcagaacctctttggggtcagctagcatgtttattatggccatatcaattgcatcttgattctccactcttgatgctcttgcagccagcaggataatcatttccctgtccatttctctgctgaaaaccttaaattacccaaggatggatcataagttgtatagctagtcaataattatgaattcaatacgttgcatttttttaattaatttttctacctcaattaggtttttgtcaacagtgagatggttgagggtgagagttccggttttgtcacagcagagaacatccattcctgccatttcctctatggctgtcatccttttagtgatagcaccctgccaaaaatcaattactacatatttttttccgggaatacgcaaggagcgtattttttccattaagagaaataaaagttatttacaatgcgaaaagaaaaacaagcacgggaccggtattggaggctggggatctaatggggatatctcgtgctagatttggctaccacgacctcgcagaggtaacggaagggacccctgcatttgccgacttccaaagcatggcttcctccgccatcgctttcgccaaattactacgtatttttgtaacaatgatatgtgatatgctgtctgttaattgcagaaacatgataacaatatcttggcacacctgttgagacaggtgatgagaacctattgcaagtgtgactgacagaacagtaggcattgcgatcggtatccctccgatcagaagaacaagaacattgttgatcccatcccggtatgaccggtgctggattgggaacatgattataacctcaacaatcgcaccgatggcgattgaacagatacagaagttgcctatggaggtaagaacctgaaaattcagtagtcagaaatagcttacagcacatccacttgtgagattcttattacagtctgaagatcgatgaatcaccttctgaaaatgcccaacaacctcagtggaatccactagatgagctgccttgccaaagaaagagtgtatcccagttgcaatgacaacagcttcaatctcaccatgcttgcatgttgagccagtgaacactatgtcccctgttctttttgtgacaggaagggattcaccggtgagagctgactacaagatggaggagaaacaaaatgtaatcaaattatctacacagatcaactaaatcagtcattccaattatcgatatcttccacatgaacggtgcgcggcaatttgagtcacctgatcaatcttcagaggatctccctcaagtaggcgcgcatctgcagggacaatatcaccaagcctgatgctgataatatccccaggtaccaatgtagaagcatcaagctcttgccattgctcatctctaagaacctggaggtaaatccatgaatatatgaacacaacaagatcagactaacacaatagattcacctgtatttttaaaatttctgttcagaaaaaaaaaacctttgtttttagcgccaaccgggccatgagtgcagcagcagcatcgcctgcattgttctcctcaatgaagctgattgttgaattgataatcaggaggcagacaattcccaggaaatcttcccagtcagtaccttggctctgaccaaagacagtaaatgagtgaataataaagaaaatccattgagttgcttgcacaaattttcgacgatttgatgtcaatatttcaataacacaaagcaagcacttacaccaccatttgctagaaccaatgccatcactgctgctgcctccatcacccaggacaaaggattccacataaagctgaggaacttgatgatcttgttctcctgacaaaaaagatttttttaaaaaaaaaaattcaggagttcagaaaaggaatatgtttcagtttcaggtaaacgatgatcagaaagaaaacagtcaacttacacgcttctcctccaatctgtttgcaccaaacaacttcaagcgttctgcagcatctgctgatgagagcccactctgagacgtattcagctgctcaaaaacgtcttccaggggcagattctcctgtcacatatccacaagaatcacggcatttttcaaagaatgcttcaaatccacgacatcctaacaaatgtacttaccaaatcaacatcttcgtcgaagaaattctctagcccaagcaaaggttcacctggttcatccatgccttcagctaaaatctgtcgcccggaacagaatgtgaaataatgaacacggctacagcatcgtcattttcattccaaatgttgcagtgaagatctcaccacgcattagacaatctgatggacaagatcacaggagatttaagtggcgttagcgaggtgggttttggttggttcttcttgaagtgttaagaagatggcagcttggactgaactggtacagtgagaagacctgaatttgggctgatccaaccaccgttcaaacctccagttagtgagcggacggtcacctgaaaccaaacagtcgcctccgattaccgtgagaactgagaaactgcatgctctcgtgtgcagatgcacgcacagtttctgtctctgctatggcaaacgcgaacatttgataaacattacttatacagtgattatactgttcatcagataattacttcgtagcagcacatcttttcattacttcatgactgttacacttattcccccaggaaagaatttttcatgcatctgaaattttcatgaatcagggatatgttggtttccatctcttaaaatatatgttaggaggcgtattcatagagtgagtgtagtgttacgtgtgcacgtatacatctcccgtgtaatcggaaaaggaaaatactcctatgatttcccttcagaaatatgagtttttttgagggtgatggactgattggctgatggtggtatataccacgtagaacgtagagagcagcaggcgccaaaaggcatctcccccaccacatcttccacaatcctcacccccgcctcccctttgtccctttcccaccgccccaaaaacccaccctctccctgactcctccccccgcagcttccgccgtccgcctccgctcccacgtcgccgcccgctcgtcgtcgccgccggtgagtctcctccactccgtgctcgccccctccgtacccagcagcaggatcggatcggtcgcgcgggcggcgggggtacgtatctgtattccgtagaattgggggaattcattccgggttgcggggttgctaaggtgttggattgactgcggtgacgggagggcggtagtttcctggtaaataggtagtaggagagatgctgagatgactgctggctttgagcatgcggcatatgatgatttagtgcttagtttgggggcttatctttagatactagcgggcgcatggttgtgagttcagtttgcgctaaccaccacttttgcatgaggaggcaaacgaggtcctctccagctgccctgccctagtgtgatatcatttgagcctttcatgctttttgtgccatgcttgatctgttccaatccatttacttcactaaccaaattatgcgggtcatatgcagttttcctttcatgtttctctccaactataaaagtttgattggccgcagccacatagagaaactcggaagattagggagtaaaccaatattaccactgtccacatagctttaacaactaacagctggtcctgctctttttttccttttggcatcagtttgttattgtcatgctatgtttccatttgacgactggactagaatagaatctgtttctttggctcgttttttttttttcatcaaatagtgatgacaaacttgataaatttacatactgatacagtgatacttggctgactttcataacaaacggttttgtgtattgtgtgtttaatggttcctcttgtttttgcagacgctcttgcgtgcttatttgtcaaatcagatctgaatataattttaggagttgcttcagcatggatactggctgcctgtcatctatgaacataactggaaccagccaagcaagatcttttgcgggacaacttcctactcataggtgcttcgcaagtagcagcatccaagcactgaaaagtagtcagcatgtgagctttggagtgaaatctcttgtcttaaggaataaaggaaaaagattccgtcggaggctcggtgctctacaggttcaacctttgtactctattattgcctcacattccatctcttgtgaaaatatatttgattggcttttctgcaggttgtttgccaggactttccaagacctccactagaaaacgcaataaactttttggaagctggacaactatcttcatttttcagaaacagtgaacaacccactaaaccattacaggtcgtgattgctggagcaggtatgatataattctaggatttgacagatgaataatttacatatatatctaactttgatagcagtcacatcgtggtcttagcattgtagtttttagctttgatttttttttcaggattagctggtttatcaacggcaaaatatctggcagatgctggtcataaacccatattgcttgaggcaagggatgttttgggtggaaaggttttactcttatgcttttatgttgcatttaattttttttgttattcattctttttttttttggttgcctttatcttaatagctcatattcactgttagtagcatttgtggattattgtttttttttttggggaaatgccttgaacagatagctgcttggaaggatgaagatggagattggtatgaaactgggcttcatatcttttgtaagtaataactctggatttttaaggttctcgttgtgctatattttatttaggttattaccgccagcactgatagatatctctaagggttttgaacaaaaaaacatgtatcaaactctttcatcgataaggtagaaatgccatgcgggaagtatgaagtgatgtctgaggattaacacacatggtagttttattttgtaagaaacttttagattggtttttttcacagtactaaaaagtaactttttactagcttatatggttgataaattttaacgtcacataaatatcatgagctaattgaatataaatcctcctgttcatacatagtcttctttcaacctactattcccttccaaacatatatgaatatgacagatactgtttttccttccatgctcacactgttttgtcgtccacaacagtacatatgtgacattgttcattttgtgcctgtatgtaaccatatacctttttggtttaagttggagcttatcccaacatacagaacttgtttggcgagcttggtattaatgatcggttgcaatggaaggaacactccatgatatttgccatgccaaacaagccaggagaattcagccggtttgattttcctgaaacattgcctgcacccttaaatggtgagatcatatgcagcgctggagttgtttaattaaaccaagattcccagaagtacatcgtattggtggttacttttgttttactaacacatgactgtaattagggggtatattactagcaacgttaatgatagatcaatagatcatgccatggagcttttatgttgtcaattgatgcctatttattatttatcattgatcatgcgtgcatttaacaggaatatgggccatactaagaaacaatgaaatgctaacttggccagagaaggtgaagtttgctcttggacttttgccagcaatggttggtggccaagcttatgttgaagctcaagatggttttactgtttctgagtggatgaaaaagcaggtataagttcacaatatcagtttgtcaagtctctgtgtacaagacacatttctacctcattaatttggaatggatataggagaaggtgttgtaagctagaaaaccttttattttctaataaaaaaactgatgccctttattgttgcattcacattgggaagaactggcagttctgaggatgaaatgcttcatgtactcaagtttatgccctttattttgcccagatccttttgcacaggtttaagcttgagctatgcttttagtttaagaccactgtttcagttaaaggtcaacaaccttgcatgatttcttcctccacctagaaaagccattgcacatattgacaaagcacacaatcctgttgactatattctttatgagctaatatacagaactgttttatacagaaaacacaatacatatgctatagttatcaatctctttccctttttttgggataacggattaatatggtgcctgatacagttgtttgatcagcacagggtgttcctgatcgagtgaacgatgaggttttcattgcaatgtcaaaggcacttaatttcataaatcctgatgagttatccatgcagtgcattctgattgctttaaaccgatttcttcaggtaattattatgttgctctatggtcatgtgtgttgcatatgagtaattcttctgttctttccggagtagtaccttacgtattacatccttcttagtgtttcttgtctctgttgtttcctaccttgaggaaactcaaatgaattttcgcttagaggccttttaaaaaaaattatgcaaatgtgtaggagaagcatggttctaagatggcattcttggatggtaatcctcctgaaaggttatgcatgcctattgttgaccatgttcgctctttgggtggtgaggttcggctgaattctcgtattcagaaaatagaacttaatcctgatggaacagtgaaacactttgcacttactgatggaactcaaataactggagatgcttatgtttttgcaacaccaggtgattttctacaatctttgtttcttctgcagttcataaattatatatatgcggctactcattttaactgactagcctgtatttagttgatatcttgaagcttcttgtacctcaagagtggaaagaaatatcttatttcaagaagctggagaagttggtgggagttcctgttataaatgttcatatatggttggttggttgaattatt

SEQ ID NO: 59360 - DNA, 4109 bp, Oryza sativa
  unsure (1)..(4109): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacatccttgacagtgacagatcaactcaacgaatctgggggctctatggagtttcatgcaaacttggctaaatacaaggcgaacactcagattatcatgtcgaattatttagccgattggatcaccggtttcaaaggcaaagtactacctaatacgggcaccattatacaccactaaagctaattaaataacctaccagcttatcactacagctacaaggataaaacttttatcataccaaagtttagctacaacaacacacatcgtgacttcgcgagtcatcaataaagcaagaaactttttttcgcggccaaaaacagcgagaggccggccacgattgacaaccgaatcgcaaccctcaccttgttgatctcgagctgcggcgcccacgagtggagcagggcgaagaagtagtcgaacatctcgacgcccgtggcgaactccttgggtcccagcttcaccggcttcgcctcctcttccttcgcgccctcctcttcctcccccttcgcctcatcctccgctcccttcgcctccccctccccctccaccttctgcttcttggccgcagctccctccgccgcctcctcgccagcagcgccggcggcggagtcatccccctcctccctctccctcttctgactcggattcgccgcagccggctccgccgcctcggcttccatcgcctccccacctgcggcaaccaccacctcgggttcagccatggccgggagctcgaagaatccgcggagacggaggcggaggcggaagtagggttttggaggtgttccaagcgaagcgagagggttaagtatcacgcgagagaacaaaagcgaactcgatgcgagcctagcccatgtgggcccaccagaggaaggcccggcccaagagcaaagcatcgggttcgcgtcttcgcgagggaggaaggaaggaagcaaaatgctgacgtgtacataaaccgctcgtcgggaaaaatgccactcctccccgcgccgttccgacctctcgctcccgccgccgccgcggcctccgccgcaccgcgccgcgccaccgccggagaggggggccgctcgtcgctcaccggggcgttctgttcctaagcatcggcgccgccagcgccgccgccgtcgcctgcaggacggggtgcgccttctcccgccgccgcttccccttcctcgggtaaccttctctttcctctttgctcttagattttgtgtggaacccgcgaaattgctaggcacgtccgaacatgcggctgctaaaaaattgaatcgctgaagtatggtacaagagtgtagtttatccatgttatgacattgatggatgtgtgaactttggaggttaacattgctacgcttttatctagtttgaattctatcttcttgtagtgatatctgaatgcaaaatttctcagggtaagaggtctcaagctctgctcggatggagtccgcttccaccaccgtgccatccattgttgtgtatgtgactgttccaaacagggaagcaggtagtactttactgtgtttttgttcttgttatattgtgtgcgcatttcatttgtggaacttgctaggcaatatatttcatttcctccaagataaagcagttagagttgagattgatcttgcactatttgtcttgtgagcatcatgtttctcctttcaatattgttgtttagcgtttatttttttgttaattaattttagcatctatttctgccttttgtttaagcagtctttaaaagcatcatgtttcacatctactgcagggaagaagctgtcacagagcatcatcagtgagaaactagctgcttgtgtcaatatagtgcctggtttgtcactttgctcatcacttccgtttctctgacactatatgcctatgaacccagatcatatgtcagtgttattggccctctgtattccatagaaaacatctttattaccttcaaaaaatttaatggaaacactgaaaaggtttagtagaggtggcagtgtaaacgaattagatcaagaaaatccatcatatgtgggaacaaacccttttaaagctttgcttaccttactttggactgaaacaagaactctgttgaatcacgaaatataatggtgctttggttgtccaatgattgttgcgctgcccttccttatgctgttaggcaacaggtgctgtgccaagattcgcaattagcttgtttcatattatcgtttatactgaattatactgaagttctgtacatttttcaggcattgaatctgtttattggtgggagggaaaggtgcgttgtggaaatttacctatagactgaatagattattaatagttctcatctttgtaattcagtggtttatcattccttcggatgatgtatttcctgctccttagcagacctaggatttagtgatcaataatctgccttcttgcaggtgcaaactgatgctgaagagttactcataatcaagactagagaatctcttctagatgccttgactgaacatgtcaaagctaaccatgaatacgagtaagcttcattcagtttattgatcttgctgtacaatctgtctgtttactatagtttacttgtaacttttctccctgaaatcttaatgtaatttggttggcctattctttcggccggcccgggagaaaaatgttcctgtcagatttactggtaacttgttcatgcagtgttcctgaagttatcgctcttcccataactggtggtaacaccaagtacctggagtggatcaagaacagcaccaaggcaaactgatctggcattcaccctgttgtatacgcgcgctgcagacccgcagctcaaaaatatccaacaacatgaagtaactgatcggatgttctctgtttggcctatgtatcacagtgacatttgctgcaaggaatatatgtgtggttgccatcttgtgagttctgatgagtaacttgggtctataattctgctcacataaaaaatcgattcagtactcatacttgtgaattgctgcccttgatttggtattctcatatgaagtttttctagcgatgcaaatgatgaagatctttaagatcgatgtaaacataccaattcacactggtaaaaccctgagtacgtacgtaatcacctagatatagccctattggcacatacagatgagacaggcgcccgtgaccaagttttgatgtcacgtataccttattgcacagatcggaaagctacaagcccacaagaggacaccgtgatttcagaaagggaaaagaagagaatacatagactgcacaagccgttctcgtgcatttgctagcagcagcttggctctagatgagatagcggtagatcatcttaattaatcttaattcttaattagttgcaggactccttggcgaagccgacgcgggagttggcgacgtcgaagacgacccggatgttctgctgctgcaggttggcgatgacgttgacgacggagttgacgttctgcggcgcctcggccatggcgaggcaggccagcggcgtggcgctgctgtggatgagcgtgttctccatcggcagcgccaggtccacgccgccgtccatgtgcaccgtcaccgcgggggctccgccggcggccacctcgtcggtgttgaagcacgtgtcgaacgcgcccagcgacgtgtacccgctcggcgccgctacctgccgccggaactcctcccgcagcgccgcgtacaccggcgccgtccaccgcgtgatcaccgtgccggagtccaccaccgtgccggcgccggtggcggcgtcgaacgcgaacgatcccgcggggaccttcacccacgcgtgccccacgctgagccccgtcacgttcacgtagtagagagacgacctgtgcgggttcctcagcatcggcgtgtaccggacgctcctcggctgcccgccgccggcgcccagccggagcgagccggagaagtagtatgacctgtagctcgggaggcagtaggagaagacgccattgtacaagctcccgg

SEQ ID NO: 59361 - DNA, 13214 bp, Oryza sativa
  unsure (1)..(13214): unsure at all n locations
tcgggcacgtgccgcacggcgagcagtgcgcccacgtcgcgtcggcgctggtgtcgagcgccagcagcagctgctgcgacggcgagccgaggccggcccggacgacgtaggacgggggggcctggccggaggcgacgggggcggaggagacgccggcggtggctgccttggaggagaggaagaggaggcgggcgtcgtcgtcgcgggcgagcgcgatgatggactcgagcggggacggcgacgaggggtgcacgttgtggtacacggagagctcggcggcggcggcggcgacggtggcggccaggaggaggaggaggagagggatggtggtggtggccgccatggcaatggagctctcctggctaagctagcttgcttgctaagagagtgtcactgaggggagtgaggattgtgactgagcgagctgggtttatatagggtttctggctgttgatcctgtagtctttggcgccgatcgattgaatggtttgagcttaattacggcggcacggacaacatgacgggctaatagcgcacattcaaatcattaagtactactctagtactctgtccaaaagaaaaataaaatctctaacataagtagtatctaggttcgtagttagaattggacttgtttttgtttttagagacgaatgggtattttaaaaattttgaaatatatttattttttgacaatgaactttcgtaaatagtttctgtaaaaacagattatttattggcttgaaaaaacgtgctcacgaaaaagagagataccataagctaataagttcatcattattaaggtctcctttgattcaaaaaaaattcataaaaattttagaggatttcatccctgtagaaatttttcctatatagccatttgaatcaaatgagtgaaatcttttggaatcctataaaattcctatagaatgtctaatgccacgtaaattttggaggaaatctaacacgaggttctacctcatggaaatcgtcctttgagtttttatctctcctctaattcctgcgttttttctgcggtccaatcaaacggtcattactgtgtttttcttatgttttgcaatcatctattttactcttacattcatatcaaatttttgtgttttttctattattacattttctcaatcatgcgatttaaaggggccttaagcttttaggaccatttatatattaatttgagttaatagtatcgccgatgatttttacagaacacgttaatttgaaaaagaaataagtctttaggattaacttgcttatactcttatagacatatagttgtttcttaagtttaattgtttttcgaaggttatagtttaattaaccgtttgaccaagcacatacggacaccatcttggcatcttttgactaacctaacacatgctcaaagaatgtgaactttggtcgttggtattatgccctcacaactccaccgccgtacagttcgatgctttactatttacctcaatcatcatctcatggtggtagtaaataaattatgataaggtcttgatttttgaacaatgttctgcttctcccttggagtagaaagattatttgggataagaatctctcactagacaaaaattgtcacaagaacaatgattaattatggagaagcaaaatactggcttatcacatgcaaaattgtagtggagtgagatgcacagaaccaaattgacccttttaattacttagttaagctgagacagcgaggaagacagattaaggaagttaaacacgcctaggagtgcgaccaaaagtcacaaagatgggcaagaatattgtaccacatcctgtcaaagtttttgtccggccactgcaggtaaaacctgacgaaatccttgattcctgacacgtcctgagacagcttcttcacgggtcaacaaggacaaggatcatcacaccctgtcgacgaatcaccaggtgtgtcttagcttagttatcaaccaatcaacaaccgttgagtgtctgttaataattactgttaatttgcattattctctgggtcattggctgtgaccggcgatcaggttaacttgtttaattattaacttggatgtgtacaaataacatcaacgtagatgctcgcatcctggtattttctgcagtctgcagaaacatgtgatccgaatgatttgttcaaggaccacgatccattggtgagtaacgcatgcttgtacgtgttgataaccacacttcctatagaggggtatcttagaaagatatttaaggctttttttaggaggagcttttagcttttttatccatattttttatagctgtattagttacataattaaaaggataactttgtataattcagaaaatttataagaaattagaagttggttttccaatttcttcatattctcgtccgctgcttctcaagatataaaacgtaacctacatgcctattcctcctacaaagtaacatatgcatgtctgccatgtccgactctctgactctcatcctgtagtatatgtaattgagatgcacttgatagtgtaatagtagtcggcgtgtggtttcaactctgaggttttatgttcaatccctagccctctcacaatttcacatccctccaaatctcttttttttttctctctttcagtacatgtatttgcttcctcacaattaatctccttttattttctttcagtacatgtatttgcttcctcactattaactagctagggaaatattgatgtggactatggatattttctcggtgaatctattgtgctgtgacgcctacagatccaaatgtgtacaaatccccgttcctccacgcgtgattccgcggcctcctttctttgggggttggattctactgctcgtctgttccttcttcacgagcagccagcggcatcacgtcccatcccttccatccagctcggcatgcattgcgtgcgcacgtaaaaagtgtactacgcagccgcgagcggatggcccgtgcattgctgtactcagcgcgcagatggctaagtaaccttcttctcaatataaatgcatctgcgatagaacttgagatatcctacgattacgaatctgcatatagttatttgtccagatttgtatttgtagaactataaatctaaatctaaatagttgcttgatcagatttatagtcgtaagatataacacatctcgcactaggtatatttatattgtaacaaaggaagtattgacttgctaattgatgagaatctaaaaatacacttagcttttttttctttacttttttttttagattttacaactcaagtatcttagaggcttccatcgtttgtcctataacttattagccgctgccacctaaaaattaatcttagagttcattttgattttctttttcattgtagttgtagtttatttttcaaagttgactttaaatttattaagaatatatatatatatatatatatatatatatatatattaaatttgtttggtgctccatggtgcccgggcaccattgttgaaattgagtatatacccaattcaaatgagtatgaaactttttcaattacttaggtattaacattaactactttactaactagttcaaagcatgtttgtactgaatttgaacttgtttttgttagattttgattctaggtatatagcatccatacatataattagttaggtatgtaatcatggattgtgaaataaagttaaatttgagttgttttgttgataggtatagatatgaatcgaattattataactaggtatatactcacaatttgaaaattttgaaaaatttgagtgattttgtacattagataccatggtgccctatatatatatatatatatatatatatatatatatatatatatatatataaaactacccataattttttttggcgaatcagtggtaactagcatttatgtgagaactgcttaggagaaattaaaattctagaacaagcagttgtccgaaaactctcctatcgtcctggcagaagagagcacagctgacaaacgcaaattgtaccttcaaaagtgccttgcaagcaggcaacatcaacaagccagccagccaaacgaacaaaccagcagtcaacggtgcaggacgctactgaaattcagcacgaagatcgtcgtccatccgtggcaagcatcgttcccggccatggctatgtacaaggtttagccacttatcagcaaattaattagcaggagaagcaaggataaggaacatagacagatcttcctacatctattaatgcatctatctcgtgatcgaattgtcggtgagagtaagcccaaaaccctcccctgtttcctcctaacacaaacagaacaaatctatactccatatattaatctaacacatatctgctaatcttcgggaggccaactgtacgtcagtttgctactccattttatattacaagttatttcaggtttgtcctatgttaaatatcaactatatttgtagaaaaaaaagtagaatatctatagtaccaaattatctcatcaattataaacctataattgaataacattttttaagtaagtttgtttcttgctgaaaatgcttatacaatttttaaaattttagttaatttgaaagacgtttgatttagaacaaatttaaatgacttgtaatacgaaacagagggagtacagttggttccctatgcttccaaagggagcaggttcacgggcaccttgttccttgcgggttgcggcgaattagcgatgcacgcagagttgcagacaaagctcgccttggatcgttctaatccacggctaataatgcagttttgttctacgtgcgagcctcgcttgcatgcgtccatgcggtcgcagggatcagatccaatcccgtgcaaaagctcatgggaggatgcagttttatccagatgtagtacagctcatctgaatttcctgccacttcatctgcagtgcaaatgggttctgaacccataggttatgatgctttgagcttgcggcaaatgggttggaaaagccaatcgttttcttcttttttttttcattcaggaactctcaaattcaatcaatcctagctttttttttttttgaaataagcaaaaaggaatgcctgatatgactatatggagcatggagcagttttgtacgtacaagatttgcacaaggcacaatcctggttcgtgctcagatttgaacacaagatttatatttgtttccgtgtctctgacaggtcaaaatgcttcactggcgttggcaccagccaaatgatcatacataaaattccatgatgcgaatacaatcgtatatctacaaatgcaatcaaaccctgacgttttcacaagccctacaatattaagcggcactgataaacagccaagtggacagacaccacgacagaatagaatgatggagaaatgggaaactcatacaacagggtgttcgtcctacagacggccgatggatttcagcgaagtgaggtcttgccggcgagatggagcaacgcctgcttgtggtaggcggcgcggagctttttgtacttctgaacaaaggttgggaggtcaatgtccttctccaggaacttctggtgcagctcctccgactcctcgtccaactttgccatcgattctgagcaagcaccgaagcaattcatgaaaatgtcagcggttgcggttgggtgtttgaaaaattaaattacatggttggacttcaaacaatgacagaagcataaatcaaggtttcacgaaatggaactaacatagacgccactatgacgctagtaccagtcctagcctgatcattggccggttacagaagggtagtgcattcatagcaaacaatagatacatacaaaacatgcccatgattcggtgcactaattcacataatgtattcaactacaaataataaagcacagactcttattaaaatacacagcaaaaatgatgcagatgcagctgttcagaacccttactttggagcttgtcgagcagtgcagcaggagaatatgacctcataatctcatccttttgcctttccaactcagccaacctatcttgagcagcagctagttctgtagttcttataatggtgcactgcacaataataaatgcgatttgaatctcaggaaaaaaaattgaaacgcagacaaaatccattattatagcattaactgtatttaaagttcgtttaacaatgaacatcatggctacagtagcttatagtttctgagatggaggtcacagtactaaacctgattcctgagctccaagatccgttgctctttttccaaattttctcctgtaagttcagaagatccaaccatatttgatttagaaacagtagtaactaacaagttgtttatatctttttcatagttaagacaatccaataaaaaagcattgcatgccgataacagaaacacgaataactcacttgcaagttgcactgtctcctttctaagctcatcgcgtaactgaacattaagaaagaacaagaagtgagcaaattgacaagaggtctagcattcagacaagtcaactatctaaggttaaaagcagcaccgaatataaattaaagaataatcacccacattaatgcccaaatcacaggagatgtgccacagcccaaagcctcaaatatgaggccagaaaaagaaaaagaaaaataattggagcatatagtttggagtttcctgtgtatctttaactactggaggaaatacagaaacatctaagtacagccaccaatacaaatttcaaacacctgtgtactcagcaacaaaacttacgttgttctgggttttaacttgatcgagtgaattgaagaaagcattatatgcctctttgtctttcaacagcctctgcaactcatcaacactgcagaaaaaaggacagtattatatacagcagttttgcattccaaacaagcatgctcacaaggaatagtgtgaaaaacacatgtagtaaaggtggcgattataaaaagcaacccaaccatacataatcacttcttttagcatttatatacatcccttctgaattgcacaaattgtcgtgccctctgaaaagctagggattcttcattcattaccaattgatagaatatagaatatcagccatgatatcattattgcaattaaaaattcattactctaatattattagttagattctagtgactctcttttagtactaatataaacactagaatatgtaaaataccatggtaaaaagtaacaaggctgttgcaattttaacccacagtatagataagataaggcataatacaatgaaacttcgtatacaggaagctacaagcaacttatcaaaaaaaggttagctgctgaccttttgtcctttaaccgagcaattatccctgcagcctcagctggagatggttgagcacgcgatgaagactgggaattatcagaagctctttgatgtggaccaacattggaagagcttggtgtggatggatgtgaagatgaaccaactacagactgagggtaccaaggttgcgtagggttgtcctggaaatttggatcaggttgctgctgctgcgagttgctgctggcaagcattcagcagaaacaaagacagtaagccagaggagctcgtttttcaggaaagcttaaggcaataagtgaatcatattaaatagccacgttaatttacttatgctaaaaattaaattcagcgtaactgaagacccaaccataagaaataacagagtagctgagtggtggacactgttcggatgataaaataaacttttggaacaaaagcaaagcaattttttgagcatcaatatctgaaggctttttagtatagaaagaaactaaggattacgaatcacatcaagcctgctggctggcactgatcaacaaatacaatactttctaccaaataaaagaggaagctcagtttatagaatacaaatgctatgcgaggaaaggttaggaacagacataagaagaacaaacgaaaaaagtattgctttcagtaaaaataacatacccaaaaagaggaaatctccagctcattgtactagagcaatctgcataaaaagaaatagcaggttacatatgttccaacagttggtggtaatcaataagctgtacatgcatatagattctaacggaaaataactagtagatggtaatcgctaacgccaatgccagactaattgttggttgcatcagaaaaataaaaggaagaagaatggatcaaatctagaacaaattgaaatcaaacccctcaacgcagagttcctattgactattgtcaaaaaacgatatacttgtgataagtctcatgttcggtaggacgcgttttctactccaaaattactgcctgcgtaatcaaatcaaaatgccaagcatttggatggcaaaatgttctgtaggctacggcttgcttctactctcaaattgcctagataccgtagagcggttaatccatcactgaagattaccatgagctgctgataactaactaacttgggtgtgactttcaagaagtcatcagaacaacagcataaaaacgtgtcccccactcccccccaaaaaattccttgtaaaacctgtcttgcaaaactaattcctctacctgaatcacaatcgccgaacggattcgacaactttaacgggatcgtgaaacaaaccacagcaccggttttggatcgagggcagacacaaacctgccgagatcagcctcgaaaccgagttgccggtgcgggcggcgctcagggacggccggcgagggtcgcggaggcctggtctcaccgccgcgaggtggcggggaggggagcgcgtcgcgttcgcgttgcttcgggtgggagcaagcgaagcagcgatggacggtggccggcttgtcgaaggagaataagcaattgggatttgggggagaagaagaagagagagaggaggcgagaggcgacgcggagtcggacgcggactgggccgtggggagaggataggtgggctttctgttgggccgtgtaacctctgcgacttgggttttgtttgtgtttgcatcactgggccccggataggagaatgtgtagggagaagtggtccaaaacgtcgagaacggtagcatttgttcgaaacgattttcggtcagtcgaacaattgatcatattagcaatttattacttcctctgttacaaaatatttgacgccattgactttttatcatatgtttgaccgttcgnntgcttattgcaaaaagaatgttaaagctaaattaattagattgcttttcctatcatttgattcattgttaaatatatttttatgtaggcatataattttacatatctcacagaagtttttgaataagacgaacggttaaacatgtgctaaaaagtcaacggtgtcaaacatttcgaaacggagggagtattacgatagaaatatggtgtttaaaagtgaatagaaaaaacaaaatttctatttgactaaaaaaatcaagaacatatatattatttatacgaaaaatgatgcttgatcggtagagaatttcagcgaatgttttcattattaagaaagtgtcgtccaatcatcactagatgtgtgtttatgacatgtttatcagggatttagctcaatctgatctcacgagcatagtctagatcgagtggagttgtgaagcagctcggagatcgttcaatcatggtgatctcgaagaagttgagttgtgggaaatcgttcgatcaaggtgatgttggagttgacggcacaatcaaatatcgagatcaaggctgagggggaagtgggaagtgagtcgtagtgcccggtgagggagacagcgtaggtacgtaattagagctagctagtaagctaagtacggcgccgtcgattaaacaccataaaaccacggcggcacacgtacgaccgatcaatattcgatcgatttaccttcatcttgtaaggacacgataggagcatcaattcctccggagacaatctcagatcgaaggggcgatcgttaacgaaagcgcgagattaattttatcagctctctagtgtgattctctctggtatatgctgagtatcattcgtaagtcgcaacccaccgtaagctatgcaatcttataactatactaattttagtgttgatccatgttaatcatacaggaaccacctatatatttatcgacaaattttcttttaaaaatttgatagatataattatagtacaatcgcaatgtaattacactgtaacttgcatgtaactacagtataacttgtatataactttcacgtaattttgaatcattagatctattacaagatttgttctagtgacgaacaaaaagatcacagtacacacgtatatgaaaggatttgttcccacgacctcgattttaccgaaataacatgttacggagagatttttgaaagttacatacaagttatattatagttacagtgtaattacatacaagttacagtataattacactgcgattgtactgtaattacatctgttaaatttttggaagaaaatttgtcgacaaatatatagcaaaattgaatcatatatatccttccttccttatatagtgtggttgcatctccacatttttcttttatttttcaccggtccattgactgtaacagtaaccgcgtcgccctagcacgatacggcaccaccttagactgtggtcttgacatgtgggccgacatggcacggtccgatataggtgatgtggcgtgttaggttaagccacccatttggcctgctatataacaggtgggtgcttggttaccaggtcacaatttaccacccctaaaattaggtgagtttaattttattagcagttgtttggttgtggtcgcagttagtagcgagagtatctttcaataaattggatctcacgcgttattagtaacataaaacgtgtatcaagatcatgttagccttgctaacatgtgattaagaatttaatcatttcaacttaaataaacgtgacgataatatttattgataaacggtgacctgaacgaaccacctactcctaaatttgtttgcaacactccaccaacccgtcttccaggctccaacacggcaacacctcatcacaccgcctagctactgcatcgtccacgcatcaatccatcggtcagtacgttgtccctcctgacctccctgttcctcgattccttcctccatcctcccgagaaaaaccacccaaaacagtttcttcggcgagagctcaaaataggatactcctacccctagctactctacaaaagctcatcaatttctgaacgatagcaggaggctttgccgtcatagaaagaaatggacggacgatggaccgactgatgccaacgtacccctcttccacccccccttcccctcctctctcctctctcatggctatgtttagggcatttgaccggatgtcagaagtcctctctcctctctcatggctatgtttagggcatttgaccggatgtcagaagtcctctctcctctctcatggctatgtttagggcatttgaccggatgtcagaaggagttttcggacacgaataaaaaaactaattttataactcgcctggaaaccgcgagacgaatcttttaagcctaattaatctgtcattaccacttgtgggttactgtagcacttatggctaattatggactaattaaactcaaaagattcatctcacgaattcctccctaactgtgcaattagttttttcatttatctatatttaatactttatgcatgtgtccaaagattcgatgtgatgtttttagaaaaaaaatttgggaaactaaacgggcctaatagttccaaagttttctttttccaaacttctaactttccatcacatcaaacctttcatacacacacaactactgttctatcacatcgtaccaatttcaaccaaacttccaaacttcagtgtgaactaaacacagcctaagagttgattcttttaatccctccatcctaaaataaatttaattttctacatatatcaatactccctccgtcctagaatataaggggctattgagttcctaaaaacatcacatcaaatctttagacacatgtatgtagcattaaatatagataaaaagaaaaactaattgcacagtttgcatgtaaatctcgagacgaatcttttaagactaattagtccatgattaggcataaaagtgctacagtaacccacgtgtactaatgacggcttaattaggctcaaaagattcgtctcgcggtctccagacgagttacgaaattagtatttttattcgtgtccgaaaaccacttccaacatccggtcaaacatccaatgtgacacctaaaaatttttatttcaccaaccaaacaggtcctaagaaattttagggctggacacggttattaagaaagtaggtagaagtaagtggttgagggttgtgattggttggaaagagaatgttggtgcagaagttgttatattttgagacaaatcctgatggctaaaaattgttatattttgggacggagggagtataaagcttaaaacagaataccatatttattaaatcctaatacagtcattttccagtactttatctgcttccgatatattttttaattttcatgaattttgatgtaatgattattaaaaataaacttattttaagataaatgaatgaaacttactcctaaattttattataggacgaagggagttacttttattcttcagtagctcattttgtagattacggagttttcggtagcttatattttttaggaccgaacatttcagaagaaactcactactacaggattgattatcctggacaccaccccattttatttccatgcggtccgtaagtcagactgcacggaaaaatggtgggagcgtcgcccgcacacgaaaatcaatttttgtgtgcaggtgacttaacaggcccacacgtgaaaataaccctattttcgcgtgcgggcctcctaatccacccgcacagaaaaatagtcgtccctcccatcctattcaaaattttcctctctctccccgcggccccttctctcctctctctcccttatcttctcaccttccttctcctccactcattttcctccctctttctctcaccttcttcttcagttgcctccttctccacaacccacaggcgggacggcggtgagctcggcggcggcgggcggacgtggggaggcggcggctggcgtagacgggatgggcggcc

SEQ ID NO: 59362 - DNA, 3511 bp, Oryza sativa
cccagcagcaactccggcgcgcgggcgggcgatgacgggcgaggagccgcggctcctcccctcgccggcggcgacgggagcgcgcgggcggtggatccggcggacgggagggcgatgaccggcggccgcggctcctcccctccccagtggcgacgggagcgcgcgggcggtggatccggtgggcgggagggcgggcaacgacgggcggcccgcggctgtccctgcccggatccgacggcagcgttcctctcctgcccttccccgctcgagggcgacgacgacgaggcgggagcggcggcggcgaccacaatgacgacgatgacgacgacgaggagggagggctctcctctccctactttcgcgaggcgacgaccgggcgggtgcggcgaggcggcggcggcgagggccgacggcaaccggcccccacacgcccggatccggcggcggcggccgtccctcacggcggtgagggtcggcggcgggcgcgacgatgtcgacgacgagttgcggcggccggttcgcttgcaggccggcgggcgggcgacgatttttctttttttttggttttttttattccgtgtgggtggtatagtatgaccgcacgggataatcgattatcccaagcggtccttccgtccgcacgcgaaaatactgattttcacagacagcggtgtgcaggcgggtcaaatgaccgcacggaaaaatggatatccccgtatggcaaaatgagttacgtagtagtgactgtagctgtcaaaggatctgtttaatttgaggagcctctgacagctacgatttcttctaggttctcactcgttactttttagaatttggagaattctgtaatatatctctaggccctttaacaactgtcaactaaaatgttgtagtcgaggaatatacaaaagtacaactaaaatccagaagccagaagctatttattttcagctcatctcatcttttgtttttcagaatctacaaacatgccataggctgtgtttagttcatccccaactaccccaaactttcaagtttccatcacatcacatcacattcaaaacttttctacacacataaattttcaacttttcccaaacttccaactttttttagaaactaaacacatcctatggagtgggacaactgcagtttcttctaaaatactccccttttctaaaatataagtatttttagtacagtgataacccaaacattttaaactttaaccattaatagaaaaaagatcaatcatgaaaaaaaatgatgttactggatttatcatcaaacagactatcatagtatgtaactctttttatttaaatcatcttacttttatagatattgttggcaaagtagcatctcgaaaaccgtgtcagggtccaaaaatgcttatattttgaggtggatggagtaacaagtttcccaaacaattaagcttttcgtccagattctaagaagttgaagtcagagtctaaaaaacaaactagaagtataaggtgtgaaacctagttttttagattatcagaagatgactatcaaatgctccctccgtcaaaaaaaaaaagcaacctagagccacatctccttctagtagtacaacgaatctgaacaaccctcctagatccacatctcctcctaaattgtctttttttttggacgaatcagggagtactccatatgtcaaaaaagaattcaactctacggatgaatctgaacatatagattttcttttaatagaaagagtataattactccatctgtaaaaaaaaaaaccactaacttagttaaacctatttgatgtgattgattttttttaacgaagtgaggagggtgtttgggaaacagagacttattccaagtctctgtcacatcgaatgtttggatactaatttagagtattaaacatactgtaattataaaacccattccataaccttggactaattcgcgagacgaatcttttgagtctaattacgccatgatttgacaatgtgatgctacagtaaacttttcataattatggattaattaggcttaaaaaattcgtctcgcatattagctcttatttatgaaattagttttttttattagtctatatttaatactctaaattagcgtcaaacatccgatatgacatggactaaaaagttttagcctcacctaaacaccccttaattcttaaaattttaagctcttcgaaatagttccgaaggctcttgaacccagaactatgtgacttttcaaaatgtcaaaagttgcaggggcaatggcgtggagggagggtacactagtccctgcgtccccaggggatgtttagatatacagttgtaaagttttagcgtgtcacatcggatattgtattatggtgttgtatgggttgttcgggctctaataaagaaactaattacataatccgtcaataaaccgcgagatgaatttattaaacctaattaatccatcattagcaaatgtttactgtagtatcacattatcaaatcatagagcaattaggcttaaaattttcgtttcacaaattagtcgtaatatgtacaattaaatttttttctaaacctatatttaaaactttatagagatgttcaaacgttcgatatgatatggtgaaaatttttaagttgagatctagacggggcctgagtcctaaccacctcgtggcggacacctgcctccgtccctgtggctccaccacttgaaagcctttgccataaaaagtaggagtcgtcctactcctacccctacccctacccctgctgcagtgctataggctagccctacctccctgctcctgtttcctctctttctctctcgcctccttcgcttcgcttccattggtggtggtctccattgctcccttcctccctgcctttttcttccataagtagtagtagtagcgggagtggccgccgccgcagccatagatctgcggcgccgcgtatctcgcggctggtttggctggtgcggttagcggctagggttttggttgtttcgtctgatcgatcctccccgattttgcggcggcggtggtgaattggtgtgtgatctgatatggctggcggcggcggtggcgggggaaggggggagggggaggggagggcggcgacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccaggtatgcatgtatatacagttatacacacaccaacacatatatgcttctctcttcctcgccggcgtctccttcgctcgctcgcagttatttctgtttaatttgcttgcaattaaatctcgatctgggtgatgatctctctgtcggttcttggaatatcgtactattgttagggctctttgtcgatcgatcagggtttcttttttcttctg

SEQ ID NO: 59363 - DNA, 3994 bp, Oryza sativa
tgtctctatcagagagattatagatctttaattttattctcacaatattcttattggtaaaagttcattggacccttgatagggcgcgcaacgcgcgcaaaatgtctagtcggggtaattaaaagtaagggcgatctgcttgcaccatggcgttcggagggatttcagcacgacgtggctttgccatggcgcatgggatttttacgcaaaaaaaaataccgttctttctctgttcgctgggccatactttctcgtgggtccacatgtcggtccgcccgcgctggaaggctggtgaatttggagcgctctcttcaatcgcctggcttggccatccgattgatatccgatcgtcgggatcgttagctcagtagcacacgatatccccgcacccacaccctcctctctctctctctccaatctcaacttcacaaggagctcgggcaaaccctagcctaccgccgcccttctcctctctctctcccttcccatccccttgggaaacgctagcccatcataaccgtcttcctccttcctaggtcacgctagctccctttctccccttgcatcctcattcctcatgctgccatcgaccatcctcattcctctcttgtcccttcgttgctggcgttggcgcgatgaaagatggtgaggggctgcgtggagactgtagacaggagacaacgtatcggcatatcgcttgaactggcctgctagcacttgattcggagggaaccggcagtttggcttagcgaggttgtcgttctgttgttccagtgcagcgaggcagcgaagcatagatctgaggtggtggcgccaagctctgatactgggcgcacgcactccactttccccaagacatcgtacgcaaccgtgcctttggcaacggcacctcaagcgcttgaggtcaatggcgctctattttctcacgtgagtaatgtcttctctgttgtcaattactccctccatattatttttttgtttgacgttgtagttcaatcctgaatcggttttttatttgacgccgtagtccaattcttcctccgtgcgaccgtgaaattccatcgttgccccttctccttgtcaccgccgccgtctcctcctcgctctcgctatcgtttcctcctcgtcctcctccgctctcccaccttcatcgcggcactgctgtctccgcctctcacgttgacgtcgtccccgcctcctccgtggttgtatctcacgatggcgccacctcccttccatcctccccgagaccggacattagcggacgggggcggaggccgcgcggatctggaaggacgatgcgggcagttggcgcaaatgacacgctctgcctccgcctccaccaccgaccgcccgaactcaccgcctccatcgccggtcgtcatgcaggaggtgtccttctcctcaggttcatcatcgagccacctcctcgctgcccccctccgccgcagcctccacctcgacggccgcgctcggcccgttctccccgtcgccatccctactgcgggcaatgctacctccttgcctcgcggctgccgcccaccacccgcccatgtacgccgccatcgttcgcggctccacgccgccgtgcgcacttgcgcccgcgcgcaagagagagagagatattaggaagaggtgaagtggaggcatgacaggtggaccccaccattttttaaaaaaaatgctgactggactgccacgcgtatgccacgtaggataaaaccgctctagattggtaattcatccggtattgaaagttcagggtgagcaatgcatggttttcgggttcaagaaggtaattcggtcaagcgcgatagttcgggtcggggggtgtaattcgtacttttttcttttaactatgctatctataagagcatgtctaataggtcaacctggatcagtgatagcgtaaccaagtcagccccactgctgtgctggaggagaaaatggtagagagagaacgcgagccgacgatacaattatcacccagctgcagcacactgtacaatgaagaaagagaagtaaacctggtggagattggttcatgcttggaacaatagtgaagaatgcagtaattagtgggacatgtatcaattaaaaaatatatcagttgttaccgtaaatgatagtaataaagaccattgttatatgagcaatctatactaatgtgctatagatgatgtggatgttttacggttagcaagtttacgacattattaaacctgctctaaatcaataaaaggcaacttgtataatatgttaccgcttaattagcacacaaactccaaaatcttctttaactaactcactctcacactatatattttactttctctttccattttttttaagattgtgtagaggttacattttacatgttagaacaagattaatactattagtaggttataaaccacttatgtaaagaagagagaatctaaaaaatgaagcggtcgatttttatgcaaaagttagctattcacacacttcaagataaatacattaaatacatagatgaggaatataaagaagagaagaaaaataaagataaccttatagctcatctactatacatactccctccgtccctaaatataagggattctggttggacgcttatcatgcataacagactatatatcgttcaaagtgttttgttgaaattttaactcgtaaaaaccatctggttttagttaatctcatcgatattattttcttcattaaagcaggaataagaaggcatgtagtttgtacatgcatatatatactgaaattaattattacagctttcagagatcagcagcagatttgtcatgacaattacatattcttcatgcatgagtaatatatatatatatatatatattcaattctgttgcttttgtcacgaatagttgttagttttaaccgagcgtgcttaaactgaccattatttttaagcaacttcaaaataaaaaggtttaagtccaactcattcataaattatttttttattacaaatctaatggtataactttgatgctaaatactaactagatttcttaaaaatattgttggtcaaacatagctaggcaactcaatgaaaactaacaactatttaattcaaattatttttaatggatatggtatatatcggtatacagtctaattaatttgtcaactgaacttgggttactgatggttctaaccattgtgtatacatatatgcaaacaaatttagtcctaattatatgtcgtaacatgagggtacgtactgtgttgatcgttttgtgttatgaactaatcacatggaaagaagtgcatatatatatctaatgtcaagagtgttgttaactgataccccacatatatataccagaatgtttacagtgttaattaacacatggcaaaatcaagcaaaaatacaaccaatctaaacttgttaattgttcaatctttgtattcggggtaactaattaagctagagctgtcaaacgaaacgacctctgatagtagcacacatatatgggattctccaaagtgataggtttgcgactgttaattgtttgttttttttttctccacaagcgacgacagaaaactagctagtcgatctattcttttcatgtacatcacttacactatttgccagtgcatgacatgatctatcagcatgcatggatatagagtgtgcataccaattggcctggtagctagaaaaagattgaccaatccaatcaaatggatccctgagcttacgtaccgctatcagagtttgtccaaatatattttcaattataatatataaaaatataagtagatatttaattttattaaagtactttttaaaactaatctatgttccagtgtttttttaagctaaatatttaaaattgttaaagttctagtcaaacatgataattatggaattagaaggagtacgtacataagagcaagtataataaaactcaagatcgtgcttataagactcaagtgttgtcttttaacagtgtta

SEQ ID NO: 59364 - DNA, 22156 bp, Oryza sativa
ttatctggaggcatttgattccttgtgactttatattggtgagcccagatacaagggcagtttccgcaagcaatatcttactccctctgtcttattttaagcaacaatgagtttttcatctaactttagtcgtccatcttatttaaaaatattttataattagtatttttattattatgagatgatgaaatatgaatagtacctgtgacttatgtttttaatcttttttttaatttttttaattaagacagatgatcaaaattaagcacggaaaatcatggtagaagcactcgatattcgattccttgggacttcatattggagaacacggacacaagggcagtttccgccagcaatagattactggatatcaaagttgactttgctgacagagagcctcatcgagttagcttatcacaaaagtccctttcgtcgggtaaccacagttcgcatccacttgtatctatcctgacgtccttcagttcgcaggataccaatatcgtcaattatttgcgtctgcgatgtaaacacgaaaaaggctgtagatttagccgatttgtttggacgaagtcttgaaggaagtgttctctgcggctatatttatgcaactcgttcacagtttagtggtcatgttttcgtttgggctactatactttgtgctctagtcaagttaataaacttatccactactcatctactggctagttgaccaccttcacgtagggtttcgtcaaaccattatacttggtcagaatcagaaactgtagtactcggtatgtactatcaatctgtactactcaagtatttaagaaagcatccgtacttcacattgtaagaagaaaaatactatgatcttcagcagaagaacatacaagaggataagactaaattccctattcaataggctaaattcctaattaaaatggctgcatatatccggttggatataaaggccaggtaaaaaatatccttctctaaaaaaacacatatgagaggatgaactcctactatacttacaaggaggcaacagatgatcagaaacgtttttcgttattccttagaaaaagaaaaaaaaagaaaaaaagatttgaaatggctcaatgctaattgagtacttgtctaatctctagagagtactccgtatataggtttacaagagtagtcatcaccagaaaataacttttggagggaaactctattgtactaaccagttcgcgttcacactgcacgctactcaaaccattcaatccgaccatctctgctccatggttaccccgggaagctctcgttgcggctccgccttcttgccgatgatcggcttggccgtggttccgtccgccacgtcccgtagcacgattgcaccggctccgatctccgctccgtcgccaatgtgcacattgccgagcacgctcgccccggcgccgatcagcacaccgtccccgaccttggggtgccggtcgccggactccttccccgtgccgcccagcgtcacggcgtgcaggatggacacgccgtagccgacgacggccgtctcgccgatgacgacgcccgtggcgtggtcgagcaggatgccgccgccaatgcgcgccccggggtggatgtcgacgccgaacacctcggaggcgcggctctggagaaggagggccggcgccctgcggttgtcggaccagagcgcgtgcgccgcgcggtgggcctgcagtgccaggaagcccctgtagtagaggaagcagtggaccatcttggcgcaggccgggtcgcggtcgcgcgccgcggcgaggtcggcgcgcgcggcgcgcccggcctccgggtgcgcggcgagcgcgccggcgaggaggtcccggagctggtcctgcggcagcgcgccggggatgcagagcttggccgccagcagcgaggcgagcgcggactccagcgacggccgcgacaggacgaggtcgtggtagaacttgcggaggagcggctcgtcgtccgcgtcgtcctgcgcctcggcgcgcagcgcgtcccacacgtagtcgccgctgctcccgctagccgccggcgccggcgccaccggacggtccgtggtggtgcagtccggcaaggcgcagtagaacttatccggcaggcggcacgggtacgccgccggccacttatcgacgcaggctgccatttgcgccgcctagagagagagagcgagaggcagaggccgtggcggtggtggtgaaattgcaagaggagaatggtgacaccagcggctggtgctcgagctcctttattggtaaaagttctttggatccttgataggggtctagtcggggtaattaaggctcccatcggattgcccattaagcagaaaaaaaagctaaattttaaattttcaaacttaattatgagattgattttgagatattttcaacgtagtttctatttcagtattgacttttaagtcaccaagaacacatatataaaagttttacctacaaatttatttttattttctaataagccgttttggcttattagaaaaaaagcgaaacgatggggccctaaaagtaagggcgatctgctcggaccagggcgttcggagggatttcagcacgacgtgctcgctccccaagctatccacatcgccccgcacggtggctttgccatggcgcgtgggatttttacacaaaaaaaatttaccgttctttctctgttcgctgggccatactttcatgtgggtccacatgtcggtccgcccgcgctggaaggctggtgaatttggagcgctctctttaatcgtctggcttggccatccgattgatatctgaccgtcgggatcgttagctcagcagcacacgatttccccgcacccacaccctcctctctgtctctccaatcgcaaccagtgttggaaatttcagaccgaaattttcggtcaccccagatacgatattattttggccgaaaattttcaatttttcaattttttcatgaatttgggtaatatttgttcaaattcaactaaattttgctcaaattttcagaaattttggaccgaaatttcgggatttcggtgacccccgatacaaatgcctcaaccgatagagtgaaccctgatcgcagcttcgcaaggagcctgagcaaaccctagcccgccgccgcccttctcctctctctctctctctgttcccatccccttgggaaacgctagcccatcgcgaccgccttcctccttcctaggtcgcgccagctccctttctccccttacatcctcattcctcacgctgccatcgacccccaccgttctcttgtcccttcgttgctggcgatggcgcgatggaagatggtgaggtcgtcgttcaagagacagcgtatcggcgtatcgcttgaactggcctgctagcacttgattcggagggaaccggcggtttggcttagcgaggtcgtcgttctgctgtcccagcgcagcgaggcagcaaagcatagatctgaggtggcggcgcctagctctgatactgggtgcacacactctactttccccaagacatcatacgcagccgtgcctttggcaacggcacctcaagcgcttgaggtcgatggcgctctattttctcatgtgagtaacgtctttgtcagttatacttgccatggtatccctggttctgattgcttgccaaccatctcagtcactatctcaaattactacatctaatgataggatttttcatccatattaccctggttctgattgctcgccaccatctcagacataatctcaaattgctagctctaatgatatgattttgcatccatattacaccaggattcaccagtgctatgaggcattctacattttggtacagtaatcggatgatatcagcagaaagtgaatcaactaaatgcttatttgaaaagaaaatttctgagtttttatgcgctgaagcttcatctgttatgtgttaattacataaaaggaagtgactgctaggagccacagaagctgtggtgggcaaactaatatactttggagctgtgagccagtgaggctagattgactaaatatatgtggagaaaactgcccacaatatgtattttagaactagccgacaacatgctggcatcaccaactaatttctatcatggtagcaccctggtcaggacagagctttgaagttttttggtgtcctctatgtagcacccaagtgaatcaatgcaaaatttgaaggttcatgtccactttagatttcaggtcagtttgaggttgtgccattagtgtgccatgaggttgagcacccaccaccttgcctaggagatgcaacttactcttttcctgagtcatgtctttgtatcaagctagctctgttaaaattatcatcctcattgactaatgaaaaagcatattaccagatttggatctataatacagttgtgtttcagtgttaaaaaaggataaaaattactaatatttatcttcctttccggtttgccttctactctaattggtagtgtgaaatggttgttaatagacagtggaatcctttttttttgagagagaaataagtgcaatctgattataaatgggaatatcaaatctgatgactccttttgttctgttcatgtaaaatggattggctactaccatagaaggtgctaaagtttgtcaaaattccaggagcgtttctcaaccttgtggctctgctttctcatgttataatgtgctaagcagctgcattgcagttcaagatgtattattttatacacaatatttggaaatgtgagaattgccactaatcttaagtttctcttaagcatgttctttaaatacagcggtatcaccgcttagttaccaaagacaagaataaacaaacttttttttgaacggaaaacaacacaagatagtgccttttcattgaataaagcaggagaaaatacaacccctaagggtaaagagagaaaaggtgttacacgtaaaatatacactatacagggtgcgggatgaactcacgtaaacgtttggcccctgccagagcccaaaggctaacctcctctttgattttcgttagcagggagctcgttgccatctctttatggtcaaagatcctccgattcctctctttccagatctcccagacaactaacacggtgagggatataagtcccttcttcagaatgtcgggcgtgtttgccatgttctcccaccgctgctgcaccgagtaggcttcctcccaatgggccggttccaaatatagaacaaacaaactgacaatagaacttgctgcacaaattattatctcatctttctattttgtttgatattagtttttccatttctaaattaatgggtaagaggaagaaaccaaagccgggagttcattttttgtttactctttttttctatatatagtttaagtgataatgttgacacttcttaccgacatgtactataaagtgattataaaatctatcgattgacttccatgcatgactatctttgtacttaatattactcaaactggtcagaagtatgctttgctttagatgctctcagcagctcttgcatagtcatattatttgcttttctttgagtactattcaatgctatcctataatcatctgtaagctacataactctttaatgaatggcagggcgccgcgaagcgcgcctaaagtcgtgcttcttaatttcatgttacatagccatacataaaattaaattgatcaatgatcctggaaaaaaggattaattgagcaattatactgcacagcttttgcggtccatttaatgtaactctatattggcaatttggcatattggcaatttagcatattgatcgataccagtatcatgcaatggctccgttttatgctgtgtgtatgcatcatgcatatatgcagttagacaccacctagaaaggtcgaaaatgctgatggctaacctggtgatatgataaacacactaatatacatgatgcatcaaagaaagtgcaaactttacccctcgttgatttactggcacatttgttatgtcatggcagtcatgctcatgttacattgcggtatagtgttaaagtgtacatggctactgatcaggctgaaatcgagggacgtagaaatcgtgtcagaaagatcgtggatcatggatggatgatggatggcagaagcagaacacatcaccgaccggtcaaatgcacgccgagattacttagctgtgaaaatacaatgtttggctgggaagtcatcgttgcatgtgtttcggtgttgatatatgttgtgctcgtctttggaatgcagtttattttcaatgttcagaaggttctgaatttcttgccaaaattcaacttctcgacacttctcctagccgttactccggccaacttatctgggccgtaggctgaagaaacgaccatcgttgcggagcccagagcgaaagcaccaaagtcctcttccccattcccaactccgctcctctctctaaaaaaacgacgcagcgcgtgcggtcaccgcctgcacagatctcagcgcggttgtctctgccaacggttgggccgccgtcgccgccatgaaaaaaactaatattagtgaatgacctaatatcaaataaatagaacaagtgagcttcgaacccagaccggctagcccatcactttgtggagcaagctggaagacctctaggtgttttccaatggaaaactctatgcgtacgaataattttgttacggaacatgttcgaacagccaccatgggctgcttctttagcctacatgttgtaatcttctcattagtacttaagcccataactaataaaggcccatgtgcagaacgtcgtgacgtggtcccgccattttccagtgattccctccaaagctaacctcctctccttatcttttcacaatctttgggtaacagaattcgatctgtaaggttcaacaaaaaaaaaaaaaaaaactcaatctccaagtatcccttgatgagcatcctgaccaggtatgtccctgtctatgttttgccatctagattgagtatttcttatgccgtagatcaaatgcattgcacattccttgatgcttcaaccttcataaactgaaattgcattttaggactaaaaatgcacattaagaaccctttcattgtcggcaattcaattaactcgtcgtgttggtttcattaatttcatagtaaaccaatttcacaagaaaagatgtttattgtgtatgttagatttcgttcttatagctggaaatattacaggtagaaaagaagcctttgatgtcctcttctactgttctattctacgaaatctgaagaagcatagaagaatttatgtgcatagaagcatggaagctttgaagtttggtactacgtatggattctaatttagttaaaagaattcagcctgaagtagcatatatgatgcaaaccaaaagaataagaggtatatttttattttctgcaaatctatatatactggagaagatctaccatactaccacaggcaacatctgtccaaactccagatgagtaaatcgtgttcaaatcataccaggaaattactgcatgctaatagcagtgcactattgactcctacacaacgaattgttatccttaatttgcagcataagtggttagttttgtagatccgtacctgtgcatgaagccaaccagctacctatagctcactgctcgtattgtgggctgtggccgtaggtgagcgtcctccgcgtcggctgctagtgcaatcgatattcttgtagctcatatgtttgattgagttgattctctccttgctctctgcatctccgctcaagccaagcactgaaggagtaagaggggtactaaatctgtcaatctgagataggggatctgtttttccctgtactagaagaatccagactgcttattgatagagtgggctatggggctgtgacttttcatgggcttttagcgttctgtgtccccgaagtgtcgtacgtagggatcttttcatacgcacttcgtaatagtttcttcgtgtgtatagcagtgttgttttccaatcgattgagccactgatcatccgcaaagacgaagctatctccttcgtcgattcatccttcccgaacacctcattactcatggccataaaccggatgccccatcgggtgcggacctagttgtgttcatcgctgatgcgcatgaattgctcttaattgttgactgggcttctaagtgcaagagcattttcgacatcaacaaaaacgatgtaagtgtacaattttccttttttttatttctccagcaatacactggtgaatacgagtttgttcactttgggggtggtcacattactaccaaaatcaatatttccaaattagtcaataccaaaattttgacaaattgacaacattgttgttggaggcataccatgaggactttcaaccgaacgtgccgaaacaaccacttagttacgaggcgaagcacttgcaagcggcgaaggcgagtaccaagtggcgaaccacctaccaagcggcgaagcgaagacccttcactaacaggaggtgaagcagcatgacaaagccaattgggctctaaacagacctaccacgcaggaaggcccaataatcaatctaggactggaccttaagagcccatggacccactagttgggccaaaagattattgtagcccttgtaaatatccttgtcataagggcgattaagtcattcccgagtaaggagaaacctagagttgcaaacatagggttttacaactataaatagaacctaagtagtatgtaacagggcatctattttttttaagaagatcaatatacattccactttacatttccacataattaagtaacaacttgccctttagcagatgtgtttgtcaatcgataacacttacaagttttggtacaatatgataaatgtgttgttgctaaaatttgataatgcaaaatctggtaatgttgatagtagcaacaaactaaacaagccctatatctacatacacatccacaataatattgtttatttcttatgattgtgagtagtccatatgttgggtagcatagcctaaagactacgtttataatatataagtaggctataaggtacttaatacccactcctattgctatggatagcacttaaacttttataaactaacatagtatatgttgtgtttatgcatcatgcatatatgtagttaggaaccacctagaaaggtcgaaaatgctgatggctaacctggtgatatgataaacacactaatatacatgatgcatcaaaggaagtgcaaacttcacccctcgttgatttactggcacatttgttatgtcatggcagtcatgctcatgttacattgcggtatagtgttaaagtgtacatggctaccggtcaggctgaaatagagggacgtagaaatcgtgtcagacagatcgtggatcatggatggatgatggatggcagaagcagaacacatcaccgaccggtcaaatgcacgccgagatcacttagccagttgggctctaaacagacctaccacccatgaaggtccaataaacaacctaggactgaacctttagagcccgtgacccactagttgggccaaaacattttttagcccatgtaaatgtccttgtcataagggcgattaggtcaattcccgagtaaacaaaaaccatagagttgcaaacatggggctttaaaactataaatagaacccaagtggtttgtatcagggcatccaattttgtttttaataaatcaatatacatcccacatagttaagtgataacttgcccttcagcagatttgtttgtcaatcgacaacaattaccaagttttggtagaatatgataaatgtgtttgctaaaatttgacaatgctaaaatatggtaatcttaatagtagcaataaactaaataagtcctgtatctacatacacatccacaataatattgtttatttcttataaatgatccatatgttaggtagcagagcctaaagactactataaagaatacttttataatatgtaagacccactctattataaacttttataaactagcaaaatattgttttatatctttgcaataaacatgacacttgcaaactaataaaagagcttttataaaatacatcgattttattaactcaaatctaggttatgttattttgaagggttgagaaccccttctcttacacacaaacgaaacgacatatcaacgtataattaattaagtattagctaaaatacttaaaaaaaataaattagtatgatttttataccaacttttctatatatttttttttcaaaaaactcatcgtttatcatttagtagttcggaaagcatgcgagtggaaaaggagtgctgggaagaacacagatagaagtattaatattatttaatagtatgatcgtaaatgaacttttaaattttgaaatatatttaagtggtatcttttgataccataatttattaattttatattattagtatttattttctccatttgactgcataagatataagaattttactatcctcactctgttgcacccaatgtgtatttacaagacaagtttattgttgtatctatatcgggtaattaaaacttccttatacaaaattggtttgcctatcaggatcatgatacacaagacaaacatactcgtgcacatgttatgcgttatcagcactatgttgcatagatattgagtaaatttggtagttatagtgtccattaaaattctattgcatactttgaattgtggtatgcaaagagagactaataactttggggcctcataccagaccgtcggcttctccagtgaaacaggcctcggtgcgccggtcaaaccaccctgcatctgaaacttcatcaatttcgtccaaacttttgaaacaccgggacactcttttttttaacatgagccaaatcatttgccctaaagtttttctctctagcaatatgtttaataagaaaatcatcaaaattaacacaatatgcctaataagaaagtcatcaaaattgacgaaaatgtttaaacatatatctaaataatatctattttctggcccgtcaaaacggttatacaccctgaaaacttgtttcactatcaattcgagtaaccaaaatcttctatgtgtatagatggccaaaaggcccaagccccgactggtgtcagcccgtgccggcccagctgtaacgccccgattttcgtttgggattaaaaatcaattaataatgcatttcaagaaattatattaaaagttaaatcaatttaatcaagtgaaattatagaggaaattaaaatttcctttaaaaatcattggctgagaatattttgtaatattctttgtgccctaaaatactctccggatttttccgcaaattttcggagctcaagaaataattttaaagtcacaaagatcatttaaacaattaaataaaaagaaaacaaatttaattctccttccttcccttttgggcttggcccaagccttcccctcctctcccgcgggccgcgcgcctcctctctctctctcggccggcccgcgccttgcgaaagtctactttatgtcccccggtttccctcctctctctccatccggccgacggtcccacctgtcagctcctcctcctacctctcgccagccaaccccagccgccatttccgcccatgtcgccgcaaaatccagcgccctcccgcacccgagctcgcatctaaccacgtggacacgaccccctccacgtcctccaccttttcccccactcaccccgcaagaaacggcgccggtttgacctccccacgagctccacttcacctccccacgtcaccggccgatcccgcctctcccggccacgatctccatccccgagccctatataaagcaccctcgtgctcccctcctccgttttcccctctctcccaagctcccccatgcccggaaccccctcctccccgtgagcccaagcgccgccgctcgtcggcggactccagccgggcgctgccgccgctaccgccgtccccgtgccgcgccgcttgcatcgcaggcctcgccgcgctttgccgcatcccatccaccgctccgcttccgcaataaaccacccgggcaccgattccaccgtgaacccgagctccaccgccactttgccgactccggtagcgcgccaccgccgccctagccaccaccaagccacgccaccgccaccgtcggcttcgccgcatcgcgtagcaccccggcctctgcttcgttttcccgttccaccgcagcaacaccatctccaccgcgaagccgaggacatcgccgcgtttgccgccttcggccgcctcttaccgctgttccttgccacctcgcgccacaccaccgcctctactgcgttagccgcgctcccccgtaccccggccgctcctccaccttcgttggagaccgccgaatcgccaccgtcgtcttcgccccgtggagcgccgccgcctccctccgcggccgctccctccgtcgccgcgcctctcggtgggccgcctccctcctccttttcctcttcgccagccgcctcccgtgccagcgccgcgttgcaccgccgccgccgccggttgactggccgtctgcgcgccgcccggccgtccccagccgtccgatcggccttggccgatctgggccgtccaacccgtggaccggcggtggaccgtccttgtggtcccggtccacggtggaccgccacctcgtctcgctgacatgcgggccccgcctgtcggcgccggcccactctcttgctgacgtcagcggcagtccttttcctttgtgaaaatatttaataaatgcgcaataaatcattaataattatagaaattcatttagtggctcaaaacttctaaaattcatatctaattcattcgaactccaaattgggccattcaaattgcaaaattcatctaaaattgagctctacatgtttgtttactttttatgttctgtttccttggtttttattagagtttttcctcgttttgcgtgcctgcgtgtagaatccgtcgtttcagaagatcacggtcgcaaggataagagttcggaagattgtttgaagaagcaaggcaagtcacacattccccttgagcatattgatcccaatttataaatgttttaccgtttacaaataaatatgcatgttttgctaattacatggggtcagggttttacctatctgctcgcttgtgccatgtttacttgatatctgtcctttatcaaccatgggtaataaatcgcctagcttgtgttactttgatgacctagctagaactatatgcttagccatgcttaattaccactagctcagttgatgggataattacagtattagacctttttagtatcagagtgagctgcgtgctcgagacatctggccatgcttcatggtcgtaattatccaactaaaatgcgactgaatggtgggctgtgggtgcatggttttgctggtcgcacccatggcagttaaggaccgattcgcgggatgccctggaagaacttatcgtacttaccacaagccagcgtgggcaacggctgggcttgtagtgtagctttcctctagccgacgcatccaggcaagggtgggcgtgatagagcggggcgggccctgcgacggcctctgtcgcttccggattcacctaggcacgagaggggactgcccgttgcccgctggggacggggggtgaaacctgaggtgtggtgtgcttggttagagggggttatgcgaagggtcctgtcacggcctctttccggtatgtcgtggtggcatgtcggcgcacggaaatgtgtcgtggggctgtgtcttgtgggtacagttgtacacctctgatcagagtaaagctattcgaatagccgtgcccgcggttatgggcggtcgaccagattcaccgtgattagtctcacacttaataagtcgacccaatacgctgtagttcaggtgggttggttgggcctgttcaacgtggtgtagcgttgatcagtggagatttaatgttactctaattactcaacagttttactgttttgctcaataaaatgttttacaaccgcctttatgcaaatagccacaaaccatccttgtatccccttgcacatctgcatcgttggtgtggcttgctgagtacggtggttgtactcagccttgctattattccccctattcagaagtgtagtgcttctaagctaaagacgaagttagaagaccaaggctcagaccccagttgagttttgcctgtggagtggagctgaagccccgctaggatcgcctttttccgctgctgctgctttcgtttcggtgcgaggactaagtgcctcttttgtaagtattttacgctttatttacgtttggaactgtatattacttgtcgttttgtgtaccctggctggtcctagacagggatttaatacacaaaatagtctggaaatttgggctaaatttctgggcgtgacaccagcccagcccgacagttgggccatgtctaggccgctgccttggcatagtgggccggcctggcacgaaacatgaggggcacaatatagacttattgagtcatatataaggcactgccaaagaggagggagggaatataaggcgcggccaaaaaatgagggaggtaaaatagaattattccaaggatgagcacgtcatgcctttaggctggctagcacggcctgactcttattaggccgtaggtggaggccgtgggcaggcccggcccggcctgaccgtttgacgtggcgtgtcgggccaggtggcccatttggccatctatatctatatgtgttgctcatataacttctaatacttgtaagacgaataacaaagcatcatattcgactcgattatttgtgcaagaatattctagggcgaacctatgattcaaagatagcacgtgtaactaagcatggtaattaacaggaacaaactaagtactgcaggctacattgcatgcggcaaagtgacagtaatgatcagtgatcattttgatgcattcggcggagctcaccacctgtccacttgtccaggctagcccagcatagcgagaggggacatcatcgggcgtggccacgtggggcgtgcggggatctgggtggcagtgtgttgatgaaaaatccgcgcttggccgatggtgccagaactatgttggcgctgactaagtcgatgaacataacggcctaggagatcattttagctccagtgcaggtctaaaatattgatgaggtacaggcgtgccaatcagtttgatcctgcaactgacaagatagataaacacgtagatcaccagaaagccgatcggctaacaagccgatggagtaataccaagaggtgaaaaggttggatatgctcagtcttgggcgcccaacgtgagcaaaaaatatcgggggctctcaaccacctatttccacacccgtgacttttcccctccctattttttctcctttatctcgctcatctctctcccacacgttgcatagcggcggcgccgtgcctccttccccgagccgacggccgccgccaatcgctcctcctctgcgacagctatgcttctcctccccgtttcttcgctgtgatggcgatgacaccaaacgctgccacctccccgagccagtggctactgccaatcgctcctcctccgcgacggcgacgcttctcctccatgacggcgacaccgtcgaacgccgccacctccctgagcaagcagccgctacggcagcgcccccgccactgttggcgatggagctctgcgcagccgagctccgtgcgacgtcaacgacagtggctatgcgggtgcggtggagctcggtgcggcgtcgatgcggttgtggttgctaaccaccaaagtggaggaagaggcagatttaggttttcctcttgaatattgtgatgttttagtccatgtaccatgatgtttcatcagttagatcaaaatgttgcaatgtggttttcgatggtgttccatttttttctcgatgtgctcggatttgtctcatgtttcaatacatttgaaactgttgcttcatacgttgtagtaaaatgtttcattgtgtgacttgattctgtttcaccattttcagcactgaaacattttcaattcgatggtgttttattcttattctcgatgtactcggatttgtttcatattttaatatattcgaaatcattgtttcatacgttgtaaaaaaaatgtttcatggtgtaatttgattgtgtttcagcattttaaaagatcgaaacattttcaatctacttggtgaaacatttttttcctcattaggtgataacatactacctcgattttgtgacaatacacaatcggtatgctccgtatcttgctagggcgccttcactgaaacaattggatcctcgaggctaacataattgacaatgcccaactgaaactgctggatgggcccgaccatgatcgagccatttgccacgaaaagaggtagcaaaagcgcgggaaaaccggttttccccgataaaccgcataaaccacctaccctacgcgccccaagagccccaagaggtactcggcctaagactaccctagaatttgacccagagacccagagaagagcaggtattcagttttcttggcctatcaaaaaagcttggcccaacaggcaacaaaaaaaaaaaaaaccctagctggctattctcccagtcccacgccgcaccgcccacacggcgcactcccgcacgcaccgagccaccgacggtccgacgccgcacgccggaggacaccccgcgcggctgccccccggcctgggcctgcccgccttggcgccgccttcccgcggccccgcctcgcgcggcctcccgtggtctcgcccgacgccgccccgccgcgtccggcactccggcctcccgccctctgcgccggccccagcggccctccccctccggactccggactccggtgagcgctagtgaactacctctctggctctccctcagtccggccgtccctctcccccttctatagagttctactagaccagtacttagtaataaatcaatttcttcaataatatctgtgattagccaattaaggagatattgatttgtataaattaccacaaaattgtgtgcaacaatgaacctcatatgacatttttgcatggtatgatggttggagattgaggcatggagaagtcaagcattgcgttacttattcaaaagcatgaagcaaaaaggagttgcatcttgtgatgtaccaatcccacccgtggatttatctaagaccttttgaacaatttacattgtcatttaggtaagattcaatcttatttgttattttctacttgtattgaaccatttacagttatataccgtatcgtttactatttgttattttctacttatttgttattttctacttgtattgaaccatttacagttatataccggcaggctgtgcacgagtgcgtccttcccctttctcgtcctccatcctcgcggcggcggcggcggcggaagcgaaccccgatggcactgagaggcggccacgcggcggcggctgctggggtaagctctgggtccgaggatgacgacgaggaggccggcttctccaggagctacttcctggccaaggagaaggagccctcctctggcaagaagcgcgcccgcgccgccggcaagctctccgacctcaacctcgtcgacgagcaggtctgcataacccgcccctcctggaaaccctccgattcgtgttcccgaggccatggcgaatgccctgattcgagatttggtgcaggtgctgcgagcatccctcgctgagatccccccgaagcacgagagagaggtggaggctctgacgagaagctacaaggagcagtaccgcaactggctgttcgagctcaggttcgtctgctacccaaaatcctcccagtgttgatgttgatgtggatgaagccaaaagatcgatgtgatgttcttctgcaggtgcggatttgggctcctgatgtatggatttggatctaagaagatgttgcttgaggattttgcgtcccgaccttgagcgatttcaccgtcattgtggttaatggctatctcccttccatcaacttgaagcaagtatgacctcctcctgaccgatattgacctttgttgcctgcagtatggattactttatcgcattgttgttgaaaagggaaaaaaaagcattgagcctacagtccttaaggggttaaggtttaggacaaatgaaatactataaggaccaaaggcatcaatttggtatccaaagttgattgtgcaatcttaatttccactgattcatgctcaaagtggcttcaaacattgctctctaatagttgactagttgtgaagctgaaatagatgattcatgaaaactgcgcgcaattcctttatcttggtgttgcttgcagtcatatggagatccttgtttgcctattaggatcatgatcccaaacacctgtaacttaacatattgaaacatctgtaccttctatttgttcaaccattccaatattgtcaaattcggcacctcaagtaaattcatgtgcatgtaattccttactatcattaatcaggaagttcttgttatattgtggaggactattgatttctacatcaaagctcttaattctgccaaattttctgccttgttgccatttcaggtcatagtgacaatagctgaaatattttgggaacaaacaaaacttaagagaaaacgccagacagcaacaaggtcccagttgcagccatttgcatcccaatcaatagatgatattatctcctttctaaataaccagacatctgacaatggggatgacaatgtatgccttcttattcacaacatcgacggacctgccttgcgtgacgctgaatcacagcagtacctagctcaagtttcgtgctgcccgcaagtccatgttgtcgcatcagtagatcatgttaatgcacctttgtgtaagttcctggctagctttaacctcctgtaatgccttcactgtttaagattcctaacctgtcaaataactgtagtatgggacaagaagatggtgcacacacagttcaagtggagctggtatcacgtcccaacgtttgcaccttacaaagttgaaggtgtgttctaccccttgattcttgccagcggcggtcatgcccaaaccatgaaaaccgccctcgttgttctgcaaagcctgacaccaaatgcgcaaagtgtcttcagagttcttgctgaatatcagttggcacacgagaaggaggaaggcaagtttgttgcagacttattttcttatgacttcctgttgtttacaaactaaaccttgctacattgtttgccaggtatgcatttcagtagcttgtataccaaatgccgtgagcgttttcttgtaagcagtcaagtgacgctgaactcccacctgacggagtttaaagaccatgatctggtgaagatcagaaagcactctgatggccaagattgcctccacattcctcttgtttctgatgcgctggagaaattgcttcaggaattgacctgaccagctgggtttggaatttttttttaattgatcgagcggtcagtgatcaccatggaaacagctcagttgtgtattccaatctgtagttgtatatggattattcaccatttcagtttatcaaatagctgcttgtgtcatgaattgttgtgctacatgttctgattttcttctgctcaacattttgatcgtgagctgtgttcggcatctcgcaatttcaaaacattctgtattgttttgaaattgcaatgcgagtgtaaggatttctgcatataccttcccagcattaggtagcgataaaattccatttaaacgtgttctcaaatttgaaattgcgtggtttttactgtaactacttatgcaactgcagcctgtaaagaatcaaatcaaccaatattcaatcgaagaacatgtttttcctttcttccatggaaccagtactaccatgttacatctcaagttattactgatatgatacaacattaacaccacaccaaacatgtacatcttacagttaataggtttaaatcagatctcagtttacatggtgtggaatgcagcacaagttagcacaaggggtgagtgctaaaacttgatcaatttttcatccttgagccataagagcatctctgatagaccttcagttaagtttcttggactgtagcccagctccctcttggctttatcacatgaatatgcccattgatgtctaagaacacgtactgtctgcaatccacattgagaatctagtaagcacaacagcatgacctatctggagatggtaaacttaaataaggaagaatactggacatacagggtaactgataagtgggagatttccagtgatgtgagaaataaaaactgaaatccacccatatatttcaatcaaccagagaggtacatggaataggggtgccttcgtatttgtaatgttagcagccatatcgaaaatctgtttgaatgataagttttctccagtaaggagatatctttcccccggtctgcccttctccattgctgctatgtgcccattaacaacgtcgtcaacatggcaaaacgattccctatcatacccatctcctatgtaaccaggtaggcgccaattaaaccgttcaattaactgcaagaatcacaacagtttaatttcttctggtcatggctatctttcaggaaatgttatattttaaaattgaaacaaatatacgataataaataactacatatttgacatagccatgagtaagaaattctctcacaatacgggaaacaatatttccagtagttagttttccaggcccgtagataactccagggtagagaatggtgattggcaccccttctgctgctgcctgcaatgcaattcggtctgcaagaaccttggatttctcgtactctgagcaaaatgttttctcttgatgtctctgaaatttagaacaattgaactctgtttatagcttatagaattactttaatttgtaaaaggcctttttgtaattagaggataatttgatgaaatggttactccatttcaacaggacatgcataagttggataattgttactaaaagtcggtatcaaaaagaattatacaagtggtagaaataagagagtgtcaggggtaaatcaaaatactttggaatggggtaaattgaacagctaggtttcaagagtgagttgcccattatagaaatttatcattaaaagttcaatggaaatcaagaaaaacgactatctactatctatactactaatggacaccttatgtgctcctattaacatgaatgtcgggtcagccaagtgctatctatactactccctccataccaaaatataaggtattttggatgaatgagacattttgtagtactacgaaagtacaaagagagtatgcctagattcgtagtaataggaaatgtcccatccgttcaaaatcccttatattttgggacggagggagtacatatcaaggaatgagcttagaacagaacctatgggcagaactactaaagacaatcataatacaatccttttatttactattcaagcttttcaaacatgaaatggtaaaaagcttacacagttcaaagtcatgttttacctgtgtctcatctgcaacataaccatcagttgggccaattgcaaagaatgaagatgtgtaaattatcttctttacggtcggtgttctcttagcagccttcaacacattctcgagtcctctcacattgacctgtaatcatagcacagaacgcgcatgctcaagtgccatttcttacaccaagccaaaccgaatttgcatgcattttagtttcatgaacagaacagcaaacggaaaatcaattattgttggacttggagccataattttcaaagaccctaaacagcatcgcacaataggcagaatgtctaggttcatctagcgttctatagtactccccactttgatttgaatgaatatagttaccctctacttgccacaggaaaacatcagaaatgaatcagcacgcgtacggtggtgaaaaccgaggggtcggggagccacggctcgacggcggcggcgacgtggaagaccgcgtcgcacccgtcgaaggcggtggcgagggacccctcgtcggtgacgtccccgtaggccagctcgacggatgccgggagcccggaggcgtcgctgga

SEQ ID NO: 59365 - DNA, 3511 bp, Oryza sativa
agaagaaatttggccctgtttggtgcacgcattcatcttcaaatttcaaaccacatgttatctttgatttaactatttatgcagttacagcaatgctgatatgtttacatgagtgaaatgtagaacactaaaatctgatcatttcgctgtccttgagccataagagcgtctctgatagaccttcagtcaagctcctaggactgtaccctagctccttcttggccttctcacatgagtatgcccattgatgcctaagaacacgcactgcctgcaaaacccaaacaagaactgaaatctaagtaaccacatcaatacatcatcatcatcaccaatgtgcaaactctgaatctaactagaccctgcaaaaacaaactctgaacctaagtaagtactggaaataaaaggagcacagaaagagacatacagggtagctgatgaacgggagcttcccggtgattcttgaaacaagaactgaaatccacccgtaaatttcaagcaaccagaggggtacgtggaatctgggcgcctttgtgttcgtgatcctggaggccatgtcgaagatctgaaccagcgacgtgttctctccggtgaggaggtatctttcaccttctctgcctttctccattgctgctacatgtccagcaacaacatcgtcgacatggcagaatgattctcgatcatggccatgcccgacgtaaccaggtaaacgcccattgaacctctcgatcaactgcaaattaagagccagtgatgttcaagtttctgatcatgattcatggctgttaattatttcaggaacaagttctttttttttgggtcattcagatataccatatatgcaggatgaataactaggagtagagaaattgtcttacgatgcgagaaacaagatttcctgctgtaagttttccaggaccatacatgaatcctggatagacgatggtgattggcatcccctctgctgctgcctgcaatgcgatctggtctgcaagaacctttgatttctcatactccgtgcaaaagtttttccttgatgcatctgcaatatcagcaacttattgtttactctgcaaaaatgtttttctttcacgaaaggaatttgaagtatacatatcatcatattttgcacaattttttttagcatgctcagtctggacatctcacacaagaaatggcagattttctagaccgaaggatttgaaaactgagggagctaattaaggagaactccaatataaatatggtacctgtgtctcatctgcaacatatccatcagttgggccaatggcaaagaatgatgacgtataaactattttctttactgttggtgtcctcctggcagctttcaaaacattctcgagccctcccacattgacctgataatcataacacgtccgaggatatgattaaatgcccatttttttaacaccaaatgaccaaatcaattttatagagcatatatttttcggaattgcttgaaaactttcgcgagtttctttttaaaatcctcttttctttttaaaagattgtacacgtaccgtgatgaagatggagggatcgggcagccacgcctcgacggcggcggcgacgtggaagacggcgtcgcacctgtcgaaggcggcggcgagggactccacgtcggcgacgtcgccgtacgccagctcgacggacgccgggagcaggccggcctcgacgtcgccgccgccgccgccgccgcccgccgagcggagcgcgaacgcgcgcacggcgtggccggcgtcggccagcgcaccgcacaggcggctgccgaggtaccccgtcgcgcccgtcaccgcgatcctcatgccgccgattagccgccgccgccgcaccagctcagtagccgatccgaccactcaaattaagcaagaacgcaggagctcgatcacggccaggaacatcaggagtcgcagctagataagtttgcgtgcttgacggcgatggctccgtcgccatcaaactccacatcagcttcgtcctcatcgccattctaggggtgtgttttcacgtcaaaattggaagtttggttgaaattgaaacaatgtgatggaaaaaatgaaagtttacgtgtgtagaaaagttttgatgtgattgaaaagttaaaagtttgtaactaaacaaggcctaggttgacaatattacgtatgagtaatttacgggctcgttcactttgctaccattttcaactttactttttttttggcaaagttaaaaaaagtggctacatttagtttgttgtcaaattttagtaagtacgtataaaatattgctaaaatttggtagccttgctaaaattttgacaaccttactaaaatttggcaatgccaaaacttgttaatgttgaaaatagtagcaaagtaaacaagtcctacgtgtacggggcatcattttcgagagatcactcgatcgatcgatcgatcgcgttcagcgtcagacaaatccaacagttccgacctctatgcatccatccatttcatgactcatctgatctgaccaaattttttcagataagggaaaggcaatcggcttgtcgtcaatcatctgaaacagcagctgtactggatttgcattgtcgtgccaggtcaggtcaacaacgtcaggatcgttggcagcattcgccaatcggatccggctcctctgactttggaagcgaacggaagataaacatagtaaaatgaatctggtgttacagtgcaaaacattgctctgcagtttttttactgtagacacagtaaaaaagtaaaaactactgctttgatttactattcaccagatactgtagatcggacgactgataatggatcaaagtcacggtcttctcagaggatctcggtccttcgcgatcaagttcttggactgcatcacagttatgtcaagcacgtactcaagttgcatacccatctttttactacctccgtcctaaaataagtgtagttttacattattcacgttcaacgtttaaccgttcgtcttatttaaaaaaattttatgattagtattttattgttactagatgataaaacatgaatagtattttatgtgtgattaaatatttttaaatttttcacaaattttttaaataagacggacggttaaatgttgggcacggatatctacggctgtacttattttgggacggatgtagtacgtagtagaaaaattcccttctcactgttaccgtacgcgaccacactttatatcggaccaaatatatcacatgggaccacctatacatttgtcgacaaattttctcctaaaaattgacagatgtaattatagtacaatcgtagtgtaattacactgtaacttatatgtaattacattgtaacttgcatgtaactacagtgtaacttgtttataagtttcacgtaattttgaatcgttaaatctattacaagatttgttttggtaaggaagaaaaaaaaatcacagcacaaacatatgtgtaaggatttgttcccacaacctccattttaccgaaataacatattac

SEQ ID NO: 59366 - DNA, 4328 bp, Oryza sativa
tttatgcagagccaactgctttgctttggtgttccatttacacagtaataaatgtcaaggagaaaaaaagattcagtaatattcagtcatagaaaaaaaaaagaagttcagatacacctgcttcttgttctgatgcatctggttctaagtttaaggttacaaattattgagcgtgattttcatacgttctagccgtggctgtcaatccagctagtgcaagctgtaaaaacggcctattgcacagtgaagaagctgtatttcacgttttctgaccaactgaattgataaaaaaatgtgcaaatttggtaggaactactgagcattaaataagtctctgaaacaaaccattcttagcagaacttaacaattttcagtaaatggcattttaaattgtgccattgttcctagcatccacatatgtaagtatgtaaccatcataagaaacatcttttctgtactaagaagtagcatttgtcggcaggtagcaccagatggcgcagagaggatgaaaaggtatgtcattatgtgataacaataacattaccacatgagcgtatgaagcctgtattgcctcccactaagtagcaaaaggtgcaaaactacatcccgttgtccgatttcttctgcaggtctccacgaaaagcaattgacagtatctacctggcaacccgtggatcaatttccatggaagctaggctcgaggcagcaagaaaagcagaggaactggaatcacaacttgaccctgaatttccctccttcgtgaagccaatgctacattcacatgtggtccgaggattttggttggtgagtactgcactatcacattcccatccctgcaacccttctttaaggggaactgttgtcatgtggtactaatacttgtttggtggcatgatcaaaagggcttaccgaggcatttctgcgagacttacctgccaaaacatgatgccattgtcactttgttggatgagaaagacgagcaatttgataccaattaccttgcctacaagaatggcctaagtggtggctgggctggctttgctttggaccatggattgttggatggagatgcgacagtatttcagttggtcaagcctacaaccttcaaggtattaatttttactgaactgaacaatatgtctgaataaatttgtacctgtaacttaagcatgttttatatatgaataatgtgaataatccttgaaaattgatttttgtccaggtgcatattatccgagctactgttgatgatggaaatgaggtaaccaagtgacatcaacaaagacggcactactaacacatcggcagacgaaaaattgcattttgggtaggtttaggcctcatctgttagtattaccattaggcacttaatctgttactctgctagtttgcagagcatctatcatgtagcccatatctatgttgggagaaggaacaatttgccactcttatgttgtttgtaattggtgtgtccacaattactgccaattcgacactcgggagtttattagctgacagatttggagtatctgctgtttatgtgtctggctactgcatgtttctgtcctaattaagttttgatggaacatggtacaacttttggcgtttagattggttagattatgaactgcttctttgacctaacaattatcctacactaatgccatctaatgcagcatgtacaacaaatactaataacacaaaatggatcaaaaggatgatgctaaatatcacatcaatctttcaactcacatacagcatcatacatgaatatcatcctacagtttctgaagccttcgctcttctcccttcatcatcaaactgtatctttctgtacataaatgtaacattagattggaaatgatcatctcagatattccttcctttccagcctcaattaagtttgttcccctcagtcctgtatatatatatatatatattttttttttatgcaaaagcaataccatcagcatataaaatggatccaaaatgtgaagactttgttccccaatcatacctcatgtcaagttcaggtttgtttttcaggctctctggtatctggccggtgagattgttgttgttcaggtatctgtctttcgcaggagcaaatgcatgaggcaagtactaagagttatcagctgtttggacatgcaacaaaaagagggttaggatacttacagctccttgagattggtgagtgttcccagcgatgggctgattggtccacttaactgattgccctcaaaatgcctttccaaattcagaaaagttagtatgatggaaatgagtctcctagctaggatgagtagtaatcaatctcctactgcctatccattgagcttacaattcttccaagatgtgcatgctgctcaaatcaggtatggagcctgtgagtttgttgccaccgaaatagctgcatacaatttcaacaggaaaattagacccaagtgcttatcccatttgatcattcggattcactctatatgatcgtgtcaatcttacatatttttcatcccagtcaaatttccaatactgtcagggagcgatcctgaaagaccatgattttttagatccctgtagtatacagaaaatggatcatatcatcacagcaacaaccaacatctcggtagcttattcactgtcaacaccatatgagttcataggtgccaaaccatgtcaatctgaacacttacagtgatacgacgcgcacgggtgatccctcggagcagataaccccggtccacgaattctgccgcggcaggcaaggatcgccggcccagtccggcggcgggttcttgatgctcctggcaagttcctccattgcaaccactgcacaagcgaagatcctaaaccttctcatcacccaaaaattaatctcacatactgaatctagctagcacaatgatgaacttttaaaattttgctttgctcaaattttgcagaaagaaactgcttgacatttggagatcagcctgtctatcgatctggagcagggtttttattttcgaaattgctttttctttgggggttgggttggagggggggggggggcgaaatttcagaaagttcgattttttttggccgaaattatttgaaattttgactgatttttaataaaatttgaccaaattcacacaaaaaaaaaagcaaaaaaccgaaaattttcggactgagatataagattgccggtggggggcgaatttcggaaattttgaaacgaaatttcaaaccctgatctggaggcgcataccatctctggtggccgtccggccaccgagcggcacaatctggtagatctcgccggcgttgatcagcgggccgaccggcgacgtctcgttgggcgtgagcacgatctccatcttgccggagagaggcatcatggtggagtacaccatgacgccggcggccgaggcgttgagctcccggaagaactccttgccgttgacggcgacgtcgaagacgcgccagctgtaggggctcgccgtgcgggagtcctggaagtagagcgccacgtagtaggtcgccgccggcagctccaccggcggccactgcaccgacagcttcttcccccggctcgtcgtcacgccggcccggagcgccttcgccggcggcacgttccagaactcctccggcgtgatcgccgagtggctctccaccgtcgggttcgcgtccgtgaacggcgcccagtaccggttgtactggtcatctggatagctagaaattccagccatgtcaggttaatcaggacacaacaacgcgccgtcgtggcggcggcgagcggcggaacgcgcgtacctcacgatctcgcccttggcgccgaaccggctgcgcgccaccgtgctcatgacgtacttgtcgaagtcggtggtgttgtacatggagtcgtcgaggctgacgagctcgagcgcggagatgaaggggctggaccgggtgtcggcgcggcgcgccaggcacacgctcatcgtcttcccctgcgcctccgccaccatctcgaagtaggtcgacatgccccgccggaagttgtcggtggtgttcacggcgctccaccgcgtcccgtcgacgatctggtcgaacaccggcggaacgtcgccgccgtcgaacccgccgtagaagtaggtcgtccggacgaggtaccgcgaccccttgacgacggggagctggtagcagtacttcctcgccgtcgcgtcggggaagtagcgcacggtggcgagcagcggcaggatgttcggcttgtcgacggcggacatgttgccgacggcgatgaacccctcatcctgtatccacttgatgctccctatctgctcctccttctccgatccacagtttat

SEQ ID NO: 59367 - DNA, 7833 bp, Oryza sativa
gacggtggcatgggaggaggcggcgaggaggagggggaggaggaagaggaaggcaatggggataggcatcgtaatgtcataataggattgggtgggaggggagagagcaatggagcgcgcccacgaaggggaggctccgcgaaggggacgacgcgaggaaagggggctcacgaagggaggccactactgtttatggatcaccgcgcgccacaaacgggtggtttttgcttccttggcttttcaacggcttccgcttaaatttagcaaacgttagttgaactggtcaatcttaggtgtgcgtcatgggccttgaaacctctttcacggcccatgagagaaatgaggcccaagtgatcactggatcaaattattgcgagtggattgtgatttgggcctaagttttactttggaccaccctcaaatcaatcttttcactttagaatcagatagttttgtatattttttagtttggatgatcagaaaattttatcaattttttttaagtttggatcatccttaacttcttcaaacacccataaataacctcaatcaaatcggtttcggtataatggtgaacttccccttttatatgctgctcatatctatacatgaatagtaaagagagtggggtgatccaagccaaatactataggcaaagttatccggtctaaaatgaaaagattggtttaagtgtgatccaaagtaaaactttgacaataaaaaggtgacttcattttactcaattatttacttgtgattgaattattcaccgagggcttagtaaatctatagtccctgtgcgtgtatatatgaacagaggttaaagaagagagaattaacggaggcccaaaattctaaatgcggccagccagcccatcccagcccagcccagctaagctagcaagctgccacgtcgtacggggacgggacggcggcgatcgccggcgaggcaatctactcccacttgcgggggtcggtgatgttgatcttccagtggtggtcggagaagccggcctcctcggcgaggtgtcggtcccaggcgatctcgatcttcctccgctccgacaggcggcacggcgagcgcatggcctcccccatgtcgtcgtacacctgccaccaccgcgcgtgcgcggcgtcgctggcgtacacccgctggtcgccgatgttccagttgcagtcgtagtcgcggtagcacgtccacggcttcagccccaggtagtggatcgaccacacctccgcgggatccgcccggaacagccgctccttgagcgcccgctccgccgtagtgttcgcccagaagttcttgaggtagttcacccgccgcggcagccggtgccaccagacgaacacctcgttcaggaacccctgatcgccgccgttgtaggaccggatggtccgccgctgccggatcagcgactggaacgtgcactgcgacggctcgatcaccatcaccccggagttgaagagcgagccgtcgttgcccaccgccgtcagctgcgggaagccgaagagggcgtcgaggtcgcggaggacgaggatgtcggcgtcgacgaacaccacgcggtcgtagtcggtgagctgccacagccggaacttgctgtagttgtactcgttgtaggtgccgcgctccgcgcgcgggttgcggatgcgcttgatcttgcgcggggtccagccggcggcgaccagcgccgccagcgccggcttcgacacggtgtggtcgtggaggaggacgaggtcgcgcgtcgacccggcgcgccggatgctctgcgccagcacgatcgcgccgcacaggtacgtgtccgacgagtggagcaccgtcgcgtacgcctcccgccgcggccgccccgccgttgccgccgccgccgtcagctccgacacgttgaacacttcctggatacctgcgttaattcattaattaattgcttgattagttgactgcagcttacgccagagaagaacacgtgctagattcttgcgaaactgcactgtgcctgatctgacaatttacctatccatgaaaacaaatttactccaagtccaaggtgatcagttctaaaaaaaaagaaaaaagtccaaggtgatctgaactcaaaaactagtgcgtacgacgaagaatttttcctaatcttttagcagatcaataaatctatttcttaactatatagtatatgtactcgatccgtagtgcgtggcacatgcatcattcatgcacttcttgaactattccaactaagctaaaaaaaaagaactattccaactgaatagtatgaatatactgtataatcttagcttaaaacaaactagaagtgtcagacaagtcaaaaccaccaaagaatcaaatcgaattgcacaaggtaagatcaagcaataaacttaatttgcgacgatattgcgtacggttggtatagatatctggtcatccgccatggagacgaatgtagtagcatgcaatgcaagtattaattggttcatgcacaagctatctctatctatccatctagagtagtatccatttagctacacgcagctgtccggccggctggccaccaaccgaatctagtttaatcagccctgtcgaccgatcgatgtagtatgcatttgttgccatcatagtgttcgactgatcggacggttggaggtgaaaggcttccaaccagcttagctgcatgcctatcacaagttaggtgaaagaggccccagtctctgcccatttatcatcttcttctaattaatctatgagtggtcgtcatcctcttctaattaattaatcttttcttgattaatctgtcaatgctcatccatcgatctccatgtgcatcctgatctattaacatgtacaaaccgtactgtgcgtgtggcatcctatgagcaattgagtagtgtgctaggagtacttatcatcagatcaatcccttaagtaattaatatttagtgctagtatattttttttatcaactgtgaataatgtgtgttgatcgattggtttaggcagtagacctaggccctagatggctagatctatctgctcttgcaaggacaggttttagcttaattagctctcgctagctagcttgtggataacactgacagtgatagatccatgattaccagtagaagcttccactcaggtgggatgccactgtgctgatcaacgataggctagctagctagtttctgctggtacacactctaatcaacctagagcaattaatcaacacctgatgaaccgtataatctgaagaccaacggttgcaaatgcagttacgaaaaaggaacagatttactgttgcaccaaccggatcgatcgtcagtactcctatgaatataatagagcgtcgacgatcgaacaggactaaacacaattcaagttgattgattggaggcttcagtttcaacctgaatcaacgaatcgtcacctcgatcgatcgatcgatcaagctatagctagcaagggatcagattcttcaggtttggtaggaataatggggactactcgatcctagtgtatgttttgctaaagagaaagtcgagtgatgatgatgaattgatgatgagaaccttgtccattatcagctcgtggcctttggcaacatttcccgaccagattcctacgctctttgggtggctttgtcccacacacaccctcgttaaatcgtcctcacacactgatcatgcatatattcacattccaagcgcatacatccctacaagtgattatgggacaaaagctgattggttaattatgctgtgcttgcttgattaattgtgtgggtgtgctgtattgatgctgatcggttttcattaggtgacatgttatgcgtctaaccagcagttgggaacacttctctgaattgaatcatgtcttagtctgatgctaatgttctattttccttagtctgatgctaatgttctattttcctgcatccgttttttttttgttcttatgtgcatgcatggccttggcatattgaagtatttttttttcaaacacaaaaagtagtaaaatccacaatagatttttgttttgcataaaaacttgtaatggaaaaaaatgtcccctttaaactaggtgtttactaccttttttataattcgcatatcctattggctaaaggttactgtaaaccattaattgatggttggagtaataattaatcattcagtggccagttctccacagatactaacggaacagactgaaaataaacctaagctattgatctctgaaacttctttagctattctgcatttctttaaaatttctcacatgtgtatcctgtctcagtgtgatcatgatatattctctcttttagtttctagaagctgaaccacatatgtgccaccaatttttctcttttttcccctttatcacctgtcatatttcccctactttgttttcatgcttgactaacatgcatgcatggcgtgagcgcgtgcatctcacggagaagaaaaccaattaaccagggtgcgagcaaaaaaaaaaaaacaagaaaacattttgatccctcaaagaacaatatcatctaaatagttattatccctttgtttcatattataagttgtttgactttttttcttagtgaaacttctttagttttaattaaatttatagaaaagatagaaacaccgacactaaaccagtctcactaaattcaacattaaatatattttgataatatgtttattttgtattaaaaataaacttaaaaaaaatcaaacgactaataatatgaaagagatggagtattgtgcttagcttacctccgggtccccacagaggtagggcgaggttgcatgagccgacaggaagccggagcttctcctccagccgctcgacgtcgaccatgtacatccaccactcgccgtccctccccaccgcctcgtcgcaccggaacaagtccatcatgggctcgcactcgctgcgcaccaccacgcgcacccgcccgccgccgccgccgccgccggcgtcgtgccgcagccccttgcgcgccgccatgtgcgccgtcacgaggtgcacctgcagcctgaacacgtcgcggttccacgcggcgtccgaacggttgcacggcagcgacgccaccaccacgtcgacgtcgccgtaccgggagaagtccggcatggggagctccgggcaggacgggccctcgtcgtcctcctcctcgtcgatccactccgggaagaggtccgaccaccggaacatgtcggagacgcgctcgaagtcgacgccgacggcgtcgccctccacgccgagcgccagcagctcgtcgcggccgatgttcaccaggcccatccgcagccgcccacggagctcgtcgaacatcgccggcgccctcccggcgttcacgatcctctccgccgccgccgccaccgccttgttcgccgccacgcctcccagctgcaaaacacaggtgtagccaattcctcgtaagcaatctctcgaacacatggtgggtcggaaatcgaagcttagctttttgacggacgtcggtcgcacgcacgaatggtggactcaccttaccttccgagagagctgggcggtggtcgtcgtcgccggggtgcaggcgtcgcggaaggcggtgcagcggacgagggaggaggcggcgccgcggtcgaggaggtaggagtacttggggtggaggaggagcgccatgtacgcgaggaagaagaaggcgaggaacgccgcgttcagcttcacgatggccgccgccctcagccccgccaccggcgacaacgacgacgacgacgacggcttgacggcctccccggcgccgcccgtcacccccatgccaatggcacaccgcgccgggctagcttgtcctcgtgtcgtgcttcggcggcgaggttggcgcgcgtcgcgagctgaggtgcgcgctgttttgcctaagccggggcggcgttgcatggcgcggggttatatagatcgacgcgcgcggcatggcgcggcgaggcgcgcgcgaaggacgcggtgtgcgctgtgcgtgcgtgcgtgcgtgtgcgcaacagtgtcagtacgtgagaggcaagattgggggcaagtggttgggtacggtgagaaaggatgggggtgcaacgaactgagatgccacgtggcgagagttccattcaatccatgccttctcgaatctcgaggacacttgccacttcagtccccctccctgatgatgatcaagctctacaaattgcgtgtactagtgccaatcatgacgtgcgcgttgtgtgcaggagtaattaggatctgtttagctgatcgagctgaaatgcaactaaacagtttcttcatcgtctgaaataggagcgaaattgggtgtagcattttcattaaatgaactagataggtggtgctgagttttgttttatttttttcccttcagaaccatagatttatatttttctccagctatattaacatataaaactcgcactgactttcgtttaaaaaaaatactccacagctccactctatatataacacctaaaactaaatttagaagttggaatttacaaaatagatccttaacaacaatatttgagttaattttgcatcgcggtgatcccatcccctctatctcgatctctacctaggatcatggctcacgacctcggaatacaagagcatatcatgaattaaaaaattggcttaaacaaattatctcgctctatacaaacatttttttgaaactcacatggattgtggggctcttttttatatacaagaggagcatttggtaaagccaaaattttagaaatttctaaccgatgatccttgaacgtgcggacgttgatacctggtctaaataaaagcagatcgaaccttaattcccatggtcaaaaaggcacgaatcgctatgcagaataacaagagtgaaaacattattactccgtaccagctaggttcctgctagcatattgcactgttagttgacaggagccagcaatcaactttgtttatgtggtaattaagcctagctatgaaagggtatgtagcctagtggttatagtgacttgagtagtaccccaaggttctgagttcaaatctcctatggagcgaattttagattggattgtttgcggggctaagtttcctatttcaatggccgtatatatccggttaaatatagaggatgggtaaaaaatacccttctctagaaaaaattaggcctagctagagcacatattttaactttattgttagtattagtactagctctggttgtctatcactctgctgcctctgcacatactgatctagaacacacatgttctctacttctctgcagtcactgctactgacatgtgggccctactctctttgggccagcatgtcagtgtcagcagaggatctcattcctacagtcaatccatgtgtgctactccgttaaaaaaacgaattccaagctacaaacctaaacacgtttttttggacggaggggtatatataaacaaagaaaaagcactgtaggtacataatatagtactagatcagtcttattacagctgttcaaaaacagttcagtatatagtgaatctagttggtctgttgctactgcagttaattggctctggttgcttttgttgatctgttgctactgcagttaattagctccggttgcttagttgatcaagttaattagctctggctgtgccctaatcaaaattcatatatagtagcttcaagcacgacataccacctttcctaccttctggtggatactcctctcttttataatttctgcagtaagcttgaaacataagtagacactgccattaattaaacaagcacagtgaattaacccagatatgtgtaatctgcatactaattaaattaggttc

SEQ ID NO: 59368 - DNA, 1822 bp, Oryza sativa
ttcttcagtgctagtgcttctactagtattcgtgacaataacctgtcggatttggaatatatgattgctgatgtggtgtcgtttttattaacaagcccttgtacagcaaggtacggttcggttgccttgggtcaatcaagagaccattcaaactgttcagggacaggaacaagaacagcttcactctgaatccgacgcaatcttggccgtccgattctgatccgacgtcgctggattagatgaccgacaaaaaaccagagaaaatgttttttgggcgccaagaacatgtacaagtacaatgacgccacacctaggagaagtgatcctaaggcttcctcgatcagcttcgtggaatgaaatattttgtaattaatggaggaaaaataggatcgaaattggcccaaaaatggtcattttccgttgcaaacagtatatcatttcactggaatatttggtaggaacaacatacctctctgacaagaacttccaaggaatttgaatattccaactcaacaaagctagcatgattggtttaatgccaaatacatgaaaattaagtattactcatttcctggagtaccttaaataagtacagttgatttaaggccaaaattaagtgtctaatctagtgagcagccatccgtaactatcataattaaggagaaaaaatatcaccggtgccctgatgtgccacatcccgattaatgctgatatgcatccatctatccagctattatcagtacacaacgtttcatctctcgtaccaaactgacatgtaagctttggtttatccctttcccttcaccttcaagaatcccaatagaagatggtcagatggatggataagctacaagcatactagccacactgttgctgattcgatcttctgaaatgctaagctgatgatggtgccaacaatctcttctctgcacttcggtccttactgcagcaaaagataaagaagttttaaccatcctgatgacctgatcagaatcttcctttttcttctgttcttgttttctagtgatctttcatgatgcaatgaatgagaagaaatatataatatactacttgagaatggagatcaggtgtgatgaacacaaaagctttctggatttaaaagtgcttcctgatatgcattataagccatgtgttcccttttgttttcattgccatctgatcagatgcttccatccaagttacagaggggcagagatgatcgaattggttctggtcgtacatacacgtcgtgctcaggcttaaacactgcgtggttttcacacgtggaaagacgacgacgcacaaagctggaagtaatccacatttagcagcgatcataaaaaaagcagctaattagttggaaccaatgcttcgaggctgcagtacgtctcctttggtttcttttctctttggtgttgttcttctcatttcctttttatctttttccttctcctttcggtatcagtgatactttcagaaactttactccactgtaatgtaagaggaataaatttcagacaaatctatgtatgtgacgttggagagagccgtttgaggggattagtgaagttacatctcacctagaatgactgtttaactggtgatttgaggcataagaaagcattcctaagtgccagctaagtcatgtaaaaatttgcttacacaccaattatattctaatcttttaaccaaagaaatgctacacatggtactattaggtgaaaatgtgttctcctttattatttgcactttatgtgcatgttctacttctactactgctggttccctactctcttttggtcttgatatactgttacttgca

SEQ ID NO: 59369 - DNA, 2568 bp, Oryza sativa
agcaacatgagactgtccattggacgtacgtagttgcaatgttgcacaccgtgatctttgatcatgttcttcttcagagcaagaaaattctggatgagatcgatggactggaacgaaaggtaagagcatgatattttggccaatctccagcttcagtacacagctacagagcgaaactgaaatgcagctgaaattaattatcttctgttagatcttgatttctctttctcatcacaaaactgctccatttgtgtgatcaaacagaggatgcaattgatagaggagaatttaaggctgaaggagcaagtaagtacccttaattttatctgccctgtcgaaactcgacagaggctcggagatgtgaaccattttccattatctaaaaagaaaactttctctctatgcttgctctgctcgttcatttgattaaacgacgatctgaagctgcaggtgtccaggatgtcaagaatggaggagatgcagcctgggcctgattcagaaatcgtgtacgaggaagggcagtcgtctgaatctgtcaccaatgcttcttacccgcgacctccacccgacaacgactacagctctgatacatctctcaggctcgggtgagttctcccatactttcagttccaactcctacctgaatttatgtgtcaagaaacaacagaggttagttcgatgatgaacattcaggttcagatgatgagttgtttactgattgattttgcatgtggcaggttgtcactcttcagctccaagtgatggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaataagctattttttcttaaagttctagctagcttggtacagttcataagccgtagaaaaacaaaggcaaataggacaatatatcaaaagtcatttttaggtaaagcttttatatctccattcttaccggtttgaaagcaaagtctgcaaaataagactacgatgaatgtcaccaagggaggaaaatccacaagcgaagcatatcgcatctaactttcaggctaatctgcatgcattatacaaagagcgatttttttgggaactaatgaattgacatgcatcgtccattaaaatagaggcctgcatgctttgggcgggcaagatatgttccattgcgtcatatggattggactaaaagtgagatgtcagctttagaatcttgagctggaaacgcattatctgacagttgaatgtgcaaaggttggagcaaactcatctcgtccaccgggaagacgataaaatgcgtccagatctcgctcatgtacataaaaatttcagattgcgaaattatccccagggttaaaagttagcactagtaaagtacttttagtttagggcaatgatgcacaagcctttagcgtgcactggatcggaaaatcagtaaagctttcagttttgttgattctggctgtcagattaaacaatgcaagtagtactgagatgaaaaaaaaagttaactttagccctgcttcgattttctttggccttttcaaattttaatctttctgaagaagttagtgtaggttagcagaatggcagagcagaggaatgttctagtagagcggaaattcagtaaaaaattcagttttgttgaatgtgactatcagattaaacatgtagccatcagtactgaggtaaaaaagttagctttagcctgcttcgattttctttagcctttgcaagttttaagctactgaagaagttagggcatgcatggttagcagaacggcagagcagagcagatgaatgcaggatgatgcagaggagagccagggccgaaatgtttcaaacttcttaatttattccataaccagatgctacatcggacggcagcgacccgcgaccgcgggtcaccggaggcgaagaagatgaagatgaagatggagatggagatggcggcttcgtcaccagggcctggggctccctcgcgaagaagctattggaggcgccttcagaagcagcaaacatcttgtagcatggcggcgccacctcccttgccttccccagcagatggccggagaaatggtccccccagatgtcatatgtgaagtctttcttcctcgttgttgtcgtcgtcgcggcgccctcggttctcttcacagccttatctttcatcaggttggatccaggagcgcgagaacgaggcgcgatcggggaaggcgaggacaacaatggcgagcgccatgcattggttggtgcagtaggtgaaggcgatggcgacggcgatggatttcctgatgttactgaaggtggtggagcaggttgctctttagcagtttgcaaccaagaactcttctcatgg

SEQ ID NO: 59370 - DNA, 12751 bp, Oryza sativa
ccctttgtctctagcaactctgatggttagatttccactagtttctggagcttcaattgataccttgtcttccacagtattactagggggcagagacatagttgaagttgtattcagttgttcatctgcattgttcttgtcttctgtcctcttggggctattatgaatatccgcagggtatttatgagtttctttgtctcttttgtgctcccttgttgacctgtttacataggcataaccataccgaattataaaccatgtaaaattcaaagaaagcgagagcggccagcattagtctaaattttacctggaagttttgctgctacactgaaggaaagagggcttaacaggcttgtcgatggtacctttcccatcatgaatcttgatatagcaatcttgagagccccctgacaaagaagttgggacacctctcgcgaacaccagaacaaacacggatacagttccaaaaaggaatatcaatgttttccaatggatggatctgaggtacgactttctgcactggtcaagcatacaaacaggaatgtttgcagtcatagggattatgaaaatcccggtagtcatagccaattcaagatctctctgaaccatagctgaagagaagtcagctttaaaagaaacaagcattcttattgattcacttggcgctaagctaaatcccttgcagttatctactgaaaatccatccacagcacaatcagctccagagattttaacctttgtcacttgaagaggaaggtcaccgctatttttgacatgtatttctttcgacaaatgttgaccgcacaaagggctggtgaactctgatttagacaatgctgacttattctgaatatcggaaatgaggttaaactctagcttccaaacaggttcagattcctccagaaggacaatagattgccgtccgccatgtgcttgaagaggcagccactccatgcctgaaatattgcttctgatcaacaccatgcttgaccacatgcactgatttgatggacggaagatgataggaccaagtaaagcactctccaaaggaccaacaatggcctcagtgattgctgcatcacttaatgagaagccaaatctagtctctgttgagtcaacttcaggggacctgctcgagaatgtatgttcacatgcatcatttatagttttgcactgaccaataatttcctcagaattcagaaccagttgcatggatgcatgctctaggcttgggttatggacggttatccatttagaaaactgtgatccaacttggacaataggaaacagcattttttgatctgtgagaacagaaatcccagttcttgtaccatgagatctccatcttctaagtactgtatcatcagctttatatgcccttgtaattgttggctgcaattaaaaaaaaaagaacatgagaagactaacagggaaaattttgtaagtgaaaaggtgcttgagataagaaatcaattctttttaattatataagcacaacaagaaattcaagtggagaaatgtttaagaataccgtcttagtgttccattttgatatgcacaacatagttatatgatcaattcattgtataagtgcatcgaagtgatcacgaagatattatccagatacaggtatctatctcaagatcataccaatttaggccataatgcaaatataggaccattggtaacttgaatcaatgcatcagaaatattttccttaatgatgtaaccagcacacaatagaaaacaataagcttattcccattaatgaaaaaaagattcttttctaaaaaataatgcccaggagattctaaatgatgccgcttcctgctgattaagatatcataggaacaacaaatcgacaaaggatgagctttgtgggactgaaaatataacgaaacagcgccgaagcatgaaaggtgctaccattatcagcttcctatatcatattcatatgcactgagtacataatttggagaagttatgttaaacaagggaaaacaaaactcgaagtccaatgctgatagaacaacaatataagatcaacttagacaacataggctacttattggcaaactcaacaatgcaaaagggaataccttcatgtgttgcaggccttttacttctacaatgctgcccaaagatcctgtccttgagttagcagataactcatcttcagaaaatggcccatcagattcagtaacagcgctagccgtataagaaagagttgcagatatcacatctcggcagggtatcaggattgaactaccaacagaactgttcgtttctaccactatattgcagttgtcaaatgagttatccgttggaactgaagtatattttatcagcgctatatctgttacagtatcaggaaagagtatcagtccattcaggtacttaacctcaaaattatttgatccatccctgttatcctcagttacccttacaatcctcagtaactttgttccctcattccttaaagaaagggaaataattgacccaactccagcacaagatgatacacgctcaaatgtgaccgaaactaagttagtgggttcatggtaggtacgtgcacgcacctctaactccataggtataacaacagtgtctactctatcagatgtgcaattgcgtaatttcatgcagatagcaccgaacaccattccttctgaaagaggttgcagttttaactctacaacagtgctgctttgtgtaggaagcacctcccattgctcactaggcctgatatggatcatcggcaatccaaattcagtactacttgctgtataccagttgctactcaaagaagtaaactccaacgactcgtcaaaagggcctaactgacaaactatatgagaagattgttttgtgccctggaatgaagacatccaaacagccacttcctcgacatagagagaatcatcaaaagggttgaatatcgacaagttcctctccagccgtccacctgttatgacatccatcccagctagtggctccaactgataaggtgatctgacagccatgcccttagcctgtataatgaacccaccgaaattcgtctgcaaaaccaaatgcgccgatgaagagcctagcaacttcggcaagaatatgaaggtgactgatgcattctctctaggctgcagcaccagatcatcataaccatacacataaaactgcgggtcggtactgaacggctcgtacacgcgcaaggcactgtcattgttcaaattcaccacggtcagggtggccatggaagccacatacaagctactcttcccccaatccaacaccggcgggctaatctcaacatccaacgacgacgaaccgaaaatgccatcggtgctggcatccgcggcatccagctccggcgtcgcgccggccatcgcccgcatccaattgtcaggcacaaggggcgcctggcacgacgccacattataccacctctcaccaccatcctcccgtcccaccccattccgggaggtgatcagcgcgtccgccgccgacgagcacgtcaccacgccgcggtggccgggcaaccggaagcccaacgacggtggtggtggtggtccccagtctctcgacaccaccaaatccatctccttgactccatcatcctcgcttgcaagcatggactcaactgccgagggcgagaagcacagggcgctccggtccgcgcagccatcccggaaaccgaggcagccgccgaggtcgccatcactcccctccgcaccatcctccgccgccgccgccgccgacgacgagacgaacagcacagcaaccaccaagaggctgcaaagaacaagcagcaactccctgcaagaaatccaaagaaagaagaaaaaaaaacacagaaaagaatcaggaacaactccaggttgatcgccaaatagccaaaagtggttactactcaccactaaagcacccaataaacctccacaaaaacaaccacaagaaccaaaaaacaaaaaaaaaaaaaacaaaaccccaaaaaaataattcaaagctttcctatctctccgcgctctcaccatggatcaagctcgaggtgaagagcaacatcaaacaagatgggggtaaaacggtttcattatttgctccggggataaccagaagcaagaaacaaggatagagtgggtagactaaccgaggagcggacaagaacaccgaagccttcgccgccgccggcgaagaggaggaggagccgcggcggcgggtggtcacggcggggagggcatgcggcggcggcggcggtggcggtggcggcggccgagacttcactgtggtggccatgggaatccacggaagaaaaaatgggaaaaaaaacataaaaaggagaggaggggagaggcaagaaaaagaagggagggaggggagaaaagaaaaggtaaggaaaatgatgcgttgggtgttggttggttttggtgttgaaaagaaattcccaaggacatattgaggtttgggaaaaaaattacccttatgcccatgtgctgctgctgctgctgttgggaatcacatgttctttttcccaacttgaaatcaacatttttgagtgagcccacaaataagaatagtataaactttgctaaaagaagaatggaataataggtgtctgataatttttttatatttaaaagctgattttgtgatttgatctttagctaaagttttatgtttttctccctttctatacacggctaaactcaatttcctacgttagcatcgcgcaccccctacaccttcctgtcctaccattcgtttcctctcaccgcaccgctcatgctaccacctactaaaagtaagaacaaaacaaagttagggcagattcgtacgtgttactcacccgtgcaccattgaaaacaccacttcctggacaacattcaatgtcaaattagatgtataattatatacatatagcatgacaaaacgttgcaaccatcatcatttggccatgaaaattgaaatcaacaacctcaatggctcacttcccttcaaagttctcaaggaaaccaaattggaaaaatgaatggttttgaaaggggaaaaacaaaatgtgatgagtgttggttggttttagtgcggaaaagaaattctagggctttgtatatatgttcaaaaatatgttggtctaccctccggtgctaacattggtaatcacatttttcttttctacaagaaattcttttaataggaagtcacatttttgtatgagtctagaagtatgaatatgggttggggatcacattttcttcatagcataatacattttgaatggagtaattaaaatacaaattaacacaaccttttcttatagggatataatatatatcttgagcaccttttttcattaagaagccaacttttggaccgctagatacccattcatcgatcctaattctccccccttatatacaccaccttcccatccttgacgccgcctcatgcacactttcgtgtgcctccctctactagactactacggcatgcttcctctggctacattcaccaacagcacctctatggcattgtcggtcactaaagaaggagggcaaattttatcttggtataaatctgatgaagagaatacgcttgcaaccaattaagaaaacaagaacccctcaacttacgtattattggacaagcaacatgtgaagttgcattttaattgatatacgcatcacgatggtagattatagtttggcgagaataagaacatcacgaaagtaaaaacatagcttagcaaaaaaaaatggcataaagcgctgtctagcaaaaataagaagtaaggagtagtagcaaacaaaaacttcagctctaatgtcaaattagatgcctaatgctatggatagcatgacaaaacgttacaaccatagttacaaaaaaaattggatgattccttagttgctattggcaaattcttgggattccttacttgcccctggtatctcttacacatggctgaacccgcacaccattaatacaatcaggggcaaataagagaacatgtaaacttttatgggcaaataaaggctttaatccataaaaacttggaatcattcgtctcaatggtttggtttacttcaaatatacccaacaaaccatattagaaaacatcgacaagatattcatttttttcctaaaagaaggtataaaccagtttctttttctaaaaaagaaaaatatgttacatttcggttgtttttatgtgggaaagaaatctgaggggtttttatataattaaaaaattattattctaccattcgggtgatgcgggttaggaatcacatttttcttttccataggaaatcacatttttatgtgatttttagaaatatggatgttgttggaatcacattttttttcatatgagacacattttggagtttagaaatattagtagtataatttgaaacataactgagcacaatttttcttatagagatacatacatatatctcaggcacttttttcccgtaagccctaggactttaatttgtatatagttggaaaaaatgattatatactaaatatgttacatacacaagtttgaccatctattgttagcttagtgttttgttgatttgctgtacactttttgttagccattacgcctaaatgtgtcatggacacgttttctagaaaaggaacttaccgtaaaaaaaaaaagtttctgcttgaatacaggtagttttttttttcttaatggaatctgaatgtggtgcccaaaatagattgagcattaatcttgtccctagttgacaataaattatcccacgctagtagctagaactacatataatcacactatattgtcctaattaaccatctactctagctaaagacctatattccatcgacagtagctatcattcgtatagcaatgctgttaaaaaaaaaccaaagaaacaaaaaaaaaaacagtagcatgagttgcatttcatgcactctcctcaaagcagaagcatatatagctagcttatcaggtttgcatgctagcttaattagctccatgcagcatatcatccaaattgatagatttggatgcctttgaaagagagatatatagcccagggaccaatgcgtccattctggcaggacccagaaccatgtagttggatgtaaacgtactctctactactactttctccatcgtcttctccatgtatacatataaggccaattattgctgcaaagccataggtgttttggtttgtccaatcgtataaaaaatgtagtagtcaatgtctgaaacaatagacgaattgtttgtgaaacaatagaggcagtactttgtaacaactagagatgttttctgattggaaatatttatccaacataattatacagaaataattggccgtgtacatgtatattcaatacatgttcctgattatattgaaatcgtcaatatatgcttaattagggccttttcaacggcgaagaattaatcgtcatgcatgttcatggtcatcaggtagaagaccaataatgcttaaggccttcaggttagaaatttaaatcattttgtcaaaccacgattgattaatttcccccttttttgggcccaagaagcatttgcatcacgatccgacacacagtattattgagctttttgtgatatgccactgtataccgatggccatatgcatcgtgctcgccactaatcgctgctgcttgctttaaagtttaatcttcttcctaatttgtttaagcatcattgatctggccttggttagaatactaccatattaagagttccaaggattacaattggtcaggacagattccctgatcagcattagccaagcaaaaccatgcttcttctggctgttctattaatttaattttcacgtcaactttcattggaagccggtttatgtcatacgacattggctcaaaacaaaagaatattatgtgtctttttttttgtgtgtgtggcatgaaccctacttcaagctgttttctgtcatgcaaaatcgctttaagaaactacccacatgagacatgaccaatcatgcacatgtgctttccccatagaggtttgtactgtttgtaatatacctccgcaggacccccttttttctcctcagaacaatatatgtttgctataaaaacattttgcaattattgtttgtccactttctgggactaggcataccacaatatgtcaaatcgtaaccacattgataaattgagttgtccatctttccttcacatcttaaataagtatatatatgtgaaaagatatgcacaaaactctcctcgcaaaaaaaaaagtgaaactcaatataagttaggggaggtctcccaccatgagtttagagcattaacatttatataaaaaaatgttaaactgatgtcgtagttttggtggaccctacaaaattggcattgagttgtagctgtttcgaaccaacactgtaggtttggtggatcccacatgacatggaacacgtgacaggtaggggcgctgagttgtagttgttttataccaacaccgtggaaggtttggtgatcccactaaaactgtagttgtgttcgaatcgacgccgtagacttcgtagatcttacatgtaaggagagtggtaagctgtatattattttgaatgtgttattggtggaccttacacatataagaggtatatataagaggtattaagtacgttagagttgtttccaactgaagatggaggtttggtgaactccacaggtaaggggtttgatttgtagctatttcaaacatactccattggttcggtgatcctacggtacataagggtagttgagtttgtaactgttttgaattgatgctataggtttcataaatcatgaacatacggagttgctaagtttgacggatcctaagcataaagttgctaagttgtaaccattttgaatgataacaatggtttgatggaccatatagatttcaaataaatattgtaggtttggaggaccttatacattaaaaactttgggcctgttcggtagccctatacagcagctgcacatccgttgcagctgcagctgctactattgatcttctatgtatttcactgtagcagctggctgccaaatagaactactgaacaggctctttgagttataagccatttcaatccaaaggtcgtagttttggtggacctacatgtaagaggtagggcaagtcctcctaaaatggtggaatcatactttagcggcgtgttaaaaattattaacttttccccattaaccgtgattaattaatatcgaaggaaaacctctcaaaacaaaatttaaaataaggcattgaacaatgagctgaattcccattccgaagttttgcatgatactatctcccgttccaagaggcagcatgacgactcaaacggcagaataggaaaataatttaggtgcagatatgcatagtcaaaagctactttgcttaacacgaaccatcgccacggcttttttacccccctatacacatagtttaagcgttagcatcagtttaataaacaatttacaaatcttttaagcatgccataatttgctaacctaagtgtatttataatattcaagtcatttgtttatactatcgtaattaccacaaattaatcattccactgtttaacccttcagcacaaaaaaacactaatttcctgctaatcatgtgtcattacactcaattcctaatcaaagcttaccacacgttcacactatacgtgtactacgtgacacatttttttttatcaaattagtgatcgtgtcaagcttgagcagcctcagctcgtctcggtggtcgacacgtgtccaccaaacgtcgatcgaacggtggaatctcctcgcgcctggcggcgctgtcgctgttcccgcggattcctcaccggctccccttccttacccgcctggcgtccacttccaccgggccccaccggtgggtcccaccccgggtggctagagattccggtgaacatataataacacccgcgccgggggcggctgcttgcgctacgtggacatcgagatgcggggccccgcggaatctgacggtggggcccctcgctcgcacggccggtgtcctcctctcaagtggtgccgtgtcgctttccgcttgggtgagcgccctcccgcttttgcccctggaaacaccctctaattacgagcctttgccattacattacatttgtgtttgaaaaaaacaaaaataatttttgcacagttgcacggtctcacatggtgattggtactacatgggttgatagtaccccttcgtcccataatataaaggattttaagtttttgcttgcactgtttaatcactcatcttatttaaaaaatttgtgcaaatataaaaaatgaaaagttatacttaaagtactttggataataaagtaagtcaaaaaaaataataattctaaaattttttgaataagacgagtggtcaaacagtgcaaatagaaactcaaaatcccttatattatgggacggagggagtatttttttatatacaaattttttttcgggatatatatataaaaaattgattaggtgattttggatgtcatcaatgacaacaaagcgctaagtgtttagctacagtgaacggattgtccgtgcaaactttttgactaatcgaggcgttagttaccgaccgtggacgattaacaccacctgcactccaaagctgatgccggtttgcaccttcacgcacgtacaaactatactgtagagtacacctattttaaagcatccatattcattacacgaaagatacacacgcacgctcatgtacctgtgaatatggtcctaacaaacgtttaaagaacatagaccaacgataactctttgatcttattaacttattattgatataacaactatatgtacataatatttataggaatagaaggaatatcatactttgtaaaaaaaaaagaaatgttcttttgtttatttctcacaatcatactacctaatacatggacgcggctggtaagtactacctccctctaaataaatctttattgttctaaaaaacctggatgtgaccatccatatttgtgtagaaaagtaaaactgtttttgaaggaggtagtagcaattaccaacataggccttgcttagctagggaaaatttttagatttagttgtcacatcggatatacggacacatatttgaagtattaaacatagtctaataacaaaataaattacagattccgccaggaaactacgagacaaatttattaagcctaattaatccgtcattagtaaatgtttactgtaacaccacattgttaaatcattgcgcaattaagcttaaaagattcgtctcgtaatttacacgcaatctgtgtaattggttttttttcctatatttaatactctatacatgtgtccaaccatttgatgtgatagcgtgattttttttaactaatcatggccataatgttttctaatatcagtatacagtcatgtcatgccattttttcagaattgataagctgctgtcatgtcatgccacaagataatggcgaatttatgccatgctttgccgacagaggaggacgactacaaccgagagcattcataagcttagaaaaattgcagtcacaagcctaattaattatctacaacttttaattgtttctttaagactacagacaatgtggcaagtgatctatcatttcctgtttggaacggcagcagttgggaaagcaacagtttctgatatgtgacgaccgtcgtctctaaacttcagagttcagagccaggaaaaatcaaaaccagtcagtacacggcgaaagtgcagagatgtagcatactttttctcaaccagtttttgtccagacaggatgagaaagaactattagggaatctgtcaccaaaaagtacttataaatctagatatgggtgataggaacttccaaaagcagataaaggttataggatagttataagcacatgctactaagaatttgtagcgacgtatttgtgcaagagatatgcatgttcatcctatagcaattgcaatttagttttatcaatcatatcattggattgtaccgcatgtcggcatgtgccacatttcccacatactccctctatttttgaatactagctaaatacccatgctttgctagggattaaaaataaattatctctgcgttaatattgtttagaacaaattaattgtgatgttttttaataattttgtccttgctgatgtctttgtatcataaccttgtattacaggaatgaaatagatagaattatatataaaagaaattttgtaatattagagcacatgaagtagtagatggtaaaaaccatgaaggggtagttggttaaaaaaaactccatacaacagttggtggggacagattcaccgtcaccatcattgtcttctttaaaaggagtatagatatataatgttttgattttaacttaagttaaacttcttttaaaggtttgattaaatttatagaaaaaatagacaaaaatttaacactaaacaaatagtatgctctaaaaattcagttatggttttaatgaaattaatttgttgctccgcaaaaaaaaacttgcacgaaagttaaagctaatcagtggctgtgattaaaagggagattagcacttaattatcattagcgaggagtaatttcgtccaaagattttcgagcccatatccagcccagtccgatccccacccctaccagtctatcacggcgccgctcctcaaccgcaccgccgcgccgattttcgccttgcc

SEQ ID NO: 59371 - DNA, 6192 bp, Oryza sativa
tggacgaaattacccctcgctaatgataattaagtgctaatctcccttttaatcatagccgctgattagctttaactttcgtgcaatttttttttttgcagagcatagaagcacatccctactatattttgtaataagcttaattagacttaaacaaatgatgaaaacaaaaacaaaacatctttaattatgaaattcagggagtatatccgatcagtcataaatcactcactcgcacaactgctactaatttagaacacataatttttataaaaatgtctcaatcatagccactttcaagtgacgacgttttcaggataatccctatgaaattcatgcgttccaaacgataccaaacttattgcgcagtgaagcgataaaccaagaacatgctcgctaccaaatatttcccctccatctctcattcatctgctagtgatatccgtagcaatctttcctgtccttcgaaacatttccaatgtttcccctgtggtcctcggatggatggatactttgcctgcctgcataaatgtgtgccattttgattggcagaagagcagtagcttactactccctccgtcccaaaataactcaattcttgagtttccgtgtctaacgtttaatcgtccgtcttatttaaaaaaaataaaaaaatttaaaaagataaatcacacataaagtattattcatgttttatcatctaacaacaataaaaatactaatcatgaaaaaaattcatataagacggacagtcaaacgtaggacacgaaaacccaggaattgagtcttttttttggacggagggagtagctttaagctacagtagtcagtgggtctcaactctcatggcttagctcctggctgccgttcaagattgattgcgaaatcatggccgaatcaattatttcagtagcacggccaacctactgttcatgacaaatttgaacaaatgagagtaaatatgatctttccggttctcagatgtccatgtccatcgtactccctcccctttttagtgtccggtgtttgtcggccgagaaaatttgctgtcctttagttttaaaatctgtccatttaaaaatttggcaatgaaattacacactctttaatattagtattcaatttttatttttagataacattatattttcacaacacttgtatatatatttcaaaatttatatataatgtatccgtctaattttgagatgactcttattgtacaatatactactccctccttccctaaatgtttgacaccgttgacttttttaaatatgtttgaccgttcgttttattcaaaaacttttgtgaaatgtgtaaaactatatgtatacataaaagtatatttaacaataaatcaaatgatagaaaaagaattaataattacttaagtttttttaataagacgaacgatcaaacatttttaaaaaagtcaacggcgtcaaacattttgggatggagggagtactactctattaaaaaaaggtaaactctagctataaatctggacacgtattttgggattgatttttttttttgggacggagggatacgtacttttagctgtcacactgtcaaatcaaattaatcccactcaataaaacctaatatatacagtatgctagtactactacttaagtaatcacttgatgaaactgaactttcaaaaagaaaaaaaaaagaactccgtttctgtcctacactgcagtattgcgaagaaatggagggcacaactgctgtactttggcttttgattccaatgcagtctttctccaacaactcatcctatgctaataatcctttcattcgcaacgaccacatttaggtttaggaggggatatatatatctccggtttactccaacaaattcagagaaacagacagttgacgttgatctgaacgctccaaccaccgtgagctacgaggcgataaggagaatctactcactcactgatcactcttgccaagttaccactaggatattacagacaaaaacgatgcactggagattgtttttttttcagcgattgctctgttttttttgtcaggctcccagcatctcagtgacagtatgtgccacgtagctagtaatactgtaatcagtaacaactagtacaggtgattactgattagtacttaattgtacagggagttgacacagtgttgctggttaaacaactccatctttaataattaattcctgtctagttgattaattccttctcttgtgaggtgaagtcggcctcgaatctatccaacaggatagctagagaagccaaattctccatagattttgatataaatattcgcgaacctaaagctgctactatcgttgtcttatatagtacttcctccgttttatattataaaactttctagcatttatatatgtcaatgaatccagatatttattaacatttatatgaatgtgagcaatgttaaaaagtcttataatttaaaacggaggtagtaacttttaatctccttttatgagagacgctggctctctccggctcgtcgccgccggtgcagaggccggcggcggtggaggaagaagctcgccggttttcgttacggcgcttggttagttaagcaggagggttagacctacaaatctgcaatagagacgtcgacgttagctggacatggacgtgtttccgtccaggagggggtggacgactaaccgtacgtaagtgctaaccgagtaacaaaagaaactaaaagaaattgtccatgtcgacctttgttacgttctgtttttgcagtgtttaggatgctgacagccacggagattagcgagatattaacgcaatcgaaggagagtatcattcattcatttcataatttgattgatcattagtgcacttgtccgtgggcagtcagtcatgtctccgagaggaagaagattcttgcgtggtggacacaaacgctggaatctcttaagaggtttggtggaggtgaagaggacggagattccgtggcattgccaagtcgtcgtggcaatcaatttcagttcattcggatcaccgcggcaacttaactggagattctgcagtagacggcactgaccgtgtcaaaaaaaaaaaaaagaaggccacaattatgatgcggctgcgaagcgttgcatgctctctcggagtgaggacaaggacggctcaggttgactgataaatctatgcacatttatgagaagacatatattgatattaggcctggtttactttctaaatctttgacacgtgcataaagcattaaatatagataaaaataaaaaataattgcacactttgcatggaaatcgcgagatgaatcttttcagcctaattaatccatgattagccataagtgctacagtaacctgcatatgctaatgatggcttaattaagctcaaaagagtcgtctcgcggtttccaggcaagctatgaaattagttttttcattcgtatccgaaagccccttccaacattcagtcaaacatccgatatgacacccaaaattttttttttcgcgaactaaacagggccttaataatggcctagtgcagctttgggccttctgacctgagaaacacctgcggtttagtaaagcccagtacaagagcctcttgcattcattgatttccatatttttggaggagggctcattttttgtgccaaactggtataaactaagcaacaattggtacaacactggtaatataccgcaccgtgttcagtagctacaataaacagctcacaatttacaagtagttctactacagtagttgccgacttggtttctcctctcaattatattagaaaaacaacaaaaagtgtgtgatcggttagtcaaggaagcacagagttcaatatgcagccgccacaaatgtccaccaacctccagcatctggtacaagtaaattgcccgtcttcaagttcaacaccctggggcctacagtagaaacagaaaaaagtgtgacgaaagaagctgagaaattcaaggaaagtatccacgaggacgagagaggactctttcgattgcccatgggctctgagcgcttcaaggatgctttcaacccacctgtgaaaaacaatatgaaaattgtgcatatggatgatacagtagtcaattttgcttcacaacatatgatgtgacgctgtgttgataccagttctgaatgtccaccattcagacgtgtccttgacaattggataatggtattcaaaaggttcgtgatgtgtgcttacccgtcaagtcccggggtggtaggataatatatgctcttcaggccaaatttcttagctgctgaggcagtcgtctcgcctatgcaggcaatggcgttgccccagttgtcaacttgtgaagcaagatttagccaagctctgcatcatcatgataaccccaaaactgaataaagtaagcactgtggaaaaggaaaattgtgatggtaatatgtaacataaagtcagcccagggagacagttcgcaaataatctagctttgcaaatagctgagatggcaaataaagctgtttgtgtgcctttgaatcggtatacccctttatggatcataaagaaacacgtccaaatagaaatcagccccaaccttgtcaaagccccgtgttaatgaaatggtacacaaatctcttgcgtattccaaaaaaaaaatgtttcaatgcagaatttgtgatctctcccacatacgtactttacctgaaccatctaattagagagtactagcataccattattattaatatgaacacggttataaatttgttccgagacagccatagacacattatatattaccggagagcagaaggaagaagctactgcaacaactgaagctgaaagagcaggctttaatattagcggatcgacatcctgtacagatacctgcatgtatatacaaccatttcataggtcaaaacaaaaatccaagattcacgtgcacaaaaactttgaaaagataaaatgtaatccatgaaaattactactgtttcttgaaatacaaaacctctactacggtaacatatgtcacagtcaaccatatcaagctaaaatatgatactatcaggtaagggatgtctgaatgcagataaatagaacgaggtccaaagtgcacaagacaaggggccaaaatttcacattactcatataaagtaagcaaataagaattaataaggcaaatgtaataatttaatttaaaagaaaaacatacagttgtatatgtgttcagtcttgtcacctcaaatcctcgatttgatagcccattctctgcaatccgcataattagttaacataacagctgaagatatgatgcagatgtggtcattgtggaaatgcaggtgcaagcatgtaaccagaaggataaaaccaaatctgactcacggatttcatggccagcctttgcagatgcaggatataacactttacaagtagtttcagtggtccttggaagctctgaggccaaaaatttacccatagctgatgaaataaaaaaaatgaaaaagaaataccttactgactgaaaacagttccaagtcttcaatatatgagagcaccatacgaattagttgacatgcaatgaaaattacatcctatgaggcaagatacctttagaaggagaaaatgcaacctcaagggatccatcattgtattgaattacttcgtcaaaaactctttcagtacctgctccaacaaccgctattcgtaccttaggatttccagcagccctgataggtcgttatgtaacttgtgttaatatggtggttttggattgttctggtgcatcacagaataatggattgattgaagaacatatcatatattgggttagacaacaagcaaatcacagagtgcacaaacctatgccacaaagcccagaacttaggacgaatgaagtgtgaaatgatgcacaatttatatttctgtagcaattgcgcacgataattgaaatatgtttgaatcttacttccatccctcaaggaacacagcagctgcctcaggagatgttatagtgatccagtcaaacttttcatctgaaaatacaaaatattaagtgactaaactatggaatacttttattatgattttgcaaagcaagtgtaatgagaatatactatatgtggagcaatggatatacaacgcaagacagaaacacataaagttatattactagaaaaataaagactgaactacttaccg

SEQ ID NO: 59372 - DNA, 1642 bp, Oryza sativa
tgacaaccaggataggtcattccatggctcattcctagagataaatgacagccatggaaggttgtactccctccgtctcaaaataaacaaacctagtacatttgagacggagggagttgttactaaacattaaaacaagaagctaactggagcagaaaacaagcttctgaagctcgtaaacagcaaagtaactgaagcaggaagcattgtgtctgactaataataagagcatagcaagaaactgcaaatctttcactacttcgcatgctagcactaggtagaaactccagcaagcaatgctctcaactctaaactctgaaaatcattgcaattgtgcaatataaatcacctcggcaagttctgaagctcccgataccagtacaccaaactacatctggaggtaaaataggtaatagccatcctacatttccttctcagacagatagcagaagagatttaatattagaattagcaccctcaggcagaggcaaccacaattcctacacgataagaattttcatccaaatgggataactgaaccttagatacatgataaatttggccaaaaccggccaagctataaactcaacatcagataccccccgcaaaagacatgatacctacaacctagctgtcacaattggtctgaactgtagataactcatctgtgcaacataaatcacctgagcaagttgtgaaactcccaatactaatgcacaaaactacaattctggaggtaaatgggcaatagagccgtcctacatttcctactcggataaatagtagacgggatttcatatcagaatcagcacactcaggtaagcacatattaaacacgataagcatttcatccaaaaggggtgattcaacctctgatactaaataaatttggctggtgttattcgtcggcccagctgaaaaactcaacctcggatacgcctcacaaaagacatggtatggtacctagcaatcacaattgtttgttgaagatcaaatgtgaagcacaaaacaatcaggaagcagtcattcacctattccattcctcatgatttataaacgatagctatggatgtctgaagctctcctcttaggtagtaataaggattgcattaggaacaagaagagcttgatggtttgtaccaaaaacaaggtacaaacaacgatggcttacagtgggggatgctacatgagggtggaggagagcttgaggcactcgctctggcacctcttgaggcagacgtcgttccagttggggacctggtgctggttgacgcagacggtccgggcgcatgcgtcggcgcaggcgtcgagctcggagacgccgcagacggtgacgcaggtctccgggatggggtccttggagaaggcccccaccttcttgagcatccgcttggaggtgcacacgcgctcgcagacgaacacctcgtcggagctcttctcgcgcccgcgcgccgccttgaggcgctgctcctcgtcccgccgccgcttcacgcggaaggcctgaccggccaccaccgccgggatcgccgcggcgagcagcggccaccacgcgtccaccatcctgggggaatacagacaaaatcgagggcccgcgattatcagatttcgcccaaatcctgaaatccctcacgggccacgggga

SEQ ID NO: 59373 - DNA, 1923 bp, Oryza sativa
ttgagacgcgatttcaatattttctccaaaaatgccaaggtgtctgcgtacgacgggtcgttcttattgaccggcttacacgaatttatatgatcagtggacgccaggacctgcaaaattttaataataataagtaaaccaccagttacaagttgcataaactgctactaccttacgaaaattataagggtggttcaaattatagctaaaataaaccttaccaaagccaacttgccaaaaattttggcgggatttcttatgtatttactaaagtttagcaacaaactaaatatagacatttttttagcaactttatcaaaaaaattggtatgattaaaaatgtcatcaatctgaacaaccccataatatgggcgaaatttggggggcatacaagaagaaaaatacaatgggatacctacaaaatcaacattgtgtctttaccacactagcttgggttttgtgtctctaacatgtataatcatatatagttgacatcattaagcatgttaaaactgtacagagtactagatgtgaatgcatgatctatcaagtccgttatagtgcaaggctagcagatcacaattaactacgcaatggtgcgaacgttataacgtggttacttacaacaagttcaccgtatcctgggtatgcagattcaatcggtactatctccatccgaagtgcccaaccaccgtaaccttcaacgatcggtgtgacttgagtctattaaggtgtgaagccagttgacataggtatattagtattataacaatgaaagcataatgtgtaattgaataacaatatcttcctttacctcactaaaactaagaacattgagcaatcctttactatggcgttgccgcacaaaatcatttaactcaacaagtcttggggatccgcttcttaactcgccaatctaaagaaagataagctgcaagtgtcataaatatagaatggggtgaacaaaaaagataagctgcaagttttttgtgaaggacaaaccgatggagctggacgaaacaccaaacccatacgccatggcatgtctgcgagcctactaccaaaatgtggacagctatagaaaacctgtgatatgaacatggttagatctcacagatgtttgaaagaattgacaaacaaatacatactagcccattcgtattgttcaggaacttgtcataattgttcagcttcgcttgatacagcatctgcttaaccaccagtcctcccatgctgcatatatgtaaatgggaataagtaagccttttcatctgtcacagacttttcaacaatttccagcactacatcatgaaccaagcgaccatcattacctatgagttacaaaaacaacaggacgactgccaatgccagcagcaattaacttccttaacagcatagagctcacctcctatatacaaatattatttcaactgaataaatttcagtaagaagaaacaaataagcctaaagttaaactctgagcatctcctatccaactacagaacatatcagatctgagtatcacaaaattatggaatgttttcgcgagatcagcaatggaacaagaaaaagaaaaagaaaaaactaacctgaagtggcaagctggctccggtccattgtgtcagattggtctgcataaatcatttgaaaccagtaagacctccaaacatataaaagcaacaataattccatcagcagggaagcatcgaatattaccagaataacaaaagttttaaaagagaccagtataaccctccccacataaagaacatcagagcaccaaactaaccttgtacttgactgtcaaaaaacgagcttgaggaaaatctgctgaaagccattctcttggccaacatgttccctctttgccagcatcttcatctatactttccaccagacctgctttggtggttgatgacttgt

SEQ ID NO: 59374 - DNA, 771 bp, Oryza sativa
atgatgacttcctcaccgcctacacggccgtcggcggctcatgcatctggatgacagtgcagagcaccgtcgccgccgccgcggggacttactcctttgacacgtccaccgccacatggaccaagctcggcgactggttgcttccgttcagaggccgcgccgagtatgcgcccgagcacaagctctggttcgcgctctcctccgacggcaacgagctgtgcgcgtccgacctcgccgccgcggcgcaatgtgtggaaggtgagccccgtgtcgcccagcggctcaccggtgacgccgcacctcgtccctctcggcgccggcaggttctgcattgtcagattcatgtacaaagggtggaggtccaactttgatttcgacgagaaattcgcggtgttcaccggcgtcgaggttcggcgtggttgtaataagaacagcagcacaacgctccagatggttaatcataggtccagacggtacagccttctcgatagggtatgtgactctcgtgtgttttaaatagaaatttatgaataaaaacacttctcattttgtgctctggatcggatttaattaaatatatttcaccttcatactagggtcaagcaaaataattttacatatacatatacatgaatgaattctagtgtacaagagttgatttatctattttgagatggaggaagtatgttctgtgcgtattttcctgttcgtgttgtcctagtacgtctaccccagacacaggaatttgatgccttcatttggttaacgaaa

SEQ ID NO: 59375 - DNA, 1297 bp, Oryza sativa
acacaccgctgcaagaattcaaagattctactcgtagtagctgatatttggttaattacattctggggtacactgagtaatttgcaattttgccgtgggtgcaggcaaactcggcacaatggcaggacatgaagcacatctggggggccacctggagcctcaccccgggcccactggtggggcccttctcggtgaggctgacaaccctgaccaccaggcagaccctctcggcccaggatgtcatccccaagaactggacccccaaggccacctacacctctcgcctcaacttcgcctagaggaggcccctccggcccatgtttgatgtttcgttggctgggctccccaaggaggcccatacggcgtgtttactttcggatgaattgtgtcgttcttgcgttgcagattggagtaacttgttttgtgtagctatagctattgatgatacctgcctaatagtgcgtgggactggcatgtgggcccaggtagccctctccgaagcggagagagagcgtgatttggttggtgttttgcttgccttcctgggaggtttgggatcccatgtggttagaggccccggtgaaaacatcctcagggtctatatagttaagtgcatatatacttgtatgtgtgtcaagtagatgaactgtattatgttccctagctacttccctgtgcgccctgaagtttgatctttgtgtttgattatttttctcgttaccaactaatgtattaatgttggtcttaaactgatgtttgcagttatttgttctgaaactacgcatacaatcaataattggtttgccttcactttttttttttgcattatcaatcatccataacctggctctcgtgctgattttgttaagttgtgttggttgttgctatgctggtaatcttttcgcttatgcttatgcttatcagccaaaatttaaatttccaaccttaaatttagagctgattttgagattttttcatcgaagtttatttttcagcctttacttttagatcgctaagaacacgtatataaaagttttattcacaaattactttttatttgcaaatataccgtttcgcttatcgcgcgaaaaaagcgaaaggatggctccgtccaattgagtccgaggctccgagccaaggcggatgttggagcaagatagattagggaaaacttttgaatatgttctaaagatactcttaacacaaattgtaagatggtttgaacttaaactaagatatataacttttcttcaaaaattttgccagacccgcaactagcacaaaactcacattatgt

SEQ ID NO: 59376 - DNA, 1967 bp, Oryza sativa
ctgtggagagaacagagaattcaagcagcagtagtacttactgtgagcgggcgaccgtgatctgcgcctcgagcgtcatcaacttcccaatctgctctgctaatcaatacggagtactacactacaccgtcacacaaaagtgcacatgcaaatgcaattcgatttcactgcgcccccggttcttcaatcgtaagctgtccccggctctgccagtcctaggcaattaaggggaagaactgtggcagtactcctccactgggacactactagagctagtgtggcctactcaacctaactagaaaggttatatttttaggttattttttttacggagtgagtgtctttatttaggccatgtttaaatctcatcctaaaatttttcacctcgtcacattgaacatttgaacatatgtatgaagtattaaagataagcttaaaaattaattaattacacatattgcgactagtttgcgagacgaatttgtttttttagataatggaataaatattccggcctttactcattagagctacagccagttattacaaggaatcatacaaacaacgaatgaagttcaaataaaattaaacacacccaacaataaaaaaaccaaactaagaaaatgagcacacatttattcaagtctatttgtgaatctccatccatggttcgcaaatatttgcataaccgtcgtctccagtttacggcatgcaacattcgtaaactctccatcatcttcacgcttttgcagctttacctaaaatcggagccaatatgttgccttcaatattacctgcatatatgagatagatggtgatttgtcaaaaactatatcatttctactcatgctccaacaagtatgagtttactcattttcttgtcaaccccaaaaaccaaccatcaaacatatcttagatatggtaatagggaggtttaaaccaaaagaaaactgtactattctccaaacaaattttgcataatgacagtcaagaaaaagatgttgaatggtctcattttttatacagaaacaacatcttaaactgccattccagttccgtcttgccaaattgtccttagttagcaccacccctttaagtaagtaccacataaagatcttaatcttaagtagcgagatgaatctgttaagcctaattgctccatgatttgacaatgtggtgctacagtaaacatttactaataacgggttaattaggcttgataaattcgtctcatggtttactaacgtattttataattattttatttattagtgcttaaacaccctatacgacaccctatataatatctgatataacacactaaaatcttacaccattcgatctaaacaccagtacaacttctatggcaggaatgcaggatgccactattgctgaggacgacgtaaaaatagcccaggaatccaagccgcagctctctctcggctcgggagcccaagaaattctcgccaatccacacccgccactacaccgtcgcagcgcacccacgtgacacgcagccacagtccatcccccgttgtcccgaatccaacgcccggtcccgctgcatgttcctgcgctcagtccagctacaaccgcagctgaagcagcctacactcgccaacaaaagtactaccacctcacgagatcgatgtttgttctcggactctagtagtcgtaggcgtactccactgacgtgaggagtagtacacggagtgctcattctgtcttaaaataaaatcaatttttaaagtttgatttttgtcttaatttgtatcggaattttgactctgaacgatcacaccctagtttagtttgttcagtgtactgtattatcccaggggagtaggagtagattttagaacattcctgtttcttttagtcgcacagtgcaacgccagctcgcactagggcagcgaagttcagcgcttagtacgactgtactactacgagactactactacgacgac

SEQ ID NO: 59377 - DNA, 2456 bp, Oryza sativa
gcagtatgcaggtggtgtgtgtgtttgtctgcgtgttagtgcgtttctgcttagaggcccgtgtaattaacggaagctggcggtgtgtttgggtggttagtgtggccgcgtactctgctcttcttggtttaactaggagctagtactactatttttggtgaatgggaaggcagattctgtactattatttctaacaccacgatttgcaagggggaaagagtgcttctttgccgttttggtgcttgctttcatgttcttcctctcgttggcgttcagcgttgagtggcaaagagtgccgatgcctgtcataagtgcaactcgagtcgagtgtatgcgcagcgaaattagtgaattagtgtgaagtggttagtactgaatcgaaagcttacgagacataagagcaagtttaacagtataagccaactaccagctccaattcatctatagccaatctaatagcttattcatacaatagttatatactactccctccgtctcaaaaaaagacaaaccctgatttccgtgtccaacgtttgaacgtccgtcttatttgaaaaaattatgaaaaaaattaaaaagacaagtcatgcataaaatattaattatgttttatcatctaacaacaataaaaatacgaattataaaaaaatttcatataagacggacagtcaaagttggacacggaaacccagcgtttgcctttttttgacggagggagtacactattaatatttggtcccacctgtcatacacacactgcgtcttagagtccgtactacaactgactataaatctgtagcccgctgctcttctctttccttatttatcttcttaaaatatatttacagctggcttatagcctgctattgtaactgctctaatattcccatcctcttttactccataccacgatgaaaagaaaaccgacaaaagagtatgccgaccagctacagtcgacctagttggcttgatgcactgcaagaattcgagaaactgtaattttttcaggcactggtttatgctgggatggaagttttgaagtcagtatatctgttttctctgcaatcctactccagtggtatcatttttttcttttctttctactgcgttcgagagaacttcaattcttcaaaaaatacacctatcgttcaatcatgaaggaaacacaccaaccgcgctcgaagaaaagatggtaatgcggttaccgggcttggaagaaagttgaagcggagttggtctgaattctgaaaccgagctaaagcatgaaggccctttccacaggggagttgataggggcggcgactgaagtcacaaatcactttgggcgaaaggcaagacaggaagaggacatgaacccacaacccaccgggttgttactgcagagaaagcgaaggaatctgccttcccatcaatccattcctctccgtaagctctgaccttcctgacgtcaaaaatcatgaatgccgatgtgcaacggctgtagtatagtccaatcgttcttggcagggctacgatcgagctgatcagctgagaaagttgacggtactctgctcggactgaaacattactgctaggtcaactctaattctatgccctttttcctaggactaaatatttttgtaaagaattcctaaatggagtcctcctagaaaattttccattccttaccgaaaggctcgaactttgcagaactcgtttttgtcgggcagaaagcaaatcccggcagtaattgcagccatgccactgagaggctgacaggtgatctccatgtaatgtaagaatatgaggcgtgatcctacgtacgttgctcgcatcgcatctcgcacgctgccatcgtcaaccgcgaaagcaacgttgcttgttcggccatgccctgacggcatgaaggctgccatccgaaacgggcccaattgaattggcctatcgttcgcaatgattcacgaatcttgttggggtgcaacggcgacgatctgtcacgctcatgcacgataccagttctggacagtggacactcgtgaacatgcatggagcagcagattcagctcaaacacaaccaaagcgatcatgaaaatggtccgacatcatgaaaatgggccgactggaggagcccaaggagtccagcaagtgtcttctcaaaggtaaggagtgctcctttcagcaaagcccatcgtatctcttagtattatattacggaataataggatgtgtactatccaatcttagattatattttagaataaaaaagtatttaagattcggcttaattaatttatttaggattatatgcaaaataaccatattggttgtccgttggcgttcgcttcatgaacaaataatgtcagtgttcgttcgaccaagtgacgttgttctcgcgtggtcctcgttgccggtggcgcggaggccgagcgcatcctagacgcctggggacgcggcgatggtgttggggctgcatggca

SEQ ID NO: 59378 - DNA, 3380 bp, Oryza sativa
ttgctcagacgcactgctatttatttctggatccgccactggtcctagaggtcgacctcggcggtgagcagtcgtacgttgggtaggtctggcttattcggcttcagctcctccgtgccacgcgatcggcatgcactcgtcggctgccacagctcgtgcccgcggcgagggttgatcgacgacatgagacaggctagggagggagacaaacatgaggcctacgattgcaagtgcaaaggaggcaattcaaacacacgctacccctccctctcccctatagatggctatatggcctgagtcccgatgacccggcccaaggcacggcaatttggcccgccccaatcacggtcgtgccttaggctactccctcggcacggtgagcctgcacaaccaaagaaaaaaaagttgagggatccatcaaagacttgattcggccatttgaggtacaacccaaagactggaggtatacaaaatagacttattccagtcatataagacacatcccaaagatagagggaataaaaatagacttatttaatagagaagcacaatgggctatcgtgccttcgtgcaggcccggcacaacccgagtcttgttgggccgtgtctgggctgggggcacagcctagcccggcgtgttggtcgggccgtgttagtctgactagcttcggcccacgcccgaacatgccaggccgggcggtccatttggccatctatactcccccccaccccccggcctgcacacacccgcatgcgcgactggacacgtggcatgcgtggaaaggggggctggacggtgcacttttcccttatttctttttttctttccccgtttcttttcgggtttttttctttcccatttattttgtggttttttaatacgtatgaataactttgtatagtaagtttatattcttgatcccgttctctctccttcacataatttaatttatagttagcttatactttatggattagccaactataaattcacgtgaaaagtgccaaatctttttcaaagtgtaacaacaataaccataaagttagctagtctgatgtgaaaagattgcattagtgacgatccaaatgaacaaacggctggtttgagaaggccttaggcccaacagctcgagcaagatatcataagctggatttatttaccttttggtcccttacaaaacttattttataaaataaactcctagaaaaaacttatttagaaatgaatctttttatgacgtcaatgtcatcgatgccgtggtccagcataatggtgtcattccctacccgcggaagccaagtaactaatatgaaggaatatatttatatttttttgaaaaatgacatatttgtaataaaaatatttataggcaggtacttagggtgtgtttggttgagctgtggcttttgaaaaagtagctgttggctgtagctttttgaaaagtagttatggaatatggactgtggcttttgaaaaagctagtttgctttaacacctgtggcttttaaaataactagtcccgctgacaagtgggccccgcatgtcatacatagaaaataaggggatggagatggcaacggcggcgtcgtcggcctcggcggcggcagcggctcggtgaggaggagcggcggcggtttggcgaggaggagcggcgacaacggcggttcggcgaggaggaggacacgcggcggtgacgccgccgctgtcaaccacctcaccaccttcgtctcccgcctccacggccggcgaacgaaggggtggcggcgggcggtgtctggcggcgccggtcggggatgggcaagagcggcgccgttgggttgggtggcggagtcggcctcgagcggcggcggggagcggcagtgcgcgcagcggcggaggagtcctcggcggcagcggctgcggttcggcgaggaggaggacgcgcggcggtgacgccgccgccgtcggccacctcaccaccttcgtctcccacctccacggccggcgaacgaaggggcggcaacaggcagcgtctggcggcgctggctcaggttgggcagcggagtcggcctcggcagcggtggattcggcctcgagcggcggcgaggagcggtagtgaggaaaccaactcaacttactgaatgaatatgtcttaaaatgatagtgagacttgactatagaatctaatggtgcatagcactccccttcttgaatattgtcatcgatcttcaaaacaaggttaggtaaatttatcccaatagcatcaacgttgtacgatccatttggttctcatatttttccatatttaaaggaggattcatatctaaacatatataaacacgatgcaccatataacatcctctattattatatttaccaatgacatgataattgttccaagaataacatggaaaatcataaattttcttctctaaggcatttagatcacaaagaacatcaaattcgatataacccaaagtacataaagaagacaataatttcagctcttcttggtcatcagcaataacaaagacacgtttattttgagtggtaaccaaatattcaaaaatataagtaacgtgttttttcactagttgtggcatgtgtataagtgaagcagtgcgcaactcttcttcattacaagcattatcaatatcaacacaatctgaatttttagcttgtgataaaagcaaattagaaatctgttccactagaggttgctctaatatagcataattagtggacaattgtagcatagcacaatctttcttaccttggtccagttgaccatcacttaaattacctgaaacgctctcttgacataatttaggtgcttcattgttcttctcttcaaaattgtttttaccttcctgcatgatattagataaaatagaaggagcaagaaaattctcatgtatcataggcatttttgtttctttctcaatctgactttcaatatcgcaagcatgcaaaagtaattgaaaaagatggctatgtgttttattctcaagcctatgctgaatttttaaattaagcccatgtaaaaatcttttaattgtatctcctctagactactctataacaccgtacaacatacaaattttaaactcccggtggtactctctcacggttctattcccttgtttcaaattttgcattttcttttgtaaatcacgaatataataatcaagtacaaatctagctctcatcattgtttttaagtcattccaagaataaggtttattaccgacaagacaaatatcactccaccaaagagatgcaaaagaagtaaaagaacttattgctgccttaactttttgttcctcagacaattcataatattcaagttcatcttccacttctaactcccaatcaatatagtccctaggattaaacttac

SEQ ID NO: 59379 - DNA, 3239 bp, Oryza sativa
ttgggtgaaagaccgaaagtacattttgcgtccgttaattatcggcctgttgcttcttgcttgtaaacccagttgtaattggctggctacttgttggagtcagtctcagtccgcacagtttatattgccactacactgtgatctgacagtccatgtttggttcctttctccaatttttcatcagtgattgatcttccggccgggctactttaatttgtatattgcctgcatttttgttggctttagaggataagattcgtgcgatcaccatgggtcaatatggtcgatcgatttcctctgcagaatttcctgttatagtattcgtttggtgagccatgcatgcgttaggtgagctaagttaacactgctttgatttcgattacgtttgagcgtcgccaaacacaggtttattgtcatggggctgttgttaccttgggtgtggcacaaacggacaggatctctcactattgtgatctgtaatctgagtaatctcaatgaagcaccacgtgttcagtgggaccagggctataaatttttcttggacccgagcgcggttcattcaatcagaacaaaaacgttaaaagtactgtagtactacgctaacctacctaaactattcacagaatcacagttacacaggttactggtaacctgctgtcagagtttcaagagttagtgaaccagaaaggtcccaagccagcacagcgaaggtccattccttccatggtccacatcattaagagctcatctcagagctccacgaattgccaccatttcctctgcatggattattaatccatggttgcagagttcagagggaggcgtaaattttgggtggcattcctgctggactggctactccgctatgcacacagctccctgcttaaacagttaaactcgcaaagtgtgttaattaagctaaacacgagcctaccaaccgctaatccactgtagattgcttagagcagacgctgccgagtacggaaccacgggcccaacttactgtacgtactcgatatgctccactacgttcttctcctttctctctttccgggctgttaagctcgatcgaatcgacgatcgcctgactccacgtgaaaccgaataatgtacgtacgagtagtgcatactaataccatctcaaaaaagaaagtgaaaagaataatgtactacaagtacagttacgggccgttcgagcagatcgcgtttattttctcgttttctcaccgcttgtgagaacgagaggcgcatgagccggtgacaatgtggagggatctgggtggttctgcgcatttgttcttcgtgcttaaccgaaagcgcggcggcgcctccggtgtgaatcctggagtagcttattgtcgggccgtgcaggcatcccatgcgggatgcggctagaggtcaaagacgagagacaggggctagttgggggttcgtgccttttgtaggcgggaaagagcggcggtgacggacgggaacagcggctttacgcgcgcgttccgtgttatgaggcgtgccggatgcggtgtggcagggaggccggatcgaacgcaaagccgcaaattgactggccgggctttcctctcaaagggtttctgtgcagaaagggtttcgctttcgtggctcatatcatatgcatacacttttggatacaaaagggactctacaaaagatgatttataggatacgaagaacttgcgcaccacaataagaaaaaaatggcccacggcccaagcctggtaacgagcctgtcactaggaatttttgggctaaaagctagggtagatccatttacccactaaacctttcgtaaatttatcctaatgaatttttaaggttgctctaaaaatataaattgaccaaacgactcaaaccattagaacataggtttaaggggttcgacccaaaatgactttatatatataaatgtttcaatttgtactaagttgcttctctatataataaatcattcctacaaaattcaaaatttaacaattttttagagtgtgaaggcgagtttaaaaattttgagaccgagttttacacacatgtaactataatttttggatcttagtaatgcatcgtgggccacgcatgtctaaatggcttaaaatttgaacgaagttgcttctccatataataaatcatctctacaaaatttaataaaatttgataagtttttataatgtgaatgtgagtttaaaaatttcaggcctgagttttccatacatgtaatacgagtttttttgtctaccaataatatagttgaaccatttggatatccatagataatctattgatataacatattcttgatggattgaccctattaaatcatggatcaataaacttacttaaaacggtttaggttagatccatatcctaaccattcccatcctgagtaagtctggcagtctgctgggccaaagttgcggcctctagactgatttcgatgtgtcaaaccttgttggtagcagaactgcaagttcttgttaggtttgggcctaaatgctcttttacgggctggactcgagaaaaggaagtccgtggctcatgggccaaatttatctcatgtctcgtgtaatttacacttgcacatgtgcaaaactgcaaatgaactgctaattcgtcagttcatctgcgtatcaccatcacggagatgctcccggagcaccgcaagtacatctccgaagctcacgactccggttagcgcgccgctgacctcgtcgacgacccagacgtacccgactcggtgcgcaagagcctgcgccatgactgccaccagcgagctcccagcatggcatgcggcgacgtccttcgtcgacctccacctgaagcttcccgacgacgacctccttgcgcgccgcgcacgcccaaaaggtgagtcctcgtcggacgatgccgacgaggaagacgatggggataacggcagagacgaggcagcgtcgtccgcggcgtccatgaggtcggccatggcgtccatgcccctgcccttgagctgcgccctgatggagcgaagcaagaactccggcggagacaacgagcagtctatgtacgtcatgacgtcgccggcggagagcgcggcgaaggccgcggacgccgactcgatgtcgcacgagccgagaactccggggcagatctcgccgaccagggcgtcgtcatcggcgacgacggccacggcggtgccgtccgcgatggatctccgcaggagcgggatggcgtcgagcgcgtcgtcgtctgcg

SEQ ID NO: 59380 - DNA, 1088 bp, Oryza sativa
cgatgtttggaacgctgttgcatgtgtactactgtggagtaacagttttcacagctaccccacccatctgcatctgtacagaatgggaggtaggacgcctgatctacgaccaggaagttccatggaaagtgatagactgatagataagcgagccgagccgcgctattcggcggcatcttgcggcgccgtgcatcatctcctcgtcgcgtagcgatacggccccaaccgccgcaatgtgatctgccatcgtccgtctcgataggtacggcgcgtcgacgcgacaacagctgtgtttttcttttttttaactcgtataatagctgtgtttttggcacggcaggtcgacgtgttcttcttctaattaaaaccacggggctatatgactagattatactcatactttgcgtctcctgaacagcttgttcacgggctgtgccccagtgtccgcgttctgaaaagaattggatctgtgaatctgtatgagaaatattttgatattttgagatttggacgctactgcgtcgtacggggacaggacgcatctttctctgaattcgccatcgcgtccgccgtggcagctgatcaggtaaatagtccaaccatgcatgtgtgccttttcttgcacagctgatcaggtgactgagtccaaccatgtgcggcttttcttgcatccacctgcttggctgcttgctatagcgaaagacaaattgaacaagtattggtactagtagtatgtttgccacaagcccacaacagagtggttgaaggttgaaactccaacgaattatctcaaagaccatcgtgcttgcctagttgcctttgctttcacagtttggctagtcaaatgtaacaagtgctaatacatgactgagatctctcccttcagtcaactgacaggagggatgatacatcaatctaatttccacgagggcattggatttgctctctgttggggaagcccatgcaacttttgcatggatcagtttttggcccaactggattttgtttcattcacgattatatttgggtgaccaccaaactgctaaatggcttgtgcctaatccaatcagtaaagttgtaggcccaat

SEQ ID NO: 59381 - DNA, 2142 bp, Oryza sativa
gcgagagagccggcgagacgaccatcacgcctgggctaccgacggtgtccgccgccgcagcgtcgtgggtgtggccgtcaccgacgaagcccgggcagagcatctccagctcttccaagcacaccggccgcgacagcagcttcaccacctgccgcatcgtcggccggctgcacggcttcgcctgcgtgcaggccagcgccaccttgatgaacttgagcgcctcctcctccgggtaacctcccttcatgctcggatccaccatgtccagcaggctgccctgttcgtgcagcatccacgcctgcaacaacaaaacatgatcgatgctgttcttcatcagcagcgtagacatggtggcagaaattatcagggttcaggacctgacctgccgcacgagaaacatgcctgatcgaatggtctgcgacatcctccttccactgatgatctcaagaatgagcactccgaagctgtagacatctgccttcttcgtcagctgtccgtgcacgacgtattcaggtgccatgtagccactgcatgcagagaataaggtttatttcgattatgttgcatgcagctcgatcattgctgaagcctgaaagaacagcttacgttgtcccaatcacacgtgtgctaacatgactaacattgtccgggaacagcttggcaattccaaagtctccgatttttgggatgtagtttctgtcaaggagaacgttgctagccttgatgtctctgtgcacaatgcttggctcgtgctcttcgtgaagatagctcagtcccttggccactcccatacagatgtccgatcttgtgctccagctgaggtcagttactccagcagctgaacctaaatgttgcaggagatttgtaagtacgtcgttgctctagatagagcataattgtggaaatttaatggagatctcttaccctgcaatgcattgtcaaggctgttgttctcgacgtactcgtaaatcaggatcctgttttgcctctgaacacagcagcccagcaacctgacaaggtttgcgtgcttagcttcagtaatgctctcgatttcggtcaggaattcgttgatcccttgttcagattcagcagacagaacctttgcagcaaatgcagtaccatcttcaaaagttccctgtgtcatgggacagagattagtttctgtttccatcctggcttttcggctgctgatttactccatttcttcctactcttcgtgcagcagttcagatttttcagttaaaacgaacaaaatatcaagtgtaaaatacgtagtagtatcttggctaccttgtacacagttccaaatccacctcggcctatcttgttgccatcgtcgaagttgtttgttgctgctctgatctctctataggagaatagctggacatttttcaagttcagaagctctgttcagaaaacaatacaaagaaacaacgtcaccatttggagttttggacaaaccgcatgagttcaaacaagctctccagaactcatgcatcacgaaaacgtccgcaaacaattagataatcatctaaaaatcgccagcgatgcatgactagaaaagaatttatactacaaactcccaagtcctaactgctaggaacttgacatggctagcatgaaagaaacaaattgtcaaattgttactacctttgatatcttcttgggatccacagaagcatctcttcatcagagccatctttcaagctggagctgtgacctggattcctggagcaatcctctctttctcagccaaacgggagctccaaaagaaaggccaagaatttgttgaagtgagaggaacagggtttccaagcgagcattaaatcttcagaggtgttggcccaagaagagagctctattacagcaagcaacaaggtgaagcaatgaagcagggaggtgcttggaaagtgccaaacaaactcttcactaaggtttaattagggttcattgatggtgtactgtacaaaaatacagttcatcagtccatgcgtcccgatggatctttgacccctccctgtcaacgagccacaacggccacttgttttagcttaaggggtcaggtcaaattccaagctgttgcctctagatgacgtgacagtaacactcctaaaaggcctaaagataacgttaccaatctat

SEQ ID NO: 59382 - DNA, 786 bp, Oryza sativa
cgtgcactccaaactccgaaatacgaggaaggccgtgctagaattttgctactgcaacgtatacgagtcattttcaacccaagacagcgttaaaccaatagttttggccatttgttatgtcgaacactaccaacctcagttttagttttggacccttttcatgtcccggccagtagatggtagtctgtcttcatccgacagtaacgcgatgtctaagtatatatgattgatacagaaaagatatgtagatatgttttcgttgagtggttggccaagatcggaggtttggggccatactagattcgcaacctattcagagttgcaaaacccctactggattggcctatgccctgagtccctgatttgtatatggcgcccagtcagagctctcacactgaaaaggccaagactgcaggaactgccggtcgccgtctcaccccccgacataatcacgcagtttgcttagcagcggcagagcgatctagacactggacctgctagagcgtgcgctgcatgtggacgagtcatgagcgagcgaacgatcagcaaaggctagatcacacataaagcaaaaaataactaaactaaactaaaaatgcacagctcagttttgtagctgaatcagcagtgacacaaacggcaacgggggagttcagccgggaccagagcccaccatgacctgtcggcaatttgcaataatcttttgcactgtctcgatgctaattggcagcagggagcagccatgcacgcacatcctttccactggaacgcacaaacctacccaaa

SEQ ID NO: 59383 - DNA, 4310 bp, Oryza sativa
tgtcaaccttaatttctgctaaaactctagtatttccttcatcctgtagtaagtttattttttctatttgttccaaaataaatttatactttaaaacaatcattgcattagagtttgtgagagtagagaatatttgtgattttgataaagtagggatattatagtgtttttattttgtattggtatgtatgagatgtgtgagtaataaatttttttggacaaaggtagtagtgttcatatttatgaattgatggctcttggtgctatcctaaatccattgagtttgaacgcactctactaaaaaatcaacccaaaatccttaggcacatcataaaaatttgtcaaatagttcgtcggtactaagtcgtaggtaaagttagttgcgcttaatttccaacatgttctaatttttttctttaaccccattcctttggtgaacgctctcctttttttctttctttctttctacctcagcctcttgcacaatcactgtctccatcgttgatgcagatggtccaataattcgaagtcaaccttagcaagcacttctatctaggaattatattccatcacacaaccgacattattccacattttatttgagagatgaggataacctcaccaacgcacaaccccactcaaaacaacatcgaaacatggtagtcgtcatcaatttttctcataattcggcatgatccttctccttggctgatgatgtatcataggaccacgacttagggaaagcagccaagggatagtgataggtgtaccatgctaagatttgatcttaaaaaggctatgtgagtcaagtaacataagtatacaaataaatttggattgtaagttggaagtcccattccaagtcgaaagtctattgaaaatagcttggccaacgatatgtgtacattaactttagatggacacattgaacgttgcaatccaaaatatgcgcacacaaaaaataacttccatccggtgaaattcaatagcttcggccactgttacattgtaccagcagatgccttaaatttcaagtccctccagcccgtttccacgtaaggtttgacagcgcaaacgcacaattccatccctgctgcgacagtgtgcaaccgttttccgtccccacaaaacgggagcagaaatgacgccgccgcgcggaggttggagggagcaaatcatctcgtctcgtcaccaaaaatccgaaacgccacagcagcaccggccccgatcgaaacgctaggccggccggccgccctccgaaacggcgcgagatacgttaactcccctgtcgcggggaatgaaaattaccgccatgtggacaccccactgacagccgggccccacagcgccagcttacatccatcgggtcaaggaggcccaggacgtttccacgcatggcctttgcctccggcttcgccagtttaccgggcagcgagcagtaaccggcggtaacagcaccggccgccaccacaccattggcacggacaagcgacaattaccgcgataataacaacgacggcggtggcggcggcggcagcagcagcagcagccgcaccaaccacccttaagtaagacgagcggaggcgggccgcgggcgagggaaaggaggaagccacgggtcgctcgctcgtggtagtggtggtggatctgacacccacttcgctacgacttcccccatcccttcctccctccctccctccagtcctcttctcttctcccctcctcccacacctctcccctacctcgtctcatcgtgctcttcgcacccgcgcgattccgccccacgagcgccggcctccgcttcgatctccgcgacgggggccaatgccggcggcgcgatgagcgtggaggaggaggtggtgggggaggaggaggaggaggagctgttctacgagtcgctcgatcgcatcctctcgtcgtcgggctcctccacctcggcctcggacgacgatggggaccacccgcgccgccgccgcgggtacgacgcgggggcggcggccgcggccgcggcgctcgacctgtggacctccgagccggcgcccatccaggagcgacggcggcggctgctccagctgatgggcctctccggtgacccgtcgctcgcgcgattcgagaggggccgatcggctccatgcgacgccgtgggcccgctgccgtcctcgccggttgcgcggtccagatcgagcggcgccacgccggcatccgccgcgaaacccccgctcggaggaggccgcttgcgcggagcctcgtccgatgtgtcagatgccacgttggaggctgttgaggaggacccaaggtgcttgatcagaaacctcgacgacggcagcgagttcctggtgagagaggagttcggtctccgtgaggtcggtacggggcggcagctcaccatggaggagttcgagttgttcatcggccgctcacccatcgtccaagagctcatgcgccgccagagcgtggtcaattccaactcaaactccaattcccaaagtggcgcttccactcccattgagaggtccagctccggctccagcaatggtggggcgcgctacaagcggcgcaacagctggctccgcagcctccgcagtgcagctggctccatggttacatacactcgtgaccgccgcagcagcgacgagaaggatacatcctcagataagggtgggcatcgctccagctcggctacggatgacagccaagatggtgttgcaaaccatggcccggaccgtgttaaggttcggcagtatggtaaatcctataaggagctcagtggcttgttcatgaaccaggatataaaggcgcacagtgggtccatttggagcatcaagtttagtcctgatgggcactttctcgcaagtgctggtgaggattgtgtcatccatgtctgggaggtgttggagtggaagatgatagaggagaaggggttggaagaaaatggggtctttgatccagagtcgatgttggtatccacggcttcagagggaagccatcgggagaagaagctgcgggcaaaggcagtacacaatcagagatcagtaagctcagaccggttgatggtgccagaacatgtgtttgcactatcagagaaacccgtgataacctttgcagggcattctgaggatgtgcttgaccttagctggtccaaatctcaggtaacactcaaaatgctgctatatgcttgtcaattcgaatatgcaaatatttgttttttttggtatactcctgtgatacatactctgctggattgtagtatgtgtgccatcagacatcaggataatagtcacaataattaggtcttaactctttaaagttaaaaacttatgaagctattgccaaattagcagtaccaatgtctcatctaaccttgagaagtcatctagatctctggtatactgcaatgctactgaaaagggaaaaaaaggatgttggagatttgaacaaattggaattacacaaattgattgctcgcaatgttctgttattcgcaaataattctgttagatggttgtttataatacatcagtgcaattgtaccctttccaacctctaagtcatgttttataaagcatgcaacttttttgctgcttcatggtgacttaagtttttcatgttgagaacatctagaaaatccagcacctgttggtcaaaggataaaacattttgaatgtcagttcattcagttccatataactactaatctgttgatttaggtctctctttcactgcagtattaaaaacttttccattgataaatagattcaagttttttgatcatcaggtcaaaggagatattaagtttttcaatagattctgtagtctacagtgtactccaatcaacagaagatatttattccatcactaattagtatcacccagaagtgattgaatgtcatgagctaagtagctaactattttatgtgttgacatgacatgaggtcagtctttattgttcaaaggtgtgatttaatattcattatgtttttagtggagtttcaaaaggtgaaaaaaatagtgcacaagaatatttatgcacggttctttgaaaagaaatatgtccagcccccaaatgctagatgcatgattacagtgtataacttcagcaaattttgttaagcaacataaagagttaattgaagtttgtcgcctgccagattattgatgccaatctaccaagctagaagtcaatttcaatgtgttgttttaccttttgcattagacaagtgggcgcatatagtattaacgcagtaacattccttcaagatattgtatgacgttcataaggcttctgtatgctgttttaagctaccagtaca

SEQ ID NO: 59384 - DNA, 1571 bp, Oryza sativa
tgcacaagaaatataaagtaggatagaagaggtctctcttggaaacagcattaaggtggatgtagctaattaagaattaaccatcttactgaaaaacttaaggccttaaactgttaaaaggtggacaatctacttatagtataaaacttgaactcagtccacatgcaaggccaatcaactctccaaggtttagaaatctaaacttatgttattgcttatcaggctccgtcactaaactttaggagtctctttggcagcaaaactccgtgctagtttggcagtctgttcaatttgtatttctgattatgtaggcctgtccaactatttattagtggaaataggttaaggagatgatttgtaccaaattttaacactagcatattccacctacaaatgttacgatggactcatttgtcttcaaagtgcagtttttcacaacccaaagctaaatttgtagctcagggacctcatcagacgttcatgaaagctttaagggtgtaggaatatattagcataattcattcattttattatgattttgttgtatttaacagttaccccagcaccccttatctccacttttcaatttctgtgcagtacttgctttcatcttcaatggataaaactgtacggttgtggcacgtgtcaagcacttactgtttgaaaaccttctcccacagtgactatggtaagagcatcgctttcaatagatcaatatctcttcctcaccccatgtattgtccttctctcatatcaatttcttgattcagtgacttgcatccagttcaatcctgttaatgataaatacttcattagtggttccctggataaaaaggttcgaatttggagtatacaagaacgcaaaattgttgactggattgatctgcatgaaatgatcacagctgcctgttatacccctgatggacaggtttaacttgcttcttgttctacaatttttcagcaggggtttgcttgctttttttcatgttcattcaaacaccttgttttttactctttgtgaagggtgcactcgttggctcccacaagggcaagtgccatgtctacgatatttctggtaaccctctctctcattacttaattgctgcacatgtaatctcccacatctttaacttatttattccaagacctggtactgatagttggtactccctcctttccaaaaatataaacacatctagcatttgaaattcgtaccaatatttaagcatttctagcactttttagtattacttgtcccattaatcaccttcaattcaattttttcccatcttatttcttaccccccaagcatccctcatttactgggaggcataaagtctcttgtccttaaccttattatgtactaaacaacctagaaatgcttatattttggaaacggagggagtatatgctatgttaagcttccatctactgccattgtcatattatataaattgcctcctataccttgcaaacttattttatttttgtcttttgcctagataatatgcttaagcacaagaaacagattgatctacatattaagaaaaggaaatctagccagaagaaaa

SEQ ID NO: 59385 - DNA, 817 bp, Oryza sativa
accatggaccatggtcctctctgtacttcagatctgacagtgtcttcctcctcattaatttatgcctcgacatttttaaccttcgtgcctactctaattaattaagcatgctgtacaattgccgggcagggaaaaaatacagcggtagtaccagctgcagcctgcaggatacgtactttttggcagagttccaactggctttcttttcagttccaagtggctgcgttctctcagtaaacgtcaggcatgccaacaacaacatacggaccaccacgacgtacgccgtgcacgatctgcctctgccccccaggctatgcaatactgtagtataataagctgagtaaatgtactgttaggtgctcacctgcggtacaccaccgagatctcgcctcggttctgcagctggccgccgtggccggcgacggcgagcctggcgaaggcggcgccgctgaggtcgaagtgcgtgcggccgaaggcgcagacgccgccggggcactcgtcggtgacgatgaccgtgacggcgcggcgcgagcagatgctggcgtcgaggcaacgcaccttgtagcaggcgcagcacccctcgccgcccttgaacagcacggggctcaccgcgcccacccgcgtcttcatcggcaccacgtccaccagcgtcccgtatccacacgcgccgcctgcaaaaaaaaaaaacgtacatacatacagccaaacaggttacaactctgaaattagaaatgctcacgtgataacccgtcatctaaaaatgagattcgtaatttaaaattggtctaatctaagttactacatttttggacgatgg

SEQ ID NO: 59386 - DNA, 1149 bp, Oryza sativa
agaagatagatcttggcctatacatggaacatcaatacaaaattgcagtcattacaaactaattttacagcaagataaatagcatgaataattcttgagataggtacacaaagttagacagcatcaaaacttccaaggtggaaacatagaatgatgtgataatctgatttgctgatgaaaacttcacgactgagataaagcgaaaaaattgtagagatacgataacacttagttgtccaaccctgtcactgaggcatgtgaatcacacatcgcaaacacttgttttctagcatcagttcaagtgccttgttgatgtaatcgaatgacaaatcatgtgtaacaaggtcatcgacttggatttcctgagaagaagtaacatgatatcagtcaacattctacccaaacaatatttgatatcagaaaaggtgaaagacctatatattggaaaaacaaacaaggtattttttgtatgtatcacattaactaaatatattgctatgtgatcattgaccaaacatcaaatatgacatcttgtacataaatgctattatgttcgattgtgataaccacttcgcaccacagtaaaggataatccattcacacaattacatatgatgaagttcagcttcttaatttaatatttttaactgaaaatagaattcagttttattaggatgtttgcttctacaacacattgtctccgtaccttgtttgcatacttgtccactaacaaaggtagatcagatttaggtctccatcctccaaacaaagaccccttcaatgttcttccagacagaagtagtgcataatgagcagaaacctctggctttgcttttggcacaccaagagttacagtcagcccccaaccctaagaagaccaaaacatgagaagataatatatctgggcagaataggtggaattgtagtgcaatggaaaggaataaaaattacatcagaacatgattgcagtgcagtcgacactactcctgtatcacccacgcactcaaaagagtaatctgcacctccattggtcagccgcttcaccacctgaaagtatgaaaacaatgtctttatgctgtgtatatcagggatatgatcaagattttagaaactaccaattggacaccagtgcaacaggagctgttgact

SEQ ID NO: 59387 - DNA, 729 bp, Oryza sativa
ccttagcggcatctctcttgtgtacacctccaggactgcaatcaggagcagatgtctccaaggtacaaagataagaaatgcagatgcagcaagaaatgccactgcgaccatttcagttgtctgcataaaacaaaaggagattagcagttggtggattaatctcctgtaaaattcaaaactacttcatttacaacgctgtggagtaatccgtaaaaacggttgagaaggtacaaataaatttcaaaggtcagagcttcaggaacaagttcttaaacagttcatgtctgatgaatcaaatgatagttcatcatttgtgtcaaattggacaacaaactataggaagtgcatcttagatgtaaagaaatttttgaaccgaaggaaagcaaatatactaaacaacaaaagagatacctttggaacagctgcaaacaagacagctctgaactttagaagaacaatatttacagactgtagagtttcttccaacttggatatagcatcctgcaaggtcaagatttgctcaacaggatttttacttggaggagttcttacttcaagcactcccaataattgctcccttccattgtacttatgccagagcataacaacagcaaatgccaaaaaaaatgagggcaacatgtaagcaataaatcccctacataacaaaaaggaatatgttaggcaatgagatatttctaagcatactttctaagatccaaagggctgcag

SEQ ID NO: 59388 - DNA, 1205 bp, Oryza sativa
atcgtattcaaaatccaaatcatgaggtttaagcattcaactaaaaaagcgccagctaatatcacctaattagctcggaaatactaaaaaaaattccccctaaatataataaggtacctacaaaatacaaatgcagcagcctatttcaccgatatacaataccataatctccaacacgtttgcagttatattaaacgagaaaacgctagaacacaagcctatctaataacgccagaaattagcgatacgatccggtctaacctttgcgaccatgcgctggaaggtgatgtcctcatcatcaatcttgtccttccccttcccccacttcctatctgcagaacccaaaatcaatattgaacaaccgaaagcgcacagaacatcaatgggggagaataataaaccgggaagaaggaaggatgcgccggaatcgcaaacctttggggtcgctgagattcgtgtactcgcggacctcggacctgacatggctgccggcggagaggaatcggaaggtcggaggctcggagacctaaccctagctcctgttacaagaagcttcgagacgtgtggcttggctgatgcctctgggcttcccgtttcgcttgtccgaagtgacgatggaataaagagaagaggcgatccacgcaggctcgagacgaagggggtatgatgttaggcaggccggaatcatccgctagagcctcaggctgggcctgtttatggaaggccacatgggccatggcccagcttgaagccacccatctcagcatatttggcagaaaatctaattataacgcattttctagagataaactttaggtttttctttggaagggagtgttgagttgtgatccaaattcatttgcacttaataaaaaccagcttctgctagagcgaagtggaggccctgccggatcgtatcgtaatcccttttaaggtcccacctcatatatatacctcttgtaaatcgtcgtgcggcgttgtaaccttaccctgatatagtgaagatattttgctggctggtacccatggttttttctctccttctttaggagggttttccacgttaaatatcgtgtcatctatgattgatctattgttctttatcgtttgtttgcctatcgtttcctaacatggaggatcttcaaaacgaattcatgggagatgaactctgaaagtcttatgaaattatgtgtttcagaggattt

SEQ ID NO: 59389 - DNA, 1323 bp, Oryza sativa
agtgcgccaaaaataaacattgtcagtgttatcttagcttgaaaaatgctttaggtttgaaaataagttttaggatgttttacttttaaaaataaaaattgaaaaggtttttaaaaacagaaaacctagacagtttcctgttggaacaagatacccttctatgagaccgtacctgatacatgatacctgttgtggtaccagctgcatggtacccgatatctgtgatacatgttacccggtacctgtgatatctaggatctgatacctgtaatatttgtgcaagagaatagttaatatgtctgttgtaacgggatcccattttataacagccgtctttaaaaaaaattgtaaatcccagaaataccagagtcaaccggtgactgcccatcttattattggggattggtggttttagccaatggccgtctcctctcctcacggagaactgactcgaaccgctgagaggcaacagagaaaccgcacggactgaacgaggcggcggaaataaaacaactcgaggctggaggctggctggcttccttgccgctgcccggctgaaaaagcccccgaagcagaggcttccggttgaagcaaagcaagagcgcgagggcgccgtcgggcatggggatcgtggagacgtggatgcgggagaagcccatccgcaccttcctcgcccagctctccacccgccgggcggcggcgggggccgcggccctgctcgcttcctcctccgccgccgcggcgtccgccgacggcgagcccggcgaccggagcatcccgcagctctcctccatcgccaactccgtcgtctcccgctgctccaggtacgccgttatccggttccggggcgacgaatctgttgttctctactccactcggggtttggggttgggggatggaggttgatccaatccatttagtgactgttttgcttttgctcatccgcaacgacggcagcgcttagctcggccgatctgggtgctctcgatcggtgtgggttgcattactctaccccgcatgatcacgctgaaatagtactgaactgccagagattgcataggacccaaacttaactcgtatatttgctggtttgctcagcggatgctaaaatcagtgtatgctaatccatcattgcttattaggtaaattgatttggtttaccaatagaagagtagcgtgcttctatagttatattctcaaggccgatagacttgatttcaatgtactggcatactctccataggacaatattgtcactcctggaaatggtgagggtaatattagctttttttatttctgagtaaatttcacgggctgcaggaa

SEQ ID NO: 59390 - DNA, 736 bp, Oryza sativa
tcctgcagccctgcttttcaggattagtatcaacaccgataattatagaagccccgcgcagcttagcaccttgagcacctaagtcaggaagatatgagtataaatattacatttcctaatatgctttcattaactaatagcatagcctctgtagaaacttacagaaagccctacagttccaaggccaaatataaccacactcgaccccttcgagatatcagcaaccttccaggctgcaccaagccctagtgaaatacagaaatgaacgaagacatgaatgatcagagacacggttaaaatgcgcagaagtgcagaacaacatagcacacctaattcttagcatcagtaaaccaagtataagctacagaaaggcgtggaagataaagtaaaaacactgatgccatctgagcccttaaaattcacctgcagatacaccacagctcagcaggcatatcctgtccatcggcacggttgggccgaccttcaccgcgcaaccggagtgcacaaccgtgtactcgctgaagcttgacactgcacagtaatggtacacaggtttccccctgagcgagaagcgggtcttctgatcgctgtgcatgacacccctcctctccaggccgagcttctggcacatgttgctcttccctgaaacgcagtgcttgcagctcatgcactctccgatgaagacggtgagcacatggtctcccacttcgaactcggtcacaccttcaccaacact

SEQ ID NO: 59391 - DNA, 1063 bp, Oryza sativa
caattagaatgactgctgaacatcgtagagtaaactcatacattgtgaaagttttacacaaaaaatgcagatttggcaatatttttcccttttgctgaaatataaacattttgataaaacgaagaagtaagaatattacaaacaaactacagaagaaatgtttctcacattttctgataattcatcctcaacaacagcacctgggtgttcccacgcaagcatcatatcaaacattaaacggcgaagattcttatcagccaaatgatctggacgtgtagttacttcatggagagctttgtggcagcagtactctaaaaattcctttgcatatgtattagactccttacaactatcgggatagtcaacttcaaagttttgctgcaaggtttcggttgcaagagcaagaaccctgaaaatgttaatttgagaagaaacttgttagaagtttgtcaggcataacaagaaattacaacttaaatcatataagagtggtcaaacaaagcagaaacatgatcatgtcagtgtatttaaaaattaaagataactacaatagacaatagtaagctatggaagttgatccaattgtggctagcatatgattctcagtactccccttaacaagttagcatgagtgcttgatcagtgattattgcattaattaaccatcctgcaacgctacaggttgttgcctttatttgtttgtgttctgttgacctccttcagacctgtttgctttagataagtagagtgttggctgaacaagattaattcagagtttaatagtaaataatctatggttgattcaaagttgaagaataaataatccatggttaatttagtgtttaagaataaataatgtagataatcatagtttctagatctcttaggcacgggtcagcaatcaaataagtttctgtcaggcataatcatcaaaactcatgtgaaactcaggcatgcaattttctcaggcacaatactcaggtcaccaaccaaacaggccctatatatatatagggatcacatgctcacaatggccaagtgtccagaaataaagagtaaattt

SEQ ID NO: 59392 - DNA, 783 bp, Oryza sativa
acggggcctctcactccctcctgcagcgggcgtacctgtggttggtgcctcatctctctctctctctctctctctctctccctctctccctctctctctctctctctctctccatctgcacctgcacgcgtgtacaaaattgtacctcgatcgctctgggagtctggggacatggtggcacatgcaatcacgagtgaaggagccgaaacttaacgcatagtagtatgtgtagcttagctagcaggacgggagctgatcgatctggggaggagtacatggacgtcggtgagaagagaacctgactatgcgtcacagcctcagaggggatctgtatgtattatgtatctatcgttgtcgcatttacacgccaatcaattggagatcgaggtgtttgtcgatgactcctatatcctggtcgaactccagctgcaatgcatatatgcattgctcatgtacctgcagattttagaaaaaactgtttgcttcctcgatcttgctagtggccggtgcgactgcgcgacagtgtgatcatcaactgtgttagttgtcatttgttttgtccaactgcagtcggggaaaaaatcgcaattattggatcgatgcgccgatgaaacgtggcatgcttgcagcctaattttaacgtagtaggaagttttgcacgaatttaacacgaactttccaagtctttctcatgtccagcgcacagctagctatcaaccaatgcaaacaggagcgggcgggcgcatttgctgctgcacttctctcgcggtgttttgttcgatc

SEQ ID NO: 59393 - DNA, 3024 bp, Oryza sativa
tttaataaaactaatttggtaatgtaagagtaaaatccatcaccggtccctaaacttgtaccgttatgtcatcccggtccctaaactcgcaaatcgactgttcagtcctcaaacttgttcgaccgtgtcatcctggtccctaaacttgcagatcactcgtttagttcctccaacttattcagttaagtcgctctggtctctaaacttggatttgaatattatctgggtcaaataggacggtctaaagactttatattcaaaaataattcataactttttcatgtgaactctaatgaagacaaactttatatcaaacttatagccctcgatgcgatttacaactttgtagttgaattgtttttattctaagtcatttttttgtcccaaaatgtaatttaaaattaaaatttcaaaatctataaacatgcaacaatattttaggaccctaaacagttttaattcgaaaactttacaactataaagttgtaggtcgtgtcgagggctacaattttgatgtaaagagtgccttcattagagttcacatgaaaaagttatgaattattttttgatataaagtctttagaccgtcctgtttagggaccggggtgacgcaactgaacaagttggaggacctaaacgagtgatctgcaagtttagggatcgggatgacacaatcaaataagtttgaggacctgaatggtcgatttgcgagtttagggaccgggatgacacaacggtacaagtttagagaccggttatggattttactcgtaatgtaaatattattatattttttataaatttagttaaatttaaagcaatttgactttgatcaatgtcaaaacatcttgtagcctaaaacgagggagtactagtttacctcaaacaagagcagagagagtatgtacacaataagctttttttcccccattttctgcatctgctgcagcagagttctttaaccggcgtctcaaccatatgaagacaatccttttgtattcgcggtgtggttgggaaagaaaaccactgcgtgtgaattttatgattatatttttcggcttcaaaaaaatgttgcaaatggagatttcgcgaacgagcctgcaacggcaaaaggttgcacgattcgtcgggaagcttggttctgtcctcgagtatatggctgcatgcacatggctgttactatctcataatactgattattcggaaactgccaaatgggaaggttctgctcatcgtacgttgcttatgtaactcaacagttatgagtgatttatcgagcactcattgttgtcagtttgatgggtaggaaagaaaaatcagtgcattatgcattcagaataaaatgataactgaataaaataagagggatataccatgccgagcagcacacttgagatcatgacaaaaatagggaaaatagggtttaattgattgcttgagggtacgaaacaaacataaggcctgatccagcaggggaaagaaaaggcagaagcacttcagaactggatgactatataatactcctccattggtaagattgatatgcttccggtacagatagagatcaccattcacccataaacatgtcactaaaagaaatggtcagcgcaatagttttatatgcttactccgtacgagttgttgcattgattgttccggcaggaatgcgcgccgtgacctcatctcttgctaatccttcatggtgcacggagaagagggaatttttttatttgccaaactaaacaatatttgtgcagatcatagttatccttgatgcattgtgttaatctactagcttctgtggctactattgttatcagcaaaagaccaaattatgtaatcagttctgtcttctgtggctagagctccatcttccactaaacaattaagacgataagctcagttaattagtttgttcaccccctttcggcatgcagctctttcacaaccctaatcatgcacactgtggccaataacacgttgatatgtgtttcgcaaagtaggagtatatgctcatcttgcttgcattggttgcacaaatcgtccaaaaccgtcaaattatttcgagttaagatcggatcgttggaagttgaaacgctcgctgatattgtctctttgctggagttagagaagaggagcaacgcgatttttttgaagcggagagaaacttgagactagaagaagaatactggattgcaaggaaagcaacagatggatcagtctaaggcttctttctcgatcagtaccgtccatgtctagccgtgacagcggccgaaagctacgtggtgcccccagcttacgcctcgagatccgtgcggcgccccatccgccgcggcacgaatcgtgacgtccgccgtgtcgcgaggcgagaggggcagacgggtcaatgcgcgtgggtcccgggcaccgaccacgatccgttcccgccacacaaacgacgcatgctttttttctcctcctcccctgtggaaccctccacgggatcgaaaaaaaaatcccacctcgcctttcgattgcgcgatcacccacctttataagcccgtttcgccccgaggcgctcgtccccgaatcagaaccacgcgccccattggctcggcgcctccaccgcgcacacgcgcacaccggtcgcccgcccaaagcctttcccgccccgccgtctcgctcgttttaccgcagcattttgttgttgctctagcgggcggccgggtttactgcactcggtggaatcgcgaccggtggtgtgtgaggaagagagcgcgcggcgttgttgggtgtgttcgtgaatcgggcgggatggacgcggtggacagaggcggaggcggaggcggtggaggagcgcgcgggcacgggcggagatggaaggggaagggagtgagcgcggcgatctcctcctccgcggccgagacgcagcagccggtgccagttttagaagacgcgccggcggccgcagcattgctccgtccccagaagaagatccgcagccccgatcgtcgcctccagcgctccatctcctcgctgtcgtcg

SEQ ID NO: 59394 - DNA, 3403 bp, Oryza sativa
gacgcaccagcgccagcgccgcggcctcctgctcctcctcctcctcttcggctccgcctacaccggacgagagccacacgcagcaagctcagccgcagccgcagcagcctacagaagagtcatccaacactgaaccgaagcctctgctcttcgtagcagagcaggacggcattccagaacccgagctgaatcctcagctccagacagctgaacaacatggcagcgacggcaacacggccatgttccagccgtcggtgacgtccggcggcatttggggtccggccgacgaggcgtggttcagcgcttgggggccaggaagctccgtctgggactacgacatggacagcgcccacggcctcctcctccagtctcgcttggccggtgagcagaccggcatggactacgcctacaccgcgccggaagtcctcgtggcaccggtgccggcggcagggacagccatggccactgccgcttcctcctctcttcctcctcgtcctccccctccttgccacagtccaaccttcgcatggaaggactaaacagcatcacacgccactcttacacgcaggaacacctaggttgtgagatgcacacaggttgcaaatttttgagacagcttgtggcatcgcacagtatgatcagcgatcacatcgcaggaatatctcaactcctcgagggcattcccattcccgaccttcctctctgaccaatctcctcctgaaaaccacaaggaaaaacccggctgcattttttaggctgggataaggatggccaaatattacaagcgtcatccttatcgatctttccatgatttttcaaagatggattcttttagacatttgactagctagtgatcgtatcagtgtctgtcacctgcaggatttgtagttgaatgtagcatgtaagggtttaaggattcctgaaagaggcttggaaagaggagacgggttttatgctctcctctgttcttacttgatgcttgtgttttcttcatttcttgcacgtactatcatgtatttattcatgtgtgtcttcttgatttggaagagatgtgccatcggcaaggtacttatttgtactgtagtctctatggtcaataataatgaattgatagttgcatgtcttcctaaagtcttgtttttcgtcttcaagtcatcgttatgagttcatgaccacaaatatggacagacatgttaacattaatggcgcgagtgtctgatcggtggaattattatgtggattcgaaatttcgaactgtttgagaagaaattgggccagaaactcgtaatagcccaatggcccagatgggccgatctactaatagctgggccaggaaagcatttacaattgcagtagcaacctttgcaggcatccccttcgccttcgccggtcgccgccgtcaaagccaagaggcgtgcaatgtcgcggccgccgtcgccgatgctctccgtcccggagaagaagacggccgccaccgagctcttccgggaccgccacttcttcaactcggccttcttcaccgacctccgggaggcacgcgcttccctctccgctccgagctcccaggcgacgacccaggacgccgcctcccgccgcgcgctcctactccggtaccaccgcctcctcgcctccgcgcgcgacgacccctgcgacttcgacgacgacctcgccttcacctggcacgacgccttcaggccccacctcaggcgcaccgcggcgtccctccgcttcgagaaggccgccgtcgtgttcaacgtcggcgccgcctcgtcgaggatcgcggcggccgtcgaccgggcggcggtgggcggggtcaaggctgcgtgcggggagttccagcgcgccgcgggggcgttcagagcggcgggggagatgatggagggggaggaggaggacacggaggacacggtggatatgggccccgaggcctccgcgatgctggagcggctcatgctcgcgcaggcgcaggagtgctgcttcgagcgcgctctcgccgcggggacgtcgtcagcggcttgctccaaggtcgccaagcaggtgagattggatttgctcgctcatcttccctagtggcactgcattgatcagaaaaaaattcccctcccttgcctgttggctgttagggttctgactgggtgaagcaaattatgcaaagaaaatattgtaacaaaaaatccttttagatagacatactatgatctatgaggggtgctgtgaggatgcattttctagatttgctttttagaatacatccaaaccggatgtacgcagccaatttatatttgctatgtggcacgcaattgagactgtgagacattagctcataacctataaatttgtgccaactgccaattgcagtatcgaaaatagccccctttgcattccccttagaactatggcatgatttgcagttagttcgtgaaatattagctttagctataagtttataaagcctcctttgtgggaggctgggttggcgctatattagcttattgtaatactgtttgtgctgaattacagtgacagaaacttgcagtaaactatgcactatgtagcacccctaacttgcacaatgttcattttttactatcacatccattccaagaattctgttttgtgctaggaattcagtaaactgagctggctgagcattctttgtaatctaccttactgaatactgatacagtacaattctagctttagatcattatgtgaactatgagttaagtttgaagaacagatcagttaatgaatagacaacaggaggaaatatctgaagtaagttcacgagcagcttcccacaggcactagcatcaggacaactgttagtaacatgtcatcaccttgcatgtctcggtccatcatttgtcttaccatcctccatcatacatatgaaatctaataaattaactttttaactgggtcaaaagaactaattgaatcagaagatctaatactagctgcagattggtggatgtattcatttccttctatggaccatgaagtagtttctgaatgagaatgaagatcatgttagacttaagcctcaaacatcattctgtctgtgcttcccggttggcgtagataacctatgatgctcaaatcctgattgttaaaatacagatttacttccagaaccagtgaacacttgttgcaaggtggatgttttgttgtatattatgcctaaactgatatcacaccagcattttgtgaccaaaaaattactgtggcataattcttacactaagaaaataatgaattttgaactcgttccaactgctttaaaagtttgaccaatcatttcaaaaagaaatacaggacttaggctgcatttgtttggagaacatggggagattggttgtttcgttttccacgcgcacgcttcccaaactactaaacggtg

SEQ ID NO: 59395 - DNA, 4136 bp, Oryza sativa
tgcaccccctactaaacggtgcgttttttgcaaaaaatttctatatgaaagttgctttaaaaaatcatattaatacatttttgaagtttaaaatagttaatactcaattaatcatgcgctaatggctcacctcgttttacgtatcttcctaatcttctcaatcccctctccctcaaacacagccttaggaaagccaaagtttacagatgtgctatttactgtttccatcaggttattggagcagcgaagttagcaccctaacttgcgttatctatagactgcacagtattcattttttgtatgtttcatgtccaaaagcatctacatcagaaaatacctaacgttgtgcgtttttctctaagcaggctgccttgtattatgaagaagcttatgcttcactggttatccctccactacaaaaccactttgagagatcttgggtagcacacatcctgttaaaggctgctctattcaatgcagaagctagctatcactatgctattgaactgcatgagaaaacagaaatcggtgaagagatagctcgattacagtttggaattaatgcaattgtcgatgcaaagaaagctgtccgtggagccccaggatccctttatgatgctgcctccagactcgaacaagatatgaaccagaacttggagagagcactgaatgagaacaaccgcatctatcttctgcgagtcccagcagccaaactactagctcctctgccagcagcttcacttgtccggtctgcttccctgagtgagatcttagatgtgaagacagaaaccggtaatcaatcatcgtaaggaaacccttcacgttgcaaaaggaaggaatcacatgtgtcagtgccactgcatttgcatgttaaagatcgtctgctgcagtgaattgcagggtcgattacgatttgtttgtttacttgctgggggtgtaaatagccacaggaacctgcactggcgattacatgggttgttactatgatttaccataccatctttgtgggctcgttattgtagacaacatggatggttcatctacatgccacttaacattttgcaagaatattatgaggtagtgccttattttgttagccattttggcaactatgggtctccctcttcaagtgtttgtctgaagaaggcaatgtactgaacgatcgtgctggtgaatgcaccgacgccatctctacaactgtcaactgggatctgtgctaatactcgggcatatcggccgggaacagaaggctttcagaacgttctttatccacagaacgtaccggcttggcggctcctccacggcgggggaacgcaacgcaagcaagcgtcgtctccagcgacagtcgcaagcgcggcgactcgaaccgaggaaaccaacgagaagccgagctgtccggtccctctcgtgctcgctagtcgctactactcgctaggtgctccttttggtttggcacgggcgcacggccaaccacagccaagtgtgtgctcccggccttatccattaactcaggtgagcatttgcattattattgccaaattctgctacgttcgttccatctcacctcctgtcgtggcaatggaatctgtcttttcagcacaaagtttaaattttgattgaaattagagatgatgtgactgaaaagttatgtgtgtatgacaggttaatgtgatgaaaaataactgaaggttggatctaaactttggatctaaacacagccgaagcatcttcaaagtgcaccttggcgtatatgacatgacttggtcctataagactcgcattcttaaaaaaatcacaagaatttgggccatgtttagttttaaggtaaaaagttttaacgtgtcacatcggatatacggatatacatttaaagtattaagcatacactaataacaaaacaaattacagattccgcctataaactgcaatacgaatttatcaagcataattaatccgttattatcaaatgtttagtgtagcaccacattatcagatcatggagcaattagtcttaaaagattcgtctcgtaattttacacgtaatctgtgtaattagtttttttatatttaatactccatgcatgtattcaaatattcgatgtgacataatgaaaagtttttcatgggaacaaaacatggccttagtgataaaacgaggaaaccagagttgcaggaagatttctggagacaaggtgagagagacagggttcttggtcctcttggattttatccctgaaaatccttgaaattctcgacatttccagggcccaaaaccagcaaatccaaggcatcggagaattttttacgcaactcggagaatcgcacacctctcctgtccccccgcacctccacctttcgttccccacgcctatcctctttactcggttctcccgcgcccaccacctgttcgacaccgaactcaaccgtctctccacaccgcgcgcgcgccgcagcttagcctctcgcaatggcgacgaccaccgcagccttggcgccgccgtccacctcgacgtcctccgtcctcctcccctcagccgccgccgccgccgccgcccgatgcctcgggccgctgccccgccgcgcgcgcctccggaccgcgcgccacgtcgccctcaccccccgcgacttgtccgcggaggacgtggccgcggaggaggccgccgtcgcgcccaagatcgggaagcgcgtgcgagtcacggcgcccgtgcgcgtgtaccacgtcatgaaggcgcccgacctggacatcaagggaatggagggcgtcgtcaagcagtacgtggccgtctggaaggggaagcgcatcacggccaatttccccttcaaggtggagttccatctcagcgtggagggccaggacaagccggtcaggttcttcgtccacctccgcgaggacgagttcgagttcatcgacgaatgagatcgatcagtaaccgtgaccaagtaagcctagcgccttttgttatacaataatgaccgcagctgtggcatgtgtatattgtttcggttgtgtggtgagagagatgagagagactgaagagagtagggaacatggcaaggaagttgtttgcttactgtcatgctcttcctcctccagttcgacatctaatttttcagatgtgggaaatgtttggatgatgatgatgatcgatagctataaatagtgatcattctgttgtcttgctggctatgtttttttttcttttgctgattctcttatcattatagttctagtgcggcaactaggaaaatgcactattgtgctattgaatgcaagcaagagtgcaagactgatgtttgttgtgtgggaatcagctaggcaagtagagctatacattactagcaacatttgaatcatcatgcccaatccatgaaaccgtcaaattatctgatcacggagcatacatcctaacgaagtaagttctcttaaaacactccttataggcttacagaagaacaaactatgaagaaggtgtttggatgatgtggacaaggatttcaatccaaattcctcctatccaaagtggcattaagactgagaattcactatctatcttttgctttcaatgaaaagctgggtccggggacctttattctaaaaagaatcattctccaggttatcctgaagaaaatttgttaattttacaagatttgaaagataacctaaacatatgaacagaactagagattgcattaaatgttttagtttgtgacattctctatgtcctcagttgggtagtacgacatggtatcagatagcacaaagtggcataacatgcagctacatgtaaactagtccgagtactcttcagtatatagtgtgcaagatgtactattttgttttatgtagttgtttttctgatccagaatgcgatatatctgggacttcttggggccgttagttgcatacagatgtctcagaacaacctgcccgttagactctaatgcattgtattatgaaagtagaaacttccactttggtccaagcctttgcatattgtttccggagaattttaatccaaccatttggaaccatctatcacctacccacaaattataagccatcaaacagccaactgggtcaattcataaccgtaaaagagacatattctgaccaaatttagtcataaccataaatt

SEQ ID NO: 59396 - DNA, 6549 bp, Oryza sativa
  unsure (1)..(6549): unsure at all n locations
cctgcagccctgaccaaatttagtcataaccataaattcaatgctatgcatacttatgttaattgaaggttttgggaagatgtcagcttatctaaaacaaaaattcttttatttgcttaaccttttgggaactacccaaaatgtgatctttgaattagaagagaacactacttatgaaaatttcatgacgccatgtttgaaacttgctcatgggattttcatcgatttctaggaaatcaccaatgtgttcaaaagattgaatttatttggactgaatcaacaaggagaaaatgaatgcaaaatgaagttgatgcattggatacaaggtagcctaataaataaggaattaatcagaaaaatcttattctttttatgaatatataattctgtttcttatgcgattatgtttgaaggcataatgcagactgcaccaagtagcaactaaacatcaaataagacttacattaaggctttaaagaacgatgttgtaaggatcatattgcaatttgattgtgtgtgcgagtttctccagtaaatttgtttactgcagttaatttcaattttttgctcaatcttctgcaaaagtggaaatggcttcatgaaagtgcatctttgcatggcacaatgtcgagttgacaacttaaagtgatgcttctgccctatggctagatagactatagaaagggttcaaggattcaatgtggacggcatttccttttactctctgcagcattttgttgtaaaatttcttctgtttatgcatgatgactaatgctctgttcggttaaagctcaaattagacagaatcagcaagttgtgacttgtaagtttaacatctgcaagcattatactacacttcctttttagaaccctgaggtgccacactgtctcagttatgtgtttaacatctgaaaacattgtacttcacttttctcttttagagccctgaggtgtcacagtctcaattgtgaatttacatccgcaaacattgtttatagtagtagtgatcctgaggtgttattgtctggtgaactctgaggacttgtgtttgttgacgtactttagatgtttagcactgctattaccgaatgcaccgaaataaaatcaattggtattcgctattgatttgtgctgtgagtgatgcattttctgtattctacatttctggtatccatttcaggtttccttcagctataaatcaaagtctctgttttaccgtactccactatcgttcttgtgcctttcatgaggtttgctcccataatgcaagtggtatgcctgatgtaaatttggcatgaatttcgatgaaaccactcaaagctatggacagtgactccagtgagccatgattctgctttctttggtttgtctgatgagaaaagcacgcatccatttttctttttcgcattcatttacgtgttcccccttttactcctctttacatgttcagcctttgtggagctatacgtctgttcgctgacattctacctgccatttaaatgcgtccttcgattttgcatagtactccgtagcccggatcagaacggtcaacttggaagctccctgatgcctgagctagctttggattctcttactccatttgaatcccccaaaggcaccattggtcaatccatgtgtttcagtccatgtgagcgtggtccgagcgtacataaaaaacctatcctttcgtatgcgccggcagcgattcaagtcgtacgcatacgtgaaatcgtgaaccattgatgccacctggggtcatcaggccccagtaattgaatggctaaactgcaacagctgatgaaatccatcagccaatcaatttaccaatcaatggctgcgcctgatccgctttgctgcccactgctcctccattttcctctcacgccgtccacgtgaaaaaaaaagaaaaaaaccaatctggaaccttgtggtttggttcacttccctctctcggccgcgcgaatctggcggcgctgccgaagtgccgatccgatcaaaaaggaggggtttttgccacggatgccgcggtggcgttttttgggctttctggcgtggcgcaacggtcggcttctctccgggcgttcaaaagaagaggtattttaacgcaacggtcgaattctggtgcgacaggagggcaaagggaatcgcccgcgagcgtgcaaatcttgtgcgtctgcgtgtcgtaggcaggaagccgttgggtgaatctggatcgggctcgctcgcgtcggatgcccaacgcccatttgaatcgccgtgcagatacagtaagcctgtttgtgacaagtgacaacggggccccgcatggttgaaggcttgaagccgagcaaaaatgaacaacttttaccaccggacgcttcgaggctgcaagaaagggtgagaactgaatctcacagctcagcagcattttgcccacaaagaattactactagtacttcgtttcttttcttttccttaaaaaaaaacccgtccgcagctgatgtaccgggtgcacttattgatttatgcgtgcaatgcattagggcattcccaacccaataattaggatggtgtccatagcattaaataagctgccacatataataaaaaatgatgtgtcaagtaaataaatgaggaaagagaagaatagtagtggaatagtagtgagataagtagcattaaatttaaatatggaatagtagtgtttgtattggaagagtaatgtctagtactagtttcttgatgatgtggagtttatggaaactatgtctatgtctagtgtcttgggttgggaatgcccttactggtagtaagcaaatactgcgctgatctgctgtgctggcagccaggcagtactggtaaacgataatcaaagccagatactcctacattagtaccactatgccctatgccagttaaatcactgtccgttttgatgaattgagatggataatcagggccccagcctcagcttcctctccgtgagccgtggagccgttactcgtggaccatcactgccacggtctaaacacagcagatcagtcctcaaacgccaggtctacggtctcctcaacgttcgccccacccgtgcgcccgaatgcaatcagcgagagaagatttgaaatccccccctctcatcatctcatacatcagcagccatcagccacgcccatgcacgcagctcgcagccgctaacacaaaacacaacgcattccaacacataattaattccccctaatccgcttccccccaagcactgcataaataccacctcctcgcactccaactcaaccttcctcttcttcttcttcatcatcttcttccggtttcctctaccatgggtctctgctgcagcaagacgcagaaggagacgacgccaccgcacggtggtgcagaggccaccacctccccgcaggtgaagaggaagtccggcaagatcgccgcggacgacaagggcaagaagacgagggcgggcagggcggtggaggcggcgggagacaagaaggcggtgttcgtcgtgaagacgaagtccggggccgtgaatgtggaggagaggaggccggtggtggtggtgcccaccatgccggtgcggacgtcgagctgcaccaaggaggaggtggacgcgatcctcatccagtgcggccgcctcagccggagctcgtccgggagggcggcgtcgagcgagacgggggccggtcaccggaggtcgaagaggagctacgactttgatcaggagaggagacccgggtgtggtggtggtggggatgaggagcgcgattgggagaggcatggcggcgcggtgtccaggccgtcgcctcaccggggctcgccgcagcggaagcgctctggtagtcgggagaggagcagcggcggcggcagccgtagagcgagccgatcgcctgggcggcgtgccgaaggtgtgtcccctgcaccggctccggcaggttccggcggaggcggcggcggcggagagcgggtggtgagacagcagccggggaagatggtgtccgtcccggcgagggagaaggcgcgcgcgccgtcgcccgcggccgcgtccggcaagaggtgcgcgtctccgagatcaagctcgcctgcgaggatggtggctgcagggaatgagaatgctggaggcgggcagatgacggcggcgcagacgccttcgctgagccggagctcgtcgccgtacaggcgcagccccatggcggagatcgacgagaactccctccgcaacaacaatggtgccaatcaccacaaggtaaacaacctatacaaatttcgagttttttttatgccagctattgccgcaattccctcctcttatctcaaatccctcgcgtgaatccagaaaatttcggaaaacgcgctcgccatcgccgccgctccccagaaggccacggagcgttcaaaggagaagccgaaggtcgtggaggagacggtcctcgttgcggcggcgccgcccgcgtctaagacgacggcgacgcgcacggccagtgccacggccgagagcctcaacacgaaggcccggtctcgccgggcgtcgcgggacttcgaccagaacaccaactcgtacgccacccagctcctcgaggacatccagagctaccaccagcagcagaacaccacctccgtggccgccaccgccgcgacgctgcccagcttctcgctcccggcgtgcgtctccaaggcgtgctccatcctcgacgccgtggccgacctcaactcctcgtcgtcggacagccactcctgcgagcccgaccgctccgccaacgacaggggatcggtcaacgcgccgctcggcggcggcatggacgacctcgcggagccgggcgtgcacaagaggcacgccaccgccccacggggggacatccgcggcggcggcggcgagaccgagccgcaggagtccgccgggagcaacagcgtctccggcaacccgtggacgccgtcgtgggagcccaactcggtggagtccacggaccggacgtggagcgcgtcgcgctcgacgaacaacggcgacgaggtggtcgagcagggcagcagcagccacgccggcgcgcgcagcccgctgaaccgctcccggcagagcagcaagcagagggcggcgcagccggagcacagcgtccggtcgcgcgccggcagctctggtggtaacagcaacaacgtcgttcatcgtggacgcggtgctcatcgcagcggcggcggcggcggcggcagcgtggccagcggccggtcgggtgttcgggccgtctcggccatgtcatagaaggaaaaaattatccatgttactcatgtatgctgctgttaggttgtagaatttgtgatcactgctcagtgtcattcgtagtagattgggtttctagtggcaagatggattgctgcttcagtcacagatgtgtttgtggattgtggtccactgttttggtttagtgatacattgttcagatgtaggtcattgtgtgacattggcaatgtatactcttgtcgtcagtgtttaggctgcacacttgaatcttctggtgtattgatttcatattcatttccagtttatcggcaggttcttctgttctagctcagcatataatggattcattttccatttatgcaagattttatttttgttacaaagcacgttggtttataatctctatatactatcatttcaaaaacccaattccagattgatcattgtagtccgggttcagtaccacaattccagattactctctcaagtttctcctatcaaaactgcaattcttaggatcggagtaattttctcaatgaaatgaacatggaaacttagtacaagtcactgaacatatcatggttattcagtgttcatgaatttcttttggcagggaaaacaacataaaattgacgaaacactgaaaataacacaactagagctttcgtagctcagttggttacgnnnnnnnnnnnnnncacccgtttagtaagcgggaggtcctgagttcgactctcaacgaaagcattttgttttagtagtattgtttgaattcatttttttctcttcatcttccaaatgttctaattcaagggtttttgttcatatatactggtcagatgcgaggggaccttcatgtttcaaatgttctaattcaacctgttctcttcatttgggagacacttttgttgtgttggggcgacgctaatgggcgggtgatcgcggccagcgattacccccccatcccactatacgtcctctccccttcttctcttcctaatacaccataaattttaaaataataaaaaaacaaagttagaaaattttatgtataaaaatactatgtataaaaaatattcaaattcaaatttaaatttgaatcggatatataaactttttacttatgaactttgggtctataaactttatgtgtataaactttaggtgtatagaaatactatatataaaaaaattgaattcaaattcaaattcaaacttgaatcgggtatataaacttttgacttataaactttgggtctataaactttaggtgtataaactttagatgtatagaaataatatatataaaaaatatttgaattcaaatttaa

SEQ ID NO: 59397 - DNA, 827 bp, Oryza sativa
tctcgcgctcgtgccaccggacttgccgatggaagtcacatgccgcgccgctgtccgctcaggaggcgcccaaagggccaaagaggatgaccaagcaggagaggagggttaaaatagagaaatttgttgaggagtaggtggctttgtcctgttggcatttgtgaatcttgcgttgatttgagttaggagatttatggatggtttattggttttgcatttaaggctgtgtttagttcacgccaaaattggaagtttggttgaaattggaacgatgtgacggaaaagttagaagtttatgtgtgtagggaagttttgatgtgatggaaaagttggaagtttgaagaaatattttggaactaaacacggcgcaagtagtgtgctgtttagaccatctcactacttgaacttcaaacctagaaaccgatgttgtgaaatgtagcgcgactttatctattatgtgttgtgattgcacataactgatacggaataggtggctcaaatgcagcgacaacatgactaatagttcatgcttcttcgtggttttgcttagtgcaggtataaggcatcgaatgatggtaaattccccacgatgacgactgttcgtcaacatgttggagggggtcactacacggtgagggagatagttcaggaacttgagtacaaccagagaatgttacaactggaccagtctaaggcagctgagctgcccgaaacagctgaacattctgagcatttaaagcccaaggatgtccatggaaagctcaatttaattctgaaagcttcagtggaaaccaaaatacagatgaccttcacctctcccagaaggg

SEQ ID NO: 59398 - DNA, 1152 bp, Oryza sativa
ctgcagcccaaagcaacaaaggaaaacagttgcttaagtacgagggctgttataacctgaagcttagcatcttccatgttattcccactccgttgcctagaatttgcccacaaacttctacctgaaagccaaagttagcgacacaattatgatgctgcaggtcccacaacaatactgctaatacatcgttgtgcaccatacacatatactgagaaaaaggcatgatcctagacattctccccagcattataacaacttgtttaagtaaaataatgaggaaatagttgctaactgacctcagcataagcttctttgcctactgaactatcaggagatgtccgagcttgaaaaactaagttatatccctcagctgtgcactgcaacacattttcaactatgttattaattgaaaaagagctgtgtcaaacaaccaacaatctaagatacttacaagttccttgagagcagcaatagaacctcctgcttttctggaattgttctcccccatcttcacaaagcgagtttcttctgaagtacttgcaattggtaacacatcgtccctactatttccagggtatccaaaaatgtttgtattgctaccaaaaccattttctttcatatcagtcatcttatttggatcagatgacagatatttatctgcaagtattgttggcatggcaaatcaatacaaaatattgtataaaacaagaagttccaaaaagacgcaaaacaataaaagagttacaatgttttgcttttttcaacctatcaattacagaaatatagcttcatccagatgttttcatcccagaaaccaaaaggaaaactgacaacatgcaagcaggcaaatttgaatgccatgaaaattccagcattctacacagtaagcttcatgaatctactcgaacctccgtatattgtcaacaggctctgatttatgataacctgattaagtattcttcaatgaaacatatgtaaacagaataatccagcactattaagtggcaatagctgaaatgcgctatgtgcccaaattttgaaaaaacacaccctatgcccccagtaaacatgtcaatcttttatttaaaacgaatgtcttggttgcgacaagattgatggcacaaaacattatgttatatgtgcagtaaggaa

SEQ ID NO: 59399 - DNA, 1853 bp, Oryza sativa
gccatagtggaatctttgctgttactctttctttctacagggtcacgtactcacttcagtgttcagtcttcagatgttgtacaagagaagcatttgtttttctcagcaacgttacaaacgctcgggcctcggtattattgtccctcctccgagacggttgctgtattcatacacaccgtgccatttgctgacttgcaaccggagctagagaaatggctttgcttgtgcctacgacgaatgcaaacagttggatcgatcgtttgatcgcgcaggatgagcacgcgcgcgcgagatggatctgcgcatcgtgggatcgatggtgatgagctttggggggtgagggtcttcgtggatgaggtgaacaccttcctccactgtggaccaagcaccggtggtctccctcgctgtactctcgcttgccacggtgaacccctctctccttgtgcttctgatcgcaccgagtgctaggcctcctccgtgctcgctgcctgcaatgggcccgttcctcctcactgtcatgccaccgccgccgctgcgtagaagaggcacgagcagggtacgacttaccgtaccacggttattagccttaccgcgggggtacggtaatataaataccacggtaacctccttaaatttaaataaatttaaaaaataatttgaatttttgataaattttgtacggtttcgtacggtttttcgcggttaccgcgcggtaaccgtgcttaccgccggagcgcaataaccccgcccccgacggtttgggaaaccctgggcacgagaggccgggccagccagtgaaaaaacatgggggagagagagagtagggtagagaaggaagaagagagatggaatttgatgactagcatgccaagggggcctaatggacgatcgatcgccagggcgatcgcccagcgatcggtccaccccccctgcccccgctcctttttcttcttcctcctccctttcttctcttcctattacagtacaccaaattttttttaaaagaataaaaagttagaaaaatttatgtataaaaaatttgaattcaaattcaaatttgaattcaaattcaaatttgaattcaaattcaaatttgaatcgggtaattttaggtgtataaactttagatgtatagaaatactatatatagaaaatatttgaattgttatattctggatggaggtagtaacaatcatataatatgattattgtattattttttaaaaaaaataattgattttgaaattacatgcacaagtggatgctatactaagtttgtcacaattcaccgtactttttatgccacgcttgcgagccacaacttagctagtaaaattaaattgtaccacactttgatgagttgatgacatgtgggacccaaatagatgagaagtaatcttgccacaagtgtggctataaaccaaataataggctaacttggtcaaacttgactaacctaagatgtggtaatctttggtaaactttaggagcaaaccaaacatcttttcactcaaggaacaaaaactcatctccgttcgagatcaagagatcaagtggcacttgattgaggagaagaattccaagaagttgagcagatctgcaagagcggcggcacatgcaagaatgcagaaggccgggtcccctgtggaacacatcaaggctaggcaaggacagacaggcaccggtaaaggtcaaatcgacgcgagcgcgcgttgccgtgcgggctgcgggctacggccggagcccggagcggatggccgtaggtggtgacattggctgtcctgcactcctgctactgctagggtgagggtgggggagcgctctgggaccaaccccgttggttcaaaaaaaat

SEQ ID NO: 59400 - DNA, 1821 bp, Oryza sativa
aaattgtgtaattggtttttttccccacatttaatattttattcatgtgttcaactatttgatgtgacgtttttagtcaatttttttttaatttaaacaaggactctatttagattcattttagatagagttatatctttaaaaatatctagctctaaaaataaatttagacaacaaagatacatgtgtgtttagatttattgtagatttaaaattttttggacagtaataatagactagttattttctttttaaacggaaagggtagagttctagtactagtctacgagacgttttggatgcacttcggctccaccgcccaaatccaccccgagatctagcgcgcccttccatccaacgacccgcgccccaaccccagacatgccgatgactcctccgtccagtcctcctcggccatggcctatggattccaacggtcctactcctaccaagctgtggactgtggagtgcagtagatcagctcatcatcaatcatatccatgggccatggccctcgttgattgagcttctttttccttcgccagaaaaggcatgtaaagaaaatgggacgctatcggttagagcaagttcaatagtatagctaaactaatagctcatttatacaatagttacatattacactattaatatctggtctcatctgtcatacacactgtatcttggaattcgtgctacagctagctacaaatctgtagcccgctgcccttctctcttctcatttatcttcttaaaatatatttgcagctggcttatagactgctattgtacctgctcttaaggtcacacgatccatgcacgccatacttatactcccatggtaaacttgcgtatgtactgtgtctgtactgtactgtactagtgtctactagcatacttactattgtagaacggcatgttatgtatactcgtgcttggagcccatccctcgtactccctccgtttccttccgttttgtcggagggtgaactcctcaaacgagggaccgtggagcccctttccggttcggaccggggacacgggtgaaagatcgaggatcaatgaggaaaagagagggggatcgggcccctcaggaggatcgggcccctcaggagtgatggaaaatgcagatggtttagacatattcgggccgtttctgtatgtggttgatcttggtggaaggaatacaagagttttttgtttttttgggattcgtcccccactccactgggcatggatctccttttatatcttaaggggttaccacaaagacccaaaacctagctttaagagtaaggaaaacattctttatagacaattaatgcgtaacttgtcttcggacgtgcagaaccatgcgcgccttaccgcagtatgggcacgtcccaccacaccgaacgacacgggcggacacccgcatcattccttctttgactaacgacgacttcctcccgtccgttcccaccggtcagccatgaccactttgaatggaccggtacgaggggatttggtctggatccaaacttaagacaaaaagcccatcattaatggcaatttagacggagcatggcgcaggccatgctccctgacagcagtaggcgcacgcgcgaggcgctctgcccgcgatcacatcaatcattccgactttgggcgggcgagtagtgcgcctacatgccgcatttaatgcgacctgtcgcgccaactcctctaataaatgcagtgggttggcgttggacacgcccgcccaaaccatgcacgcgtggccgtgcatggagggggtcggggcggcccgacccctttcgtggggtacaaccaacacggggtgca

SEQ ID NO: 59401 - DNA, 1065 bp, Oryza sativa
atttaacctgctttgcgtgcacgacgtccaggtatcagtgccagatgtttgccattcgcatgatcgctggttttgttcgaccgcgggggctgcatggtgtttcagtggtgatgtggttcgacataacgaaactgacgtgactcggggtggtgtttgaaccaggttctagaaggagtacgatcttagcgtagccacgtaggattgttcccgatcccgtcgatcgaatcgccaccgttggttctactgggccagaagtggcggacagtaggctcagtgattctccgcctccagtaggcccagccaccatcaatccccacgtcgaattaaaatggaataagttcatcgagcatccctcaactttgcatctgagtatgtatgacatgcctaatccccaataccataaatctccacccctaaactatataaaaccatacaaatgagatcctataggaatatagatatctggttttactgacgtggcatactagtcagcaaaataaaaaaaatatgggatccacatgtaagtgagtaatgtggggttcgcatatctttcttctctcttctcttctccgattggatcccgccgccgaccggtccgaaccccaaccgcctgcctagcaccgtctcctccagtgggcctccccctggatcctggggcatccccatccgccattgctaccgtcagggggatgaggcccacgccgcccgacgacctcaaggcccgacgcaccgtccgccaccggtcgcccccacaacgtcagccaccttcagctcctctctgactgtcatcgacgtccgccggtgccatcctttgctctacaccatcgtccatcggcaccatcccgccaccaggggtctcaacttcgccgacacggcgccccaccaccgggctcatccgctgcgctcctccctaggccaccagtgcactcttccccagccccgcctccactagtccactggcgtccgctgtcaaggctgctacctgcgtcgatccagactcagatccgagtcgacgtcgccgtgaacctgggagggagaggcggctggccgtactggtgggagagg

SEQ ID NO: 59402 - DNA, 3829 bp, Oryza sativa
tttcccgttttaatatgccatgaacagttgatggctgtactttcactactttcccgtttcaataagggcatgtacaaaggtagagtcaaatagaagctctatatcatgtagacactagtatcctacaatagttagagataatatggtctctaatcattaatgtatctaaatattttttcttactcttctttcctttctttcaccaccatgcaacaaaatttgttctaataaatgctaagagtcgactctgagctgttgtcatgcataacaaccatactcctttatctttcttttatatcatcaaatttacttatatggtaatagagagaccactaataaagattgttgtacctgtgctaaggcatgaatagtttgagcctgaattagggattgccgcgttccaacaggcagaaatcttcgtcaaacattgtgacccggatcacgtggatcacatcgctcgcccctgaaaaatactgttatcgtcatcgacgccctgcgtgcacggtgcacccgctctaatcgctaatcctcgcggtccatctgtactgtacgcttatcttgtcataacactgacatctctctcacgaatcgcctaaactaatgatcaatcagttatcacacaatgtcaccatgtgaatgtgcagtacaacacgtacgtccctcttcattccttgacttcttctcgtaagttaagatatgccgcttctttgcgttcacaaggacaaggtgactatgcttgcacgactttccatgccacggcaacaaggatcaaacagtagtcagcaaaaatacgggtctataaatacacgacgtctctccgctggcttacacacaacaacatatcgcaagatcgatggcgacgacgaattgcctcctcgcgctcgcaatcgcgggcctcgtgcttgtctccctcccaggactctcgcgcggcgacgtcgacgctcgccgcggccgcgagctggcgggcgggtgcaacccgagcggcacgctccgcccgagcaggagccactcgtgccaggactgctgcaaggccggccggtcctacccgacgtacgcttgctccccggcgaccaccgggagcaccaaggcggtgatgacgctgaacgacttcgaagccggcggcgacggcggcgacccgtcggagtgcgacggcaagttccacaagaacacggagcgcgtggtggcgctgtccacggggtggtacgccaacggcaggcgctgcaacaagaacatccggatcaacgccaacggcaggtccgtgctcgccaaggtcgtcgacgagtgcgactccctgcacggctgcgacaaggagcacgcctaccagccgccgtgccgccccaacgtcgtcgacgcgtcgcaggccgtgtgggacgcgctccgcatcaccggcgaagacgtcggcgagtacgatatcacttggtcggacgcatgagatcgaccggtccgtgatactgttccaaatccaaactttttcatcatatcatcgacgaagagatcgtgtagcgtactcgggtggattaaagtcttaataacgagtacggtcacatccgaaaggaataaatattacaacgtttaataaaggacatgggcattgctacaaaaagagccctaccatggacttccgagaagcaccaccgtgcactagggtgtccacacatttcagccttaagattactggattattttttttttacctttgaggtcttttttaaaaatttatttacaagcaaactcttgaaaaaacatattccatgaatgaaacattttcatgatgccagcgtcattggtgtcatagtccaacctaacagtgctaatgatgttggcgttatccccctcgcacccctgcagaccgcacaagaccagaagctaagtcactaacatgaaggaggtcggcaccaatgtcaatggcgctaagggcctatctgtaaaaaaaattacattggcggtaagaacctataagtaaaaaaattaaaaatgatctaattttaattaaaaatatctacaaatatatcctcaataccaatgacactaacactaagggtgtgtttggttgggcttttcaacaaacttttgcttttgcaaaagccaaaaatcaaccaaagggtccaaaagtcactgctgcttttacccaaagccagcttttggtgtagtacaaatcaaaagcagccctccccttgctttcagctgcttttgagagaaaaaattacccacctttgccattacacaaaaacgattcgcttgtttttttttctttctcccatcggcatagctcctcctcctcctcacttcgccgtcgccgtcactcctcctcgccctgccgccgccgctcctcctcgacgagacgtcgccgccgccgccgccgctactctcgtcctgcgctggcccagatccgccgacgaggaggtgtaggaggaggaggaagaggagtacgaaggggaggaggaaatgaaggacgaggtgccggtgtccccgccgccgcctgaggccgactacaccaccgcccgtgtcaacctcccctctgccgccgccgaggacttctccgccaccgctgatgtgaccatcaagcatatgcatgcatccaagcatgagaaatataaaacatgaccaaagaattcatcgagtgaatggaggatctacaagatatcaaaattcaatgagttttggaatccagttcggccttcggagacagcactgacttcaaacggacctagcgccttcatgccaactccgatttgggtgatcttagacttcgtggaaagcttatctcgttacctttcaaacgcatccggtctcatgtccaaattcatcttgagtcaacgggaatcgccaaaacaagacagtgttattaccgaaaccgaacttgggccttgggccttgtaatagactaggcccatctcggaagtgtctccctccacctccacgaattagcacttaaccctagctttattttcctctataaatagctttgtacatcctcaaaaacatttgggttttgtttagttgaattttaccaagtgccattcaccttgtctctagtcctcgttcgattagtcggcgactattgattcagagcccccaatagttggtgtgttgatttgccgggtcgattagatctaccacttcaatcgcaactatttctttgtgctaattacctattcgcaatatttagattgcatcttatcttgttcttgcaatgttctctcgtttgcattgcagggatcatcacccgcgcgtcatggttggtacgacatcgtttgtggtgtagcgattgcatggcgtcctggacttgttctggttggtagccacgtcgtaaacgtcgcactcaatcaaagcgagagttatcccctcaccagaagatcgggccacaagagagagcgtcatcagttggtatcagatggtatcagagtatcggttgcctggtgaggattttagttttatatatttattttccctacccattatctacaaattgccacaccactttttccttcaccaaacattagttttgagccttgcaattgttattcaattttgctttattgagttttggtccactgttgtgtcaagtgctggttttagttctagtttcgtcttggtttgagttttgcatcttggttgtgcattgcctgtgcgttcgagcagtggcggaaccaggatcttcggacgactagggcccaaattaaaggctaaaacttgccatgacaaatgtgcaacaaccacatttggttctagcacaatacgatcttgcttattgttactagccatggtttctgctgaattaggcattgggatggagtcattggtttcttccgtttcctgagttgccgga

SEQ ID NO: 59403 - DNA, 723 bp, Oryza sativa
aatctaattgagtaatgtgatgtactaaagcagtaaagctataggtttgagatttcagattcgagacctgagaaaggaagaagaaagagaacaaaaaaaaaaccactgaccttccactcccgcacgaccgcaagccaccgccgcacgccgttcgccgccaccacacgcccgcacgccgccgccaccacaagcccgcacgtcgccaccctccgttcgccgccgccaccacaagcccgcacgccgccgccgccgccgcacgacccgtacgcctgcagcctgcaggccgccacctcgcgcagccacgccgcacgccgccgccacacggcccgcacgctgcagcctgcaggccgccgcctcgcgcagccgcgcccccgccgccgcacgtcgcctcgcgcctccccgccatccgccgccctatcgagcgtcgccgcgcctcctgtagggagagatcgaagagagaccaagagacggagagaggcaaagagagagagagcatgattcggattcagtcggcactcggcactgcaggctagggttttcactggttagtgggctaatgggcttcggcgtttgctatttcgtgggctgttcggtggagaaggcgttttttttggaaggccgagtgtagggccggcctgcatacgagtggggctgggccagaatatatgaaaaaatcggaaaaatcacaaggtataggtattaattttttttttcacgagtagc

SEQ ID NO: 59404 - DNA, 1071 bp, Oryza sativa
attatacatggtatctatctattttactcactaattaagccacaactcacgcccgctgattcctatctattttattactagtattatgccaggtccctctgattcctatccattttataagtagttaatttgctccaaatatatatatagtacagtagtatatacttgtgttttttttacctggggcacgtgtaatacaatctagagattatttggaacttgggattttttatagtaattagtttaagactcataaagtttatgtaaatatcaaacattaaaaagtatccactactgaaaaaacgatttttttttacgagagccccctatgggttgcaaacgtaccgtaactggcgacatctgcaaaaatcaaccttcattatcgcatacgactccttaagagacctcatgttcagtcttgcggggggtgcgcacgactctaccgcgcgcgtcgttcgctgcccccctctccacgcgcgccacctgttcagtcttgcggggaggtgctgacgactagttgtgatttagccattccaggttgcatcggcatccatagccgaaggttgaagacggcggtgggctatacgaactgggtctgtagctctactaggctgggctggatcgaagagagacagtttgaacagagggaggcaacagactgggttgagactaaaaagaaggaaagaataggcggcccaaaaccaaggaccaattttcattaaccttttcaaactatctattaacttattaaaagaatagaaaaaggagcctctgtgttcgctctcacgacctagaaattctcatattaatcggagaaaaaaacagaatccatattgaaatacaatttagaaatagttgaaattcagaattaaaaatataaagaatattggaagaggagactagagtccatatagaaatacaatttataaataactggaattcgaaattcaaaataaaggatatataacacagagtatagagtccatatagaaatacaattaagaaataatagaaatttggaattaaaaataaggaatattagaagtagagtatagagtccatataggaatt

SEQ ID NO: 59405 - DNA, 7471 bp, Oryza sativa
attcctgcagcccagatgataacagtggtcaagatttaattaggttgagaggccttttaaatgaatataatctggatggtagagcagatagagtggtttggcctaacaccagcaacaagatctttaatgtgagatcgatgtatagattgatcacttttgggggtgttaaagattctgaaatgatgagtatttggaagagtaaaattcctcaaaagatcaagcatttcttgtatatggcaggaaaagggagactaccatgttctactcaattggttaaaaggaagtggagagggggagatgagttgtgtaagctatgtggtaaaaaagaaacctcgaaccatatcctctttatgtgccctttagctagttttacttggtgtgtcattagggatgctcttggcttggacaaaagaccaagtaatatcagtgagggtttggatttggttaaggggaagaaaatgaatagggtttggggtggtgcttctggctactgtgtgttgggcgttgtggttggttaggaacgattgggtttttgaaaatgtgttgattaaatcccctttgcatattgtttacaaaactctttcttttgttcagaaatggtgtatcatgctaaaaggggaggagcaaggtatcttggaaggatggtgtgatcgtctgctggaaaaaatgggacaactgaagacaaatcgattgcctgaagatttgtaactgtgtagttcagttggcccttacctacgcctcatgggaaagacagcctgtgtgctgaactgtgtttttctgttttttaataagactgtttgtctgttgggctttctttcaaagccaggtcaatataattgatctgtttcaaaaaaaaaacaagaagacgcagcacctgccgcgcgagggaggtgccatccgccgtggcgcacgcctcctcctccaagtcatcacagattccctcaagcttggcatcgtcgacggcggagacatcggttgcggtggcggggaacgtcatcttcttccgtgcagtgtcctcgagccctaacgagacatctcggagcataatcccaagcgggcgtgccctcacaagggcccgagcatccactgcatgatgcgccagttgatgtccactgcctccgtcaaggcggagaggatgcgtccggcctcgtcctgacggttgagagatcggacctcgacatcaacgccgccgacggccgcaaggtccgccatggcattctcaacctgctccagcgatgacactagtacagtagataccaacacggaggtgggagaggccgaggaaccgaggctcgaggccgacaacgaggagacagaggcagaggcagaggtagaggcaaagtgcaccgcggagattggggttgaggagctcgccgtggcggcagtgtcaaggagtgcgcctaggaaggcgaaccggtgggaatcgaggcggaggcagagttcgccaaggctgtcagggtagcaaagctcaccacggcgatcgcggtagtggagcgcattgcgaggcggtcgaggttgaggagctcggcgcggcggtcgtggttgagggccccacaagtcagaggccttggctgtctcgcagtccacgtgaccatcgccattgttcctcactgttggatagtatagagagaggagaatactgcgtaacgtggattgattgtattgagcctctgggggccggtatatgtaggagtacgtggggaggagataaggaacgattacagatttggaaggagttcacacaaatcaatcatatcctaatatgactctaactaccatatactcgaacatccccccgcagtccatgcatgagcagcgcggacacttggactgaagaaaaaaccagcaagaatactcaacacgatgatagccctttatgccatagtcgatgtagataaagcaaaggagccgagagagccgtggtcgatgaagccgtgcgtagactagccgtggtcgatgtagccgaagtagggaagccgatgatgtcgaggtagccgagccgtggggcgcgcatggggcgctgtagagtggttgtaaacgcacgggagggcatcatggaccaatggtgcgcgaggacgtgctggagatgaagacggtgatacaatcacgatgatcgtggaggaatatgacgccgaagagccgatgtagtcgaaccgtgaagtacgagacgtcacgccgggtttgccagacccagggacaactcgggacgaacacgcgcaacggtgttgccaataccgcgtagacgaggtagggaaccaccatgaatcatacgccaatgtcggaggagactagcagagaaggccttcgagacggtcgcggcgcgagaacggcgtagaggcagaattgccgaagtagcacccgcagttgccggagaagagcgaagtgtagtcgaggaagatacggcgatgctggcaatgagacatgctggatgaagaagatggtgaagtagcaggaccaacggcctggacagcaacgtcggtagccatgtagaggtagctggaccaccggcctagaacggcgatgatggcaacttgcagacgcagcggcaatgctctaagtagacgaagaagaacccgagtggctgacgatgaccagtgcggatgatgaggttgtcgatgcgcgaacggtgagaaagaagacgaaagcggcgaaactgcggtccgagaggacaacacagctgcagctccatatcgatgcaacggcaagaactaaatcgacggtgaggccacgctgagaagggcctctcagcgttgcaacagccagtggacggggaccatgggcagcggcactgcggcccgagggaacaacgtagtggcaaccagaagattgatggcgtagtacacgtgctcgaagacgatagcagcagtgtgtcgtagccgggcgcataaacgggtgatcaagccaaaattgcatgaggctaggcgacgaagaggaagccggagttgatgccgatgttcgagatgtgcaaatgtcgacgaggcaatggacgacgcaaacccaatctctgatcgggggaaaaacacacacacacacacaaatacaagcagcaacagcactgtagcagggtagcaatccacacgctcgacgacagtccaagctgaacgcagcacagtccttcatcaagtcaacaagctaacctctctgtacgtacatatccacgtgacctctctcctcccttgcatgtagagctacgcaagttcatagcagaagggtacagatacagcagagagagggcggcctatggactagcggcgacccgttggcttggcaggggctgggccggctgggcgcaggtcgacggcggcgactggctgtggagcggagcagagaccggtggacagtgtcggctccaggaatgaatcgttgggtggtcctacttggcatcccaaattgtcacgatgttacaaaatcaagtcaaatatgtcaaatatagtggaaatataattcaaatattgcaatatagctcaaaacatcacaaattgattaaaaccaacatttaagccacactacaagaaaaatactctgtatagacatttttctagtactgtagaggcacttatcaaatacctttacaacaatatagaagcattttaaaaaatgtctaataagtgtcttatggtgaattgtctctacagacgaagagacattttataaaatgtctataagatggtagaggcattttttagagacactaaattgtaccgcaaacatataaaaccagtccaaaaaagagaataaaatagtttccttgcttttgataagtcttgaactcgtgatcttttggttaaatcattctaatctttgatacactaaccaactcaactccatgtcattacttgtatacttgttcctttagttacttatatttaatcctttagtacacattatcattctaaaaatgtctctacatagtttaaaatgtctcaacaaaatgcctttatatattagacgcattttatagtgccgaaagaatgcctctacgagataaaatctaacaaaatgatataaaaatgtctctagagtaaaagttttctaggcaatttttaaagtgcctctataaagtgtctctacactataaaacttctgattttagaagcaatttacaaaatgcctctacaaaagtgcctctatacgaggtttttgttgtagtgccaatcccatctcttgatttaatcgaatcccactttctatttcacccaattcaagtgcttccataatcttatgaacaaaacaaaattgaagtggcgcttcttaccataaatttccttgactgggaaatcatgtggataacattggtttggacctttcagaatatatgcacgctgaactgcgtcttgttcattgacattatagctcgcaataggggacctcagtcctggatcatattgaagatgattagcatcatactttggaggtgcatcttgctattcatttgttgcctcaacaactagagttggctcaggctgtggctcaactagtggcggctcatcttcttcaatttgagcttcctcatcaataagatctgccctcttcttcgcctttgcttcatgtttccgaaaaagcgatgcaatgtctccattccttttcatgtctcactgtaatttgcattacaaattaatgagatactaagttataatgttatattgactactaactaagttgttgctaaaagaaaattccaagtttcagttttcaatcacattttttcatccacatttttcattcatcgatgaccgatctattcaaagtatatactaaagacaaatgagtaactcgccatctcggtcttcacagaggggcagggagcagcaggggagtagggcactggaggccggagagtcgtcgactcgttgagtaggagggagagggacccgactccggtgcaccgtcgccgccgtgaggggcagcgggggcaaaatcgtggccggctggccgccgccggctgggatggtgctgcacgcccgtgccgggcccgggcggccgacggacgacggctgccgcctgcaagcgcaatggccgccgacgctggcacctggcgcagagcgagagtaggaggaggcaaggagcggggagtcgggagaccggagggagaggtagagatgagacagaagcagcgtgatttgggggaggattggagtggcgggcacgcctgcgcggtgcgcctctcctctgacctctgtcgtcctaaccctagcctgtggtgggctttttctggtttgggccgtcggggggagggggtcctcctaggccaaaatccagggtggtccagggaccacctggactacccactggagccgcccatgccggtggagagcaccgtccttggcgccccggcgaacagcaagaggcaagatcctatcggtcgcagagcccggtagaggtcgacggaccgtcggtggaggaagtcggccggcaacggggttatccgtggtgtcgtcggtggcaggcaacgaaggcggaggtcggttgcagagcccggcggatgtcgacgcaccgtcggtggaggaagtcggccggcagcagggttgtccgtggcgtcgtcggtggcaggcgacggaggtggaggtcgaaggcgtcggcccacgcagtcacgtcgaagtcgagggagcccggcatagcctgtgaagtggagtcgcggaaagccggcggggcggacgacgtcgccgccagtcctgcgtgggaggcttgggtggcatcggcggcgaccgaggctacacgacggcggtggaggcagcgaccggcgaggatggctcgacgaggaccatggccgtgacatggccgcgacgaccggtagattcatgcgacgacattacagctgctgatgcttgaattgatgacgacgtgaggagaagatgcaggactcctggaaatcgatctctccaactcaacgatgacaacgaacgaaaaagatgaggccgccagaggggatcgggatcgatcttctcggcgacgaaccacgaacgaccaatctgggaactgaaccagatcgatctgatgcgaagacgaaaaaggaaaaaaaaggggtgaccgcccccgggagatcgctactcccggcggcggcggaggcggaagcagagagagggatgctagatcgcccgctctgataccatgttggatagtatagggagaggggaatactgcgtaaagtggattgattgtattgagcctcagggggccggtatatataagagtacatggggaggagataaggaaggattacagatatggaaggagttcacacaaatctgtcatatcctaatatgactttaactaccctatactctactccatccgtttcacaatgtaagactttctagcattgcccacatttataaagatgctaatgaatctagacattattatatatatagattcattagcatctatatgaatgtgaacaatgttagaaagtcttacattgtgaaacgaaggaagtaacactcacctctagctaagagtggtaatgggtcgagagactcatgaatgctttacaaccctatgtaaccctcatatattttaggtgaaaatgtataaaaaaaataattccatcatgctttagatccaatctttaaatttttcaggataaaaaaactcaagacaatcaccacacctacctgcggccatcgatgcatcccaaacaaggtaagtcgataatgcgccatggcgcacccttcctcattaacatttatagcctccgtcagggatctcccattagccacgtccacttcactgccgctcatggctcaccagatcctcctctgcaccggaacctagatgccccaccactttgtccgataattgatttattacaagtttaattctagattgttttaaagataattttaaaaggaatgaaattgattggcattgaaattaggagtagggtggtcgggtggagcttcatcaagatcaaagagtgtcatggcctcctccagctttaggatgttacattgaaatcccctctctttcagtgaagaaaaaaattgtattatagcaaaaaacaaaatgtataatagcctttgtttgaaaacacttttacacattagcccctcaggattgtagtgaagctcagccactgattagaagatttggaaaattcaaccataaaacaaagttaaatcagctgacgatccaaaaagaaaacattcgtcgacgatctttagggtctgttcggcaactacaaatataaaatactgttcttgttggctgcagtacagtaaaaaaaaatcgggattgctatatgtcattcgaataaaatttagggaagaaatcttacagattttggaccactgcatccatgccaagattcgtgcgtcggcttctctcctccaactccagcgggctccccttcttctccagcgccggcgacaccccaactccggcgggttagggtttggggttggggtgagagtaggaggggggttgggagagggggaagaggggggtttcctcggggtttaaagggatggcc

SEQ ID NO: 59406 - DNA, 6454 bp, Oryza sativa
cctcgcaggtgccgttgaccccttccggctagccggcgaggcgggcggcggcgcggtggggtggtggcggcggggatcgcgcgaggacggggtggcggcggcgtgcgatatgaatcggtggggaggaggagaggagttaggttaaaagggtctgcacgaatcttaaagcatatccaatggtccaaaattcgaatgatatggggtgggattttctgtcacaatatgtataaacagcccaaaaaaaatagcagccgaacagaagcttaatttaaaacaaaagaatgcaactacgtggcgctcgttaaattcttagcatacatgagttctggaggaaaacaacaccaaaaacactattcatctcttaaggaagtaatttgataatttctatgttttttcgcatggagctagcatccaaatagttgttcattgtttgctatcggtcgggcgcctacaatattgcaatttgtcagtctatcatcgttggatacgcatcaagatccatgcacaaaaccaggcttggcctgatgcaatgagtaacgggctgcatctgccctggcccgttaagccgtgggccatcaatttttttggataatggatttttcattaatttggcctctatatccatatatatccgtaaagaatatacatagccaaaaacatacacaagggcaatacacacaaacacacacaaaaaaaaaaaagctagaagacttagcttcaaccttcatcgatgacttattctattcatcccagcatgagaggggtatgaggagaaacaaaactagtttgtgctactcgtcgccgcaccatctccacctctatggaactcaaccataaactgctgcaaactgctatgtccgctttccaccgtcgccatccaaaaacccccttatgcagttgttgcattttgaacgcctatagagtaccacgaagccgcttgccgtcccaccaccatcttccgtggactatcaaactcaccgtagctcctagagcatcatggaaccatccagcatgatatacaccttgtctttactgtcatgagctttgccgaagatgcaccgctaccattcacatctatccgcagccagaccttgacgccgtcactcacatgacagctgctgcctctaggattactccgtcaagagcctccattgccatcatccttatatgcatcaggaaagtcgacggccatcgcacaccatcagcccagccatcgacgaccatcgtccactgccctcgcctgaccgtggtcagaacggggcactggagctcacctaagtcgtcggtgcctctaggacgttaccattgagaaccttcgccgccatcgtctcaacttgtcatggttgaaccaacaatcaacaagaaccttcgccgccatcgtctcaatctgtcatggctgaaccaaccaaccgtcgacagtcatcaccatgctattgtcccaccatcacaggtggagggctagatccctccactgttgttatcgccggtggcagagccgtcactgcccaacaccaccaccagcgcgctccctaccgcctagcaggttgccagcgtgcgctgccgctgccaccaccgcctggccggctgccagcatgtgccgtcaatgaggtatgcacactcagatgtggcaagaaatttgagattaagccatcgtccaaaacaggtttcgtcaaaatgccatcgtctaaaacgggtttcaccaaaatgcaatcctgcacgtaatttggtttcatccaaataccattctcaaacaggccacacgctaatgtcatttctcccttttattgattgttcgcccatcatgcagaacatataaattccttatcactatgtaggaaaattgaactgtatgctaagtagcaataaaatgtggcatgaagcatgtcagaacttcaaataggtttccatcacttgaacagatgaagttacaacattgttgaaacgcaggcatacatgagagcaatggtatttgcaactggcagaaacaacactttctacacacaaaatcattagcttctagtttcagtgtggcagttactgcagggctcaataacctttaagctaacactcgagggtactctcccctcaacatagatcctaatagcgaggagagccttctcagcttccaagagagcttccttgctcatttgtaaacattgacatgggtcaatcttgtcatttctcctgtcatagccacgggtggtgtccaatgtaaggtactctagagacgaagccttctcgagaatgtggttggcaagatcgatcatgctctttgcagaggaaaaaccggttatcatcatgttcttgagattgtcatggcggtattctgaagcacgcattggatgcatggagtcaccactcaatgcttcaaggatcgaatcatgtcttttagctggccgttcaatctgcaaaggattacgtcaatgtctgctttttttttaatgagcaaaaggtactgaataaaagttagccatattaattctctccctcttttatttagctactactttataggaataggatagtgatcaaggcaagtaatttagttgcaaagtttatcaaggccatcaatagtgtcaatatttattactagagttgcaacgtttttatttttttaaagaaagctcatcacatatattttaaagcccataaaaattatattatcatcatgccaattttgctgccactttgtaggtgtcagttgagttagccataggggtcagataaagatagggatgcaagcggggcgggcaagcgggtgtttttagcccgcttatctcacttgtagttcattttttcttctaaattttgtgctaccatatgaaaaatgaagtagtaagcgggtttttatgcgggtagtgagactacccacttgcatccctagacaaagtcttgtctgattgttcgtggaccacatggtaattgggtggcaaccaccaccagtaagcgtcttttaagatagtacatatgagatcagttgcatcatttgcagaacaaagaaatgttacatttgtccaattcaagaaataacaaaaaacatttgcatgaaacatcataacaaataattctttaagagaaaacaataaaatcttgaacataagtggtacctgataaatgatagatagctttgacatataaataataacttacacgcaggataaaagtctccaaggcaggagaagcatcaatgaaggaaaccagagaacaaaaatcatagcccggggacaaatctggtgtaagcagcagtatctccaagcacttgagctgcaggaatttgccaagtacctttggtgtattgactgtctgaagaaaaagaggccgcaaaaattaattgagtacagtagtatacagtgcaaatctagtgatatactccctccgtttctaaatatttgatgccgttgacttttttaaatatgtttgaccgttcgtcttattcaaaaaaattaagtaattattaatttttttctatcatttgattcattgttaaatatacttatatgtatacatatagttttacatattttttaaaagtttttaaataaaacgaacggtcaaacatgtgcttaaaaagccaacggtgtcaaatatttagaaacggaggaagtaacatgctattattatggtgtgttgagtgacaagtgcaattgagctaataagtaaggctaaaaccgacctcattacgtgttgatagataaagcttctgtatgtttggcgcaatggatggaagcttcttgctaccataatgtagcgcgtcagggcttccgtcacaaaacatttgcattttcttcacttgtaataatgcttctccaagtgagatttgtattggggggccagcatagatgaaagtagagagctttggagcactactgtcaatcacctccaattttctaaaatgcaacacttccaggtaattaagctccagcagatgggggatcttcaggacaacaatattatggcagtctgaaagtaacaatcgctgcaaagcacaggatttggatagaaagccgcataattcctcctcagtaatttttactgatcttaaacgcaaacttgtcaaggtactcatctgaccaatttgtatgccagggtggaaagaacagccaccaagtaaaaaagactgaattgagcttgctacccttgatagaagtgagcatgggaaatcataatccatcttgctaactcgggtcatttctagttcaaattctttgattcctggtgcaaacgcaatttgaagccagcggtcaacataactaggatgcagactgaaacaagggtgggttgtaagtttaaacatcttcactcctgtgccagcatgattcagcataatggggtcgactctactgatgaaatcaattgttagtttatcattgctaggtgctctcttatctatgcgtagtgtattaacattaagattgagcctggggtagaatctccaagaacgcagaaaacaacgagatgcacaggcggcacgagctgcatcctgcataggcatgagagtgtgtatgtgataaaggatgtcctgcacaagccaacaggagaggataaaaacattagaaaatgttttattaccactataataataactggcatactgctttttgggaatgaatagtagaggaaactatcaatatgctaaaagaacattttcaaattgaacatggatgcactgctgagttccgtacctctggaagctgcatcttggattccactgtactggcagattgagaatcatcgccacattgacaaggggagttgtctatttcagaagctgaagaagtagctccattacctgcaactaactaggtcatgatgcagaagggagcattttgtttgcacgcatataccaaagatggatagttggacataatttaaagataactataatacaacaaagacatatttttgtgcttgagattactaaatatgaagattaagtacgggcacttaaaacaagaaaaccattagctcatgattaattaagttttaattattttaaaattaaaaaaatatttatctgatattaatgcaacttctattctgcataaaaagtttcagtacgaaatataatagtttgaaaagcgtgcccaacggaaatatcttaatcggaaaaagaaggagaagggacctaattaaataagggttttcaactaacatagaaaatcagagaatcatcattgaaatcaaaatttgagcaaagtcacttgagatttaggccacctgatgatgcagagaagtgcagaacaaatgtgcacttgagatttgaacctagctagttagaagaatccgccgaagcggctgaatccaaccagtttgattgattttacccaccagggaagccgtgggagcccttccaaaggaacaacaggtaatcgaacctaaatctagcgggtgatttgatcagctacgaggggtgggggacaggaggaggcttacctattcgcggcggcggctggacgggcacctccagtatctccatatggccgctgcttagtacaaaacgatgaatctcccaagagggggaaggagcctggggcgatcgaggctctcgagaagtatcaggcgcgacgttcgccgggaacggcgggagcggcggcgcgcgagatcggcggcggcgtcggcggcggcggcgcggggaaattaagatcgcagagccgagacggatcggaggaggagcggctaaaggctaaagtgctaaacccaccgctcgtttgttttaagtgggtcccaccgagtccgactgttcttcgtacgagttcaccggattacggaaaacccaagagaaaaaggtaaaacccgatgaattttcaatcaataccatacagaaaccgactaataccagttaccgtacagtaacacatgtattataagatgttttgactttagccaaaatcaaatagcttcaagtttgactaacaccgtgtttagttccaaactttttttttcaaactttcaacttttccatcacatcaaaacttttctacacacataaacttccaactttttcatcacatcgttccaatttcaatcaaacttccaattttagcgtgaactaattacacccttaagtttataaaaaaaatagtaatattttcgacctaagataaatttattataaaaatatatttaattattaatctctatctctatctctactattataaaaattgaaaatgtttttgccagtactttggtaagtcatccgtgtatgagtcagtttttaaattcgatcgcttttggaaatacatagtgtatttaaataggtttttaagttcgttcgcttttgaaaatatagtaagagccgtataagaattctctttaaaaaaaactcgcatgctaacttaagacgatcggacttctaattatagctcatgatttacattattgtatttgtatataaacttagctaaacttaaagcaatttgactttaaccaaagtcaaaacatcttataacct

SEQ ID NO: 59407 - DNA, 3432 bp, Oryza sativa
tttaaattctacgtatggcttttaatttttcgatagaaagtttaaaattttacatgaaagtttcttttagatatagatttctatcaatatgttagtaaaaaaaactaaggaaaaaaaggaaaacattcccttaattatcgtcattatcctaaactaactcggtagttatgggagaagataaaacgcgcgccgccactcgctttctcagtgttttgtgtcttttggtttgaagccaacttttgataagcctagaaaaatagaccatttcaatattaacttaagctattttgggttttttttttttgcagggaggctattttggttttaatccagacacaatattgccttatcaagattagccatgctaaaactagacaaaatttagtgttgacaaaattggtaagatcaagttagactacaaaccaaaccagccctataattcataagccgaagaaaatttcacaagggaaaaatggaagataaaggtaccagcacattgctactccagcttgctaccagacttttaagagaagtcaagattcaagaataatataaaagagagaacacaaaagaaacacgtaagagagataagaaaacatagaaaataagcaaaaatcctgccatctaaggctaataataggcttttgctagagaatgcatatgctacagtctcatgcctgagtttacaggaagcagatttcatctgaacacaactgatttctgatctgacactcacagaaggttatccacggcaaaagaggtgagaaaatttacttaatataatctcagaaaagctgagagttcgacgcaattatgcctcaatatatttatctgtcttcctgtttgtacatttcatggcctgcaccacatctttacttgattacttctcactgtgcagaatcgaccaatctgcaatagaatagaacaattagcaggagtggtggaatagattagagagtcaaggtttcgcttcatttcatcatgccatctcatgctgcaagagacatccctgatccatatagctgacttatttgaatgcatgctttgcttatgatgatcagtgagcaaagctggaggcttccagaggacagcgtttcccacagcacagatgtggaatagatggagggaaggcattaaagcaaatggtgcttggggaccagttaaagtcatgcaattgcaagcagcatttagcaccgaggacatccttctattataggagacaacaatactaacacttgctatctaatggtaaccatttataaagcactaatagaacttaactaacgtggctaaaccaccaaccaacccaggatacttatgacattatagtagtcaataattaaagagacaaggagtcatgaatttgattatcagtgttaattacactatattaattcaaaagtaaaaatcagatagcatcggttagacatcagacaagttaactgacatcagagcagctcttctagcatgtctttgtgcccccctaaaggagcttaagttgtatgaaaacatttgccatacatagcttttgcaatcagttctggtggagagaatgttagacttctcccagttcctatatgttcaggacataaagtaagttccaaaatgataaaacttgaattgtccatggcattgctccatttcaccagcaaggtgctacagacaagcaatggcatggtgtacaacaaactagcaggccaatgttggactcagtacatgtgccaccaaggtacttcatgccataggctctgttgtttaactcaacatggaactaaaaaggaattgtgtagaaatattaactggcacaatgtacatggttgcccgtcatccaagccaactctatgtgctcgaaatgtgctcctgtattgtgacagccctcctgtattgtgacagctctaacacatgttgcatatcgtctatcatcctgtttgtgataaaatatcagtaattgctcgagtttggaggttttatacaacaggtcatttgatttcacaattttctctttaaaccagtgaaatacataatttacgacaaaaatacatgctggaattcaaggaactccaaaactaaacatatgtttgaactctagataacacgtaagatcctagtccctagaaatgcaaattcacatttcctttgctaaacttggccttgctgaggattatggacttagattacaatgaggcaacgtgtatacgaggcaactatacaaaatatgcagaaaccatcctatattacgaggacacaaacacaggtagataaggcctctagcaggtgccacagaagaactccagaagggtaattttaccatcctttataaagtacctagaggtaccatattttctagtgtaaaaatttggtacctctaggtactaagtacctcaatgtaccaaaaagtttagtgtaaaatttaggtaccttaaggtactttatcaaggactgtaaaattcctcactccagaaacactagagcaaccataaaaagagtatgggaaaaaataacagtatttgtgcagcttaacaataaatttcggactatcttaaatcaccgtactacatgattgcatcatgtgacaagttgagcatagaactacagctcaaattcccaatttccattaaccataatcctgtgataattacattggcaaaaaaagatcctaattaaccatgtcagaacatatcacagtatcagtgaactacagtcacaagacaactccattcccactgcagattaaatggatcgagtgtgattgtggcaagttacctgggctggaaagcaccgccaaaaggcattggggaatggggacagcgtgatatcatgccttctccaggacaaggcagcatgaattcccagtggcaaatccaacggtcaacctttgcgctgagtcaaaatggtcatccagtggcttaattgaacagcctttagcccacaaaatcagaagattttcatttatggtaaaggattcctcactgtcatgttgtctgttgatgaatggagtccttaccttcaaatcagggtattcactatcaaaactggccatcaaaaaattttataacttaagagatcaggttcttcactctgaacttcaatgcaaagcaaggactaaatattggctttcagaacaagttccagtacaggaaagccctgattcctatctagagttggtcatttgttagtggtccatgcagtctctataatgcaaccagtttggattcaggaaatatccaatccctatggggtggatctgcatgctcagcagtactacatcagttggcaattgttggtattcatgacaagggatatattctcaaggatgctctcattcagttcaaaggaatatactggaatggtgccaatgattctcctcagacttaatctacttcatacttcctctgtttcacaatgtaagtcattctaggggctgcaggaatt

SEQ ID NO: 59408 - DNA, 14518 bp, Oryza sativa
tggcaagctgcaaccttatactcaatcttcagttgtcaatatgtcatatcttaagtgggtctataaattctcggcccctatgatgttcttgctcgaaatggtccaaatgcatacaaattacaacatccagagggcagcctgatgcatccaatctttcatacttgtcagttgaagccacatatacctgatcacacacaccaatctttttatctctctcggatataattgaatttgatgctgaaaaggttcaagtggaacaaattttgtgcaggaaactagttaagaaaggtaatgctgctcgccttcaagtgcttatcaaatatcaagtggacctcattagctattttagcagcaaggagaattatgatgtccttgtgacaagatttcctgcagcatcagcttggggacaagctgagtctcacggcagtgttgcagctatactagaggcaatgggccagcaaggaggacgcaaggtaggcaggacattgaatgaagagttgaagacatataactgagagtgcgggtggagggccagtgagccttgtaatatgtgagaggtgctcaggccaagtctagctaactactagctggaatagactataaggacagcatgctgtatcacgtacgctgttaagcaatgaatgagggaattagctgttcttctctgcctcttccttcttcttcctcctgctaatccatggggatgtacagagcaggcactgaaaaacagatatgataatgaggtaaatcatcatttctaattagaaaacagatgttaagaaagcgatccacatccattacaggggaagggaactggctccaatcagtgctagagtggggacacatacacacacaaaaaatatgtaaaccaacctgaccaatttttgttgtttgggatggacacgctattttgagcctgactcattgaagagatcaaatcccaaaagaagacatcaaatatgaataagaatattcttgagagctcacttgtgtatagccaattgataatctcatcgcatagtcatttgtgatatgttgcttctctgttcctgtaacagcatcatggtgctgagcaagagctagagcatcagctaaagtatctgttgtgagatttaatttgctttccccttaaaagaattccagaagccaagatgcctgaaaagtgaaaagaaataagatattaagcatatggcaccacaaagtaccaagggaacaagaaaatatatcacatttaaattggacatgtgaaagccagaataatgaaaagggtggtaaaaccaccaatcatagcacggactgttgttttaaggaaggtcttcttgtgaaggaaccagtccaggcattcgggttgtccgcataccaggtgtaagaaatacagtcaaatgcatgtgaaagaaacaaagtgaaattacccataccaattatgaatatgaaaatagaacatacaggtagaaatcatttgtcttgagaggccatggctcatttaagcatattttgcatcagtataaatggaagacatggaatagagagcattggcatggccaattaagggaatggaataaacacgttgaaatcatcatatcacaagttcaagatatctgcattatgtaatgccatgactgcaacttcatggtgaaaccaaaacaaagaaactaaacaatagtcagtattagtaatattaatgatcatctttaaccttattgacataatgaattagtttgtccatcattctgaaccaactttatccataatgataaatcataattgaattttgaagtctgtatccattgtaatcatggcatggtttgtcgtcataatatttgcctagagaaaagaaggaaaaaacatgaattaggatgaatcattcattcctaagcagatcgatagcttcaagttaaaatgttgatattcagaaataacttttgagtattaaaagcacaaaggtcgatgtatcatggaatacagaacagcaaagatgcattctcatcttctgacaaacacatatcactacaacatccggaaaatccagtgtacattcaataaatagtttgcagttgcatcaatccatatgagactaatggatttacatgaaacgcacataagagagtgtacattggcatgaagaaaagcgagaatatttttggagtctaatgtacctgtgctagagctgcaacaaagtcgttcacccattgttcaacattataacaaaaaaagagggcatccagcatagaggcaagcaatgtagaataagttcaatgtagtatgtgttaactagagttctcattaaattacctggaagacaaggtaattatcatcaacttcgaaataaaactcactaggagatggttcataaatttttgggaagatatcagcaaaggatgtgtaagaaaatgtgcatatttcatatgaaatatggattcctagacttaataatataaaattgaggtgtaacatttactatcaaaaaaagagagaaggtttacttaaatcagctgacgagccgagagtcttggagcccctctcacaacctcgagttcttctgttccctttccgcgtatcactatcttggtaatcaacccggagaaaaaaaatcatcaattcctgcatgaaacataacaacatgtttgctgaaccatcccttttctattaagttcaatatgttagtcaaaacactggatgggcaactgttattccaattaacgaatgggttgtgttagactcaatagctatgttgtgtggtcaatgaaagggctctcggtggcgtcactctttaggggatagcaaggtacatatactgacattattatatctcaacataataaatatctatgacgggcaataagtgataacatagttactgttgtaacagcacagcagagttcaaagtttgtcttatcttgcaaactagctatatgatgaagtagcagtgcatcatatacaatatttgcgttagtttctgcccatgaaagaatttgactcgcattaactctcaaagcatagaagtgcatcatatacgacatttgcattagcttctgccatgaaataatttaattcacaactctgaaagtgaaagcatgatcacacaaatgggtttggcacattacttacgcacctaggcagtaatcctgaattgcagagtgcgaaattggatcaatctgccaaccaatccttggaatctgacccccaactactccttgatgaacctgtgccaaatcatagattcatagtcggtatatatatcatgttaatgtagcagtgcacagccgcctcagcatgcatgcacatagccccattcttcaacttcacaagaagcactgtgttcgctatagaatacagacatgagtggcaatgctaacatatagagtaaccaatggggcatgaaaggccacacattagttccagccatccagtgctgatgagcccctccaccgtatccttaatcatgggctatctccaccatttctgaaattgcctagaaccaatgaaaccattggtcaagaaaactcattatgtctacaagtagatgcacattgcttcctacccaaccaaaaaaatgccccccacactgcagcactaaccattttgggatttagtttcagtaacttcaaatcttagaactggtagccaggaaatggctgtagaaacatcaggaaaatagtagtactgcgctttctacacccaaattccaattacaaacagccggtgcaaattttacgagaagaaatcatgcccaacagaactaaactagcttcgctaaacccgtcaaaaacttctccacccaaaaatggggaaagaaatccaaggaccgcgcagcacgggcctgcacattctgcaagcaagccccctgaaccaaaaacacccagaaacaagaatcaaaacaatcaaccgaaactatgaggagaaccagatgattcgtttccaaagttcaggtaaaatttgacggggagaaaccatcaatcgtgcgtaagctagcttccccaaacccttcgaaacttctccccaaaaaacaaacaaagacgggggaaaatcgcggaaaattccaagaactgcatcgcgcagctcgctcgaaccaagtactgacctcctggatggagttgttcgaactgacgtggtagtactacgtcgtcgcggccttgcgggtgtggagcttccccttcaccacccctgccgacgtatggtagggatgtacacgcactccccccgggtggtgggcggcggcggagacggaggcagaagcggcggcggcggcggcggcgcgaggacggtggcggcgctccatccgaagcttctagaatactagtactactttagtggaggctttggggattggatatccgaggccgtcgatgacgtggagtgcgccacaagaagcagccgtggcatgggccccacctgtcggtgactgcgtgggtcccacctgtcggtgacgcgaaaagcccgcttataaatttacgacttcaccccccccgacctctctctccctccctttccctccatccgcaacggctaccaaagccagagcccagaagccacgaacgaaatcccctttccgctcgaatccccccgccgcagcggcggatcggggaagccacggctccttctccggccggccgtcgcctcgcccggatcccctccgccggccggaagccacggctcctctcccggcttcgcagcccctccctccgcctccgcctccggtgaccgcccggtgatcgatcggggactactccatcaactcgacgcgcttcgccttcctcgccgtcgaagcggagatggagccgatcaatatcacctcggttcgcgagttggaggaggctataggcaagtacggcgccggggagagcgtacgggtcaccatcaacgtggccaacgttttcgaggccgatgagctgcttcggctcatcggcgatcgggagctcgaggttcgttgggagctgagtcccgggggcatggatatgctgagatccgcggcggactactacctcaatctcgacctcctctacgagttcatggaccttatgcggctggatctgcgcgacggcgtccctgtcaagaaatcgttgttcgattggatccggaccgcctccacggatgtgcttacttcttctcacccatcgtcgactcgtcgcatcctggaacaaatcacgctggaggcacagctaatcgggcgagtggccaagggattgggcttcggggcggatgacgtgcagcagtatctcatcaccccgcacgaaatgtcatggtatctggaagaggatgcagttgcggtaagaaagaggagagcaagtttgagttcgggtgatgccgccacgagtgatgttgctgcgggagcgagtgatcctgtggagttgctcaaaaaccacaagcagaggctgctggacaaggttgcgcatctgcaacaggtgatatcttcatcgaaatctgccccttacatctcacagttagagcagtagaaatcacaagaactagaatgcatttcaaagagtctcacatggcatggtacgcataggccattagaagtagagctctgagtacaccaggatcaggatgcacttgcaagacttccacatgacacagcagaaatcaactagtagtacggctttacttcagtgtggagttgcagtttttcgtttgacttgactattgtaaacagctggtttatgtcaacaaataagaccaccagtttctggttttacttgcagaagaaagtattgtgcactgataccatcaagtattacattccctctgcatgtttatagttttggatacagaattagccacggaataaaaataaaaccatgaaacagatacagggaaaccttcttttcttgcatgcacattacatgtttacaacctggtcttagaatgacagtattgattgttgaagcgcctatcgtgtgaagccaatacatagcatcttgatacttgattgttgaagcgaggccaatagtagctgtagaatacagtggaaggacaaatgcataagtaaacacaatgaagtatcaggcaagacaaagatctgtagaaagctattctaggatcagaaattccattggcttggtgattgaatggtgaaccaatgaataacgatggcttatgtctgaaagattatttaaactcaggctcaccattcacaggtattaatccaaaccataaattatactgaggttttccgagaagaaatttacatggctatggcttagtgatccaacgattgaagaatttaatagtctttacttggaagcaggatataaagggaggaattcaagaggctcgccaagctgcttcactctcagcaagtaaaaaccatgtagtaaaaatgtaatctgtgaaaacaaaaacacaaggaactcttgagagctaaagaaaaacattttttccctacagagtacagacaacaaacagattgtactgaagcatatttctaaatattgtcacacatcttagcataatctcccaatattaagtatacatgacaatcatgtagcaaatgcagcaagataatacatctttacctatgggtgtacttaaaaaaggtcactagaagaactcatcatgataatgtatacaacatctgaaattttcatgtaatctccatgaaatgtgcataggataataatggattcttgaaataaatatgttacaaaatgttaaatagcagaagtatgcttgtcaaagctggatgaaaaatgtagcccacttttcccctagcaaatgcattgtatggtgtaacttcagttggaaagtatacccatgtatcataaaaatattagcatgtgatttcccagaaatgaaaacacaaatcaaattcaggaactaagtcgtcagaactgttttagatcagcaaaagaaactttgcctttctttactgagcaccctgagcttcaaaacatgaatggggaaaactattagcaactgacaaaaacacttactagctaattaaaggtaccagtaataatgcataagtacatcccttgccattgttgtttggtggaatgatattattcagttgaggacatagcacaaaggaactgatggctccaacaactgtaactttgacacatatcgtattctaaaagtcgccttaggcgttaggagctgggtagccaccatgattagaaattacctggtgcattaggcacataatctgccttgagggttcttgagtgtacactgaagactctgagagtgtgtatacaatgaagtatgtcctgcacaggccaagatgagagcgtacaaacaatggagcatgttttactaatattacggtacgatgcattctgggaacagatagtagaagcaaactattaatttgctaagaaaatatttaagaacatgggactcattgttcattgctgtttgctgaaatatagctccagaaaatgcatcagtagtaatgatgacgattttttctgttcacgtagtttcatcaatagattgttttttttttctctcttttgtactactccatacctcttgaggatatggatatcaaattctgctctactacattattcagaatcatcaccaccacatcaaaaaaaaaaaaggtgagttctttattccagtaggtgaaatagctagtacgtgtacgcccattacctgagattttcactaaaacgaacgatttggtattgatttaagatccctagcactagcagcagaagcatggagatgaagggatgaggtgggcacctgcctccaatgtccccatgggcgaccaaccaaccggcggtgatgactcccctctcaagagacgaacctccgacgaaaagaggggcgctgaagaagccgaccgaacacctcctcggacgtcgttgaggcggaggatgggagaggattgcggcggcgctgcggaggagtcgagaaacggcggcgccgccacacagcggccatcggcggcggcgattaattccacggatcccccaaccagcctccgctgctgtgtggccttcgtcttcgtaggtttttgaggtctttgggctggctaactgtaactgggctacttcggtttacatgggacgatccgtgggttttcgttgtgatttggctcaccacaactatttttttttcttttaatatttacagaaataatctatcgacgcaaaaaattacaaaaatagaccctgccgccctaatggagggtggcaagctgatgtggcagacggcgccatctgccgccgtctgcgaaaattgcatttagccccctaaagagcatttggctggtacttttttgcatctggaccccttgccgccctggcccagatgcaaaaagtaccagccaaaaagtaccaggcccgggctggcttttttgcatagaggccctgagggcggcaaggattgtcgtgcaaaaaaaccctccctctcctgtctgccgtcaccgtccgtccctcccctgtttgccacgtcagcttgccgccctctactagggcggcagggtttatttttgtaattttttgcgccgatggattatttctgtaaatattaaaagaaaaaaatataaaaatgaaaaaaaatccaactagtgtgagtggatcgatctataataataaatctatttatagattaaaattattaggttatctactcgtgggttggcccgcttacatatttaggtctgtctacgtaaaaatgtaagaatcaataacaaaatttgtgacacctaaatattcagtctcaattggttcggtgaaacatattgtgtgctagctaggccattggtcgattgaatatcaattcaacaactaggggtcaggtatatagcaaatgtgctcattttaatataccacgcaacacactcataaaaaccgaaaaacacttgacagacaccgcgagtgacccacatctttactaacacagctggccggtccaccaagcctaaacatcatcgagtaaccgaccacatgtgtccgactaaagaatcgtcatcaccaatactggcatagactatacctccgtcgcttcctccgtgacaactgacaaacacgccacattaacagtcaatagagtatatatgtggtagttataagaacaggattgatttgtttaaattcttcttcttctatatattcttattacattccttatctttacccaagagtactttaatgtatataatgtttctaaggctcaatacaatcgtttaattatgcagtagtatttcggtatcagagcagcaacctagggtcaccgttactttatgctttttcattgttgcccttagaagggaccgtatcatctgccattccagttccaactggaatggcagagggctacagtgatccatgctattggccacttacatccgtcggatcaagcgtggacgtacgagacccgtcgctacagtaattctaataaagtaaccgattgtccgatgtttctactgttcctctttgccatttaccccctaatggcagaggatgcgaacccatctccctcggggcaaccacttgtttagtcttcggctttttcttgtgtcattgtgcatcgccgccagattgatctagatcccctcggacgagtcttctcattcgtttatcacgacttcgttagcatattcaagcaaacaacaattgccatccatcctcgttcttgtcattgcattgaatgaggcatggtgccatggggtgggagcgacgctagggtgcactgcgataaatgcaaccaagggctcgatgtcattgttggagtagctacatagattcttagggcgggtttggttgcctacatcaagcttggcccgcatctgtagatgcaacttcctcttgtttggttgcctgtgcggccttctcagcctggccccgctgatgcaaaaagggcttcccagccaggctgaggagaaacgctcgattcgagcttccgagcgcagccaggcccggtggctacagcgggttgcatccgcgggtgcaaggtatttctaagtggtaatatcaaaaaagaaaaagtatccaaagctgcaaaccatgcaaccaaccaaacaaaatgtattccaaactgtacatttcatgcaatcaaccaaacagaatctcctgctagccaggctaaactgatgcaaacaaccaaacaaccgcaagtgcatctcctcggtcaggccaaacttagcctggatggaagagatgggccaagatgaggggatgcaagtaaccaaacacaccttgtacccacggccggggactcgcctgctgctttcaactatggctttatggtgccgcttgctaaatctagctatattcatggagaagatgagatgaaggaaaaaatacatgaacaatttggtctaatatatactccagtgttaaaatataagttataatgttcagtttcataggtatatatggtgttaaatttagtaatagatagctacgtgttaaaacggaaggagtatggactaaccatgaaaatataaaattataatggcatgacttgaataataatgatatcttttaaatggctgatattttttaaaacttaaaacttataatggcatcaatataattaactcaaccagatgaccaacctacggattatctacttaaggtcaagcctcattgctctctgggaccgacaggtgggtcccgatgaccattgaccactggcccacatgccagtgagtgtgtgcttctggtttcccattttccacttcgtcgcttcgccccaccctgactccgctccagatctccccgtcgcgctccgctccgcctcctccgcgtcgccgtcgtcttcctcctctccagccgatgcctcctcccaaaccctagccacctcgcaaaaccctagatcccctcccccccgccccaccacgccgccatggatccctccggatccggccctcgccatgaccgcctcctcatctccccgtcgctctcctccccgtctgtagagatggtcgcgattcctccgatcgcacgagggtagggggaagaggcgagcgctgccaggggaaaggggacggtgaagaggactgctcagcggactccatttgttaatccgatctctaatttgaaagaactgtatcttttccgattaccggttttctgttccaggtgcaattctaatttgttttatctgaattatcacatggaatcgattccttaatgaactttccaactgaaactaactgctgctctgagcaatcaataatttagttactactaccaatcaggttatatatataccatggcattcttgttttggttaacgatctctagctgacaagattctgtcgttgtgattcccgtgattttctccaagtcgaaggtggttaattactgtatcgacttgggcagtaatctgcaaaattacaattttaccccgccctcatattttttttttgacaattatagccctccacttttctactgctgttaagtgaggtggtactataaaccggtggtagtataaaccgatctaaactcttgaataaaactagatgtgtggtttagattgttttctactgctagcagagagcaccgtagtgggactctaattcataggctaaagaaaatttcacaagagaaaaatgcaagaaataaaggtatcgtgcacatttctactccagcttgctacctccattcctaatagagcacaatggtgtattttcaacacatacatcacgatgttgtatcaacacccagataaacaagtcacttgcaagttcaattaaaagtttattcattcaaaattcataactttttaccaatacaacaaagaaatcagctttacacattgatggaaatgatagatatagaattttactctgcctaatatatgtaagctcctaaacaaaagctaggacataagttaagtacatgccatcacaagagagaaaatagcatacaccacagttgaacagtttgaagttgagtatatgataacaagtgacattatgcatactatagcctagggcctcttgatgtttccacaataactcgtttcctgcaaggctcaataacctcgaaattaacagttgaagggactttcccttcgatatatcttctaataacttgtggagccctatatgcttctattagatctgaatcagacatgagcaactctctgtctaactcagattccatccgatcgtccgtagtcatcataatgccacagtcccaggatatgaatctcctaatttcgtatttgaaaccatatattctagtgtccagcgtaaggaactcgagtgaaggcgtgttgtcaagaatgtgacttatcaactcaactagggtctttgatgacatcagtccagtgatctttacattcttcaggttactgtagttgcatttaggaagcttcctcaattccgaggaatcttcaagaatgcgatcattcttagtcccgacagagtccaactgcataaaaatattgatgtaacaataccacaggtaaataaggttttgaaagtatcagttccaaaaaaagccttgttgcagttgtgatatatcaaacagttaaccatatcagtctatgttggtaaaggttatgttttcctaagtttgagctaatgcttttaacctttcactgtagctagctttgagacataacaataaacaatgacttacatgtaagacaaaagtttccaaggctggggaagcgtcaagaaaaaaaacaagagaaaaaaaatcatagcaggggggtgattcctttctcggtccaataaacaccatctccaagtacctgaggtagagaaatttattaggcaccatgggtgtgttgacatcctacagaaaatacatacagaaaaaaaattagtatcatatgaaggaatgacaatgatatgcctacatcattctccaataatttgaacataaaaagtactattaactagttggcacatagaagctcaaacaaacctcatcacgagtcattagaaacagattttcaacattacgggcaatggttggaagcttggtacgggcataatggaacatgcggtgccaagggtagagcaatagatttacatcccttaattgtactgcatctccgagtgatattactgtcagtggccctcgataatgaaaactagagagcattggagcatttatctctatcatatctaacctatggctatgctgcacacgcagacagttgagcttttgcagcacacttgttgtcttgaggaaaccaatcttgcaacaggaagagatttccaaactctccaaattgaaagaattggagatgaagcatgccaattcctccccagtaatgtccacccaactcaaatgcacactcttcaagcttctcaagcactcaaactgaagtgttggatggagcgtgcaggaagataggtggaaagattgaactgaatttcctctacggttatcagaaagcaaatgtgaatatgggaaggtgtattctgtcttgttgcgtaggggaagctcaaaggcgaattccttgattttgagtgtgctagcagccttaagccagcgatcaagatgcgagggatgcactgcatagccaggaccaagttcaagcttgaatatcttcacaccaacgcccgagtggtttcgcataatgttgtccactatggcgatgaaatccacaggtgtctcattgtcattaacaccttttcggtttagcgctaggttttctgcattgaagatgaggtttggatagcatctccaggaatgtagaaatgcatgagatacgcatgcagcacgggcagcgtctcgcattggcacatgggaaagtatcatcagcaggagatcctgtgcaggcatgggaaatatatatctttgatattagaatgatagtagctcttgttgtaaaacaatgttaccagtaatggtcactttttttggaacaaacaaacagtgcatacaagtgtggagtcaaacatggaatataaatagagcagatgtagcttgaaactgcaaatccaagactcagcaggactattggcatattgtattttgtcgaattagtggcttattcattacagctaaagtgattccacattttgttatatcattgatggcttccattgaaacaaataaacattacgccaatcataaaggtgtggagtcaaagatggcatataaacagagcacaaaaacataactagtaaaaaccacaaatcttatgcaacacaagacttaacaagactatttgcatattacttttgtcagattaccagtggcatcatcaaatattttattgtacaaagaaagtgtctaatctgtctaaaattcgaaatgtgcaggcaaacatgaaactatcatataggtatttaattaatttccctgttggacacttctgttgttaatactttgtacctctggaagggaaggaatatctagtttcgttgttttgtcacatggggaagaatcatctcgttggagaggaaactcctttctcttggttgcaacctttctttcagcttgtgaagtgctcgacccgcctgcaattcagttatgtcataatcagcgatccaaatactggtggtgaccaacaggtaaccaatctgaactcggtgactggtaccggaacaaaccagccaatttgaatataaattttaaaatctaaa

SEQ ID NO: 59409 - DNA, 16866 bp, Oryza sativa
  unsure (1)..(16866): unsure at all n locations
ccatcatattgttatagtctcatgcatcatattccgtatattatgcctcatgtccctcatcagtctattcaacataagctggtgatactattttgttaaaaaaaaagaaaagaaaggtgccatcccgaaaattttggccaaatttctgaatatcacttttgtgaagatataaagaacgaaaacctaagaggtcacaaaaatagttgggatttcggccaataaacaattaatctaagtttgtgatcttgaatgttgtagcactttgccctaattgtccgctaaatcaaataactggaagtgtaggtcgaagggatcagaaaccacacagagagagaggcagaggcatacctacccgcggccgccaccgccgccgctgtggcgtggataggtctatcatccccactccccaggcgaggagtatctcctcctccggatgaatctttgcgagagaagatgacgagaaggaaggctctgatctgatgaatccattccggatcccatccccacccagtcccaggattgaccacggtcactgcaggtgggccatggagtctgggcccactagtacacgcgtggcctcttctactaggaatttttttcgtttttagattttttttttaatatttacagaaataatctatcggcgagaaaatttgcaaaaatagaccctgccgctccaatggtgggcggcaagctgacgtggcaaacgggggaggaacgggcggtgacggagggtgggtattttgcatgaaaacccttgccgccctctggtggggcggcaaggggtccgaatgcaaaaagagccgcagggggccggccattttgcaggcggccccttgccgcccactagccgggcggcaggcctcgctgcctataaaaggcctgccgcccagcccccagccctcatttctcacctctcaactccagtgaaaaaaaagaagagaggggaggagaagagaagaaggggcgaagccctgccggattcagacgccgatttcaggtaatattcgtatatcctatatgtgactattgagttaaatagtgtgtatttttaaaaaatttgtttgaataaatgcattatatttttatggttttagttgtactaatttagaagtgtgtattgtagatatcggaacaacgtagatctgctagtttggaatcaatactttaccgttgcattggcttacacaagaagatattacgttgtagatgtttattgcatgaaagagtaatatgatctagttaattcgttgacagatatgtcgaacaaaccaatattccaagtttaccatagaccaggaaacgtccgttacgggccaactggggtagatctgtcagattttattgtatcagaaaggggaattgagagaccggctgagaggagtgtaccttctataaaaggatggttaatgaggggcttgaaagttgatccacagacaagtgacataacaatcaatgttatagtaagtcgggcaactgagggtttttattgggaactaatgccagttcaaaactctcaagtgtggagatggtatgtggaaaatgcaatgcaacgtgggtggcctctagctttggttccgtttgtgcacccgaaggatccaggtgtgcagatgaacatggatgatggcgagggaccaagcgctgaagtaaatgagacttctgtggaggaggtcaacgcaggagtggacaggggcgtagtagctccagtgggcattcaaccaggtggagtggccgacgagggggagactgtcgcagccattgtggatgaaatggagagggaggattctgacaacaagcgtgtagaggaaggtgattcgtcagatgaggagacggatattaatccagcagaatgggctagtcaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtccaaccggtcgcaatatgaagttcggtgtgttaaggaaaaagatggttgtccctggagagtgcacgcgtataaggggaaatggaaggattattggacagtgtcagtcgttaccaagcatacatgttttctacctggtgttcagaaataccacaggaacattacatgtgcatttgtcgcatctgagatgtatgcgcatgtcatcgataatctcacatacgaaccaaggtcaataatccgacacatcgaggagacatacaagtatactattagctatgccaaggcctggagggccaaacagaaaataatagagatgagatttggaacatacgaagcctcgtatgacaatttgccacgcctgcttggtgttatcgaggaaagaaaccctgggagctcttacgaagtgaagaaattcccatcaattgaacatcctggcaagagtgtgctgtaaagggcgttcttagctctacatgcatgcaagatggcattcgtgaactgtcgtccagttctctgcattgatgggacattcttgacaggaaagtatcggggccagatactgacagcaataggggtagatgggaacaatcaggtattgcccttggcatttgcttttgttgagagtgagaataccgacagctggtactggttcctgaaattggttaaaacaaaagttgttggtatgaggccaaatgtgtgcctgatacatgataggcacactggcattctgcgagcgatagaagagttgcagtttgggagcatggaacgaggataccctggtgtttgggacgatgtacagagtaggtggtgcatgcgtcatatgggagctaatttcttcaagcaattcaagaacaaggagctcatgaacatgttcaagaggctgtgtaatcagaaccaggagaaaaaattcaatgagctttggaagagattagatgagttgacagccaaatgcagtgatcagcgtgcagcggctccatcgactgccgttgatgaccctcctcaagctcttggacctctcccaacggatagtccaactttggttagaagaactggattggagattcagaaattttctcagtggattctgcatgaaccaaaagagaaatgggctaaggtgtatgacaccggtggtgctagatatagaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaacaacaacattttgtttggaactttcatgcagaaaaagctagaggagttgcgtaaaaaggccatgaaacatcgagctctagtgcaaggtacccaacaacataggttcgagatactatgtcaagataaggcaggcaggggtatctaccgcaagagagtgaagcaggagtgtgttctcaaagccgacggcacatgtcattgctcttgttcaaagccgaagctgctccacaggccatgcacccatgtcattgctgccgcagcggagtgtggcataccagatgcagtatatgtgtcgcagtacttcagtaagcaagcaatatatcatacatggagcggcgagatttacgggttcggcatagctggggagttcacagagactaacgatgaagtactcaatattcctgacccatcgaagctccgaggcaaggctggaaggaggaggactcgtcgcatccgcaacaatatggacgagtcggaggctggcagggtaaagcgttgcagcaaatgcgatgaacgtgggcacacctataagcattgtcctaaagacaaggagaaaccaagtgcggcggaggcaggactatcaggatcagcagtagatggagctcgccctacgggtgaaggcactacctccactcgaccacgtcctaggcgtcgtcgtgccacgtctggctacgtggtgtagttcttatgttctatgttggcatgtgggtttgcttgtaatttgtttcgaacttatcgatgtgtttatgtttcgtcgtgtaatttcagacttcggcttgtcatgtctttaggtctcgtgatgtaacgtcagactaaggcacgtagtgtctttaggtatgctgatgtatgtcggacttcgacacgtaatgttatgttatgttatattatcgaactctacatatatgttaaattgcacgtcatcgttatgtaccattagtaatgtttgctttatttaaataggctgtactcttattgtacgtaattattctcatgatttttttactatttcattaatttgcgagtcatcttttgttttacattactactttttgaattgttctaacacgaaacactatatttttcagagatggcacgtcaggatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggcgacgcggacccggccagacgatggactgtggacaggtccctcctagcagctttggtcgatcgatggaggccagagacgcacacttttcacttgccgtgcggtgaggtagcccctaccctacaggacgtatcgtacttgttggggctaccgctcgcaggagacgctgttgggccagtgaccacggctgtggactggcaggacgatctgacggcacgtttcgcactagtacagcgcgcaccgcacctcccgctcgagccgttggcacaccaccgcaacaccggacctacgaagaggtggctgcttcagttcaccgtgagtgtttttgtaccgaaatgacaatcgtattatatatttagtccgcagttaaggtgcctaacattttatcgacggcttgcaggttgagcagctacaggcggaggccgacgagtactcctacagccgatgtttggaggcgtacttgctctggctttttggctgggtgatgttctgtggcagtcacgggcacgcggtcgacaagggactcgtgcactacgccaggagcatcgccgacgccgcggtaggcgaggtgcctcagtggagctggggttccgcgttgttggcggctctgtaccgtgcactttgtgagtcttgcacgaagacggatcccagcgcgacctttggtgggtgccctctctttctttctatctgggcagctgagaggattgcgatcggccgccctgaggtggaccagcacgcgtacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtctcgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttccgcgtaatgcggcagttcggcttccgtcagccctttccagtatcgtttccaaccaccgtcccagctgctgttcaccggtaagatcttgcactacgctttccgttgttgcattaaaatctgcctgttcacaataatttgtaacatctgtcgtttcacactaatattacacattaatttgcaggtactcgcgcaagggtcagcatttagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctctacgccaggcaccgcgactaggacttcgctcgtgctgtgagtaccctgcatcgcaccattcctttatgttttcatgtctttctcttcgtcaaattttacgaatatttacgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccatccagctgcgcacgttcctaggccgactccccctccgcacggaggtaagtatttttattactatttctgtacatgcctcgcacatataagtgagccgtttcacttgccgattgcttcagggtttcgtgcaccgttcagcaccccgccttcctcggctaggccttctgttgtgccccccacaggtacttaaaaaaacaacattacttcgacaatcaatttacatacattttatttcttagcttacaagggtcccgttgtcgatgtgtaggtttcgcccagttcgctatgacgcaggccgcccacttctcccaggctgcagggtcagcgtctcaggcagctgcgtctcaggcagctgtgtcgacctcgcactcagcgcagttctggcagtacaccgggacttcgtcacaggtagccggcacgtcgagtcagggtccaccactggaccatgctgggacctcgtcggaccgcttgctgccttccaccttcctcttcgacatcactgacttcgacttcgcttcaggctcgacaaaggacgtcatcggcccctcacagctgggaggcgcaccgccggtgcagacgcaggaccaggcgcaggccactcctccgcgggacactcgtgctacccgtgctgtgccaccggatcgtttcaccttctcccaggaccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcactgatgcagcctcctttattcgcgtgtgatacgagtatttgcccgccatttggcgcatacgaccaatgtaactttcggcgccgatcatgcatgtatctttcggcgccaatcaagtgtaaccaccataccccaccacgttcacatgtcaggggcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggcctatataaattatccgagtactaatacgtcgaataaggtacaaaataatacctcacttaacatatgaaattgcgcaacaaccaacttcaatacatttttataacaatattaacaagttttaccaataaatacttctttatttattattaacataacatagaaaaatcttttggccgtacttttttcatctaggtcccttgccaccctctattggggcggcaagggacccagatgaaaaagtacggccgcaagctctttatgggcggccaaaattgcaattagccccttgccgccctctgtatgggcggcaagggcctaatcgcaattttggccgacggcggcagacggcgcggtcgacccaccgtctgccacgtcagcttgccgcccaccatttgggtggcaggggctatttctgcaatttttttggtcgatagattatttatgtaaatattaaaaaaaaatctaaaaacgaaaaaaattccttctactagtactaacaggtgggccgtgggccttgagcactggagtactatactgctccggtctgcgggccccacctccatccgtccgtccggccggtgacaatgcctcccaaaccggcagtgtttgtgctaatgggatagggaaaatgatttcccacccaccagaagacatctatagattctgaccattcatttctacttttccatttaatcttaaccattcatttatttgccaatcccaataccaccacccattgcccattatctatacacaccctacaatctacatgcacagtcacggcgcggccttcctcatcgatgttgccgtgactcctcgctctagcagcggccaaggttacaggtgttgtagccatcggataccctgttatggcgagttgccgtttgcgtgatagcaatatcnttctttttnnttcttcttcttcttnttcttcttcccanatttatcatcaatttagcagtactgacaaagctcgttttttgctttatattgaactagcagcatatatgaagtatagtgaaccaaaggctttgccttggaataatcctgatggtctatgctattatagcactctgtaaatttgtttgctaccctgctagttgcttctgtacagttgttcagactttttagtgaactctacctgaaaatcaatgtcagtactagtaataaattggtggaggggattattctcgaatttttatttttcacatgcttttagctatctgtcgaccttattcattatcccatttgttgtgaggtgatacttggccattttataattgatttcattctgttcatgcattcacttggtatttggtatgaatgatctaacttcttatcttgaattggttatgatcttccctccataagtttgaatagaattgggaaatcattgggtaacaatagtctttcaaaagtttctataggaagtattgttagcaatacctcaatcaccattaactgttgaaatggtgataccaatatttcaatcagcattaattctggtgttgtgatctcctgtgaatggtctccaactatgtaattcgttttgacctgactttatgcaaaatacaatgatgtttcagttacatcagggtttcatagtatgacatgttttctgaaatctgaactgaaaatagagctttgtagatctgaaaatagggtttacatcagggtttcatagtatgacatagtattgtaaatcatatccatctgttggatttggtgttaggttttagaaatcatagcagagtttggaaatcatagcagtgtttccttttaaaaaggttttagaattgaatctacttgtaatttatattatcatgtactacatgatactaaaatttattttagactgcccttctattctgtttgcacgggctgccctgcttcaagtgccattagttactgacaatgaacttatagatttatttctgaagttttcaaatataatggttggatcctcatggttaattttgcttcccttagtacatgtctgaaattgtcattttaattaatattttcatcaacgaaagtatcatcttagttatttttcatcaatgaaaggatcattttagttattcacaagtgttttactattcacacccccccccccccaaaatcccaacataagttttgggatggaaggtgtagctgtttagcataaaacaccttcgtaattaaatatttaaatccaacgacttggatatctgttcttttttcttcagtcagactatttgttctgttgcttatgtttaggtattgaatttattgcatgtcaaccttgcatgttattttggagctggcagtgtttcagtgtgggctgcgctagcggtaacaaattgaggcaaactctggatagttctaccaaaaataacagggatcaaggtcgatggggagataagctttatcttcgagagcgaaaaagcctagatcaggcccttaatgactgttcagtggtaagagaggtggggatgcaaagacagccagtaggtttgctagcattgattctttttattatttgtctgcgatcagcagaaagattcctggtgcttgactgcttgttgtggccagagggcttcttttttgttattgtgcagccacctattaaactttcatcggtatagcggtcagaatttcacaacagcagttctatgggtcagagtatcacaacagcagatatatctgttggctacacttcaatgtatggttttatagcatccaacccacatgaccattatggctgctcattgcaacggtggtgcttatgttaacaccagttacataagttatccctgtgaagtatgttgtcgagttgctggcttcttatgcattgggggttggagtttacacttggcatctccatatctgtttcagtacttcatccaggcagttgttccatatcctcatcttgttgcaacaatcgtctctgctgctgtctttctcttttagtattcacacatctgccatctgggtccagcacaatggttttccatgtgtgttctcttcttgatagcatcgtttccagtcacatcttcttaaaggacatctaagagcaaagagttttgcgggtgatcatgaagcaaagaagttcaccaatatgttggctatagaagaggtcaaaatgtcagtgtttggtctctatgctgctgtaagtttcaactatggagtgtggactaggtgttatgcatggtgcacctggtcacagcttggcttttccaccaaaaacaagaggtcatgagcagaggtagcttgaatgcctgcgattcgtaacttttctattgtattatgtatcgtctgccttattctcagtataactcttgctagtggctcagaccatgctgtttttttccctggtacctttccttctgcttctgaaccaggattgcggacttctttgcagggtttgatgctgtcagcattcctgttaacagcattgtatataggatatggagacctaagactagcaatggagggtgggcacttgatattgggggtcctaggctggctggctctttgctatgacaaacattgcccttctcatgctgccgttacctaatgctaatgtacatttcgattgcttcatttgagattttatatatgtcaggcagacagatgcgaattgtgaagttacttctgatgctggctttcaacaatgccgccagttataatgccacaaacatactatgcaggtaataggatttttaattaggtgctctttattctctagcatcactatatcgtggtgggtaggagtttctgggataaaatacatttaaactaggagatgcaagttcagaggtatgtatattttgtcacaattgttgtgaatagaatctctagcttcctgaacaactgaaccaaaaaaattcggtgctttcttgcaggctttcagtcatacaacagtgattgctttcttaggttctggcagcatgaagtcatcttttaccgtgagttgggagcagaattgtgcaacaatcgccaattgtcatcacttttgtactagatgatctttctactggactagtggtaatctaaggtgttgacgtgttgtgtagcatattatatccctaaaatggtaccgaactcaactcatacagcacatcaccttggacttgtgaccagacaacatcgtgtcgatatgttctttattataagcctcaccaggaactgaccatgcgaatctgcattggtttgttgtcaaagtgactagtaattccgaaatgcagtgtaatgttctccaggtccaggagaccactttttgcttcagaaactaacccagattgggaggacatgtcgtcggtagtaaaattcgactcccaactaatagacccactaaaattcaacgaactggaacaacaatcggtagctgcacagattcgactcccaactaaaattgaacgaactggaacagcaatcggtagtgaacagaaatcgggatcagagcttacttcaagtctgacaagaccaccttgtcgtggagagtggcctcgacatcatggatgagcgcctccaggtaccaacgtacagcagtggcgcggaggtgggcgttgcgcgcgtcccaggacacgcgattcgccaaggagaccagatcgcggaactcctcggcggtgacggcgcgccccgcggctgggagaggttcgccgaagcgcgcctcgagcagctccagcccgcgcgcgtggctgacgaggtcggaggggagcacggcggcggcggcagtgacgcggtcgaggatccgcttgaactggagcttccgcttgttgaggtccttggacatgtccgacgccttgccgagcttgtccatgccgacgatcacccagcccatcctgcccctcgcgtacccaagggaagacatccgaggcgtcgacgaggcggtcgagctcctggacgacgacgcgggccaagggcggcgggtggtggccgaagacgtcctccagcgccaggacgtccaccatggaggtgacgaggaagtcgttgggaccaggtgccgccatggccgctctccttgctcgctgctcgggctcggatagaaggcgaggggaaggggagggctcgggctgagagggaggcaattggggcgatttgaattttcggtttcgactcgccgcctctaccttttataaagtacagtagtacacgatcgaggtggagaaaactgtggcggattcgattatctttttttagtggaatggcttaggtggtgtttgcataaaaggacttaacgcatttagatattaatttagagtctacttacaaaactaattacataaatgaaaaactgcttttgtaattacataaataaaagctaatttgcgagacaaatttttttaagcctattaatccataattagagaatgtttactgtcgcatcacatagactaatcatagattaattaggctcaatagattcgtgagagagaatgtttactgtcgcatcacatagactaatcatagattaattaggctcaatagattcgtctcgtgaattagtccaagattatggatgggttttattaatagtctacgtttaatatttataattagtgtccaaacatccgatgtgatagagacttaaaagttttaattacatctaaacagagtcttatactactcattaaggctatgtttaaggtttccttcaaatttccaaaaattccgtcacatcaaatgtttgggcacatgcatgaagcattaaatattttcgggaaaaaaaaccaattgcacagtttacatgtaaattgcgagataaatctttgagcctaattacgctatgatttgacaatgtggtgctacactaaacatttgttaatgacggattaattaggcttaatagatttgtctcgcagtttataggtggaatctataatttattttgttattagtctatgtttaatacttcaatgtgtattagtatacttaaaaatttttacacctcaacaactaaacacggcctaaattagggcatgttttgatcccctggcaacattttttaccctgtcatatcgaatgtttggacacatgcatagattattaaatataaaagaaaaaataactaattacacagattgcgtgtaaattgcgagatgaatcttttaagcctaattgctccatgatttgacaatgtagtgctagagtaaacatttggtaatgatggattaaatttttttaatgccgtaatgatggattaattattttttttagggaatgacggattaattaggcttaataaatttgtctcacaatttacaggcggaatatgtaatttgttttattattcatctacgtttaatactttaaatgtgtatccgtatatccgatgtgacatgccaaaacttttcacccctatatttaaacaacccaacccagatcatcaatttactgtttaaaaaaaacaggagtacaatatattccaagcagcaaaaccaactcatgcgtgaagacatcacaatatatatcacccaatttgagatgttagagtatatgatagttagagtcatattaggataggattgatttgggtggcctccttctatatttgtaatccttccttttctccttctcatgtactcctatatataccggcccttgaacctcaatacaatcgtaccacgttacgcagtatacctctccttctatactatccaacatgatatcagagcgggcaacctatagctgccgctcacgcttctgctgccatcgcccccggttctggtctcccgggggtggccaccgttttttttttcttctctcgtcgagtcgtcatcctgagagatcgatctctcaggcatttgcgtagtcatcaagcagcaatagtagcgtctccggtcgtcgtcgttctgcccgtcaccccttccgcgttcggcctcgggactgtacccgtcacagatctgtgccgcgcatgtcgtccgccagcgtccaccaaatccaagccgtcgtcgacgtgcggaacttgctccggcgtgacttgttgacggtcgttatccataagtttcgatcgtcaatattaccaaaatagaggagaactagtgatacttgcaatgcatatgtttgttagaataataatattccactagtattaggtatactaaccttttgcagagaatgacaataaagtggaggagaatcgacatcagctcaaacgataaattaatcggacgatgtcgagaaccagacttaagtatgaatgggccaagaactcagaattgacgtgacaaactgggtcagaattcacaagtctgcagagaagaacaacagagtaggtcaccagccgaaattgggctggattgggccggccccaggttcggctgaaccagggggttcggccgaaccctcctcagcgccatccgatccagggcttcgcctgaacggtgtggattagcccccaatggcggttggagggaatttccgaccattccaaccgtcacaaccgtcattgggaggctataaaaggagtttctcattctcacttcactcacacacctcaagcaatagctctctcatttctttcaagcttagtttagtagtatctatctggtggaataggaatagagtagaaatcaggagtccgaaagccttcgggagagttcgggtatggctctagtagcttttctcttctcttttgtaagctttgtatttttattagaatactcttctaaatacatttatggtattgaaatactttccgagtatatgaatgtctactttacattatgttcatgttatacttaatatatggctagcttatctaggaaatactttggtgcgggtataatgtttgcttatgcaattactctatgtcatgacaatgatattagagtagtatctggtagtttaggcgtggtgtctagattacgggatatcattatttagggttatatattacggatgagaggtgggccgctgatgctgacaactcagtacgggtattccttcgccccggtatataatcctaagttaattctctggggaggatattcctccatatttagccccggttgtatggtcatgacggactgtcgtaaggaactcggcagtcaggggtggcttctcgaagtaccaggagggcatcggatagagggtattagctagtatgtcagttaactagaatgtatgtatactatgtatattacaagtataggaatatatttttttcctcttttctttccacttagcttagatgatttattatgagaatgagtagttaaagcttgtgtctcactctactcttgaattatcttaacccctgcttagaatatgattatcacaagtaatatataaactattagttgagttctctctacatgatcttcccgcaggataaaaaaaatacgatacccttggaatactctcgggtgaaatgctacaatggtatatccgtgcgcttgcggatgaactctgtaactataatatactagaagtatttctgcgccattgctgggaattatatttctagtaatgtcgttaagaaataccaacagcgacgccgccggcaccatccgccagcatggcgctgggggacgaggtccctcctccgtcttccgccgcccccgacaccgacctgcacccgccgccatccaggccgacggggccccgcttcctgccatctgccagggagccggcctcggcgccccccaccggccggtcaccgcccgtcgacttcgcccgccgccggccaccgcctcccgccggccgaatgacgtcacaccgtcctcctgccctctgcatatacgccattggtcaccacgtcagcccttgtcgtctcttggagctcatgcgctctctctagtggtaaattattaagcgcgaacctaagaggggcatttggataattgccgaacctaaaagtggcaaatagttaaattccccccttgtcaagagcagagaagggataaagcgttttgaccaggaggacgtggacttggtctatggaccattggcattggactttgctggactgctactgattgctgctcgtgctgttattttccttttacgatcagagatcggtttgcgtcgcccatgccatcgtttcactgagatcaaggatgttgttgttttgctgtcccaggctacaacgacattgtccaacatcgtc

SEQ ID NO: 59410 - DNA, 3395 bp, Oryza sativa
  unsure (1)..(3395): unsure at all n locations
attggactttgctggactgctactgattgctgctcgtgctgttattttccttttacgatcagagatcggtttgcgtcgcccatgccatcgtttcactgagatcaaggatgttgttgttttgctgtcccaggctacaacgacattgtccaacatcgtcgtcnnnnnnnnnnnnnnnnnnnnnnnncgccgtggtcaccatagtgttttttttaatttctttttctttatatttttttcttttggtcgtcgtgtttgttggctcactacaaaaaaaatatgaccttttatgatgaattcctcgtgacgtcagagctattcatcattagcatattccattttatgacgattagtatgagatgtagtggcttagtgacgaaaaaaaagtgtttgtcgttaataccaactggaaatcgtcataaagtatttcaatgggacattgtgatgaatattaatttttcataaggggcaaaaagcaaacgtcatagatttatataatgcatttctagaaaaatatattaaaagttgaagcaatttaatcaagtgaattaataaggaaacaaaaattttcctttaaaaatcatggccggaaatatttttttaatatactaagtagtctaaattattctctgtaattttccgtgaattttcgaagctcaataactaattttaataccacaaagtttatttaacctattaaaataaataaaaaacaaattaaaatcactctctctgtccttgggcctttttcggccaagtgttactctctccctctctcagtccacaacctctctctccctccttggtggcttcctcttcccctcctccctcctcgggccgctggcctagtccttttgctcctccctcaccgagaagtctatttttcctcccttctctcaattccaatattttttcgggtagtaaatgatttcaaatgaaaaaattttcaataacaaagttttataacttatcaagatttacaacttttgttttggtcattttgctatatgactttgtttcaataatttgaatttgaatttcaaattatgacaacttcaaacaacattttcaaatactaaatgatttcaaatgaaaaaagacatcaacaacaaagttttgtaactcatcaatatctacaacttttttttggtcattttgatatatgacttgtttcaataatttgaatttaaatttcaaattatggcaacttcaaacaacattttcaaatactaaatgatttcaactgaaaaaaatcataaccaacaaagttgaataactcatcaatatctataacttttattttggtcatttcttcatccgacaaagtgatactaacattgttcacaaaacttacatatctctcttatagtttataaactactagaaaaaatgcctgtgcgttgcaacaggtgaagtctattttaatcttattattgttatatgatttagttaagatgaaattcaccgtgggatttcgcttggatatatatatttttagaaaattatgagctacagttaggaatctgatcgtctcaagttagcatgtgagttttttttaaatatatatttcttatatgattccttctttattaccaaaagtgaacgatcttaaaaaccgactcaaatacgaatatgtatttttaaaagtaaacgaacttaaaaaccgactcatacacggatgtcgtaccaaaatactagcaaaaaacattttcaatttttataatagtagagagaagatatagattaaaaccaaaacataaaattaaaaccgactcgaatatggatgacgaaccatggaaacattttcaatttttataaccgactcaaacacggatgacggaccgcgaataacatcttcaattttataatagtaatagatataagagatatgtatattttgcgaacaatttacaaatcacttatttacaaatcactttggcggatcaagaaatgaccccaaataaaaagttataattcttaatgagttatagcgctttgttattgatgacttcttcagttgaaatcatctggtactcgtaaatgttgtttgaagttgttataattttaaattcaaattcaaactgttcaaacaaagtcatatagaaaaatgaccaaaacaaaagatgtagatattgataagttatacaaatttgttgttgacaactttcccatatgaaatcatttactaccccaaaaaattatttaaatttcttatattctaaaattcaaattttatatagttcaatcaaactcggatggagaaataaccacaagaaaattggtagatctcagtaagttctacaactttggttttgacaactttttcacttaagttcatttagtatgataaaatttgattctaagttttaatactttgaaattaattttttccctccttacttcaaattttttcatcttctctcttgcctcctctcctgatattttttcatttcctctcctcgagaaaattgcatatgtaccactcataaaaactggcttcgctataatgccaccctcaagataggattcgcccaaacaccactcttaacacgtgggtattcgctggaatgccactttcgggcttttttccatttcggaaatacttttcatcaatttcattttttcttggactattatgcccctgagtcaactgattcggtcggactctttcttctcttcgtttcaatctagcgagcgagcgcgagaagtcgagaagagaagtggcaacgacatcggcgctgaccaccaaactgcatcgccgacgctgcctctctattacagccgccgcggtgcgcctcaccggtcccgccccccaacagttgtgccgccgcctctccccggcgagtctcctccccagccgcgccgcctatcctcagcgaagccctaggccgagccggccgcatcgacgcgtacggccgtgccgtgtctgccggcgaggtgctggcggcgcaccccaaccacgtgctgagccggcagtgctcgtcgcagcagggggcggtgggccggatacacatcgtgtcgccggagtcgaagctggagccggcgagatctacttcctcatcccggccgcctccgtccccgatgccaagaggaggacgagcaccggcggcgccaccggccgagggcaccacgtccgcagcaagtcggagggcagtgccgccgtcgccgattggttgggcagcctgggcaacgcgtcgccggagacgacaagggtgatgagggcgcataagcagcaccaccaccaacaccggcggcgcatgagcaccgggagcctgcctcgccgtggcagcgcacatcttgtgcatcactgatgacccctgagcttagcttttgttttttttcttctcttctctgaatttatagtggttttcttgtctcctgtgtaatttcctctggtg

SEQ ID NO: 59411 - DNA, 1982 bp, Oryza sativa
gtgtatattttcaagcacaaagcgacttctattctagtagtatcttcttgtatcttcgaaaaacattttgcaacttctttttaaagttcgtttgggttaaccaaagcgaacgaacttgctcatacaaaattaaacaagtcggcagctctgcttgatgcgaaattaaatgaaaattaaacctcttgcaagttatatatatgaactcatgaagtgaggttgtgtgtcatggactcatggtgtatgtcaccgaggaggcggcacaactgcgcgcggaccaggaggaggcgaggagcggcacagctggagaggacatcggcgcggcggctggagcagaggtagcggtggcgcagtggtggtgggcggcgccggtgtcactgccgcttctcttctcgccttctcacgctcgctagattgaaccgaggagaagaatgagtctcaggggcataatagtccgagaaaaattgaaattgatgaaaaatattttcgaaatggaagaaagcctgaaagtggcattccagcgaatgcccacatgttatgagtggcgtttgggtgaatctcatcttgagagtggcattatagcgaagccagttcttatgagtgtagggatgaaaacggagcggatagtttccgtccgctccggataaaaacgaatacggatacatctcggatcggataattctcggatagttcggatacggatacgaatacagatattttctcttgggtacgaatacgaatatggtatcagggtttccgtcggatacggataataattcggatatccggtgaacagtgctattcagatatccgcagaagccacaagacataccccatttctctataactctagtagtttatctcttaacactagtccacattattaatattatttaaaattttaaaattatttataaattatactacattttatataaaatgagctaattatatatgttgatatttgtttctattagaagttgaattggttttcgtgttccgagaaaaatttgtttccgtattcgtgtccgatcatattcgattcttattcgtattcgagatagtccgtatttgttttcgtattcgagctatccgtattcgtttccatatccggtaaaaaatatgaaaataaatatgatatgagcattatcggtcccgctccgttttcatccctatatgagtgtggtacatatgcaattttctccctctcctctcctctcctgtcagcctctcactctttctcctctcccctctctctctctcaccgacggcgaggacgggagctgcgcggcgcggcagcggcgggctcggcaccggcggcggcggcggcctcccttccccgacggcggcgggcggcgggcacggcgacggccggcggcggcagatctgcacggcgacgggctgggctcggtgcagtcgaccgcgagcgatgggcgctgcccccagccaccccgcgggcgcacaaggtgccgtctcctggcggcacgcgcgagggagacaaacaacgcctgcgcgagggagtcaatgcgagggggttcaggcgaggctggcggcgaggctcgcaccgcggcggctcctctcctccggtggcaaggtgctcggcgaggaggagaaggctgccgagaacatctacatcaaggtatgtccaccctgttcgcttcccaaatcttccttccctcgtgattcttgctgttcttgctgcggtagatgggctccagatgcaactagagatgtattggtgtgctgtgtagaggtttatggtgccaagtggtgtgtatgtgtgtgcgtgtgttgcggtgggggtcgattcctcttcgcttcttgctccgtcgcttcagggattttggctgatgggacacgtgaaccgtacggtttttttggtagtattgtgggtgcgcatcatttgttgagcggtatggttcggggaaatggatgtgctcctaattgaaatgaggctgtttttcctatgcgaattgctgagtttg

SEQ ID NO: 59412 - DNA, 3360 bp, Oryza sativa
aagttgcatagagcatttaacaaacaagattgatgaattagatttcataaatacatatgagttttacgtttgggtctgcaatttctgcagagataaggtaattgatctgtcgtcagaagtagttaattcaccatgctatctgtacaggttgagactgaacattgtgcttgtagctaggtggagtactactcaaatgtttctaattaagaaacaccccctttaggatatgaaactcctgtttttatagagaaataaaaaaaatagctctaaaaacgccgcctcaacattagcttttcttgtagcgaaaacatctaaattcacagtgcaactgttgagttcaagatttcgtctacttccatctaaacatgtgaagcataatgccccattattcatgcatctgaactactacgtcagtggccaatgcaaatgccatcacctaaaaagaatcatgatcaggagtagggccagaagttgttgtcaagccatggcatgtttggtgaactagcacggccaagagatgctacaacaccggcaaatggtggcgtcatgggcatggggttcacttaagcataatgcatacactcatggacaatttagggaaggaattgaagaataatcagtccatcaatcaatcagcatccttttcttagatcatgcttggtaaatgtgaagttctcttgtttgtttgtttatggtaggtgttgttttgagtaagctgggtaggagtacttgtttttggtgactctcactcattgacctgagctggtggtgattagttaaaaaaaaatggaaatgggaggaagtactacatcagtacatgcatatacattgcaaaccaccacaaggaatcaggcatcagcatcagcatcagtcatcacttggatttgtctgcgtttgtgtgtgtgtgcatcttttgtgcatgcatatatgggtgctagtataactttatataggaggcatttacacacagccacagcagcagtgtactgctctgaagatctgcaatatatgttgcttggtgttgccgaaaaggagaaagtccttcacatctatcactgtctaactctccaccagaagcaatttgcattttttgcattcctcacctcacctcacagtaacatagttcttgacttgtattcaaattgaaggcttgtttgttaatctcatcagaattcagaaaccatccaattcatctttcagaagaaagtatatatatatatatatatatatatatatatatatatatatatcgttttgcctgatctctgagcatgcttagtttctttgttacaaaatgctgaaccgagctgaactgaaaatttcagaaatgtgtgatgtgcaggtggagataacatgcagagggagacagctcctcccgatcctgacattgcagcatgtccgtgacatcagtaactgcttggatattttttattcatctattatactgcttgaacagtagaagaaactaggatgatatggcagttactgatgttttatcttgtgcatatgcagtgctgctaagctcacttagaagatcttggtcacgcggcatccggtgaaattttggttgctgtgattgtatttggaatgtggctggatttggctgttaactgtgttgtaaattttgtgttgtattggatgtttgtcgggttgtgttgatgctaattgggctgtaacatttatgctatatgggtttttattgtgtttgattgttgggcctatatgggcctagcccacttgttatttgatactaatataaatgaatataatatggcgggctgaaaaatgatgtggtataatgtttgggtctatatgggcttttgtactggacttggcccatttattatttaagcaaatggatataatataattgggttaaaaatatgctatatcatagatgggtcaggctaaaatctagtcgggcttgccattgggctaagctcataaacaaggtactcaatacatgaattttaatgggccactagatattttatgacttttttagactagataatgacgaatatgagcatcataaagttactttatgacgacagaaggatcgtcactagattaatgatgaaaaaataaggtttcgtcatagaacgcctttagtgacgcatgataggtgacgggaattttcgtcacgcgagtgtcacagattacgaaacgtgacgaaaattttaatgtttgtgacgtaaatgaagcgctatctatcataagatctcttatagtggcttcttgcctgcacctgcgcactcttgcgcctggcgccacaatccatgccacgaaccgcaaccgcacactattgggtgacttgtgctatattgatattggcgataactggctactacgactacgacaactttatctcggctacatcgactacggcacaaaaggctatcatcgtgttgggtacttttgccggttttttctccagtccaagtgtccgcactgctcacgcttggactgcgggggatgttaaagtatatggtagttagagtcatattagaatatgattgatttgggtggactcattccatatatgtaatcctttcttatcctccccatgtacacctatatataccgccccctgagactcaatacaatagttttatgttacgcagtatacctctcctcctataatatccaacatgacaatccaaagcaaattaatattaggagacttgcaatacctttcgacgtgatcactgcaaaatcagtgtgttctaaagatcaaaattcatacagcaggtgatgatcgagcatattgacaaatgacgaatacaagaacgagagtgtatccacgcaaaaaccacgagccgcttctccgtcgatcgagatagtacgctatgtcaccacgagccgcttctccgtcgatcgagatagcacgctatgtctccagggacgctgcctccgtgtcgagctcagccgcgcgcctctccagcgcagaggcccagtcacgcgagcggatcgtgtcaagcaactcgctggcctggagaatcggctcggagaagcgcttgatcgagaggtaatcgaggcaggccgaatcgagagcgcggaaatcatcgtggtcgatgtggctgaggtgaagccataccttctccatctccttgccatgacggatcctggcacgagctacctcctgtgcggaggctatctcgtcgtcgtccagcgacaccaagtcccacaactcggaggggatccgcttgccatcgaccatgacctcgtcctgcttcccctcaacctcctccccctccccctgctcctgggccatcgcggcgtcctggacgatctccccctcctccaggtccatcccggcgtcctcgacgatcctatccgtcgcatcggaggaggccccct

SEQ ID NO: 59413 - DNA, 3541 bp, Oryza sativa
atttttactttatggtttggactatttatagcccagcttaaagcaagcaatcagatgatatttcttttttttggtatttacagaggctatgtgtattgaacatatttgacatcaattccaactggaatgcccgttgctcactacgaaaaacagttccaaacctattttgcttcaagcatgcatgtgacatacatgaacaatgggagcaatgatatacatagattttttttctatcttcttactttcactctccagtctccatggcaaacaaatacacaccaaattcgccataactaaagccttttgagacaccatgacagactaactaacggatgaaacaaaattgcgtaatcctaaccaacctaatcacaatcaagaacttgagccggtcgttgagcttcttccggcgacgggcgctccgccatgttcttggccgggatcccctccgctggcgttgcgacggatggagctcgcgctcattgggggaaacgagagctcgcgctcattgggggagacgatcgtcagaggcccagcatcacggccttgccgcgtccacatttgcagagaacgtgtagtggtcacgggcacagaagaagcggcggcgctccgggcacgcccactgcgtcgaacaagttgaagccggtgaggccaccgaactccggcattttagccggatgccgacgcggtgccaatcgaagccgacgaacaccgccgcgttccccagcgccaagaaacgccacccggagacgtcgaatgatccggctgttccggccgctcgccgtgttgaatgatcccggacgcggaggcggagcccccatgaatagatggaaccagcgccagccatcgacccccgtgcgagccggcgacggcgccgacccccgccgcattgtagtaccagtcttcatcagccagcccggcgcgcggaaccccatgtcatgcctccggcagcggccacggccaggaggtgtgctggtcgcgcgcggtggctccctgcatcctgcgccgacgacgccgtcaccacatcaacccctgcggtggctgcgccgcgctgctcgactgctcgcgcccatatttccacttgtgacttgtgccactgctgctgcgagacagccagatagagtatgtgtggaattactgctaaaagcccaatttggaacaaaagaaaaggcatatactataagttttaaaggattcctatcttgtgagaagtaattatatgcagcattttgaaacaaaaagggttaatccctatcaatgccgttaaaaatttggctgtgtacatctgattggatgttgagactgggtttatcccattttctaaaaaaaataccgttaaaaatattatgaaatgggctggaattttggaggaaaacaagcatggtatatctcaccttatgttttttttgcacgtttgtgacttgagtttttgaattatatcacgataaaaagaaccaacatttcttcttcagctttcaatgtcgttgccatggtctcactctcacgaacttatcctattgttaagcaccacgggaattttccttgttttgacatcgagttggcccaccctgattgctccatcgaatcccctacttctatttcgacatatcaacgccgttggctcatttcaccattcactgatttatccccatctttattgtaaatgatctgaacataggttgcactttccaatatgttaattcactaggccatggttaacgtccgtagcgcctatggttcattccttatagtccattgctcctcttggatttagggcctacttaagttaagggaacttctaataaccatggctactttaagaagctccacaccaacttctcaaatactttagattctcaccctacattttaagagtagttgtagagtcgatgaactagtagacattcttttccaccaagaagatactcgtgaagtacttttcacagtctctaactctacaaacaaagtatgacttgttcatgatttaaacttttagattaattacggacatggccacataattattccatcctaattgctccaccgattgccatagttaagtcgaatgatttagcccataaaagttttatctttacatttaaccttgtgaaagcctttctcggagtttattcttacacacgacatttgtgtaagaataatataggtccgatccgtcgttgattaaaagctaactccaagttaccttgtaaaacagaccaatctaaatttatgcacatattattcacatcttaactactcctttcgtccataaatataaaatagttttatctttttatccatccaaaaatataagatatttgattttttttatttgtagacaaatatatgaaatattaagatctcgaggacatcaccttagttatccattcaatctctcagcctaccttttttttttctttatttctgttaaatatgtcaaaaaaaaataacaaacataatctcatttatacctttttgttgctatcttaagttttatactagaaaattggtataatcccttaaataggtagcaatgtaaaatgagttagaaataaacaagattaccaaccaacgtttatctacttaaggccaagcccattgctctctgagaccgacaggtgggccccgatgaccattgaccactggcccatatgtcagtgagcgtgtgctgctggtttcccattttccacttcgtcgcttcgcgtcgccccactcgattccgctccagatctccccgtcgcgctccgctccgcctcctccgcgtcgccgtcgtcttcctcctctccggccgatgcctcctcccaaaccctagcccacctcgcaaaaccctagatcccgcgcacacccccaacgacgccatggatccctccggatccggccctcgccacggccgcctcctcatctccccgtcgctctcctccccgaccttctccaccagctccccctcccggtcccccgcaccgcaccacgaccgccgcaactccacctcctcgccgcagccgctcctccccttcccttccgcttcttcctccaggtccggtggcggcggtggagcagccgggggcccgcgcgccgcgggggcgttgtcctccgcgtcgcagccggcgttcgcgcacaacgcgcgggtggcggccgcgctggcccccgccgcggcgttcctgctcgacctcggcgggctcccggtgttcgccgtcctcgccgtcggcctcgccgccgcgtacctcctcgacgcgctccgacagcggcagggggccttcttcaccgtctgggccgcgctcatcgccgccgacgtggcgttcttcttctcggcctcgctctcgtcggccgcgtccgcctcggtgccgctcaccgtgctcgcgctcctcctctgcgccgagacgtccttcctcatcggcgtctgggcgtcgctccagttccgctggatccagctggagaacccgaccatcgtcgccgcgctcgagcggctcctcttcgcgtgcgtgcccatcgcggcgcctgcgatcttcacgtgggctgttgtgtccgcggtcgggggctgcaggaa

SEQ ID NO: 59414 - DNA, 3225 bp, Oryza sativa
tgcgtgcatgctttgtacctgttgttcgtgccagtgttgttccatgctgcatcgcaccatgctacgctcttcgcgtcatgggccaatgtgtgtgatctgctgctgctgttctttataccgttcttgttccaactctatgcctctacacgaggtgccttgtggtggattaccagagatgtgcgcacaatggatcagataaggatggcgaatggcttggttgcgctggttgtagtggtgctttgccttgaggttcgagttgtatttcactcgtttggaaggtatattcatgctccaccacctctgaactacctgcttgtaacggtcacgatgcttggcggtgctttgggtatggcagcacatgctgcgggcaaggttggagatgctgttagctcggtagcctttaccgggttggcagtgcttgtcagtggagcaggtgctatagtcatcggattccctgttatggtacgttgcagtcttatggtatcctcttgtagtacttgcaaatttatcatcgaattttgttttttcttatgcttgtagctgtatgttaatcttagtcactgaccaatgtgtttcaaggtgacacttggataatttacagttgactttattctattcatgtatttgcttggtcttttggtatggatgatctaagttctcagaagtcgttggttctggtgttctatctgttaaattgattagaatttgagaactcattgcataacaacaatcttttaaaagctactatgggaagttattgtagctgtatctcaatcattgttaactgtggaaacagtgttaccaatgtctcaattaacattaattgtggtgttgtgatctcatattgattctctagtacatggcaatagctggctgtgcatgctctccaactatatactcctttctgagttgatattgttctccctgaatttgtctactcaagctggtgtgattttagtttttatacagaaatgctgtacccaaatccatatattcctattgtgacactcctcaccactactgcctacaaaccttgggtaactttgctcctaagtataccatgattgtgaatttgtgatgattctcttgagtccttagctatttgttaagatttagtcagtatttctatttcagggtaattctagcaagctttgcatgttcatagttgcccatgcttgaaaaggaaacttgcatacacacacatgagcgtagtcttatttaacatcataaaaatgatgttcttgctagacttcaggtgcttaaatattcataatgaaacatgttctagagtgcatgggcatcatgagaattctgattgttgtagaatagctgtctcacttccctttgaccgactgtggtcttgaggcagtagtctgcccatagattttcttctattgtggttgtcctaccataccctcgaatatgcagcatcagcataaaaagttattacgtagcatttttatttttgatcactctatacttatttctgtgaattaatcttcttgcagttccttccacttccaatgatttctggctattatgcggcaaggttctttactaagaaaagcttatcatcatacttcacctttgtagcaatagcaagcatgatggtcctttggtttgtagtccataattattgggatctgaatatatggattgctggcatgccattgaagtcattcaccaagtatgttgttgcagccgtaatcatggcaatgactgttcctggtttggcgcttctcccaacgaaactgcggtttcttgtagaacttggtcttactggtcatgcattattgatatgctacatcgagaaccgattgttcaactatgctacgatgtactactttggatttgaagatgatgtcatgtatcctagctatatggttttgtttacaacctttctcggattggctctggtaaggagattatctgttgatcagagagttgggccaaaagctgcttggatcttgacttgtctttattcttcaaaattatcaatgttatttatcacatcaagatcggtgctatgggtttcagcggttttgctactcgctgtcactccccccttgcttctttacaggtataccacagcatcatgttctaattgagtgttttgacttctttatataacattcttccctgtaccttccagagacaagtccaaaggggcttcaaggatgaaagtctggcaagcttatttccatgcatctgtagtagccttttctgcatggctctgccgggaaacaatcttcgaagctttacagtggtggaatggaaggcctccttcagatggcctacttttgggttcctatattctgttgacaggtcttgcttgcataccaatagtcgctctccacttccctcatgctcaggtatttgacgcttacccctctgttgtaaaaatatcgatcttctcataatcatatttgttattatctgttcgtgatctgctctgtacttttgcactaaaattcttcaagtttgccttctcaacaaattccctagtgagggtttgcttcccagtggttatagatggaccactgacttaaaacactttgaggttgaggttctgtggaattttaaatgatgacatcaattgtcagctccagcttatttaccttcttgagggtatcatgttggttgacattgctttggggacactacttgctaaagaacattagatgcaaacattagatgatgatatgtccaatacatgctacacactggtaggattcaagctaaccttttttggttggacgttaccttgattttggtaaagttttattaagttccatatgttggatttcattttaggttatctttttaaagagtttttgaagtgatcctactcgtaagttttattatcatgcccataatgttaaaagttattttagattggtctaaggctttgcttgcacggaatgcactgtttgaagcacttttacttactgaatactgatcactagctaaatgcctatgcttctctatggataaaagaaaatatgccatagtattgcctaaaataaatgtattctttttttgcttcaggcatgttactcgcttgtttgctataggctgtgctcaccttgatcatatatatgtggcaacccatttatttataactattctgtaatagaaaaaagagtatcagggcgcaattataaaagctggagaggatagatgtatggatgaactttgaaaggagtatagatgaacttactccct

SEQ ID NO: 59415 - DNA, 4890 bp, Oryza sativa
tatagtattcactcatctgccatctgaatccagcacaagggttttgccatgggtgttctctttcttggtagttctatttccaatcacatatcttcttgaagggcatctaagagctaaaaattttgtggatgatgaggaagcagagaacttcaccaacatgttggctatagaaggggccagaatgtcacttttgggtctatatgctgccattttcatgattattgcattagaaattaagtttgaactggctttgctattgcgtgagaaagctgcagacaaaggtgtaacacatggtccacctggtcggagttctgcctttccaccaaaggcaaggctacttcagcagcgaagagctcatgctgcgccaactttcactatcaagagattggcagcagaagcagcttggatgcctgcaattggcaacttttcaactgtgctgtgcttcatcatctgccttattctcaacgttactcttaccggtggctcaaatcgtgctattttcttcctggcacctatccttctgctcttgaaccaggattcagatatcattgcaggatttggtgacaggcaacgttacttccctgtaacaatctccatttctgtttatttagtattgacagcattgtatcgtttatgggaggagacttggcctggcagtggcgggtgggcacttgatattgggggcccaggctggttctttgctgtgaaaaatgttgcccttctcatgatgacattacctaatcacatactcttcaatcgcttcatgtgggattatgtcaggcagacagatgcgaagctacttctgacgctgcccctcaacttgccgtcaattataatgacagacatacttactgtgcgggtactaggactgttaggtgctatttattctctatcacagtatgttatatcaaggcggataagacttgctgggatgaaatacatttaaactaggacatgcaacttcttttgaggtaaatcttgtatgccctgcgtcaatggttgtgaataagagtctccagcttctgatgctaatatttcggtgcttgcttgcaggctttcaaccatatacgacggcgattgctttcaaaggctcttgcttgaagtcacatttgtctggtgaactgtgaacaaaattgcgccttgaagtagagaaacaatggtcagtagtcaccagttttgcccttagatgatctttatactggtaacctaaggtgttgtagtataaatgttactgaactcagctcgtacagcacatcaccttgggtcctcagaacctgtgaccatacagcattttgtgtcagatactttcttatataagcctcaccagaactgacatatgctgagtctgcatagattcttttgttgtccaagtgactaattctgaatggcaatgttctccacggagctgtctggttctgtttgcttcctatattaataccttttcaatgtacattatatatgatagggtatatgctgaggtcttggagagttggagtgactgatcttctgtttgtcagtaatcagtcagttttttcccaaaaaaacttttgatttcatgagatagttttaggatctgctttctgacttgtgaggctgttctttggtactacatgaagatttgcttcgtattcggaagtgcacgagtttcttcaggtcgcagtgatagacacgggatattctaaactaccatgtttgatgtttcatcagaacattgtctatgcaattttccgcttcaatgcatttacttatctcgaaaattggacctgttgtcagtcatcacaattaaaagtttttcttttttgaaataagaagggtgtttctcctgtggtatttttgttccgttgaaaacgtaatatgaaaacccgcttccttggtcacaaagcgaccgacgaatgaccggacgcgctgcacatggcccagacgctgccacggttgccaccgagccgcaccgctcttggtgggtcccaccagccaagcccgaatttaacgaggaggcgatggggcccaccagtcagccacacgtctcccaccacctccgcgatcccctctcctctcacctcgcctcccatggcggccgcgctcctccgccgcgcgctccacctccacctccacctccgccgcgcgctcccctcccctccccgcgccggcgcgctcctcctccccgccgccgcttcctcccccgcccaccgcttcctctccggcttcaccaccaccacccagcagaacagcgcctccaccaccaccatcgacctctcatccgacgagagccgccgccgcctcatcaacaggtgcgccgcccatcccgcttctctctatccttttcctttccccgcgatacctcgtcgccggcggcggttgttgacgttgtgttgggggtgggtgctggcgcaggctggtgtacaggagcaagcagcgggggttcttggagtggaccttggggttgggacctgggttgaagagaacattcaatccatggaagaggccaacattcgggccctggttcaagtccttgaccttgtaagaaatttttgggttttgcctgtttcccctcttattttgtcatggacaaatatttatccgaggtaacctggtgccctggtggaacagttaaataatcaagtaagtgaaactggttcccaatgaacccattgtatatggtctcagttatattttactgtttatttttccctggccctgggtcaatttgtaatttataagtatttgtttgggggtttagcctccattctctaaggctgattcgtagttgtgtgcttttgtaaagagctatggttgaacacctttaagagaatgtaaagcatcttgatgagtactgctcggtagattcagaagggccatgaggttttttgggaactagaaattattggttctgattgttgatgctgaagagttctgactatccacgtgggttagttttcttgttcaacaaagtcaggaaatagtttcagcccatcagaagtttgcattctagccatcctctgagtatcctctgagtagttgcaatgaatacatgggaatttgattgggcaattcagcaattgtggatcctagatccaagataaacatccagactgtacattcatggataaagagagtataaatccaggcagtggcttttgtgactgaaaaattcatagcataaagtggtataactgtaagtcatttgaccagacaaatttggtaacctatgagtctggttttcctttgaaccatttatctgcctcagagccttcaaattgtttttttttgggttgaccagaaatgtcttcttaaacaaacaagaataccaatcacattttagaatgtttagaatgtctatgcatcatctctcatgcttaacaacgttttatataacatgcttcatactgctcataacttcttggaaggcaagtgccatgatccattggacagccagtgcatcaaagtatccatttattcttgtgttgaacttgtagattggctctaagctctaatttatggcttttcaggaaaacccagatttgtggaagtggcttactagtcaggaacaaccacccgaggcagtgaactctaatcctgtatgtcatatcacagaactcttctatctttcttctatccttctgaatctctggttgcttctgtactcaacgggttttgtccaaacaggtatttatcgctgttaaatcgaaggtcacggacaacctgagcaagcactcttctcctgagaccagatcagcacctggtcagccatgggtgagagggtgggatgacaagcgaggcattgaaggaccaaagtatggaaatcagtgatgagatatgcttcagagaatggtagcggttttatgcctaagtataatcctgttttgttgcccctatagtttggtgcttgtgtagaataaattaaatcatggtatccaatgatttggaaatttggagtgtcaccatgaatttggattgacaaataatgctctgtacaagtttcaaacactttctggttgaagacaaagcagtgtggtggtaacaacttaacatgtaaatcaaaagctcttgtgtttagcattttctcgtttatgaaataatgatggaaaataatactctaaattgcaatgcacagacctatatattgcaaccaacaccttaagaggagggcctacccaattaatagaaggtcaatactaattgtaagttaaatgatgagagacatctgatcatcacggggcccctcatttcactacgaatcatagaactggtgtatatatctttgcaagatttgaaagaaaaaaaaacattgccaaggcacgaataattgttatactgaaattgcaatgttcattttgtggtgtatacaccatctttgccacactgaaaaatgaaatatatcgctcttatttacagaataaatgaaagaacgaaataataagatggaattatttttgacattatcgtacatcacagaactgcacagagaaaaaaaaactatcgtttgagaatatcacaattaatttcatcttcatataaagaaacgaagatcacttcaacagtatgcagaatctatgaaccggttgaagcttgttgagctcgcatcaccatttcttcagtagtttgccctataatgtcatttgcacgcttcaatggaacacatacaattctcccgattgaatcctgagcagacaaattttctgtcagaattaaaaaaaaacctcgaaatggattggtaacttttgataaaaacaagttagagctagatcttgaaatataaggattgttcaatgaaatttgaggtactttggtcactttctgcgctgcaattacatgtgcgtctgctaggacgagaatcaaatatttttacttggagttacttgaatgaatctcgttcgtaatcttacccgagat

SEQ ID NO: 59416 - DNA, 7062 bp, Oryza sativa
  unsure (1)..(7062): unsure at all n locations
ataatatattttaacattcttttaataaagaataaataaatttcccgcgcatctgcgcgggcttcctccttagttcataaaaagggaaaaaaagacatgcatgtctatatagatgtatagtctttctctaatgtacgatgtgtctctcgttaagactaaatagagaggcctcaccgtttatattttaccttataaaaaccaataattataaaaaaaaaaacctaaacgacacgtacttttaaaccgaaggaatgtagtatcaaaatataagatctttattaattttatacgcaacttacattatttccctttattttaacttgggacaactcttaagcctgcacacacacacacatacatatatatatatatatatacatatatatatatatatatatatatatatatatatatatatatatacatatatatatatatatatatatatagtaaatttgtttggtgctccatggtgcccgggcaccatgattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtatgtaataatggattgtgaaataaagttaaatttgagttgttttgttgctaggtataggtatgaatcgaatacttataactaggtatatactcacaatttgaaaattttgaaaaatttggacgaatttgtgtatttcataccatggtgcccgggcaccatggtgccccatatgagtgtcctatatatatatatatatataagtctactgcttcaattaagcaggaagcagtactttaagttcaagttcaaactcgattggcaaccaatggcgctaatttaaattaggccgcaattagcgccattggagtacttcaagttgaagttcaaattaagcaggaagcagtacttcaagtactccgtaattaggccgcaatggacttcttgccttcgtcgtcgacatggccgccgccggtggcacgcagcacgatcgtctcaatggtgagccccggcccgagcccaaccatagctccccactcgcagtactcgtccgactcctcctcttcttccccaccatcccgccggcaccggcgtcgcagctcatcgaggacgaagatgatcgccgcgcagctcatgttgccgtactcgctcagcacccgccggctcgccgccagcttcccgggctccagccggagagccgcctcgtaggcgtccaagatcgcgcgcccgcccgggtgcatcgcccagaagaggtggttccacccgccggcgccggcgccgaggccgagcggcgtcagcgcgtcgagcaggcaccgctcgacgccgccgcgcaccagcgccgccacctcgccggagatcctgcagtcgaggccgcgctcgcccagcagcagggagactccctcctcggtccccggaatggtcgcctgcgacgccgacaccacgtggaagatcgggtgttcgacgggggtcgtcgggtccgcgcccacgacggcggcgccggcgccgtcgccgaacagtgccatggcgacgagcgcgtcgaggcgcgcctcgtagggggccgcgaacagcgggagcgtcacctccgcgcacgccacgagcacgcgcgcgccgcggttgttctcggcgatgtccttggcgaggcggagcgcggtgcagccggcgttgcagccgtgcatgtagaggacggcgcgctgcacggtggcgcggaggccgaggagcgccgcgagccgcgcgtcggcgccgggcgcgtgggcgccggcgttggtggagacgacgaggtgggtgacgtccgcggcggggcggccccactcggcgatcgccctcgccgcggcggccatggccagctccggcacggcgtccttggcgatgccgaggcgcgcgtcgagggaaggaagagcgcggttgatgaactcagggtggccggcgatcgtctcctcggagtggtagaaatggcgtttcttgatggctgatttgtcacctggaaatgaagcaaattaaatcacggtttcaacgtcagcagaaacatcctctatttttcaagtttagaataattaaaactcaattaatcacacgttattacaacctcattttacgtaaaacacttaaatcttcatgttcatcttcaggacattcaaacaccaccttaatcatctttgcaaattactcaagataaaaaaaactagagcatctcacgaatattacacacatacatataaattttcaacacaaatttagtcagattagatatgtatctttgctttctgtctcttagagtatgtattagcagatacattcacgaatgatatgagtatggtattacatgtgtagtgttatgtgtgcctatgcgtctaccgtgtaatcgaaaagaaaacaaaaagactgtgtgcactagtttggtaatccctctgttttaggttacaatacattttaacttttgtcaaattcaaactactctaaatttaactaattttgtacaaaaaaatgtactaatatttttaacccaagacaaatatattatgaaaatttattcaattatagatttaatgaaactatactatttatactattttttttatagagttagtcgaagttagagtaatttaattttgactaaaaatcaaaacgttttatagcctaaaacgtaggtagtaataaataagggtaagaaaaatagcaatataagaagagatataagagataatcttacacatcctcttcatcttggctttaaggtcggggaggtggtcgctctgggtgacccggaagtaccagtcgacgaactcctcctgcgccaccacgcacttcgccgggttcgccgtgccgatggcgagcacggcggcgtgctgctgtcgcgccgccatggcgcagccgcggtcgatcgcagagagatcgattatatgcactgtgtggactgtcgagtgatgtgcaattgcttgctcctctgcactgtaagatgcacacagatgatcaggggctatatatagcttacaccaatgcgcgtgcgtgcgtgcgtgcgagattttgctgatgcacatgccaatggtgatcatcgatcgatcatcacacggtcacatggtattacacatgttaacatgtgaaaggagtggaattagagtcatgttaagcaatatatgcgttgtactgtgtaatttttttttataaaaagcaatgtatacgtgttcagacacgaggagcgatattagtgacggagctaggatttagacgtggaaggagactaatccagttttacttagttcaattacgtaattagtttaactaggaagatagctcgcgcgaatgcgcgggcatgtgtcgtagactatgttgaacatctacaatatatgatttctccataaattattttcattagcattgcttttataatgttctaacctagctattagttatctttataacataccatatttaattaatccctacaagcaattatttataatattcttcatcatctaaaaagtaggtactcatattttgtgttagaaaacatgtatagcaaatagcaaattaagtgtaaattcaaaagtaagatttttttaattgagtataggttgtcattgtttattgacggatgaattgggtgggatatgtggctccactaaatgcatgggttaatatagcctaatattattgtttagtttgagaatccatatgtgaacgttccatgtagagtgtgtgtgagactccatgcaacctagcgtgaataatattggatgaagatatatagttgtgcaatatattattttggaagatgatgtattatgaatacacgcttgtcttttaatatgagatagatctaatggttggaaataataggttcatcggtttaaaaaggcctaggaggatttatggggtaacatgtggcgaccttatatgaaaaagaaaccatcatctaaaatcgattagatgatatataaaataaaattataagtgtagcttaaaattatggtctttttaatatttgtttatctctttagtttagtagctgaaaatagggaggagactggagagaaatgaatagcatagaactcgaatcagatatgagaaagggttcgcaatgcaatagtgttatgtgcatgtgattggagagggaggtggagggtacattgttttttttaatctttgtaaataatctaagtgagaacctatgatttgttgttttctcattctaaggatatttaagacatgacatgtggtggcttaagtttttttataaagagaaaggtattctaatagttaaaaataatgtgtcatcaaattaagtggatagatatatatactttattttttctttgaatttcaattttttcaaagttttaaaatatcatacgtggtgactgtggtgacttaagagtactatagagcatgtttaatcgatctttactatgtaaaacgattcaagaatatataagatgcgttgtcatgtttttcaatgtttcgttgttatttggtaatgagattttatttttattgaggtagatttaatgcgttcatctgtttgaattatttatgtctttaaatccaattgttaaaattataactccacttatttaaataaaaattgatcaaattatgagtccgccaatttaattgaaaattgatggttagatttgttttcttcataatttttttttataattaaaattgttatttataaaataggaaggtgagagaaagaattattggagacggagaaagtgtatgtatgtatacttacgtgcgtagggtggtgtgaagggtgggctagtggggagaggatagttgtgccggtgggagagaggcgatggatgtggattgtgatttttttaaggaaaaaaagataaatataatagttgaaaaatagatggtttaccaatttattataataccatgtggcggtttggtagtgtttataggcgtaccacgtggaagtataggagtgtttgtattttttttagtttatattttttttatttttaaatggtaattaggatgacatgccctagaaattattcttttccgtagaagtttaccacggttgaatcattaagttttttaaagacaccatggatctaaatttagatgtgtttgcaaatttgatgattatttagggtgcttgttgtttagccagtaaaaagataaatcgtctagtagagcttagcaggatgaaaacacgtgcacacccttatttgtagcagacctcatgctaattgcattgataatccctagcaagaataggttagcctatttggataaccaaattaaagcaagcagcacacacgttgaaaacctattcaatgttttgatttatctgcatcgttgtggtttattatataacttagaaacaattatgatcacttaagtttttttagatggggttgctaggtactccctcattccctaaatatttgacgccgttgacttttttaaatatattagaccgttcgtcttattcaaaaacttacttttgtgaaatgtgtaaaactatatgtatacatatataaaagtatatttaacaataaatcaaatgataggaaaagaattaataattacttaaattttttgaataagacgaacggtcaaacatttttaaaaaagtcaacggtgtcaaatattttagaatgtagggagtataaaataggagagggaggaggagtatgtatatatagaggggagatttcttttattggaaacagatccttgagatatatctaatggttagaaataatagattcaccagtttataagttataacggatggtgatttttttttctcataattttaagattttctctaatttattagagtgtcacataacggtttagaagagtatgtaggatgtcacatggtgacttgagtgtgtttataggaagtttaatggacttgtgcgtagaatacnnaactcaaaataacattatatttttataactattggctgaaatattaatttggtttttgtctcatgagagtgaaaaaaagaaaaaagaaaagaagggaaggggggacacgtgctccctccatacccacaaaacaagtcgttctgggctcttacccgttttcacaaaacaagtcgtcgttcctcagcggggtttagtttggacgcgtatgcccctgacgcgagagccgagcaacgagcggcgaggcaagaaacgaggcgacgtgattaatgccgccttaagctgaatggacgtgattaatggcgctcgatctttcctcttcgtctcccgcatgcagcacacgctcgtcgcttgccgctcgcacacgcgcgtctctcttcctcgccgcccggctgtagttagggttcagagcttggtcgcgccatggagtacgtcgagtcgctgaagtccgtcgaggtgctggactccgtcgacgccctggacatcgtcaacgcactggactccgtcgaggggctagaatcggagatggcgttggactccgtcgaggtgccggactccgtcgaggtggtgccggagtccgtcaaggtggcgccggacttcgtcaaggtggcgccggactccgtcgaggtggtgcagtgtcctcgctgcggcacattccacgctggcggcgtcttcggagaagcatgcttccaagctcgccgccgtgctcgcaggtgtgcccgttgtggccttttacatgaagactacgacctcatagcaaggtttttgcataacatggaaaagtttgattgtgagttatacattcctgatgtggagaaacttaaaatggatggtgaaaccatacttcttcctaagcatgttatcaaaaagttggacgagatctacagtatgaaggagttggaagatgcaaagatgaagcaagaacagtaagttacatgtctcattcagtcgacctaacatgcaagcaaaaactaatttgctactaatattcttgctttggctagcgtgttgcaaagactaacatgcttgtatcatctaatattctacttctaatttgctgcagggaga

SEQ ID NO: 59417 - DNA, 8050 bp, Oryza sativa
tataaaaattgatttgttcacatcttctcttggccatttggctcgaatggcaggcaacactttgtttaccatgaaatctctaatcacatctcttgttattgaagttattggcttgattactagttctccacgaagacgattctgactacttctcacagcatgttcataagtgacaagtggaaaacaaccaattttaccatcaaaaacacattctccattcctaaaccttggccgagcacaaacacacaagaacatgaacctagggatgtaattcttgttcttacaagtgcgatgtggttcatcttcctcgggtagcaagtaatacttctcagatttttgagagaggtagaaccatttttcatcaatgaacacatagtcaaaaaaatccttaaatcttggatcaccaaccaaacttcgatcaatcatgtcaacacaccacttcaacctagtcttcttgttagcatctgtgaggtatggtttgatgctactagagtgccgtctaagcaaaccttttttcaaatacctttgtactctagatttggaaataccaagtttactagacacatcttctatggtcattctttgcttgagaggaatgttgcgcaattgttccaaatcaagagggattgccttatgaccagatctacccttcttgtgactagcaaccacaaccggaatgttatgagtaagttggattttacctcgcttccataagcgctgaactgatcgaatgtgcactccaaattgatcagcaacccttcttgtatctttcttgcctagtttcccattcttgttgtccttcaacaatgcttggtacacttgttttgtgacttcttctgtcatgtccttccttcgatgctgtccttcaacaggagcttggttctgtacatcatgttctagtcaaagaaaaaaaaacaagcacattcaaaaaaactagccacttctttaataaaaaaatgaaaaaggaaagaacaaactgagatcaagattaccagcgtggttttgtaaaaaatctaaatcaactacaccaaattcatctagtggcatgttcaaatcaaatcctgtcggaaaaaggaaagaaaaaacttagaatagaaacttagttgatgttgttgctgtgaatataaaaaaaaggaaagaacaaacacattaccattaacgttgtgatcctccaatattggctcgttgagatggaagggaacattgccgtcctcatcttcttctaggcagacattcaaatcaaagccagcaacagctggaacagccattgcatgcagtagatggaaactctcgcggactaaaagtgagcaggttaagcacaataatggaaagagaagaagccgtttaaataggcatggcgaaactgaaacggcatctacccgtgaaaagaacgaaaaatacgcgcccaaaaaacacccccgagagcgccatgcaaaatcagaaaaaaaaaacaaagtgcccagacgaaaaaacgaaaaatacatgcccaacatacgcaaaaacagagtgcccagacgaaaaaaacgaaaaatacgcgcccaaaaatacgcacgcaagcgccatgcaaaatcagcaaaaaaataatgagcccaccaagtatcgaacccaagcactcaaccttcaaacatcgctgcactagcgtttgcttctcaaatgaatgtacccgcaccctcatttaataggggcaaacatagaagaatagcctcaaattaatcactccttggtaagcacaatcttgtcctaaacgacttgttttgtgggtatggagggagtacgtacaaagtatgtatacacgtacgggatggatcgacatagaatgtgacgcattctaatataaatctatttggtattttttaatatcagatctaacggttaaaaaatatgggttcaaacagattaaatgaaaatcaatggttagatattttagtttttcttagaatttctccaatttattagagcgccacttggcagcctaggagcatttgtagagatgccatgtggtggcttagaagcgtttgtaggaagttatttattagagcgccacttggcggcctagaagcatttgtagagatgccatgtggcttagaagcgtttgtagaaagtttaatggacttttagtatataatagatagatggtttataattatgtgtcaaaataatatgttggagtcttggagagggctaggcactatccatcccctatcacagtcaccgaacaagcaatgtactccagaaaatcctgtcacgctaacgcaccatgcgaattggtctgaaatcgaaaaagattgacctaatttacgagaaaaactgaaataattaactatttgccactcttacgagtggttctaaagaacttgcgacgctgaaccatatatcatagacacatgagggcccacatgtcatagatagcgagtgacaaattcttaattggcatatttcaaaagtggcaaataattaaatgtcccagaaaaactagaccaaaaaccatacatggttaatttaaaagaaactgataactgtcacaacatcctaaccaacccaatcgaggatcagaatcatctaggcgaaggctccaagaggatacaacctcaaagatgttggtaacatctgtcccaaacaacagataacgctttcacctgaaaggaagagagaactatctaagaaggcctctaaggagaaaaccgctgcccacggaagtcgacataatccacaccagacacggagcaaacaagacttttgccataagctctcttaactattgatcacctctgcattgattggctcgaggtattaagggttatcattgcccagctctcgtcaccctatgaacagttatgactccgtcacaaaacaaatgtcaccccccacctccggcgcaagcaccgtctgggacatctttagtttccaaattatacattgttcttctggaacaatctgtgatatttccctgacatccaatttgtaaattgttgccatatatttccaattaaattacatcaagcattcccaacctgcaggtaggctaacgatgcttaaatctgtccgctgctgatcgagcacatatgctgaaatctctaattccgctctttcaatctgttgcaacatgtgtaatatcagtaaaacaccatgccaatattagcatgaatcatgcgaaatctagcatgcaatgcagctcgtttgcatgctaagctagctcatggtcgttggcagattggagccaattaattaaggttcagatagaatacactctctcgatcgcttaatactccgtagctttcaattcagccattgcaatatatatagagtacagtgctttggccttcttgtgtgcatcctctctcaccttacagtgcttttcgttctcgatctcggcaacgacgacgacgacggcgactgccatggcgagcccactgccgacgatggagaccgcgcacgccaccgtgctcgccatcgggacggcgaacccggcgaagtgcgtggcccaggaggagtacgtcgactggtacttccgggtcaccaagagcgaccacctggtcgaccttaaagccaagatgaagaggatgtgtgagatttcttaaacgatgatatgcttcatcagatgtttttaatttaatgttgagacattagattccttcagtttcaagctattaatccactaaaataacagagaaatactaaaactattaaccttttattaatccttttattttatgttgaaaccgtttctccatcttttaattccttcagtttctctgttaatgttgaaacattttcgcttcattggcaggtgacaaatcaggcatcaggaagcgccatttgtgcctcacggaggacatgatcgctgcccatccagagctcctcgaccgcgccgccccgtccctcgacgcgcgcctcggcatcgccagggacgccgtgccggagctggccatggccgcggcggcgagggcgatcgccgagtggggccgccccgccgcggacatcacccacctcgtcgtctccaccaacgccggcgcccacgcccccggcgccgacgcgcggctcgcggagctcctcggcctccgcgccaccgtccagcgcaccgtcctctacatgcacggctgctccgccggctgcagcgcgctccgcctcgccaaggacatcgccgagagcaaccgccgcgcgcgcgtgctcgtggcgtgcgcggaggtcttcctcatagcgctcgccgcccccgacgaggcccgcctcgacgccctcgtcgccgcgtcgctgttcggcgatggcgccggtgctgtcatcgtgggcaccgacggcgacgacgacccgggagcccccgtcgaacacccccccatcttccacatgttgtccgcgtcgcagaccaccatagccgggacccaccagagagtctccctgcagctgagcgagcgcggcctcgactacaagatctccggcgaggtgccggcgctggtgcgcgccggcatcgagcggtgcatggaggacgcgctggcgccgctcggcctcgccggctgcggcggcggatggaaccacctcttatgggcgatgcacccgggcggccgcgctatcttggacagctacgaggcgggtctccggctggagcccgggaagctggcggcgagccggcgggtgctgagcgagtacggcaacatgagcggcgccgcgatcatcttcgtcctcgacgagctgcgacgccggcgccggcggcgggatggtggggaagaagaggaggaggagtcggacgagtactgcgagtggggtgccatggttggggtcgggccggggctcaccattgagacgatggtgctgcgtgccagtgccaccggcggccatgtcggcgacgaagtcaagaagtcgactactgcttgagcctcgaagctatagctaagctagcgagctcgatccattcgctgctgagcttgaagcgtcttgagtgtgggtgcggtcgtgcagagtatgcaagtaaaaaaaaagacggaaataagatactataaaataatgggaaataactaaatactcccacagtcccgaaatgtgtacttttcgcatgacgtttaataattcgtcttatcgtaataagtaaataaatattatttatctcgttgtgacttgttttaccataggagaaattatggtcttaactcatactttacatatttatactaaatttttgaatatatatatttacactaaattttttaataagatcgatggttaaaacgttatgcgaaaattaggattgtcatgtattttggtatgaaggaagtaagttatatggcttacagaactttgggacaatcaggaacaagaagtatcatgatgccatctcagtttatataaaatcagtatttgaaagactagtacgcttataccatgaaatgcaaatttctagcttttctgctcaaacttcgttaagtttgaaaactaatctgcatatagagtccaatacaggatttatttgaaaataatttaaacaacgaaaagacttgaattaaatattgtgtcttaatatttaaaatactaggtaattatccgcactttgctgcaaaaattactaagcaattctcaatatattttttcgataatcaagttaggagttaaaaaaaaacagaaacatcgtggtttatcagtatttatcatgaaacaaacaaatgatacccaagctttaatctgaatcatattaataagtatatgttaaatattataaaaaaatgatagataaatttattaaaatattatgcaaatgacgcgaggggtgatgattagatatgctttcatgttgatttatagaattaaataaattatagatgatgttgtatacttgcatgaggttaaatatgtaattattgctagtgggtaatgatgtagtatggttgcatgttgagttttaaatttaatggactataactatatagaaagtatagattggtgtaaagttatatagtgactattttagatgatgaaatttattccggtatttgtttggaagaagctacatcgaattgttacaaagtttgcagttcaaaacgactacaaatcaaaaaatacagtatgatggaaaacaaagaactaactgaaacatcagcctaaaagcagagatgagaacccataactaaaaactctgtgctcctcagccacaaggtctcggatacgttatcgcccaagttctgaaattgaactgaagtcttgaagtcacagagaaagattcatcgagatccatgctagattccttaaaaaaatcaaaatccattctcgatcgaccagatgatcagatgatatgcacatctccgttagctccagaaaatgatgggctagatgatctatattcgaagcctcacccccttctaattatttgatattaggtacttccctaatattcgtatttttttaaccgaaatatggaagatgggtcaacttgaagggtcataaaataacttaattgtaaaatatgataatacgctacaccaaaaactgatgacaagtcctcgcaaaaaagaaaagaaaagaaagaaaactgatgacaagggaggctacaaacatcgagatcaccgtcgtctacttcagtaaccacatcagtgacatccacgactacgacgtcggagaagcaaaccgtcagctgccatccaaccaaatcagtactcctcgctaaaattctgtagaatggaggaaataaaatgagcaaggctacaaactctgaatatgttcaatgctacctgccatctgttcaacttccatggatatttacatacatacgattcatctgctcaaaatgtgattcatatccctcaaatacatgcaggcatgggatcgaacagttcacatgtacacagctacaaagcaagcgtgcaacgcaaatattatctatatatcatcttaattacatgaatagtacccaaactaacaaattgtataaattatagttagctcaatataagttctaaaaaccctaggctcaattgggcacgcataaaaatccatatagctattgagccattttaggtttgaccaagtttacataaaaacataagcaatattttcgacacaaaataaacatagtttcaaataaatatattaaatagtagttttagacaaactaatttgatgttgtaaatgttgctaaatttatctataaacttggtcagactgaaagaagtttgactagaaaaaagtcaaagttacttatgttatctttatctttacctattataaaaaaagtttaagatgtttttgtcagagatttttgtacgtcgtcgtgtccgattcactggtggagaaatgctctttactcctggtttagaaccctttatagtcccggttttctaaccgagactacgaatccgggactaaagatcgctatctttagtcccggttatttgaaccgggactaaagatcgatctttagtcccagttggtaacaccaaccgggagtaaagaggggaaatctttagttaccaaccgggactaaagagggcaagcgacagttcctcgagatccttttttttttattttgttgttgatttgcttaatggctagggttaatccacgtattttctcccgaatcgaataggatgcacatccccaaatcaacatcccaaatattaagttacttatacacacgaatcaaatacatcacaaatcctacacatagatcaaatacatcacaaatcctaaaaaactaaacacaaattaaatacatcacagattatacaaattatacatatcagatccatacgatgcaatgaatcataaaatctaaaaaattatacatccagtgaaacacaaattatataaaaaacaaacaaacgagccggcgccaggccgccgcacgcagccgcccgcctgcccgccgccgcctcccccttcatggccacgccgccgccggccggctgatagaagacggagtaaaggggaggaggaggaaggagaggggaggagaagaggaaggggaggaggggaggaacacaggggatgggaggaggaagaggattagatctgagaagaggaagagaggggatgctctaatcttatctaaatatctgtctgggacttaaccgat

SEQ ID NO: 59418 - DNA, 2380 bp, Oryza sativa
gggttagggttagggttagggttttcatcaaattcaaactgatctgagccgtccatcaaaacgaacggctgagatcgatcgagggtttgggccgcaccacttgggccgcacgcggtcctgcagtccactaagtgagaggagtatgggggtattaagtagactttgggcgcttgtgggctgaagaagaaaataggctgaaaaaggcccatagagaaaaaaggatttttatttaaataaatattgaaatgatatttgtattatcaaaattagcaattaagctatgtaaattccaagaaaatttcaatgagtgtaattaatatagaaaatttaataaaaattaaatccaaccataacattttatttctcacacctactttacttataaattaatttaattatatacctacctatttaaaaaatacccaaatatttcagaaaatttgtatttcatttaattagaatttaatatgttttaattcaattttatctttttttcttttcgatgcaacgaacgaccacttttgctataattttaaaaagtgtaattaatattgcagaaaattttatatttcattaaattacaattcattttcttcgtataaatagttcaaatcaaatttcagtcaccatatcattacccggtgcaacgcacgggcattttgctggtaatataaaagaaaaagtatgaattaccccctgaactacagcgatcgattgaattacattcctgaaccacaaaatcatatattcttcatctccaactatgcgaaccagaaaaataaccccgctggctcaatccgcggtggttttggtcctacgtgatagttcagtcagcatttctttttttaaaaaaagtggcccctacttgttattttctcactctatcctctcttctctctctttccccaatcccctatcttttctccatcccctcacatccatcaccggcagcggcgagccgaggacaacagcgcacggggggcgaagccaacaggaggtgtagaggggggccgaggacgacagcgggtgggggcggagccagctggtgcagtgccgacagcggtttcggctttggcagccacacggcggtgggtcttcgtcgccggaggagaggagcagcaggcgacgcgcgagacgagggcgacgagaccgggggtgcagccttaccttccatcgactcgctggagggcggtgggtcggcgcagtagcagggggacatgggcgtcgccccctcctgctaatgtggtggccggcggccgccgttcaagcggcgccgccgcggtgtacaaggaggagattgaagatgacgacgacagaatccctagcaaaactcccaatagttggaactcccaagcctagattcttggttctccataagaggggacaggcgctgctcccaatctccctttcctgacaaaattctcgcgccacgcggaatgttcttgcaagtggtttgtcacgaggttgttcgccgctgcatcgaggtgtccggcacgatccccccccccccccgccaccgcctcgatacgacgcgaatcaacccgtctgatcccatggtttgaaatttcggaccgcaccggtaagcacaaatctccccataagtttttggatttctccaatttatctgtgaacgtggtcaaattttgttcaaattcagtcaaaaatatgttaaaatctatctattatatactaaaagtccattaaacttcctacaaacgctccgaaaccgccacgtggcgtttctacaagcgctcataggctgccatgtggtatactacaatcccaccatcgattttcatttaaattggtggacccattattttacaccgtcagattagatctatttaaaaaaagcatatgttttctgtgtccaatagaatccatttaccggaaatatttacatatgtatacgcatgaaaatagttacgtacgatggaaatacttaaatacatatacatatgaaaatacttacatacgtatatgatggagtatatatctaggtactgtattaagaaataaacaaagaacgtacgtgtgtgtacgataaaaaagcaactgttcgcttggatggaaatatacaaaaggaacatacgtatgtacggttaacgcataataaaaaaaaatactataaagccctaaagtaaaatatacgaagttataaccgtggaaaaaaaatatacggtccttttaaactaggatcttctatactataaaaataaaatttattactccacaaatatagtcatgttgtgcacgtggcactatataatctcactgttgattttcatttaaattaatggatccattttttatacgtttacattagcccgcttcctttttaatatcgtctattatatataaaagttcattaaatatccta

SEQ ID NO: 59419 - DNA, 1007 bp, Oryza sativa
tttaaacaactatttatctaaatcatatagctaatttttttattggtgcactccattagattatttactataaaatattttaaaattgaagatccaagtttgggacatatattattaaaatcatatagctaatattattaagatccaagtattcatattaggttgtgtggagcctctgacccactctaaatgaaaatgttcatggatggatcatctctcaaactacatcaatcatattagtctatataaacacatacatttagtgaagcctcatgtcccacccaatttatcctctaataaaccataataatatatatgcaatttaaaaaaagaaaaacaaattacttttactttcattgacatattttctaaagaaaataagactatattcttttcaagtgatgaagaagattataaataattgcttacatatattacttaaatatgatatagcacaaaatgtaataggttagaaaattatataggcaattaataccgacgaaaataatttacggagaaatcgtgacagttgatctccggttaatatttcgcttttataaatatcttatacttagtgtacgtacgatgcatgcccacgcgaatgcgcgggttaccttcctagttttaaataatttcggtcaaaaacaccaaaattcacgaatttttcaaaattttgacaaacatcgatatttccgaaattaactgcaaaccctgcctgcacccgtgtcggcctggcacctccatgtcccggttatttcgacgtcctccgataatgtgcagacgacatgttcccgaggcgaccatcggagacaccaaagcagccggatcccatcgtccatgacttggccggagttggtttctccttggcttgggattggtctctcgttgatgatggagatcagtttgtctgtcgaagcagtttgcccatcggcgattcattcagcgatgcaagtgaatgatcctgatctttgctcttgaagaattgctcaaacttgtaccatgtttta

SEQ ID NO: 59420 - DNA, 3204 bp, Oryza sativa
tgttgctgaaatgatgtgctgttgttgatgctgctggcctactgctagttgtgatctgctgatgattgcttgccatgctgctgctgatcacgctgatccgaattgatactactgatctgctattgttgaaaatgatacgctgctgttggttcttcaggtagtggtgttgcttgattgccgacaggatcagatttgctggtgtgctactgcatggagagggccgatagagaggcggtgcccgcgatcaggagccggtgaggagaaacatccaggggtcttccggctagctctacaagttggtggactagctggcctgggttcgaaaccccatccattctgtttatttgatattatgtcattccttgtttttttatcaggagtcggtgagcgtgatctcgcaggagcgagaggcggaaacagatttcaattggtaatttttgtagttttaggtagtcaattttggccaatctcttagctagattaatatcttaatatcataaattctatttagaattttcataaacaaaattttggaatacttttggtgatgctcaagagtaccgttccatgaatcttgcttggaaataagttggaaatattattcatattcgatcgatcgggccatgttgtcccacttgcacacatgcatggcagattagggtcgatcagatcacatgtacacagaaatatgcgttgattaacatggcatatataatataatgcatgaatggtacgtacccatagcatatcccatagttatatcaacaaggatgttgatcagctgtgatgtggtgatgccttcactcgaggtgtttcatctgtgctctcccatggcaacccctgatggcatcctccgtcgacctggttttgttatgaccagttgcatagccggcaacatcatcggcaatcgcaggagctcgccgcgcgcgccggtaaaatcgagcggaggtgagtcaaatttaactagcttacaaatcttcataggtttgaggttgtagtgaattatactataggaattctgggcttctgtgacgattatagtatgacgataacaacctgcttcctgtcactgcctgctcgcagtgacgaaatggctgtcatcacagaaggtgggtcactaaccatcttctgtgaccacaagaggacatcgtcattgatacagtgacgataattctcctgtcactgataaatgacgagacaaattcgtcataacaaattgaaccgaataacgccacgtgtatgatgacatgtgatgttgcaaatgacaaggcgggtgatgtggcaaatggcgtggcaattcacattcggcccatataacatgggcttttttattttcaattacaattggcccaaatatatttttttgacccagctacaaatttgcttttatggtttttttttcattatagcccaacattacaattctagcctatgggccagcccattaaaaagcaatcacagaatataaatcacagctatttgtataattatattataatcacattcctgccataattaattttctagcccatacaaaatcaagttccaaaatacagtttccaacatgttccatacaaaagcacaaaacatgaatacaaaatgatccatccaccatccaactacacaagtacatgtgcctgtgccttcaatctttcaagctcctcctgaagtactgcagactctagcttctttgcatctagttcaacttgtatctctttcatcacattgttgtcttggcagcgggctgctatattccgacgttgcgcaaaaatgtgtttgacttccgcagcacttaggaaacagcttcaatagaagtcttagcttggtgcccatcttctactgatggtgaagtgaggacttcccgggcatgcatatcctcctagcaatcaaagaaaggtttcagttttgcattattatataaataaaggttcattgcataaggtacttaataaaagaaggaaagaagaggtaatagtttagtacttactatagctttcttcacaggttcactaaaacctttagttttgctgcaatgcaactccttaaagagatcaattgcagtgggctcactgtcaattgaaatgcccatgctcttcccccttggctccacttgtctacttccagtgagggtgcctaacataaaacatttacaagtgtcaataaaaagatcatgcacttgatttgaatgaagcatagcacatataaggacaaaagaacaagaatccaagttacttgccttgttcagtagtgctcaattccattggcttcagttctgtacttaaagtgtggttgctcaatcccattgccgccgcccaatatggccgcccagggcaaaggccccgtctgtggcgcgagaaggaagggttcaggatgatggctggctgcggcacgccctggttagggctccacccgccgatgctcaccagcgccaccggatcttgcagtcccgaggccctcattcctgtaggcacattctgcaacacagatgaagaaaggatcagaagaaaggatcacaaaattgcattagagttgcataagcttctgactagtaaccggttttgctaggcaaatctgtgagttgagtaggattttaaggaacatgtactctttgagcaagtttatagccaatttagtaaaaatctcacatcttatttacattcttaaagggatatttctgtgacagacattatattggattatagaaggagtcagagagatgctagccatgacctttcttctcaggaggtgatgctagccatgacctttcttctcaggaggtgatgcttcccttttaccagtgacattttctgctttatgaactacagactgaggtggagatgcagcagtagcttcccatcctacttcatctactgactgcactaaaggatccaagctagaaaaaatttcttccttggagatatcataatctatatacttggattaaactgagttcagattaatgatctatatacttggattaaactgagttcagattaatgctaccacacctaacattaacaaaaaaaaaggtgtttgtttttcaagaagaatgcatgtggtaagtttggtacatagtagagatcaaagcagtaaacaacagctgtgatcggttgggcaggcataaacatcttcataattataattagttaaccatgcatttttcttgaaagaacttatcaggaagcccattgcaaacagaaagcc

SEQ ID NO: 59421 - DNA, 17191 bp, Oryza sativa
cagtttgttaatttccttggacggaatgctcatttgtccaagctatgaacctcaagtcaatttgagttatgatcctcaagtcaatttgagttgtgcaatgcctccaattcactcatgaattatgataaaagtaattaggtccacctgtaccagtaaagcacctgttctagtgactatacgatcagaagaacaagctaagcaaacaaacccagtgtacttaaacttaatagcgcattcgaatttagcagaaaacaagggtcagatttttgtcatgggtatgcccacatgtcatagtatagttgagtcaaataaaaaacttgttcacaataatataattaatcattcctaattgcagcgcttcatttttactcattcctaattgaaccaggaagtaaagacacaggatctcaattctctacatacaaatcacaaaaatatgccttgaactgaactaagtttactcattctagttttcaacttttcaattaatctcactctctgataagagaaaaaccaaaccagagagagagatcctagaaatactcactgaatataccagccgtcagccgtggacatggacagatgagtgaacgacgcttggagctggacctttggtcggcattctggcgcaaccattgctagtgcagtgctcctggtcgccgactcgctggccgccgtgacggcgtgcagctcctgtgccgaggcgttgacgggtcgctggcccactgccttgcacccctgccccgcgcagacacgcccccgcaagtcgccggccaccgctggtcatcatcgtcgtcgtcgtcgctgctgctgttgtcgtcgtcgtcgttgcagccactatcgccatagccgctgccgccgtagacgctcgctcccgcctgcctaagcccgccgccaccgctccggagggtggaggcgagcggatccgcgtgctgccggtgctcccgctcacaccaggccgctcccgaggacggaggccgctggattcatgcgacgtcgtcgctcccgaggacgggaggcgacggatccacgcgccactgtccttccctggctatgcggcgaggcggggaagggcgaagaggtggctgggggcggagatggaggctccgcggtggatggaggaggagagggatggtggcggtgagggagtggatggtggcagcggtggcatatggatttagtttgggctagggtttggggaacatgttatatggataagaagcaattcaatgcgaatttaccaaactgtccctggtgtgtacacagtagttacgaaattgtatggacaaaatggacatttcaccttaaatttagagaactttaaatttcattttaggctgatttttgtgtttcaaatgcaaaagtcctaaacaacaaaattgcagaactcatcgagatctacaacttttatattggtcttttttaaaaataagttcatttgaacaattcaaattttgaattttcaaaatttgataacttcaaacaaaaattggggttaataaatgattttaattggaaaagtcaccaaaaccaaagttgtagaactcatcgaggtgcaaaatttttattttggtcatttctccatctgactctatttgaataatttgaaatttaaaattcaaagtttgagaacttaaaatagaattttttattagtgaatgacttccactgaaaaagtcatcaacaacaaaattgtataatccatctagatatagaatttttattttggtcatttattcatccaacaaagtgatactaacattgttcaaaaattttacgtatctcccatatggtttcataaattataagagagatgtgtaaattttatgaacaatgttagtatcactttgtcggatgaagaaatgaccaaaataaaagttatagataatgctgagttatacaactttgttgttgatgactttttcagttgaaattatttaatatttgaaaatgttagttgaagttgtcataatttgaaattcaaattcaaattattgaaacaaagtcatatagcaaaatgagcaaaaccaaagttgtagatcttgataagttatacaacttttttgttgatgactttttcagttgaaatcatttagtatttgaaaatgttgtttgaagttgtcataatttgaaattcaaattcaaattattgaaacaaagtcatatagcaaaatgatcaaaacaaaagttgtacatcttgataatttatacaacttttttgttgacaactttttcatttaaaatcatttactactcgaaaaattatttgaattgagaggaaggaggcaaaatggacttctcggcgagtgaggaacaaaagagctgggccggcggcccgaagagggaggaggggaaggggaaaccggcccatggagggagagagaggctacgggctgagggagggagagagtaatacttgggccgaaaatggtccaaggacatagagagggattttaatttgttttctatttatattaataggataaatgtattaaaattagttattgagctccgaaattcatgaaaaatttcagagaataatttagaccacgtagaatattaaaaaaatattcccggacgtgatttttaaaggaaaattttagtttcctcattaattcacttgattaaattgctttaacttttaatatatttttctcgaaatgcattatataaatctgtgacgtttgctttttgcccttcagaacaaattaatattctacacaatgtcccattgaaatactttatgacgatttttagttggtattaacgacgaatacttttttttccgtcactaagccaccccatctcatactaatcgccatatttctgattttttttcattcataaaatgagactagagatgacttcaatccaaaaatcctaatatgagagactagaattgatgtagacaagaagagttaacctaggacaaacgatttgtggtctagtagcaatgtagtataataagattttttttgttttaaaaaaaattataatagttctatattttatgacgatccactattgtcatcgtgctatcgtcacagagcccatgcagagtatactgtgacgatgattatgacagatacactgtttggtcataaacattcgtcatactgtgaacggtcgtcataaactgcctctgtttatgacagatatgtgttctatcatcaggtaatcgtcacagaagcccagatttgttgtagcgacttaagtagcatcttaaagatctgagttcaaatttttataggagcgaatttcagattggattatttcaagtgctaagttttcaatttaaaaggctgctatatccgattggacatagaggtcgggtaaaaaaaacctcttaaaaaaagtaaaattagcttacaaattgatgcacaaatgtagtcggtcagtatatttatgcacattgatgcagaaactgaagccacgaaaacatattgtttctttgaaaatggaaaaatatttctatttctacgttttgctaggtcattcgcggcaacagaacaaattcgtcttacaatttgtttctatctgcatatcatacaatattccagcagtagcacgcagagcttcatcaagtaaataaataaatttagtaactttgatttggactgtcatttccaaaaatgccagtcaccttaattttcatccttttgatggcaatcaaatggttctcatcactctcctattattcatttaaataaagaaccatcttccttagacgaaaggtactaaactacaaagttacatgaaataaaattataattcataaaatttacaaaatttcattcaagatttttatttaatttgcatgtaattttcttcttcatttataaagtatagatatggagaaaaaatataaaaggggatcgttttatcctctctaaaatctttgcaaatttgccatgcctttgccagccgaatctgctgctcgacaaccgcggggacgaagccgcatgcggccgccgtgcagccgcggcgtgcggcgatgctcgtcatcggcaccgcgaacccgcccaactccctgtcgcaggaggagtacaccgactggtacttctgcgtcaccaacagcgaccacctcaccaacctcaaagacaagatgaagaaaatatgtgaatttctaattactaagtactcggtgcgttgcaacgggttcatatagggatgggctgcataggcctagctaactgctctggcatctaatataaccgttttgttttaaccagattttgtttttaaccaaccctttgattttttttcttgattaatttaaatttgagtttttcccaaaaaaaaataatttgagtttatggaattttgctttgaattttttgttatactagtactatacccgtgtattacaccggaataattaactattcgccacttttacgagtgatgataaattatttgtcactgcattcacatgtcataatcacatgagggccacatgtcatagagagcgagtggcaaattcttaattgccacatcttaaaaatgacaaatagttaaatgtccgtattacacccatagacaatgatgtaaggatgtgcgacatatatacaaccatagacaatgatggaatttaaccggttatttttttaaccatttttttcttgttttgtttttaaccaaccctttgattttttttccacggttttctccagaatgggtggttatgcacgtaacatgagggggaggcaggaggacaactatggttttggttttataataactaggaaggaagcccgcgcaaatgcgcgggcaacttatttataaaagattggtaaaagaagtcatacttcaccatattaattataagaaacgcttatttattatttataaaaataatgctaaagaaatcctatctcaccatattaattaattataaggaccatagatcaccttataattatataaaaataaatgtctagacacaacaaaaagatcatctctacttcataccaaattgttcatgtctcacttgtgtttaaatatatgcataaatattttgaaatattactcctaccatttcatgggataaaaccattaaatttgatctaaatgcccctctaatgggtgaagccgactgtagccaccaaggctttcttctcttatgctttgaaacatgtgtccagtatcgatatagttgttctcctcgagatcagtgtggagcacaattttaatacctaattcactatcagctaaagaatcacatcggtaagtaagccatttgaactttattgcgaatagtagcctctcactggggtcacctcaacatagtcatatgcatacccccgccatacgtatagtagcatagcaaactatattatcaatgcttggtgcccttcagggaatgacacatagatgagatgaaagtgatacattttttttaaggttttgagtccatttatggaatagagttgacacttgtttatggtgttaattggtctactaaattttagtggtacagatataattttctcttctgaaaataagcagagttgatcattcgatactacttcaaataatctaatagcttcagtggtgagaaacacgtggaaaaatatttgcttgagtagtaataattcatgaacatatgaggtaatatgagttttgatatttttcttttctttgtattattgatctaattcatcttcgtggggtaatatatgatggaacaatatatgttatcaagtttatttgtgctaattgttaatgctatgtataataatgtgaaaagtgatagaatgtggttccatgtaatattttttattcaaaagatagttaacatatttataaattttctatagaaaaagtgggttgtaaatgaatataatatccactatcagttattaaaaagcatggagtaattgttgagattatttggataagaaagatataaaaattggctagaatattgtttcgtatgataactttttaatcagaatttgctatatatatgtcacaaattttactttgggtcatattttattatgaatgttttattttagactaccctttaaccaatattttcattttggattgggtaagcatatcaacgatctcggatacgtcggctcctaataataaattaactgtcacaaatataagatataagatataagatatagcctagtcaacaatgaccctaggaaataaactggagagatcgaaaggagccacagcagagggtagactgatcatgtataaactttctaatttaagggttagaaggacatggttaatatatttttttatgtacgtacatatgcatgtttttttttttgcaaataatagtctcctgtacatgcatataaacatacgtatgttttctccgggagaatagtatatatttatttttctctcttgcaaatacgtatgagattaggagagagaaattaattactttagtacgatctaatctaatgattgaaaataatagttcacctgtatatgcgtaaatcaatggttcaatgtttaacttttatttttttcagaatattttggatttgtattgatcttaagttatcagttactcccaatctaaattaaattgtgaccatttaactcaccatgtttatgttgaattgcttgctataaaatagaccaatagggtgttgagagaaaaggagatatatgtgggctgcacgtacgtatctgaagattttagatttttttttttgacacggtacgatgacagggtatgtacaaagggggagagagggttatgtgtgggaggagggatgtggatgtggaaagattttttttttaataatctgacggcttgaaataatgggtccaccaatttaagtgaaaacggatggacagatgtttcacttttttcttagaatttctaggaatttctctaatttattagaacgccatattgcgacttaggagcgtttataggagaccacgtggtggcttgagagcgtttataggaagtttaatgaacttttagtatataatagatagatagagaagagaaaaaaaattgctttcagatttcgaaatgtttgcatgaaacttgacagaactgttgcgcaagaattttgtggaagagaaattttacaatcctcgataatgcacctaaattttacacttaaatttatggtaccttaatatatccagtatctaataaagataccatggtaaattatcctttgtaaaacattatcaggtcacaggagtggcatcaagaagcggcacttccaccacaccgatgacacgttccgcgaccacccagagctcgccgtgcgcgaccagccgtcgctcgagacgcgccaggacatactagcgaccgtcgtgccagagctcgccgcggaggccgcggcgagtgcgatcaccgagtggggccgcccggcgagtgacgtcacccacctactccggcatgcgcatgcccggaggtgacctccggcttgcgtccctcctcggcctccgccgttcagtgcagcgcacgtcgatgtacttccacgggtgctccgcagccgccgccgtgctccgcgtcgcaaaggacctcgccgagaacaaccccggcgcgcgcgtgctcgtcgtcagcgccgagctcagcctcaccctgttccgcgcgccccaggaggggcatgtcgacacgatcgtcgggcaggcgctgttcggcgatggcgcgggcgccgtcatcgtcggcgctggcggggatgagcgccaggtgttctagatggtgtccgccgcgcagacggtgctgcccgaaagcgagggcggcgccgaagggcagctcaacgcgtccggcttggtgttccgcccttcgttcgagctcccggcgatggtgcgcgacaacatcgagcagtgcttggccgagggagtcggcaagcatgtcgcccatggcggctggaacgacctcttctgggcggtgcaccccggcgggaggaagatcctggacgtcgtggaggaccggctcgcgctggcgccggggaagctggatgcatcccggcatgtcctgagcgagtacgggaacatgtctggcgcgtcgattatcttcgtcctcgacgagctccgacgacggggcgacatgccgtcgggagggctaggcgtgatgctggggatcgggccggggatctccatcgagacgatgttactgcgtgtggcggcagcttgaagggagctcaaggagggaataattaactatttgccactcttacaagtggtgataaaagatttgccactggacccaataaaaaatttgtcactggattcacatgttgtagacaacgagttgcaaataattaattgacacatcttaagagtggcaaaaagttaaatgaactaaatgtattttttgaatttgagtaaattcgttttttatttttatttttgcgagagagtaaattcgtaaattggttttagagcttgaagaccaaaaaagctcatacaaaatcgtacaaacgagaggatacatttttgaaacatgaggtctaataaaatatttgagaactttgaaatacatgtatatactagatgatacaccgcacgtttgatgcggaacgttgtctataaatatacgtgagacagggaactaagcaactgtgaactgaaaaaaacttaggagggaatataaagatgttcagcaagtgcttatcaggttttatttgctgaaacatgcggatcaccgatatatttctaaaattgttaacttaagtctcgatccgtacagcagctagagataacttggtcagtgtagcaataacgtactgggctgtagcaagctggtgtctagaggatgttacattgctaaatgccctagaaacaggcacaaattaatagctgcaaactgtaaaaaatagggaacataaactttttatatatcgaacaaagagcaaatcatatatgtttgattttttttagcaaaaggaagcgactttcaacgaatgaaaccattagtccattacgaaacattgattttacctcaatatgtactgctgcacacttttttttccaggagaacagatgaaattatccctgcaaagtttctaatcaaacaatcaaacggtggaaaatattttaggtgacgtaaaacaaccacagcaaagcaaaatagtaataactacataaagtggatcaattatataggtttaacagataagtatataggattcacaacctaattaaatagggaagatgtctatgtctattttactgaatacgacttgagaaaaaggagattaatagacgtatattgtgcgaactggaaaagaagagcaaaatgacactacctatgattcttctatgaactgaaccatacatacggagaggaaattataatttgcaagattggaggttatgaaagatgaggtgctgggatctgggaggtgcagaggagcaaagtggagtttcgatgctagcaaaaagtacaccgaaggtccctcaacttgtcaccgaattaaaaaacgaccccaaccgcaacaccagatatccggagtctcttaactaatcaaaaccagtcacaataggtcctttggtggttttgaccctgattttaacctacgtgacagcttagtcagcatgagacccacataaaccctacatgtcagcgtggtcgtgaaagtctccccctctttcccctcctctctattctcctctctctctcactcttctcttctcttctttgggcaagccggccggcggctggggagcaggccaccgggcgaggcggcggcggtggccggccgcgaatggcgtcggcgacgctgcgtcgccgccatcggcgaagcgccccgcgcgggtgggcaccgcggcgttgggcgcggaggcagatgcgaggctgtctcgcgtcgtcaaagtccccgtctcgagtggcgaggaaagcgaggacgaggttgccatcgatcgccgcggggtcatcgccctccgcctcagcggcggcgagggcgcgctcggcggtggtgtgcgcctctcggagtcgctcgccgctcggaaccggcttcattgacaacccgctcagcaccggcttcagcgctgcgccgtccctcgccgccatccccactaaccagtctgtcggccgagcgtcgtagtgcaggcggcggcgagaaggcaggcagcggggagggatgggacagctatcgttgcacaatgtttttcaggtgttggatctgctggaagacgcatgcgagtcattacttgacagcatcgtggcagagaatgcaagcgtttctgcttgatctgaatgaagctatatggaggcaatgtaagcatcattttttccatgtaaccatgttcggtatctatctatgccatttgattgcgattcagataaccagaaaacactcacataagcatgtatgtacccatgttcaattgttcatacaatgtcaggctggagacatacttatatctttcatgtacaccatgatttacactgtaataaaatcaccaactcgaattacagaagctgaactgttttgttagtaacacattgcacatgtaggaagaagccacctctcgccaaggagcagctcgcgagctcggcgtcggcgacgacggcgaggtagtagtcgccggtgggctcaggggacgacgaatccgacgcgtacgtggcctcggcggtgtcctagtggacgcccacggccgtgtcggcggcggtggcgagggacctgctcccgcgcttcttgtgcagcacatggtaggcgcgcctcgacgacggcaagagcgcgtcgtcgaaggcgacggcaaggccggtggctccggcgcagcgctacgcgtccacgtgacccggatgaggagctccttcccggagtgcagcgaggcaccgtacaccgccgtggttgccgcctacagcgagcgatccagcgcgccgccgcggccagaccgccgcggcgatgccgaccgagctgttgccgaagcacgacagctcccgcatcgcctccagctttggtttttttttttccggcgagattagctgccgctttgctgttgctgctgcaataaaatggaatgcgctatgtggcacgatggtggcatcgccgcgctctcacacgccgcctctgctccgctccgccggccgccgctcagccccgctcgccgctgtccgttgctactcccccgcggcaaagagaatgaaacgaagaagagagaaaagaaaggggaaagacgtccgcgtcaccggccgccggacctcctctcccgccacgccccgtcagtctgctctagggctatcaacgagccgagctcgagcgagctcgtctgcctaggcttgagctcgataagctcgagccgagcctataaaatattcgagctttccgacaggctcggctcgtgctcgactatcgagctcgatttttaagtaaaacaatatatatttcaaatataatctttaaaaaataattaatttcaagtaaatcatattaatagaagagaaaaaaaataaaataaatatatgatgtcatataagatatacaaataacatatttgatctcctaatttattaaataacaacaaaagttatatattactgggctcgttggaagctcgagctcggctcgacaaaactcacgaacttacggagaggctcgggcttggctcgtctggagctcgagccgagcccgaatcgagcctaggacgagccaagctcgagcagctcgcgagccttgagcttttttgatagccctagtctgctccctactcgtcggttggcctgcgagagatagaaagaaaggaggaagggagggaagaggggaaagagagttgacgtggcacgctgacgtgtggggtccacgtgggttccacgctgactcagctgccacgtaggctaaaaccggagtcaaaatcactgaagaaactattgtgaccggttttgattagttaatggatcccggatatctagttttgcgtttgctgacgttttttaaactcgatgacaagttcagggaccttcgcccctttggtgtaatttttccttcgatgctacgtgcctatacatggttggcctggcccatggttcaccttaacaccaaagcaattttacggtgttatcttttcgcttacttatgcttattagacaaaatttaaatttttaactttaaatctggagttgattttaggattttttttttatgaaaatttatttttcagcctttgcttttagatcgttaagaacatgtaaataaaaatttgagtaaagtccatcactggtcccttaacttttaccgatgtgtcatcccggtctctaaactcgcaaatcgaccattcagatcctcaaacttgttcgattatatcatcccgatctctaaacttgtagatcactcgtttaggtcctccaacttgttcagttgtgtcaccccggtccctaaacaggacggtctaaaaactttatatcaaaaaataattcataactttttcatgtgaactctaatgaagataaactttatatcaaaattatagccctcgacgtgacctacaactttgtagttgaaaagtttttgaattaaaactgtttagggtcccaaaatattgttgcatgtttatagattttgtaattttaattttaaaattacattttgggacaaaattgacttaaaataaaaaaaattcaactacaaagttatagatcgcgtcgagggctacaagtttaatataaagtttgtcttcattagagttcacatgaaaaaattatgaattacttttaaatataaagtctttagaccgtcctatttgacccagatgatatttaaatccaagtttagggaccggagtgacacaactgaataagttggaggacctaaatgagtgatctgtaagtttagggaccgggatgacacagtcgaacctaaacggtcgatttgcgagtttagcgaccgggatgacacaacgatacaagtttaatgaccggtgatagattttactctaaaattttattcacagattatttttcgtttgtaaatatatcgttgatggaaaccttaatcctgccgtgtcgtggaatccgccgtagtggggatctaccatatagatatataggatttggtcgatcaaaccaaatcccttttttagtggaaaatatttggccgtgggccttctaggctctatcaggccggcgcattttacttgggccagataactgtatcgtggctgggctggatgttcacagaaaatctgggaccacattgaccgaacgatcagtaatatcgacttctttttttccccttttgcagtttttcagccgattaaggaatagcgagtctgtttgagagctatgcacagttagagacttattttagccttcagtttttttttaaacgaatcagtaagctgtcaatttcattaaatatagaagaagtaaactttaaaggtgagaaagaaaaaaatatcaaggctaaggaccttcggtacgagcaattaaaaagaaagccaactaccgagatctctcgtgccttccaagtaccatgatttggtattctgtttgattttagccagaaggctacctatgatcaatagctcttttcttgaaaggttctacggtttcttttattccagatttttcaggctaccaagagagttaatgtgcgcatggctttcttttctggagcaccttttgtatttgcgtcttttgtattttagccttcagttaagtcattcatgcagcgatatactagaggtatttccaattctccatgcatgcaagtttgataatgttgctgttcaaggatctatgttttttatgtttgtttaccgaccttcgtacacacaataaactacaaatagggcgaggtaagagtacctcaactagttagttttttatttaacctacccacaggatttaagttttggatttatcatgggtgctcatatttacaactagagtaaagcatacgggcggttagaggtgtgtcatctagttccctaaactctcaaaatgcatatccaagtctccctaaactctcaaaatgcatatccaagtcccaaaacttgtcatagtgtgtcatttaggtcccaaatcgtcacaatctcttcaggatcctacgtggtgttgatgtggcatgccacgcggacatgacatggcattaatttgactgacaaataggacccatttaattttttttcctttttctttttttccttctcttttccccctttattcttctttctctgtgacccgccacgcggacatgacatggcattaatttgactgacaaatgggacccatttaaattttttcctttttctttttttttccttctcttttcccctttattcttctttctctgtgacccgccacgcggacatgacatggcattaatttgattgacaaatgggacccatttaaattttttctttttctttttttccttctcttttcccctttattcttctttctctgtgacccgaggagaagaaaggaaaaaaagaagaatgagaagaaaacggaaaagaaaaggaaaaataaaagaagaagaaaaaataaaatgacacgtcacatccatgtggcatgtcacatcagcgccacgtaggatcctagaggggatgtgtcgatttaggacctagatgatacactttgacaagttctgggacccggatatgcattttgagagtttaaggacctatatgacacaaccctacaagactaaggaccgccaatgcactttactcttacaactaatatttgtttatgatgactttatcaacctcaagatttgatggcagagaagtttaaaaaataaatttaatatatatatagcaccgtattttgttctgaatggcattacaaattgaattacaatatcaacacaagtatcagtacatcttctggagtacttagcatcagaacaatctggtccatcaggagtatgacagattgttagctgaactcttctgaactaacatactgcctccggagtaacaaactgaattcttctagttctagagataagccatcaagaattttcatggcacatatgtactggaaacttccaagagaattggttagtgattatcaattcaagagaactgagtatagtaaacctcatgactgaatgtacttgtagttttgtctgttgtcattaagaactaaagaatgtactcctgttacatctctaccctatagttaaacaagtggttttactcattcatcatgtgacacatccaacgatcgaaaaaatctgatgagttgcatttgacggcatccgcgcctcctccacccgatcgcgcctctccctcacgcacctgccccattcccatccccacgcatcgccgcacacaccagcatccccattaggccattacgcatcgcgctgacgctgctccaccgctaccgccactagatccccgcacggcgccgacttccacatcatccgcggccgctgctgaccagcaccaccgctacgcatcgcgttgacgccgctccaccctctttcctttgcacgccttcctccccacatcgtcgtggctgcgcccccgtcctgtccgccgccgagttcgcccctcagggcagggcatagcaccctcgcccagatcggtgccgccactgacccaaaatatagatttcccgatcttcaaaaagaatgacggtgttgctcctactaacaatatctgagccatgtgaacaagattaattagaaggattaattagaaggagtattacagattaaataatgcgtttatattaaactatttttgggcttatatgttaatttcttgaatgcaaattaatatgtcgttttgctcttcgaaagaaaatagaacaacaaaaacatccggtgggatttttctatttatcactattgtactataaaatatcaccaaaacattagcacgggcaaattactagtgaatgtactcctgttacatgagaaatgattaaccaaattttgaatggtaaataagatcatgttcgtggaaatgatcagccaaattttgcgtatctaacactagaacggataccatcatctcaatcgggcggcaacccccatctcaatcgggcatggcgtccgtcataggctagaagtcattgatgtgaaaagttatctcaatcgggcaaacggccgtcacagatgaacctatatcaatcgggccataattaaagcccgtcaccgatagctttaacccagacgatcagtcaaactatagcccgtcacggatgactatctcaatcgggcctaaactacagcccgtcacagatgacccttatctgtgacggacattaactatagcctgtcacagatgagtcatctcaatcgggcctaagttaatgcccgtcacagatgagtataatcccaaaaaaaaaattatttttaggaatgccgtccaacctctcacgccagtcttttttgtccttactcgtgtgcacctgggatgagcttcccgattggtcacctatcccgaaattgctacaagccaagcacgcttaacatcaaatcaaagttctttggagatcggcatccgaaagagtagttgtaacttattgatgtgagtattctattaatcctattaagcccttggccaggatgtcacaccccaacatctctcattcatatacattcattcacatacacaatcatcaaaaatcctaaacaacaaaattgtataactcaccgagatctacaactattgtatcggtcctttctataaataagttcatttgaacaatttaaattttgaattttcaaaatttgacaacttcgaacaaaaattagggttaataaatgatttcaaatgaaaaagtcaccaaaaccaaagttgtagagctcattgagatgcaaaatttttattttggtctcttctccatctgactctatttaaacaatttgaaattcaaagtttgagaaattcaaatagaattttttgttagtgaacgactttaactgaaaaagtcatcaataacaaagttgtataactcatcaagatctataacttttatttttggtcatttttctatataacattttttgaaccgtttgaatttgaatttgaaaatatgacaacttcaaacaacattttcaaatactaaatgatttcaactgaaaaggttatcaacaacaaagttgaataactcatcaagatctaaaacttttattttggtcatttcttcatctataaaatgttagtaacattgttcacaaattttacatatatgttttatagtttataaaaccagataagagatatgtcaattttgtgaacaatgttactatcactttatcagatgaagggctgcaggaat

SEQ ID NO: 59422 - DNA, 1894 bp, Oryza sativa
gccccaacttaaggcccgtttgagatatggaatgttatctcaatcgggcctaaagttggtgtccgtcacggatgatggtcatctgtgacgggccccaacttcaggtccgtttgagatatggaatgttatctcaatcgggcctaaactacggctcgtcactgataggtgtcatccgtgacgggcttaatttttatgcacttctaatatgtctgtgcgaccatatctcaatcgggcacttttttggctcgattgagatgacttccttgtgacggcccgctatttccaggcatgttagaggccgtcaaagatagaaggatctgtactagtgtaaagaacaatttaagcatatatgtctagctctgtactccaaagagtatcccatttatgtcatgtgaccatgtcatgatactgcaaagagtatcatttattcattttgaactgtactcattacacattgtgttctctcagctactaaaacacctgtactgaatatatgaacaatgaagaatgctattcagttctttcttttctgcacaactcggaataactcagaatgctatagagttacactgttgcagttctgattcttaggaccataactcttaggagtaattcaagcacagaaactataaaacctgtttttttatgtacctcaacttggttctggaaggactgtagcataactgatgatctcatccaaacggagggcatttcctgtaacctgcagaaaagcgcagttgtatcttcttcttttttttttttaggagaacgacggcaggagatctgccggaattttaaattgagaagggtgaaaaacagagttttacaggggtacaaatctgaaaaggagagattacaacttatttcaagatacaaggattacggaggtttaaaaaccagaatacgaaggtcaatatcatgcttaatctgaagagctatagatagctcagggctagaggagttttggaaaattcttttatttcgctcaagccaaatgttctaccaagtagttagaagagcacccttgatcgatctcacttgctctttagaacccgcatgactaatttcggcccaccatgttgaaatatctgaaagaatagaagcgctggcagggccgaaattctgaaaacgacaaaccaggctccaaacttgtcggacgtaagggcattcattgaaaaggtggtttgtgtcttcgaacgcacaggtgcaaaggcagcaaatcagttgcatggccaatgcctatgcagcaagatttgggcagttaatgtttttttatggaactagccaaccaaaaaaatctcattttaggttctgtcggggccgtccaaagggagctgaagtcaattgaggcaaacgaaccttaaaattgaaagagatacgcactctttgaagagtacgatccagagcttgttaatttccaagagatgtcatccggttcttgagaaagagatacagattggagtaggccaccgagttggaccaattcgtgaagctcttcaacggaggtgaattggcgaaacgaggaaagccatttgttatcatttagttcgaattgtactgatctctactttcgctttgccaatctgaaacagtttggggcaaagtcttttaggcattgattttgcagccaattgtcgttccaaaaactcgtctttgctccattacctaccgagatggtggtggctgcttggaaaagcttcacatccaggccgtcacggggaagttccatgcctacccagggcttttcgtcctccttccatttaaaccacagccattgcaggcgtagggctcgtgaaaatctatccaaatctggtagaccagcccctcctaggtttttcggtctacaaacagtctgccagttaatcagactatcacccgggtttggggtgcagga

SEQ ID NO: 59423 - DNA, 1106 bp, Oryza sativa
atggatagtttgcaagtttaaagggtgagtagactggtagcaataggctggtcaggtcacatatgaagttatctgacataaacaggatatatccgggactcgacgaggagttgagatatatggagttaagccagaactgaagaaaaatcacaggcaactgcgggtgaaaatcgttgagggcatcaacgggctgtttggcagtataggatatatccaagatctgcggggtttacacgatggggatatatgaaatctgcgtcactgaagaggaagagcaagcgctatggcggtaattctttgggtgattcaaagcaatggtgaattttctcgaagtatcatcggttcagtctacaaatgcgggaaagcgtggatgttggatttattagctcggttcataagacgataaggaagaaagggttctcttcaagtctggcgagtttgatttatctatttggtgatggcatgggctatctagccatggataagatgaagtcaaatttaagacagtagatagagatgaacatggttttcggggagtctatgatgtggcagctaggaaggaatccaattttgattggcaatacgactgtgatgataggagagaaggtggagcattgttgtaggtggagtccagaggaagaaattattgggatagctgagtctctcgaaggtggtgggtctagcacaggctcgtcgggcggctcgtggtgaagctgcaaagaagacaacccaagtttggaggacaggtggattggcatggtgattctactacttctgggtggcgtatattcgtcaaggtggagttggttagaataggtgtcgaatatactgtaaaatcaaaggtgttttttattattattctgtgatgaacaattggcattggagattattggttttgatatttggaatttatttgcgaagtggttttggagatgattggatttttacaggtgatctacaggtactgctgtgatttgggtccggtcagaccgggcagtggtggccggtcagaccagcgtgtatggcgcggtcagactggccgactctgtgtcagtttaggtttcgggttgtttatttggatttccgtgattgtttcatatttatgg

SEQ ID NO: 59424 - DNA, 1627 bp, Oryza sativa
  unsure (1)..(1627): unsure at all n locations
ctcgaatatatcacaaaagcaatggaactcgttatctgtactaaagaacttatatgtgcagaccgactcaaatatgaaagatactctcggaatccaacacgcgattaaactcctccatgagttcaacaatgttacctagaagagacacgatcttataattaaataagaatagtttactggagttttataggctggagggagatttacttggtctaatatgcagttacagactgtgagaattgccttggacaaattttttgtttatagtacttgggaatagaagcatcatttaactgtggtgggttgtgttggatactagagagagatgggttagcttcaacatgagtgtttttagaacatttaaaaaagatgatgtggcatataaagggataagttgatttctgttatttactgatgccttttcttaaaaagtgacttagcggctggttaaaaggtggcttagcggctggggagcaaataaggttagtaagttcagggaaaaaaagtaaggtgttagaacagaaattgggggagattgatagcagagctgaggagagagatctttttgaacatgagtagaaaaagaggtggaaagcatttatttgcaagaataaatttggtggcagaagagatgtggggagaaatggctgctacaaggtgatgctaatacttctttttttcatgaagtagctgatgggggactcagaaaaagacacattttctctttgcaatcatggagtagctgatgggggactcagaaaaagacacattttctctttgcaaagtggggattaaacaatttgtgagtttaaggatatacaggagcatgtgtatagttactataagaaactttttggtaaggaagagtgcagaaatgtacatttggggtttctctttgcaaagtggggatcaaacaatttctgagtttaaggatatactggagcatgtgtatagttactataagaactttttggtaaggaagagtgcagaaatgtacatttggggaatgtttggagtgcttttgttagattaactgatgctgaaaaggaaaacatgatcagaccttctctcttgagaaactagacaaaaatataaaggagatganagctaatacttcccctgggcttgatggcttcccagtggggttttataaggactgaatttggagggttaatcaaggaaatgttggatgatttacatgtgggctctctcaacactgataggataaactatggtgtgatatttttattgccaaaggttgttgaggctaaaaccatcaaacaatataggcctatctgtttgcagaatgttattttgaaaatcttgacaaagacaatcaatggactcaaacaacattcattcctgggaggaatattcttgagcggtgtgtcatcctgcataagttgcaaagagagggtgacatggggattatctttaagattgattttgacaaggcatatgatagagttaattggaactttttgtatgaggtgatgagaaagaagaattttagtgattagtttattggttgggtgaaaaagataacagaaggtggcagagtgagtatcaatatccctttttttaagacccatagagggcttaggcagggggaccctttgtcccctct

SEQ ID NO: 59425 - DNA, 1938 bp, Oryza sativa
aacgttttttataaaaaaacaagtatacttctaatatatacacatgtacacatatttgtacacctaaattctcaattttttgatccaaacacagcccaacttgtctcttacgatgccttcaaccaacccgacccactccgtcatgacccatcagacatcagttgacccacttagccaccactcttccagacagccccctctcgctctccctccttgacccatccctccctggctcggctccctcgcgccactccccatttgcaaaccctaggtggcggtgcggcaagacggcaatcggcagcgggagctggaccgtgctaccgcggagggggaggccattgccacggcgggcggcgcccgacactccgccaagctaaggcggtcaggtcggttgggtggccagcggccgcgaggggcaaggacaggcaacggctcagagcttagacgggaatacccaactttgaaatcctggctccgccactgggtctgaccaccctgccggcccgatccaaccgatatacacgcacctctgttacacgcttcaaccaagccttctgtctcgacgaccagcaatatgatttaagcctgcgtgccaaaagttgctcgacgttgaagtgccctttgctgtcgagcgctgtctcgtttccttgatccttctacgtccaaagtccgagttgaatatcaaccgacttctcccttgtcacctcgtatatatcaggggcggagacatgcctagggcagctagagctcgagccagtggcggatccagaaaattgattcattggtgtcataacgtgtctatcggtgtcatagtacactaattatgcttagaatatgatgttgtaatatatgaataagtagttttgctataggttttattgaaattcgtcagtgtcgcctgacaccgatgactatactgttgatccgcccctggcttgagccctaggcctgcctctaaaaacttgcttaaattttgttgattcaccatgtaattttttcagaaaactaatactcaattagtcgagccatatcttaactctagtcttatataatttctggctccgccattgtatatatcgtgtactaacatgtatatatcgtgtactacgatgaagaatctgttacggactcctctccaaacagcacccaaactcaagtctgactagctcgtaaacaacttttgcacggtcattaatctctgtgatgtctcctcgttgcaaagtctctcccatctacggcttgctgccttgctgtatgcaagtccgtatcagctcgtgcttgcatgcgtactgcacccaagccacgtaatcaatgcttttgaccaagcacatgcccaatacaccaattaatttgcatgcagcccgtagtttttgtttgtttactttgcatatttacttgcttgattcgtcgcatgcatctcatgtgcgcgtgtagcacgtacacatacatgcttgttcgtgcctctgcacacaccgcagtcagagtcctcgtgttcaccgtccacgaccctatcgtcccggccctccacgtccactgcgccgcaccacgctcgctggcttcgccacgtgggtcgggcacgttgtccatggcgttacccctccgatctctccgaacgccttcggccacgttcggccccgtcttccgatcatgttccgccatcgccggtctgatcgcgagtgaggtcgtcgccgccgcaacgtcctcgttgtcaccgtcaatctcatcgccacggctgacgacctcgtgtttcctgctccacttgtcttcttgatgcaatgctgaaaccttctgctctgatactacttgttaaagtgcgcagcccggcccaccaaccgtaggccaccaggtcacattgagcctgctccaccacaggcccaaccggagccataactttaggtcctaggtctacacaacccaaaaaactagtttgatgggtga

SEQ ID NO: 59426 - DNA, 11813 bp, Oryza sativa
tgcccgtaggtattcaaaatctccctcacctgaagtttgaaccaagggaactgctcttttgaactcttttgttagctctgttctgtagataacaagctattcaatcatgtttcaaagatccccttaacatatatcatccccttctcactgaacttgagctccttcctcatctgctccacttggacatcatcaccccgcacaagaatttcggatacattcccgtcatccgataaaatcattttgaccttgatctcttcttttcttgatgcctttgtccagtagtatacacccctgaaccatcaagaagggacaggttactacatttgacctggaaatttcattctaaatttctgctatagagttgcagagacatacgccaatgggcttaaggtcataagccagaaccagttgttgccaccctccgggactgcaattgatagaacaagaccgacgctgccaaggctaatgcaggtgcagaaggtaagaagtgctgcttgccccctgctcggcaccatagtgccctcaaaactgcgcaaaaaacataaatcgtgcctcattttgcattgcattttgatgtgaaacaaaatgcataagcttatgctagatatgcactatataaacaacatgggcagctttacactgtacttctctacggtaccagggcaaaactaataaatacaactgctatactagtttgggtttccattctattacaacttccaagtaacttgtgagtatcagaattaatgtaattctagcgtaaagcattgttaagtagaaaatattacttgttcatatctttgcttcaatcaagttctgtgtttgaatcaccaaattactatgattgttgttatggtggagatcactgtgaacctaaaggtacaacccacaacatttggattgcaagaagaataaagaagcacattaacacagctggtgtatgtgtaaaactgttgtacaaagtcccaatggtattgtcacaccgtgctaaaagtatagtccaaaggttatcctgtacttctgcatatcatagtcataactcagtagattactgcattaggatagaaatccgatctggctacttacgtgataacctcgccacggtcagagatggtgaagttgttacgggtgaagaacgagaggatctccccagccacctggttcggcgccatcgtctgcccttcctccttgacgaatgtcttctgcacaacctgcactagccaatttgacatagatgacaaccacacactattggtggacatcatgcgaacagctcaaaccgtcagaatgaaaggtaaccacaatggttcacgattggtggatggaactagcaaacactaatttactagtaccaaaaaaaggaattcgcacactaatccacagcacatctcgcttatgctgctgtagtgtttttacttctcgtacaacttttttatacttgtatatataacttttactcttcatgttttgaatgagactagcatgtctaatgccggttaaaaaaaaaggcaaaccacacaaccatgctactgttttcagcaacgaactaaacaacatcacctaaagaccgcacaattcagagaaccagcagccaaacataactaagtcaccatgaaatttctctattcgcatcattgactagacagatttataaaaaaggacgcaacgattttgatacagcaaagcagtcatgaatccctattggatttaatggtggttcttgcactgacaagaacactctgcaaagaagaacttgaaggaagtgaaaaagcaaagcacactcagccactcgttgagctatctacagaagcagcagtcacctccaaagaaaggaggaaggaagacagccatggtccaatgcgaagagctctcgaggctcgagcgcgcgcatggcgacgggcatcgccaacactcgtcagagcgagatggaggaagcagcagaggtggagagccgtaccttggacttgacggagcgcttgatgagcgaccagaggccagggacggagagcacgaagagccccagcgacgtgtagtagctcgcctgcgagtaccccgtcgccccggccaccgccgcgtccaggagcacggcggcggcggccgcgccgccgctgctgtcgacgagcgacgcgcggggcgggacgacggcgcggcgggccctcgcccgtctcggcacggcaccgcgccaccggcccccaccaccggccgccgccgccgcgccgccggcgagcgacggcggcggcgcgcggagaggcgggaggaggaggcgggtcgcggcggcggtggcttccatttgggtcgcgggagataaggccggggaaagtgtattcggcgatgtgttgatttcggttggagtgggcccacatgtaagtgggctgtgggccaggagttcgatgttgggaggaggaggataggacacgtggtagaacaagtgcgcttggttttttttttcttttcggacaaaaagaaatttatggcagttcaaaacaattccgaatttttgtagttagagaaaaccattgcctatgaaatactcctccgttctataatttaagggattttctcaatcaaatttgtctaataaaatcataagacagtattatattcttcacctaccaacttttatactagtttgtttctctaccatctcacatctacaaacttttatagtaccttattctttcacccattgccttgtgtcacatcagatatccttttactacttccttaatttttaccaaaaaagagtataattccttttattcacggatgaagagagtataagcttgcttttatactgcatatgataaaaaaaacctcgtttaaaatcagtacaatgtaaaatgtgttgatccaaaaacagacctgggagatctgcttaactccagtgcaggaccaaaggttggtgagatacggacgtgccagtcagtttgaccctgcaacaaacaagatatgatgagccggtcggctgacaagccaatggagtaattacagccgatgccgataccagccgatgttcgatagggttttgagcaatcggctatatgtatgtagataatgatataaagtcgatccgatgatgatgataaataacaataatataatccaatagaaaccaatcggctaataatgatatgatagataaacatcgatccgaaggttaaagcatacatcggctggaggcccgatgtcataaaatccacaagattagattaaacagtgaaacctttattgtcatcggctagatccgacttatatgtatatgcaatccttataagccaatgcaacgtctaaataacttatcggctagtaccccgataaaacattagcatgaacctatcggcttaacaagacttatattatcaacaacaatctagtagcacaaaattgtatatgattatctaatactcgatgagccgatagatctatctaatgtgatggatataacaaatctatttaggacaacattgtgattgtagagatatatcggctaagacagaagatcggacctaatcgagacagtcccaactaaaccgatgcgtctttaaatacaatgcaattagagatagaattgagatatcacgtaggcaaatatatcaactaaaccagagcgatccaagagatcgaagcgatgcagccttgaacaacaccaacatagccgatagattcatcagggccggcggaacgtaggacttaccccttcgccggagatcaaactgaaccgatgcagccccgcgtcaggtgccaaattccatcggatgataagtaaaaaccttaggaaagagggtggcgatgcgtcgagagtagttgtattgatcgagagataaattacaatgaccctgggtgtacatatttatacacatgggaagatactagtccttgtaggacaagaaagaaacttttctaaacataaaaggaaaatataaagttcttacactaaacacactttcctaaaaataaaggaaactacttcctccgtttcacaatgtaagtcattttagcatttcccacattcaaattgatgttaatgaatctagacatatatatctatatagatttattaaaatcaatatgaatgtggaaaatgctagaatgacttactttgtgaaacggagggagtaacaaactgtcagggttatggataccacatacctaatagtagttgactaaatctcggcaggatccaccacataccatatcttatacggaaacaaccttcggatagggatggagttccggataaggaaagacaacaagagttctacatggaaacgacaaggactactcagattgtgtccatattggttttcctagttctacttggacaaggggacacctatgggtataaatacaaggccccctaggaggagaggggatacggacaacatggaacaacagaagccacaacatacaagccaacatacgccaagacaagacgccggatatcgacttcagagataggcatggctagtcccctgcggtgcctacggataccgtcaggagagatatagcgttgtctctgatctcgccggatgcggattcgaggaggaaagctaccctgttgtcgactacgagtcagaccttcagaccgccatgtcgacaacagttagataggctaccccaaatattgtactggtgtgattatgatgaataagagcaacgaccggcttcggccaacatgatgtagggttattacctgacaattcaggagcccgaacctatataaaaatcctcgtctctgtctcctttactacaatctcgcatatatcctagtaccaacgatccccgtactatgtaaataccagaatcgcgacatcaaacgtcgacacaaactattcctaataacctaattaatagataacttgccatgccgcatcctccgtgaacttggactcttctggataaatttcctttaattgatccgactccatcaagaatacaactgctggcgatttgacaactcctatcggccgattccaaggctttgaagccgatactgactctaggccgatgataacttcgggcttatcaaattttggcgttaacaaagctatacttgtgttctaaccttttctcatatgatccatatgaaatgttttattagtctctctattttcttaatacatgatataattttagaaccactcatcttatttaaaaaattatgtaaatataagacgaatgattaaacatatgtcaaaatcaacagcgtcatctattaagaaaataaaatatattttatattttttacccggcctttatgtccaaccagatatatgcagccatttaaattgggtacttagcctcttaaacaatctaatctaacataatctgaaattcgctcatatggatatttgaacttagaaccttgggatgaagatatagaggataatgaagatagtatatctttatgtcataaaatctatgtggaatttagttatatatcaacaagccattgttgatcaattgattaatattatcaatttggttctgtattgttttgtaaaatagttgaaattaggtgattctgaatattcaaccataaaactcatagttatatcacaacaagttataacatctgatatttttcatacctcaattgtacagcccaaggttctccgaagttcactctataatttatttcaaaacataataagaacgcaggctctattgctctaatgtagacatgaattatcattagctttgatatgctttttaataggtatggatttaggttaaaacaactcctttaccttttgtcgagccaatcctatatatgtacttgaattcttgttcgagagtttttatcgagggaattcatgtgaagataatagcatttactttttatatcgagccaatccttagtacgtacttgagtcagatattagcatttagttttgtaagtggtcaacttgtacccttaagagcacctaagaaccaggatattactccctccatgttttaatgtatgatatcgttaactttttttttatgatatgttcgactatttatttttctcaaaagaaaattatgtaattatcatttattttactgtgatttgatttatcatcaaatattcttttaaatatgacgcaaatattttttctatttgtataaaaattttaataaataaaataaatagtcaaacgttagttaaaaagtcaatgaggttatatatttattaaaatacctggagagtaataatttttcacgctcgtataccggccggtctctctcctattcttgctcgattctttctataaatcagttaatatggatgagatgataaagccgtgcctatatactcacaccttagaattaatctattaattaatacgttattaagcctaattgacgccggcggccacaaggggaacaacgacgacgtcaagccggaagtgttcggcttcggcggcggcgacactctcgccggaggaggcggtcgcgatggcgtggctgccgttcgatggccggccgcacatcgggctcgtcgtctacgacgacgcgcgcaacacggcggtcctggtgcgccgaggagggttcacggccggctcgctgccgctaccgttgccagcggcgcaggccgcggcggcggaggaggagggagtcgtcgtcggcggcggtggtggcggcggcggcgcgcgcgtccgctactgccactgcggcgtggagagccgggagaaggaggtgcggaggccggggccgacgcaggggcggcacttcttcggctgcggcaggtggacggcggcgagaggggcggcgtgcgattactatgtgtgggacgaggccgcgccgtcgacttttggtctcaactctcaaccaagtccaccacgtgaatagcagatggcgatgatgatccatctcgattgataatggcaaacaataataatgtcgattagttcatcattccacacaccattgttttttttattaatagttgctgtgttcaccagtaatccaagactacgttatccagatacggggatacggatatgcgatacggggatacgaggatactgcattttcttaaaaacaccgatacggggatacgtcaatatatatttaaaataataaatatatagaggtaaataattatgaggctgtaaatagagatagccaatacatgacatcaattgatcaatacaccaaatttttttagtacaggctcaccttagagctcccatgtctggtcgctagtactactaatgaatctgcaaagtgcagccgcatagccacgctagcagtagcagtacgtacgagtgctagagatgcactgccacttccaaaactcattggatttaggagaggagagaacacttagcactaagatgagatggggaaacacgcaagaaatgcagatcgagacttcaatgggaaagaaccaagtagcttggtggcgtactgatggtgttggtcttggcggccagtggagatgctgcacccggtggaggagatgaggcgaccggcggtggccctgcgcagctgcgctcaggggcggcgacgcgcgaggcgctcgagctcgattgcgggctggttgggaccctgcggcttggttggcgatgcggcggcggaacccgacagctagcggaggactcacgcctcgggcatggatgcggcgatggggaggacgtggcccgtgggaactgcatcagggattggagcaatagcaggcggcacggcgacggattggatcggcgcttcgtcttccatggatgggtttgggcgtatcaggagcgacgggaggggacgtatcaacgaagtatccgatttaatttattttttcgaaaatcgaagtaaataacgatacgtacgggatacgtatcggagcgtatccgatacggatacgtggcttttcagccgtatctgggtaacatagatccaaacatctgctaaaagcatttgtctagcgtagatggtgccaagtttgtcgtagcaatgccataccaggacggatccaagacagggagactcatctcctttttttcttcggccctcttcaatgatgatccagcagggagttcctaagctggatccacccttaatatcataattcacacatggaagttcctttgttttggctaccttccctaggtattctttccacagaaaatgcgttcttttggtttggctaattcctcaatttatataagcatacttttcaaactgctaaacggtgttttccatatgaaaacttacatagaaattgctttaaaaattcaaataaatgtatttttgatgtttttaataattaatactcaattgattatatactaaaagtttatatgttgttgcgtgcggctaatcatccgtttcaaaatgaactttagaataggtcctttaagtcgcccccaactttgggggctatttttaatacaaagatgaagtacactactaaaaagggttttttttcatgtggctaaatcatattttcataggcggagcccccaagtgtttgtgaaaaaaggaatttttgcaggcaggtagcacaacaacttgcaaaaagtattttcgcgggcgggtgttatgtcgtccgcgagcaaaaacaaaaatcgcaaaaaaaaaagctttttgaaaccctagttcaaatccaccctagtcgttgtcagatccgcgagggaggtggtaaccactgttggatccatgaggcagagggttgttgccatcgttgtcgatgcaatctgccgccgttgtcgtcgtcattgagacctcatctcacccgaggttgacggtggcggatccgtgagggagagggccactgtcgtcatcgtcgatgcagtccaccgtcgcatcgtcgagaccctgctgcacctaaggccagtggcgcagatccgctactcccgaggtaactgccatcagatccacgagggagaggtccgctaccaccagacctgtgaggggagccggtctctcccgatgcggcggagacgccctatggaggctaaaaaaatcatgagatacacttgctcaaaaaaatttacatatatatgatacttgaccaaaattattaagcatgtgacatgtcatcatttatatgcaatctgtacacaatagttgagcattgttttatctccaataatggatcaaataaatttatacgaatcttttttatccaggtaacacatactctttatatatttcttgctaacaaacaaacactaggatacaaattggtattaccatgaactattgtcctgtgattggtgcaaatcagtaagcaactactactaagcactgagatgcaagaatgtacctttcttgcaggctggcactctgaggagaacaaatcaaggatgctccgctgcttgacggagattagccccagccacattgctggcaacgccggacggcctgctcactaagccgttccgctgccgcgcgctgctccgctcgaggctggccgcgggcatcaccgtcggccactggccgcgcctctctgcccgtccagcgcgccgctggctgcgcctcttcgcctgccccgcgcgccgctccccacgcttctccagcgcgccgctagatccgccgctgccagcgcccgccaaaccgctgccccacgctccggtgaggaccccggcagacccctcaaaactgcgctcaacgagtaggagcaccacggcgctccagtgatgctcgcgacgatgacggaggagccgcacagcggcggcggaggttgagattggagtcgccaggagaggactgcggtatgggctcaagtgggaaggttgacggcctgttaggttagtttctttagaggatataaacgtgatatataaaataatatgaaacatctaataaacatatcatttgtagctcagtggtttgcacaccgcccctgaaacagaaggttgtgggtttgactcccatggccaacatttttttaagaaattttgctgagtaacgggttggcccatttcggggacgatgctgttgggctagcaccaggttggcccatctgtgggtgcagataggcggttcattacacacaatagatggcctgtttaggcttctataggtagcccaattagaacggaaaaacagattattaaaagaaaaaatgaaaataaaatctgatgtggcagtaaggcttgcctacatggacaaaagtatttaaaatagtacaataaataatttgtaacacacaaatacgtcttatgacatactaaatattgtcacttgatgacaatagactagctatatgacatttattgtgacacacaactttttattgtcattaagttgaaatgcctgaaataaaatgtcataaattatatgatatagtgacattatgacatgtgtcatattaaatacgtcaaaaagccacgcatatcttgtagtgacgttgttgccttggacccactgctgtcggagctgcagtccatcggcctcctcatgcacctccacgaacttgtagagtgagagaggatgaggagcagaggactcacccagcggcgattctcccatcgacctcaggtgaggagaggagtgggggtgagaagagaggagaggaggcattggaggagggggagaggaaagaagaaagggatgggacagctcttgtgccaagcggatatcttaagatggccacatgcaagaatcaatttttccatgcgggacttaactgaacatcatctaattttttttacatgccgacgttcttttagcccgcctacaataaatagggttgcgtctagaaaaaccgtttttaaagtagtggtagcaaacttcatattcttttttttttcgaggtcatactttttaattcgatgaccttgtatgcataaaatctttctattgtttgttcagtatagccaatatgtataaccgacgcaaaagtatatacattaacctccgtatcatagtgtagcaaaatctattatcggctagtatactgcatgatattgttgtgtgaaaacgaatcattagtgatattgttgacagttgcaaatagcaagagaacatatgcagtcatgagtcataagggaatatatataaattccttttaaaaactaaaggtacagaaaatgaattcaaaatgtttggggacctcaaaaagtgcgtcataccgtgtcgttcttgagtcacgcgcgcatagtttccgaaagatatttgaccagaaattaacgctgctgatgcgaggtcaaaattctcgtctacctgattcttttcagatttccaggcaattgccggggaaaatctgaaagcatccttacttaaatcagcgtacttgatggtgaatttacaccaaacaattttgattttttgagcgaaaggtaatttgtgtagctgcttgatcagcttacactctcttgaagtttctatatgaataccgcggcggcgcgcggaggcgatggcgttgccggcgtccagctccaggagttcgcctacttcgtggtcatcgacttggaggcgacgtgcgagagggggaggaggatatacccgcaggagatcatcgagttcgcctccgtcgtcgtcgacggcgccaccggcgagcagctggcggaggcgttccgggcgtacgtccggccgttgcaccaccgggagctcaccgattactgccgggagctcaccggcatcgcgcaggccgacgtcgacgccggcgtggacctccgcgaggcgctgcgcgcgcacgacgcgtggctggacgcgaggggcgtcaagaacgccgccggcggcggcggcggcggaggagggttcgccgtggtgacgtggggcgactgggactgccgcaccatgctggagggggagtgccggttcaaggggatcatcggcgacggcaagccggagtacttcgaccggtggatcaacctcaaggtcccctt

SEQ ID NO: 59427 - DNA, 8263 bp, Oryza sativa
acgttgatatgtctcgagcaaatccacggccatagctcatttcgtatttaataataataataataataataataataataataataataataataataataatgtttttgtgctaataacttggacgagctatcagcctatcacgctgtggctttgtaactgtgtcgcagatttacgaaagttttacacttaccgaaggcgactacagacctgtgggtttggcattggtctacttgagttgagctatgagtgccctcatgaaaaaaaaataaattacgtcactttgaattgggacactatcgaatcactagctctacaatggaggtcacgatgtagtattttggtagcttttaaaaaataaattatactatagtaagttaaaattaaatttaaaattttgactgcggaaggtaggaggaagagcaactgaagggttgtctacataaggggacataaggaagatggcaaaatttgttacatggcatttaaaatatatagttttgttgccagacaccccaaaaacatgaatttgcccaataacactttaaaaatgtggcattttaccctaggacacgtatgcattaaaatataatatacatctcattgatgagagagaaaacatgcaaaatgttagttttaccccctatcttctcccccattctcacagtcatcttccggcaataggacgacgagatccctgcgtagcacctgtgggcaataggacggaggacgagatgcccggtgggcgacgatgcacctgacacggctcaaggtgtggtaaatggtgagcaaggtggtgcggcaaagaggacgggtggaattatgacgtgcggagggtgaacaagcggacgctcagagagcacctgtcgtcaggtgatggcgagacgctcgcatcgtgtgaaggccaccggcgatggtcgagtgcatggtgtgcccatgcctggagaagatgggctacaacctcaacaaatcgtgccttgtcttctgctccaccagcgctgcccttcgccgtctctgctgcagatggcacggatgaccttgttccccgtagcggtatgtggcacagctcgaagctaccggccctgctgcctatggtggctagcagatcgggagcaacacggtaaaaaaaaaaaggtggcagccccctagggggcgacggcagcggaagcggtgagcggcagtcctaggtcgcccgctctgataccatgttggatagcatagagacgagaggaatactgcataacgtggatctattgtattgagtcaggggaccggtatatataagagtacttagggaggagataaggaaggattacacatatggaaggagtccacacaaatcaatcatatcctaatatgactctaactaccatatactctaacactcacctctagcaacggctgtccgggacccacgcccgctcctccctcctccaccgacgacacaatcccaatctccaaacctctccccctgcccccccaatctccatggtgaagaagagagggcaacagtgccattttgttaaattctctctctggctcgaatgaaaataatagtttaatggtgttagtgtccagcagcaaattattcttgagcaaattgacgttcctatggtgtctaccaacaaagatcactatagtgcgtgtttgctgctatgaatgtactaaaatcttctatctactaattattattttatcttggtttctattgacgatatgtcctattgtcctgtagaaattgacatgcttcactttgcaatttttaccatcatactttctattagtcctgccccatgttatgtgcttttggttttgttgtctatccgatcatggccgagactcgagaggtgaattgttcaagatcgattcattaggattaattaggagtgtttttaaactgttggtggtttgttgtattgcacataggttgctcatgaatctttgtgtaactagcgggcattttgttaattggagaattagtgataattttgttgatggcgggtgaatccgtcgccaacgaccatggggacgatggcggtgggccttgggcaaggcggcggcgacggcggcggtggcggcaacggtctcccagccttgggcgtctggatccgtcaccggcgaccgcggggacaacggcgatgggcctcgggcaggccggcagcggtggtggcggctggattagggttccaagacggcttttgattttcacgtgtgggtgcttcacttgcacgaaaaaatcggattttcacagatacttcgttccagacaggcgaaagatccgcacgcgaaaaccgcttttgaccgcatggaaaaatcattattgtactagtgtgcgtacgaagcaaactgggattgaaaatgtgatgccatgaatgcaatttaaattgaaacgatttaggatgatactttttttaataagtattcaaagacgaaaccaatttgattcagtatgagtggtacttggtctttcatttgtaataatcaactatatatactaattcccaaaaattttagtctaaactttgtggagttgacacctccaagaccattcttatgggtaaaaaagataagatgtgttacgaagataaaggttttcatgtggctcatattctgtaataggctaaatacgagaaatatgcttgatagaaaatattatccttaagaagatgcgaccttttatgagtgatttgctttagtacagaaaaagaaactcccatacaactttttcttttcttgtccttgcagcagaaattgttgggagagaattggtacaaaaatgaatgataacctagaactctttcacatgttggtcttggcaagaattagattcataagaaaggaaaaatgtttattgcaggcatatctgaaaataaagaaataggaagatctttgagaatattactcatggaatggaagtctttctttgtccaagatgaatgactctcttagctccctgaattcttcttggttacaatggttataattttatttcttttattcttttcttgtttgtacataactttttttaatatatataacaaataggcaaggtctggtagttattttttttaataaaaaggaaagtgaaaaggaaaggtaagagaatggacaatagtgtgacgtcagcatttgagagaaaatgccacatacaaatttttgatgcggaggaaagaaaagtaggatataggaggatgtcgtcatatataataactagagaataccccgcgtgttctccgggattccgagtcttaatgcaagttgctgtggaattccactataaatagtctccctttgtcccatatttcttgtcttccagatttagggcttcacactgacaccataatttacaatggtaaatcgataattttgtggttgcatttagtttagtaccaaatattgataatgtttatggaaattggtgacatcacatttattccatcatatcaaaacttaaacaattttatcaacttaccaaaaattttgatttgactaaattttaaaaaggtttattttggtagtaataatcttaaacatgtcctcgctaaagattgggggagacgtggagtacataggagtatgttccagtctttaggtgtgattgctttaagattggtgacgccacgtgtcaagattgtagaacgggcgtggggttcaagtgcctctccccaacaggagtacctcgtcggcgacctgcggcggcggcgatgtcggcggcggcggcggaggccaccgagcggggcgagccctcgggcggaggcggagagatcgcgtacgtcagctacggcggggagcaccacctcccgctggtgatgtcgctggtggacgaggagctcagcgagccctactccatcttcacctaccgctacttcgtctacctctggccccagctcaccttcctcgtacgccctctcctcccctcacctcgcgcgcgtgtttcacaagagttcgtgaggatttgatgcgttcttggttgatttgatttgggggacaacccctcaaaaggcgttcgatcccaaggatggcaagtgcgtggggacggtggtgtgcaagatgggggagcacaggggggccttcagggggtacatcgccatgctcgtcgtgctcaagccctaccgcggcaggggaatcggtgagccctccttcgattctccaagaagagtttctctgtttgtttgattggttgattgactggtttgtttcaaaagggagcatattcttccctttgatagtatctgcacaagtctgtcctgaaaggaagcgtagaccactcatgaatctaaataagaacttaagaatcctgctgattgggaggaaagcaaagggtttttcagtttttgttccaattcgatctgaaatggctggcacctggtggagtggtgggcgatttagtacggatttacaatcttccatcgatttcgatatgatatccatatgtactaaataggtgtttttcccttgttatgcttgcacaaacttaattgagtatcacttttacatgtgtcaagaaattactagctataggtcttataagtctaatttgtttcatgatcctttcacactaccatttacttgttttttctctgtaatagttgctttgtgttgatatggtattatttttgtcttaacatcagcaagtgaaatatgtctgtgtagcagagtggaacgaaaactagcttactaagtgttactggttttctaaaaacgatgccatgttaagtatttagtaggatttctttgttctttgcctgcttgatttgcagaaaggaaaggcatttttttatttcttttatgggtacaatagccttctattgttcccttctcttaaactatataatcttctctcatcagtttcaattgagatttgtgctattattttgataaaatgttagttaactttgtttaggtggttttctagttttgtgtaggagtaggtattgtgttatgaaccaatattcccatgtttagttttccctgtgacagatgtctcgtgttgggtgcttcagcgattcagtctgtggcacatgagagcattttggtcgattagttctttatggttggagccatttagcacttcatctgatgttgtagtatgcagcctaaccttatcgttacatcaacttcttgcatgagatgatttcttcttagtgtcatacacttggaagcgtgctgactataattgatgtagcaataaataggtgtggtgcgacttgctaatgcatatatcctgtgtggggagtacatttttcataatacttttatcatgaaatgcacactgatatttacatatatcttggtacaatggtacagatagtctgtttatctgaaaaacattgcctttgttgtttctgtaatgacattcgcagcaaggatcttgacagctttaattgttgaatcctgcctgacatgaatgacctttctcgatgtatgaatagagtatatggtagctttgtcatctgttaagagtattgcgaaagctccagcttcagttcgaatagctttcctgaagtatacaagtgctttgcttttgcaaatggtccccatttgtcttttttaattttatctgtaataagcaattaaatggacactatgttggcctttatcagctaaccctctgtttcttcatggtacagccaccgaattggttacgagatctattcgggtaatgatggaatctggctgtgaggaggtaatcaccactgtgttgttatcttctcacccgatgaaaaacttattattatcctattgtcgttttggtacccatcacttgactttcttggtgtaaaattgcttcattgattattcaattatgccctagactaatctgcaatttccataataacaataatatctttcgtgaaattagtacaaaaattgaattatttgatatctgactcactctccaaccaggtgacacttgaagcagaagttacgaacaagggcgccctcgccttatatggtcgtttgggtttcatccgagcaaagaggctgtacagatactatctgaatggcgtcgacgcatttcgcctgaagctgctatttcctcgccctgatcctggtatgcatccaatgatgatgctaggcaatgagagagatgaccagcacatggattctccttacttgtgataccattctggtcgattgataggatgagttaggatccaaggcattttgctcttttatgtcagtttgatgatgcttttgtagctttgctgtaactcttgtaacattgatgtgttcaaagatagtatcttatttgacatggcattatgtttctttcaatccatgttagacggttgaaaaagaatgccttattacatactccctccgtttctaaatattttacatcattgactttttagcatatgtttgaccattcgtcttatttaaaaacttttgtgaaatatgtaaaactatatgtatacataaaagtatatttaacaatgaatcaaatgataggaaaagaattaataattacttaaattttttgaataagacgaacggtcaaacatatttaaaaaaatcaacggcgtcaaatatttagaaacggagggagtatatttcattacttggcactaggaagaagagtagttggggtatgaatttgtataccgtttcgaatatttcgatccatttcctaaatttatggattcattgatcttactggctaacccctgcatatgcggatatgccacacatcagcatctacccaactacaaactgcaagattcttcatattcattatgagcctaaaagtccttgcaaaacagttaagcctagaagttactatattataattcattttgatttttttcccacggcaaacttatttagttttgatcaaatttatagaaaaatatagcaatattttaaacataaaaacaaaaggccatcaaaatatattcagtgttatatttactaaaattaatttggtgctataaatatttctatagttttctataaacttgatcaaaggtactatcaagaagtttgacttaaataagtcaaagcaacttataatataaacaaggagtatttacatataatcttggctcacacatgcagctacataggatgccaccaatctagccaagctacatgtaggagacgaatcactctaataccttatgcacaaaaattacatgataaaattatatggggaggttatggccaccatcgatgatacgggatcgctagtgcatccggtggcatatgtgaagctcaggaggatgaagaagcagcagcacttggtctgagaataacattgttagcagaaacatcagttggccatggagtaatcactggtatgctggtggtgctgcgacagcatatactgacggagcagcagccacattgtttccatcacaggatgctgtgttccctgggtaggagtagatcgccgaggaagctccataacagtagtaggttcaggtgcatgagtgatgtaagtggctgcctgctcgaattggctcccctcagatgaatgtgccgcagctccaatcacactgcttggcatagacccataattcctaacgagttgtaagtttgtcatagctgccccagttgctgaagcacttggagtagccccagaattacaaactagttctgagtttgtcgcagctgcctcaggtgctgcggttgcaccacttggaatggacccataatggctaataggttgcaagtttgtcgtggccgcctcatgctctgtaccgtaggtaattctgaaattgaagacagtagcaaggaacaagtaagacttccaagtagctgcaagtaatgttctttcagattttagacaaaatcgcaaattatggttctctattgcgcctgcaggctgcaagtatcagttcattaagtttttcaaactatgtccagtaactgaacaacatagttttgagacatcaatgttgtcagcattggcctacacgctaaacataatttaattcggttcggagaaacagccaacacattataaaattgacaaacaggaagtactagaaccataaacgcgtacctctcagatgtagttcctaagtagtgtgatcttggaggatcaactgggtgcatgccaatttggtgggcggcataatatggggcagtatagtagccagtagccgaaacatgatcagaaagagattgttggccatagagattgttggccatagagatattgttggctgagggcaatgaactatatgctgtgtgcgctgcttgatatggatactcagctgttgacatatggtaaggaggtgtaatgaactgcatg

SEQ ID NO: 59428 - DNA, 1729 bp, Oryza sativa
tcaggcctcaaaatccaaacatgattgaaattcacatgtgagtatgtcacacaagatttcagaaggaatatgttttaaggtctttataaaaattaagattgggtccaatttgtttcatcttcacactgatcataatatcaacaaatggtgattcaaccttacctgcacaagggtaagttctgggctgaacttcccattggaataattctcttttatagcagttcttaggctactctctgggataggcatgaaatcaccatcaactgtaaatttaacctgcacaaataaaatgaacataagtggtcactgatatttctatatcgagaataaaatacagctaactaatgaaattttattattaggattcgttaaaatattttaattcgatagtaaacatcacaaaacgtgaggtaggaggaacacaaatgtcaggaaaatactaatagcagacaaattagttcatgtcaggggggctcctaacatgtctgcctctctggctcctaaaagagataaagttgtggaaacatgtgccattcattgcatctgtaattagttctggtgaagagaatgttaggcctctctcagggcccatatgttcaccacataaggtaaatgctaaaaaggaaaaaaatatcttgatttaatccttaatgttagatcttgcagtcctaaattacaataggccagcatgattttgctgcactatatcagtttctgcagccaagcaagcgcatggtctaaggtaacctagcaggccaacattggactcagtcacaactcacaagcaccagtaaaggttcttcatgccatatagactgttagttaactcatcacggaagtaacaaagacattctgcaaaactactcatcacccaatttggcttcatgtgttcaaaatgtgcccctgtataacagatgtgacagagataacagtaataccagtaattgctcatgttggatattttatacaacaggtcatttgaattcacaattttctcctttatatcgatgaaatgcattattcaccacaaaaatacctgctagaattcttggaacttcaaaaccgagcatatatttgaattcaggataacatgtagtatgctactcctaggatatgctaattcatatttcctttgcttagttcgatttgacagaagaattccacaaatgctagagcaaccagaagaagaatggtgtgggaaaaacaacagtttagaacaaaacaatgagtttcggattatctaaatcacagatcaaatttgcaatttccatcaaccatcactgtgagtattgcaatgacataaagatcctaatcaaccatgtcaacatatatcattacttggtgaactatagtcacaacaaaaacccgcttcctctgcagaataaacacacatagcacaacgacagagaattacctgggcaggaaagcggccccggaaggcatccgggacgagtgtgaggccaccattggaatcggcatggtagggcccatagaggtgcttggcatcgaagtcatagagaaagagcgctgtgccacgcctgatccgggacaccacgtctagactccccagtggcaagcccatcacccggtgcctgtagcactcagctttcgtcacgccattgcacatgaagatgtacccagcaggcgatgacatggaggacccactggagcaaccattctcatcattctctgccgcagaatgtggtttgtcacacaccagagaaggtgc

SEQ ID NO: 59429 - DNA, 6107 bp, Oryza sativa
cctacaacaaagtaacaacaatgatgaaatagaacgaagtaaatatattatgtagttcatgagcccaataaaattttgcacaggaggaaatggaagataaaagtattgtcctttcctattccagctagctgccggactattaacagaagtcaagattcaagtataacataatagagagagctatatgttcttattataccccatttgtgtttttcttgtgttataccagtcatttcttttctcaggacaaaaaacataatttcaatactaaggccctctttgtttaggcttataagctagcttatgagttgaaaagtctaagcctaagaaaacaagcagcgttttgcagctttttcatttggcttttttaaagccataagccactcttacactgttaagccaaaagctaggttggagaagcttttttggcttatgtgaggtagaggtatgactccaacattaaacttgggactcttaatctattggcttataaatcatataagccaaaaggctaatttaaaagcctaagcctaaacaaagaggccctaaacagccaaaatacaagcagaaaagacatattcaatctatgtaacaaaagaatatctgagttcaagataaataaaaaacgcagaagtgtcatataaagaagacactgaaaagaataagcttcatgccttaaagcccaaacatgatgaattgtcagtacattgcaaccctcccaacctcgatttgactccttattcacaagtggcacaggaggaattttagaaggaaatgacaatatgttttatgatacttatagaagttaatattagatagaatatgtttcatctttactctgatcacagtatcaacaaatgctgattaaaatttacctgtgcaagggtaagttctgagctgaacttcccattggaatagttctcttttatagcacttcttaggctactttctgggataggcatgaaatcaccatcaattgtaaatttgacctgcacatatacaagaacataagttgacactgaaccttcaactatattgagaataaaatacagccaatctacgaagttggttattggacttcattatgatttttaactcaaaagtcaaaagtaaaccgcatataactgccagggaaaataaaaggatggtagacaggttaattcatatcagtagagcacttctaatatgtctctctgattcctaaaggagctaaagttgtaagcaaacctgtaccattggttgctctctttttttcttttgaagagaaccatttgttgcttgtggaattagctctggcagagagaatgtcaataaacataacccagccgatatattctcaccacacaaggtaaatttcaactatataaagaatctaaatcaaggtgagtttgccatcccaccaacacctcttatggctgtaataagattattttgctgctatgcatgcaatcattgcaattgtacaacttatgatatttgattacagatacgttgcgacagatgggtatttggttagtaggaaaaacaatttttcatcattaaccttagattctgctgtcctagaccataatagctttttacaattttgctgcattacaccagcaaggtgctgcagccaagtgatcgcatggtctacgacaatccagtggaccaatgttatactaaaccacgtgatacagcaaggttcttcaagccacaggctgttggttaactcatcagtcatcacggaagtaacaaaacattatgcataattactagtgcaatgaacatgactgattgtcaacccttctgactaaatgtgttcgaaatgtgctcctgtataccagatgcgacagcactaacgtatgttacatttcgtcctgccggttataaaatatgaataatggctcacttgtggatgttatttacgacaaaaatttcaaatgcaatgcataacgtagcacaaaaatacattctcgaactcaaggaactccaaaaccgataagatgtatgaactcaatgaaagatgctaatccttggaaacgtgtgtacgtatttcctttgctatgtttggcatgttgtactcctacaaaaataatgaatttacattcccttaaatagtacattataatcaccgcatagaatgtgtagtaacatgatggctcaaattaccaaattttccatcagtcaccattccgcgagaaatacggttctataaaaatgattaccactccaattccacagcattctcaattcatcaccgttctccaataataacaaaaacgatatcctaaccacgtgacgtcagcatgtgtcccacacaaccgcattcctcctgctgcttgcagatgaaacgcacgggggagcgcgacggcgcggggggagggcgagttgggttacctgggcggggaagcggccaccgaaggcggcgggggcgaggtcgaggccgccgtcggaggcggcgcggtagggcccgtggaggtgcctggagtcgaagtcgtagaggaagagcgcggcgccccgcctgatccgggagacggcgggcagcctcccccgcggctggcccatcaccccgcgcgcgtagcactccggcttcgtcgccccgctgcacatgaagatgtaccccgccggcgacggcgacggcgacggcggcccgccggggaggccgccctcctcctcctccgacggcgaggcgtcccgcggcctcttgcgcggcggcggagacgtggccgccgtaggggaagacgaagggtggtccgccatggatggaagcgaaggggagagagaggggtttttagggtttttcgttggatggctgcggtgggagtggatgagtgaccgaagcgtgacggctgccgcgggtgtactcaggtgatgtctgcttttttttttcttttttcttttcgggtttattaaaaaaaatactccttccattttagattatactccctccgtcccataatataagggattttaattttttgcttgtattgtttgaacactcgtattattcaaaaaaaatttggaattattttttttacttactttattatccaatgtattttaagcacaacttttcgttttttatatttgcacaaacttttttgaataagacgagtggtcaaacagtgcaagcaaaaactcaaaatcccttatattatagggacggagggagtaatttataagtcgtcttgattttgacccaaattaaattgctccaagttttaccaaatttatagataaatatacaacaccaaattaattttattaaatatataattgaatatattttcgtaatatatttatattgggttgaaaatattattactattttctacaatcttggttaaacttggagcagtttaactttaactaaaattaaaaagacttgtaatctgaaatgaagggagtaagtaaaatttatattatataccgacttaaaaggcaatatttgaaaaagatatttagattggaaatatcttaaatttaactctaaatttaaattttgagaacaactagttattttttggcaaacgaggaggcgttcgttacattgatagcagtcactatgcaatttactatgaatagtactcatctattttatattataagatgttttgacttttcttttaagtttgatcaaatttatcaaaagatttagcaacatctacaacaccaaattaatttcattatatatatcatttgataggaaagaaaatcaaaattacccctgctactgtagaagtacgaattaacctcctcaattcaaaaaccagacatttttcatcatcaactttttatattgaacgaattaccctcctaaccaactttagagtggttttgatcctacgtagcgcacacgtggtagtcagtcagcaataaaaaatactccctcattgtgaatgtggaaaatgctagaatgacttacattgtgaaacggagaaagtatataaaaaggttaaaaaggtagggcccacatgtgttgacggcagaaccaagtacaagtatttgttcatcataatatattttacagtatttatttttgagtctgacaagtgtataaaagttttactagcaaatgattttttatttgctaaaaagcaatttggataagatcatgaataagatcgatggcactgggctggttgtttctcagctggaagagaagagaagaggggtacacttgttaaaggtagtgtttttagaatggaattttactaattttgggtggcaatattacaaagtggcattttttctggagtgggattatcaaattttgcccacgttttaaaatggcaaagaaactggtgtcctgcttggaacttggattgtgcctacctaaataatctgacaggtgggtccagtttgtcatccacagtcacagacgcagctcaatacatgccggtttcctcactgtccagaataagaaaggggttcagaaccaaatgacatggagaccaaaagtttcagtcacttatcttcactgaaaccgagctcaacttaaggtgaagccaaattcatttacaagctacaaacagggctcagtggttggatgctaccagtgcatctctgcattcggtcaccaatcaccatggccacattatttcttattgctcatcaccatgagaagaactcaagctaaaaataaaacattggtgccaaggccatgtcacccctcacatcaactgtttgccggactgcggggcgaaattgatgaggaatgtgcgtatctccatggggcccagatcaacgacgagcttggaaggatctacggggcctccccggacgatcttttcatcagcaggagggccttccaccttccacttcagcctctttttctccatggctgaacgttcttggttcgctgataggcttgtctcaacaatcttgacaatctggagaggtgaggatggaatgatcgaataagttgataatggtcatgtatatcaaacatagatgtatatcagaaaatgtgatgatgatcaccttcttgtctggaaatactctcttcaggtcgacgctagctagagctgaaagatccttgtgctctccagcctataattacacagggcaagactcagaaaataaataaaaaggaagatcaaggtataccaaggaaaagtaaggatgatagcacaagacctcgtataggtgagccaaccgaagaagaacagttccgtcttcaagttcctgtccaacgcaggggcatttgacacatataacttttaaagcgacatcgtgcaacacttgcccgatacagatttagaaagcattttcatcaattttgtacatgagcacatttttagctaactggctcattactgtttgtaatcaatgatatcaagcaggattggggcaggacaaagaactagcttgcaccattgcaaatggttaaaaataatataaatattatactgcataaaggtgaaccaaatcagcgatagttgggtagtcgataaccaaagatgggaataattctggttcccacctctagaatcaagtaatccatcagggctttcaatgtagttgttagtgcaaagacaagcatttcatttttacttttaagagaaacaacagtggtccatagcacgcagatacctgaagagtaagcaatgcaacattatcaggcaagctgtaggccggatccattgcagagaattttgtaacgtgtgaattcacccaattacctccatcctgagtaaacagcaaggacatgctcagaactagcataaccttttggtcaactattttataaataagttccagtttatacctgctctgcaaaagcaataagaagaggggagtatatttcctggccaaatgtccgccgccacctagctccttcaccttgtggatcaattttgagataatactttccttgaatctgtgaaataccataataagatgttttccacagtatttttgcacacaatcaatgtatttgaaaacattatagaacaaaaacatctctagtgacagttggcacaacatatatatcttctctttatactccaagaggactttgttatagataagaaaatatttcaagagggcagaaacgatatattactttatagcactaacttattttatttaagtatgctctaaattttcttcaaaaacaaggg

SEQ ID NO: 59430 - DNA, 892 bp, Oryza sativa
catgacatacattcatggaaaagttcaagacaatgactcatatcttctgcgagataccaaatgataaatatgcaccatcttagacatgtattttattttactggaatttgtaccacattatcaactgatatgcccccaaagaaaaatatgaaagaagcaacaaagtattgtactatgttgtttgagttgaagatatacctgtgtagcattagctctatctgtccatcctttatgctggcacctccaacagacctgtctacaagtatagataactctctgcttccatcttccacataaatgccaagattaacctgaaagtagatataaaatcatcaacaaatgcataaatcagccccaaaataaactatctgtgaagctacacagaaaactatgactggatcctttcaattttaacatcacacaataaataagaattgaaaacattgtaagttcatcaaacattaaggattgagtgaactttaagacagtctcactcgtacatgtcaaattttcattttccgatcattcataatccttagtgcatcgaagtattgtaaagagaaaaaaatttctattgtaaagatcactgaacttcttacgctagcactaaatgttattgttatcatatctcaatggaataaataaccaaacaaaacccaaattcctttaaaaagaagccagccatacgtgaataaagtcataaactaagaggataactcaaacctaactcctgactagtttcggatattgatttgatgataaaagacatggaagaaaccaatttttcagtgcttctacacttgtgaaaaaaaaaaaagaggctggagaagacaaaggctcacaggataatagtttccagcgataggctggtgcacttcgagggctgcaggaa

SEQ ID NO: 59431 - DNA, 702 bp, Oryza sativa
cctttgtaaactctgttgatctgtgcaaagaattgaaaaacaaggcatcaggaaatgagcaacagcagcagcataatttcccattcattcacaaagattgagagagcagaataaactttaggtgtggaacagaaaggagttaagaaaaggtaatgattgatgatttagacaagcaattatcatagaaataacctgatatatccatggattaatctgctgatgcacttcgtccaatatggacccacggagaactgtcagaggaaccttgaagtgggcaacataacttcaagtaagacttacgtgcaattttaaaatctctcaacagatgctgcagtgtaaatgttattctcggaaaaaaaacaatggaaattcttaaggcaaattactgaattagatatcttcttcatacctgtccatcagtcttgataggaactgtgccattagggcgaaatatgtatgctccagaagcctagggtacaggaaagagcaaataaatgccaataatagtaaatgttgctgaataaattaattatataatttgtactgcacctgaggatcacttccatttccatcctgtcctatgtaatacttgtacttctgctcaaaatttgcttcaaccttggaatgtgttaatggtgttagagtacaagtgagtttagatcatatgcaataattaaagcaagaagcaatgaacacatggtt

SEQ ID NO: 59432 - DNA, 7468 bp, Oryza sativa
atggtgctgagcaagagctagagcatcagctaaactatctgttgtgagatcagagttgcttctccctttaaagaattccaactgcctagctgcctgaaaagtgaaaacaaataaatattaagcatatgaacaccacaaagtaccaagtaaccatgaaaatatataatactgaaactgcacatctgaatgctagagtaatgaaagatgaaaatttaccaagtaatatccactcataacacgaacgtatcgttttaaggcaggtctgcttgtgaagtaacctgtccaatatgcatttgggttgtctgcatacctgatggaagaaatacagtcatttgcatgtgaaagcaacaaaaatgaagttaattatatcaattatgaaatataaggttagaacatacgggaaaaaatcattagtcttgagaggccatggcacattttcagcatgttttgcatcagtataaatcgaaggtgtggaatacagagcattgacacggccatcctgaggtaatggaacaacatgttgaaatcatcatcattacaacttcatggtgaaactaaattagttaaacaatagtcagcatttgtaatatccatgctgatcttaaccttattaacgtagtgaattaatttgtccatctgtctgaaccaactttctgcatattgatatttgaagtctgtgcccattgtaaacataacgtgatttgtccttgtaatatttgcctagagaaaagaaagaaaggagcatgaattaggatgaacaactcattgctgagtagaacaataacttcaagttaaaacgttgtcatttagctaatatctttgaatattaagagcagaatgatcgacatatcatggaatacggaacaccaaaactgcattctcaatttgtgacaaacacttaacactacaacatccagaaaggcagtctaaattgaataagatgtttgcactttgcagtagcatcaatcaacatgactaatggatttccatgcaatgcatatggctccatagagggtctacatcagcatgaaaaaagtgtgaacatacagtttaatgtacctgtgctatagctgcagcaacaaagtcatccacccgttgctccacattataatcaaaaagaaggggatcatcctgcatagaggcaaggaatgtataagttcatgtctggtgttgaatgatatgcattagtagagtactcattagtttacctggacgattggggaagtatcatcaacttcgaagtaaaactgaccaggaggtggttcataattttttgggaagatgccagcaaagatctgtaagaaaatgtgtgtttcatatgaaatatggaatccccagagtttaagaacatcaaattgaggcataacattaaccgtgaaaaaaagaggtcacttacgtcagctgatgagccgaaggtcttggagcccctccacacaacctcgagctcttttgttcccttccgtgtgtcacggtcttggtaatcaatccggaaaaaataaaaagcatcgaatcctacctgaaacataataaaatgctagctgagcaattacttttctggtaaatctaatttcacttaaacaattggattgtgtagattcagtagctacattgtgttgtcaacaaaagctctctgtggcatcactctttaggggatagcaaggtatacataatgacatttttgtatctcagcacataactacctatgatgggtgataactagttactatcgccgggctgataactagttactatgataacagcattttacatttaagtcgaattaaacactggaaggacggcatcaatgagttcagtggattacttctgtgcctaggaggtaagcctgaactgcggagtgcccaaacggatcaatctgccaaccaatccttggaatctgaccaaactcctccttgatgaacctgtgcccgagcgtagtctggtctatcatgtcaatgtagtgcacggtcgcttcatcatgcatgcacattcccccgtttctgcaacagcaaaagaagcatgtcattctctatacaacacagacatgactaccaatgcagcatacatagcgatattcgatttaaaccctacattaattccaatcgtccagtgctgatgagccccttcactatatccttaatcatgtcgctctgctgtctccaccatctctggaagaatgcctaaaaaccaaagaaaccattggtcaatttcagtcaatgtgtctacaagtggttgcacattgcttcctatccaaccaaaaaaggactcccgacattgcagaattgaccattttggatgtagatagaatagcttctataacttcaactcctacaattgtcagccagaaattgcttgtagaaacaccaatatggttacagatagtactacattgcttcctacccgccgcagttccaattccactcctccaagcggctcaaaattcaattgctgacaaggacaaacttccaaaggcgggatttaccccccaaaaaaatactccctccgtttcaaaatgtttgacaccgttgactttttaagacgtgtttgaccgttcgtcttattcaaaaacttttgtgaaatatgtaaaattatatgcctacataaaaatatatttaacaatgaatcaaatgataggaaaagaattaataattacttaaattttttgaataagacgaacggttaaacttatgctaaaaagtcaactgcgtcaaacatttcgaaacggagggagtatatgttacctgctcaacatagacgaacttgcggttctcatccttgagcagcgctggcacgagcgaatccagcacattctgcacgcacgccccctgcaaccaaaaacacccagaaaaaaaaatccaattcaaaacaagcaacgtgacgagaaacgagataatccgtttccaaaattcagcgcatcaatcatgcctaaactagctcccccaaacccgtagaaatttctccccccacaaaaaacggggaaaaaatcgcggaaattccgaggactgcgccgcgcagctcgcgctctcgatcgaaagcgcaagtagtagtagcaacctggatggagttgttggatccgacgtagtactggtcgacggtcttgagccacccgacgtcgtcgtgggtgtgcggcaccacgtgcacgttgagcttcccccccaccacccccgccgacgtgttgtaggggatgtacacgcactccccgacggcagcggcggcggcgaggaggagcaggagcagcgccgcgaggcgggcggcggaggcgcccatgggcctcttcccgaagcttctagaaggggcgtggaaggtggagaagggaggtggtggatggaggtcgttgcggccggccgcggtgaggccggggggtggagtgagctaagaagaagaagcggagcggggtggtggggcccacctgtcggtgacacaagggctcgcggccgcggcgtgccgggcgggtagttgcgcgctgtgccacgtcagctacctagcttttatcgcggttattgagtgaattttcagtatggccattcgagtttcctcgatttgtggattggggtcttgttgcgtatgagactttttttagggtccgttcgatctagatgttccgatgagctaaacagtaaaccctacgtccctaccacgtactaattcatttgatcggtacatgattaattgactatttactaatatgggtttagaaattgatttatttatttttaaaaaagaaacttcaatataaatttttttaaaaaaaatacattgtatagcaattcgagaagtaatggagttgctcccccaaaatagctaaaaagccaaaattattttttttcacgtatagtgcaatttggatgaacacaatccacgcgcatcactaaatgcatatatatgcatgtttgctctttaagcatacttgaaatattatcaaaggcgtcaaacatccctcccctcttcacgcgaactcatgcgccattcttcgaattaaattagtcgaatcaaaaacaagccctacaacgtatgtccagcaatgcttttttatgtagcataaacatgctaacttgatatgtacatcatgagctaattttgccgaccatgcatgtgctacggctctagttttagtttgagagagtcgacgatatatcttatataattcagggcctgttcactttgatgtcatttttaacattgctaaattttgataaagttgctaaaaaaatggctatatttagtttgccgctaaattttggtaactatatcaaaaactatgccaaaattttagcaagttaccaaaattttgatattaccaaaatttggtaaggttttttttttacattaaagtgaacagaccctcaaattatggcgcttacacggttctaaatatgctcctaatgtcgttgagctgtagccttataatttaggctatcggtaagcttcagatctctccttttgacaggtgggaccccgatctttcctttgttatcatatttgtttatgttgttatcggtaacttgttgtaatggttatactatggtataatacaaagtagccatgataataaacaacacctcaatttgcataaaagacaacactctatgatcttaataggttgaagagaaatcaattggaagaagaagataaacctctctcatgtcactactactgaattggttttcctagacgttgcccccttttggttccatgcccccgaattgactggcgctaggttgtgaaccacatgggaaaaatgtgcggtcctcttaaatgaaccgcacgggaaaataagtcgatttttttcgtacgaacgtactaagagagccgcacgtcaaaatagtatttccctcctacccactttaaaatttcctctttttccgcgcacctcggtcctcactctatcttcttatccagtcaattctcttattcaactcccaaaatttctcctctcctttctcacgattctcctctctcctctcctcacttatgcctctcggcggcagcagtgccccacggcgacggcggcgcaacggtggaggcgcgggatccggcgggcggcggcagtccccgcatggatccggcgggcggcggccgtccccgcatggatccggcggccggccgccctcccccgccacggatccggcgcgagaaccgcctgccctcccctcccctccccggcagcaacgggagcgcgcgggcggcggatctagcgggcaggcgggcgacgacgggcggcagcggctcctcccatccctctcccctcccctcccctccctggcggcaacgggagcacgcaggcggcggaaccaacgggcgagtgagcgacgacgggcggcccgcggccgtccctgcacggatccggcgcccggtcgccctccccccgccacggatccggcacgggaggctggcgggaggcgccaatgacgaggcgggagcggcgacgctgccgccgccgccgacgaggcgggagcgacggcgacgacccgatctagggttttcttttttttttgaatttttttcggttttctgtttttccgtgcggtggcataagcaaccgcagatttcgcgattttcccaggcgatttgttccagacaggccaaatctctgcacgcaaaaaaccgatttaccgcataggaaaacgcttagtgtagtaatgtgtaagcataacagacaagcccgtgatataattgaacttatatggcaatgttgttttcaatatcagtccatcagacaagtcaccaaaagtccttattttatttaattttcgtcatcaagcacaagcataaaaaaaatatagtatatactccaggtatcgcggatgaaacaattcatttttgccattgaaaggtcaggctatctatcacctgttactattatgggactgttcactttgataccattttcaaccttacaaaattttggtaaagttataaacaagtagctacatttagtttcctgctaaattttagtaactatataaaaaatcctgccaaaattttggtaatgtttttttcattaaagtgaacagccctacatatacacataatttcatcttaacagccgcattagtgctagtatcatttcctatcaggagcgtagcatgatttagtacgattggaaggtctcattcgcaaaaaggcgagatgcgaataaaaataaatagcccgtgccacggtggggcgcctcttccggataaggaggccagaacggggccccacctgtcggtccctatccagatcgatccgctgcaccctaccaaatatgaaacgccgaacaaccagcggacggcgactacactacgaaaattgttatgcatacggcctgcctcttcgacttatatacgactaaatttgatcaacatcaataattataaacgattataatgtatataaacatattgtctcgttcttttatccaacaagagttggatgaaaattaatattttcgtggcacacttttcaaactactaaacggtgcgttttgtgtgaaaactttctatataaaatttgctttaaaatcatattattctatttttcaagtttataaataattaaaactaatcaatcatatgttaataccacctagttttgcgtaaaaaaacttaatcttcatctttatctttatctttaggagaaaaagaacaccaccatagttgactaaatttgatcagcattaatagtgagtatgaatcgacatatatatatatatatatatatatatatatatatatatatatgaatagattcatatttagaattaagtgttttttttctaagacgtagcaagtatgaatatgaatatgaatctagatatatacaaatgtgaatatggatatatacaaatgttttagaatatacttgctacgtcttagaaaaaatatgaatctggattcatatttagacggcgtactcgcgttggcaaagctgatgatgagttgctgttccttctcggcgcgaataatcctctccctgtcttatccgatccatcttctttgtcgctgtcgcacctcgtggacttccttctcttgttttttcggggaccctctcggactaatcatacagttatgtattattcggtgctcttgaatcttgattagtgatggctaccattattcttttttctcctgcagtaagtttcattcgggaagtgatttgtattttttttttcattttgggattcgacagaaaatcctcaacagatacagtatctgtacaattatagtgtatagtgtagtttctatataactacatgtaagtagtatatatgtgacttgagtgtagtgtaaatagaaaaacacgtactactccgtccaaatatttggacatgtacagattcattgctagtattggtctctttttttttttttttgacagcggtctagtattggtctctttttttttttttttgacagcggtatagttcagtggagactggatatgtgcacttgaaacttagaggctgcgggttaattcgatccctgcccta

SEQ ID NO: 59433 - DNA, 1174 bp, Oryza sativa
tactaattttggcgtggagttcttttttgtttgcttggcatttctaaattttgacaaaatagagaaccaattcaacagtaagttcgttgcaacaaggcaaacttttttttttttcacggagtactctttctattgcatctttttatttgtttgttgcttacctgcttgtttcaatgctttatttcgataaagaaaaatacgatcggagaatgcaataattgctgtggtcacattaatgaaagtcgcagcataactagagaatcaggaaagtacgctttctattgcatactactccctccctgttgttacatattaattgacgttttagacaagattaaggtcaaatttttataactttgaccatcaataactttaaaaatatttagtttaaagcattgaacaacatatatagatttgtctttcaaagcattataataaaagcaatatatattatatatatatattataatagaaaaataaggtcaaaagatatattttatagaccgtgttattgtctaaaacgtcaattaaaatgaaaccggagggagtactattttatttgtttgttgcttggcttgtttcaatgctttatttcaataaagaaaaaaacgattgtagaatgcaattattgttgtggtcacattaatgaaaggcacagcataaataaaaagaatcagggaaaaaaatcaggggcattccgagaattgaattcgggacctctcgcaccctaagcgagaatcataccactagaccaaatgcccttttacgattacttttcaaaattacggtacttgaccaaggttatttggctcgacagacgataattacccatgacatgcattcgccgtcgagcacgccggcgaccaatccgccggcagaagacggcgccttctccggtgatctccagcagaccaacatttttctcaagatgacagcaattattgacccgagcagatgatcttttacaagtggagagcactggttgcagagacaactcacattgccatagttttattctcatttccattccattacatataagtattatttgttcagacttcagacattatgtccaaagccatatgaaataacggacgatgcaaagattcaggtacaatccaggatgcttcaagtctaataacacaaacacaaatcgttgccgggctgcaggaat

SEQ ID NO: 59434 - DNA, 10951 bp, Oryza sativa
attcctgcagccctttaaagtaaatgattatcttccaatcttgaagtatgaaaaagaaatgatgttattgaaccacattatcatactttgtaactcttagcaatgatctccacacccgtgatattattacatccactttctccatgaagaagtaatcagttgtccggtcgattccaatgccccgccgaaatataatgtactgcaagcatggttgatgtgataattagttatgcaatatattatgtagaactgaaaaaaatgcatttatcatcaaatgtatgccatcatcatgaggtatcaatagaaagaaagaaagccatttagaacaaagaagactgttttttttttgttgcattcattcttttttcgtccaaactgttgcttatgctcttgaaagtaaaagaatgataccttatcaacggatgctggtagattatcatgtggatgtgctttgaagtaccttgtcaacaacttcttgtctacctaggatggttaaaaaaaacagttaagcaagtgaaatagatcatctgtttgcatgcatgtttatggcccttgattgaaaatattacagaagtaggttcagaccttggattcatcaactttgattggtaggttcagaagatactgaccagactgggctacatcatattcttcatcagataacaacttgaagttgctcttttccattatctagttagtatcatgagtattttttttagaacaaagggagtatgagttattgtcaaatctcacagaccacatatattttagctataacgaagtgtatatatagtggcttaacctgaaacatataagttaagaaattgagttcaagcgtttcaatctcatctggtgtcaggctttgctgctccaaactcttcacgccattaacaggatcaaatagggcatataattgctgaaccacggcacaaaattcagacaattgaaacttgatcaactgaagggagaactatgaaataataaaggagggggaaaaaagaggaagtggcctagataccattaggtcctcaaattgcagaagataccaagcacggatagtgtactccaccctcctacatagcttcaagaactcgccacgatccttatcttgctctgaagattaaacccaaaaaatgtgtggattatgacaatgtagataaatcataaaatttcaagtgcacagttccaaataacagaaattctgattcacacatggagaagagtaaaactagttgagagtttcagaaatgtcaggttgtttactccaaaagaaatttcagaaactcagaaatgtcaggttgtttattcccaaagaaatttcagaaatggattgccaatatactgaaatggagtaaaatatgcaatattcaccaacaactgagctagaaggacatattttttatccagataaagaacatcatcgcatttgagatcactgggaaacataaaaagtgatcaaaatccacatgcaaaggtttgaaacagattgcaaagtactccttcatgtcagacagataatgtaaatgtaatataggaccagtaactgtaatcacgggaactcccaagtatataacatgaatctttcgaatcgcagcatggtttcctcgtcagcaattaatcgactgtgcaacacatactccaaaagagcaagacagttcccagttcctatttgaaagaacccattcaaatcaacccatctaggacttgttagtttgtcataattcaaatcaacatgagtcgttcgtcgtagcaatcatgaatcgtgagatgaacaattggatcaatcgttcgtaacccataaatttcaccaggagaaattaacttaaaaaaaaaaaagaacagacatgttcttgtccctcccatttccaagaaccgcggattcttgtggcaatgcgcggccaaccgatcgaccgatcgatcaaaacccaaagaaatcaaaaaggaagaggcgggcatgggcgggcgtgtaccgacgaggtaggcgagcttcatgatgagcttaggcttgaggatggggatgacggactccctctccagccgtatcacctccttcaccaccccgtccttcttctccctcctcatcctctccgcctccgcctccgccgccgcttgctccatcgatcgatcgccgcccggagcaacgtatataccctacacctatccgaccctgatctcgcagccgcagccgtggaatcggggcaagggatggcgtcgcgccgcgggaagaagacgatgccgccgcgagagagattagagaggtaattaattaagaattaattactttattagtgattgattaattaggagttgggaagaaaagaaggaaagataccaaaagtagtaaacacgtgagggtgtgtgcacggggcaaaagcttccggaatcgagggcctgttcacttcgatgccaaaaaaaaccttaccaaattttggcattaccaaaattttggcaattttggcaactagccgaaattttggcaggatttcttatatagttaccaaaatttggcatgaaactaaatgtagtcatttttttggtaactttaccaaaatttggtaaggttgaaatggcataaaagtgaacaggccctgatttggtccacggaaaaggctcatcatgggctggaccgggccgggccgaagtgaaagcccagtatggcccatggtatttcggcccatattcagccggaaaaaagttcactgactctgtcaaatatacgtgtaatctgattcgtatgtttcaacagtattagatatcttgatcctcaaactattaaaacggatgcaaaacgactgcctcggtagttcattaaatcttgcttcgatggagttcattgtagattgatatgcataatgctgtttttttttatatgaagtgaaactgaaagcattgcagaatttgcagttcgttctgagcaaaatctaactgtattcatgactactaattataaaatcttaggggaaaagagaaggatgatcttggcaatcgtttctcatttttcttatacctcaaaatacatggcactttgggcaaatgtagccatcaatctagaaaaaatatggtggattgataatactaaataggcagtttggcctcctttcaagtttgagtttgcatcttttggtatcacaaggttgtgcttttcatcgtaggatgatcaaacaggctttaatttgccgacgatgcggcacaatgagaagtcaatttgttgtcaataatataggggatggatatcttcacccctaaaaaagtgtagtttcttctctaagatacagaaacttgccatggatttcctagaagcatataacagcacgtttgaaaagaaggcaaaatttaaaactctttgatgcttttcccccactgcagtggatcgatcatctcgtatgtttctccatctagtagacactgttcaagtagaagaacaagccggccaatgcaagtatcccgacggcgataccgataggcaacgcttgcctgcaaattgatcaacaaagttttttgttaacttaattaaatcattcaccatgaatcaagggcttgtttggaatgcaggatatttgacgaatgtaggtgaaatgggactagtttctgtggagtttgtgcgttcaaatttgtctacctaaggaaaattgaaagcagctcaaatttaatttaacaacttgtaatctttcttctgtatctatgaaaatttctgattacccgacggcttcgtcctttttcagctgctccttcctagccttgcgggcatcggtggcgttggcgttcttggccaccttaggctcgtacggcttgaaccttctctttggtgctccacaaactgcatcagcaatgcagggacagaagaaattcagtaatgcagaccaaacctcataatgtgattgtcccgaaatcatgccagtatgccactcaatgatccaattaaattgtttactaaaattccctatatttttcttgtttgattccccttaattaaaacagggtaaatatgctgccagctgcaaactctgggtgggtctctctcttccgattatggaacacagactgatacagaatgtcagctggtaatttcagtttaagctgtacaaagcctcacctcacacatcgaaaaccaacatatattctagttaaaactgtttattttgggtgagaaatcatgtcttaaaatctgttctcttttgaatgaaaaaccttgtaaaatcgctgatttttgcacatgttgaattcaccaaaaaaattgcgagctgttcttaccggggcagaagtacttgtcgggaagcttgtcgaagggggtcctgtcgctgtagatgtacctgcaaacgagcacaaagtcgtcaccaaattttgcacagcatcaagcagaacaagacgagatcgagtcgttcgacgcggccgcggcgaggcagtggcagaggcagagcggctggctggctggctcacccgcagtcgcggcagatgtaggcctgcttggacgcgacgccgaagcgcatcgtgatcctcgccgacgccgtcgacgccctggcgccgcgccgcggcggcgccggcgccggcagcgacagcggcgtgcagaacgatgacgaccggagcggcgccgcggcggcggcgggcgcgcgcagcgcctgcagctgcagggcggccatcaccaccgctcaccgcagcacaagaaacaggcgcgtggcgagctcgagatccgaggagagaagaagagaaggtaggaaagcaatgtggggggactggaggaagaagaagcggtggaagagaggggaggataagagggagcgggagatgattggcgcgcgcgcctgcaacgcaagcgctcgctctccttttcttttctccctcgctttttcgcgcgcgtggcgtggcgtggcgtggcgtggagccgggagctccgagggggcgagtgtggattggagaaggtgcgtgcgtggcggccatggcgtcccttcgcgcgctatccctttccactggacgggagcgccacttgccgccaattgcaagggctcttctcctgtaccgtttgccagggacgaaaacggtaggaaatggttggaaatggtatcattattttattatttttttaaaacgatcggaaacggtcggaaaattttcatatttatgaattcatctatttagtgtcaatttcaatgccacgctgatagaaattaaaaaaactaaattttaaaaagggtaaccatcagtaaaaatattattattgtactacctctgtttttttaatagatgacgccgttgactttttctcacatgtttgaccattcgtcttattcaattttttttacaaaaggtttaaaatttaattaacattaaaaatttggggagtgataaaataactcataaaaaataaattataattacgtaaattttttaaataagacaaacggtcaaacatgtgagaaaaaatcaacggcgtcatctattaaaaaacggagggagtattagttttgcgaaaacagtatcggtacggtcgggaaatttccatgccgctttcacccctaccgtttgctaatcccttcgttttaaaacataacaaatacttgttggattaaacatatcttagtacttcgtattataaatctggataaattttgtagcaccgagatgtgtttgtgctcaattcattcacattattgctatatttcaggacggatgaagtaggagggaagaaagaattgtcatttgtctatgggggtttaatttgacgcctaaattaaccgtattaaattttggtgttacaatgttttgtgaggttaagatggatagagtacgtgtagtggatgccatttaggataatctttgcaccattaccttgctaaattttagtaaatgcaaagatttgctggggtatgtttttgacaacaaaggggacaagctagaacaacttgtactctacacatatttacgcttcactgatatggtattttgccacttcacaaaatatatttcgatggtttgtcatcttggccaactatgataatgcatttttaaagcccaacacctgttcaatcggacgtacacgtcggaccgaacttgtggctcaacaagcaaaaaccaagaccagtgcaaactttgtgagccagtgagctggttgaaccgattggtttttaacatgaactgggcattaatccgcaatggttagatccgttgggcatatgaaaatgtggatttttttattttacttttttattaaattatttaaaaataattttctatttcaacatttaaaaagtgcttcatccgtttcatattataagattttctagcgttgcctcattaacatctactccctccgtcctaaaatataacacccttagatttgtcctaaaatataacaacttcaccacctcttcccaaccaattacaactttccaccattcacttttctcacctaccttcgctactaatccaatcacaatcctcagcattcacttatatctactttcttaataaccgtgtccaactctaaaacttcaacggaggaagtatataaatgtagacaatgctagaaagtattgattcataaagaacactgctcgtattaggttgaccaacaatttaacgatggagtcaatgagcaacgtttgacattacacaattacaggctatgcatgcatggccctaattaacaattaatgatcaataatctcaaaatgtaaatctgaacacgtacagaattaattaattaagtgattaaacacggagagcgacgacacacttaccctctaattaaattaaacatcatcgatcgatcaggcacatacacaatgatcaattttaattatctacttgcattttgtgattttactcctccaaccttctatctctcccatttcactggtcgctgccggtggcgggggcggcggcggcgccgtcgaccttgaggggctcccagtgcgggacggcgtcgctgaagaagcggccgacgacgcgctgctcgaggacggcgatggcgtcggggtgcttgatgcaccgcggcgtcttgtactggttcaccgacgagccgtgcgacacgcacatgtccatgagcgcgtcgaacgcccccggcgccacgacacggatctccagcggcccgatcgacctgtcccggctcctgcaccgccggtacaccgagtccagcccggcctccacggcggcgcagcacgccgccatgacgtgtgccaccttgtccttgtcctcgccgatgtcggctgcgtcgtcggcgtcgtcatggcatggcggcggcggtggcgagggagagggggtgagctcccagaagaggacgtagtggccggggatggaggaggtgtcggcgtaggcggtgtactccgcgaggacgcaggagagggggtcgaggaggggcttcgcagcggtgacggcgcggaggaggtcgtcctcggaggtcttgtcggtgtcgacgctgaggacgacgttgcgccggtgcacgaaccggaattgcggcgccgcgttgtgaaacccggccacctgcaggatgtcccccaccctgtaccggtacaaccctgcacacaattaattattaacccaattatttattattggattattaaaacgaattatttgggggaatgatatagtacggtattccgtttaaagggatgatattctagaagtatcgtctgatacctggcaggtatcgcttataccccatttgaacaggatgatacctcagaggcatcacctgatatctggtaggtatcagctgatacccaggtgatacctccgatgtatcatcatgtccgaacggggtatgttatatagcatttttcattatttgctccatcctttaaaaagtatgtttcctcagaaaaaaagagagtttctaatgcattgtttatactgcttgttctaaactattggttaagtttgtttatcaaaatatttaattcatccctagtaagtacaatccatgatggcgatccgctaaatattaaaattcaaaatgggcctcacattacaaactaagtacctatatgccttttttttttggaacacgtgattttttttggtaggtgattgttgtggcattttttaagtgattttttttatgtgaggagtgtgatagttgttagtaaaatgcttggaaaacaaaatatactaagtattccgacaatgtaagtaggggagtaagaagttgttgggccaaagaaaatgccagcacggccttttcagcccactgaggatacctgtcctttttggtgcagaggctctgtgtttttagcctgggccctctaaaagaacacctttctatctaaatttcttttaagtgacatactatcttttgggataatgaaactacataaacatttcaatccgtgaaatttactgagataaagaggcacataaattatactaactccgttcttttttgtttaacattggttactgcaaatttgcattaaccaacgtcaaacattgagagatgtaggtagtactttgacaagaagtcagtttcagtgttgcttaattaagttctggcaaaaaaaaaaattctcccactgaagtaataactatattttattcttattactcaaaataaaataaatatgcttcaagataattagcaactatttaatctacctagccttttttttgcggaggactttataaattttaatactgaattaaattgctgaaatattttggtacacatcactggccatgcatatgctacaataattggcactttgactttgtgccaggtcacacacttgtgtagggcttttccacgtgcaattgctatctatttgattcagtattgcattaaacaacttttatttaggagcatagtttatgtatggcggatccatcagatgatgtgcacagtccattttttttatggaaatgcaaatttataataaatttattcagctggtagtgcagggttgagagaggaaggtcaaagaaatcggatattgttttaatatgtcacatctcgatcaacttttttttgtgtcatctatcattgattcttccatgcataatatatcattgttttcagatgatgcacatatatcattttgatttgggtggaattaatgaatccttgagtaaatttaatcaagctaggagataatgcagtggaagtcaagcactctacgcactgcattaatcaaatgaggtatatgtcatatatcaaccatgcagcttctctagtgatctgtacaactgaactttctcaatgaaaagctagacgtatcattttttatcttttctttagctaataccatttttcgtgtagtagtagatagcatcatacatatataatgtttatgttgtcaaatatttttttaattttcctgcaactatttttgttttacccctcttaataattaagtatgcaatgaactatatattgtgactacatcctttcttgtgataactactggttcgtaattagatagtatgttaattatcaagatatttttcaaatattctagtgatatatataatttccatcacccaatatataaattatatacatattacacagagggagcaagtagttgataccaacgtctccatgtcgggttaaagtaagtataattaagtgcagacatgaaaggctataggcaagctaggagataatgcagtgggagtcaagcactctacacactataccccgttggcctagtagggaatcccaagctataacttaattatttggtcaaactctgaaaaaaatctactcaaataatcaagttaccaatattttaatcttgccacatctcatcacaagaaacataagcaactaaacaagtgtgctctttacttattccttcaatataaaagaaatggaaagtacagtaagctaataaaaatctattttatgttaacacccatgcattgccttggattaattagattaatttgaaaaatggtacctaagaaaataattctctgactccccaaccaatcgacttgcagttagcttatagcttatactacttgctagtaactcttatttctcgatgaaattaaattaaaccttcttttagatattaagtagctagcctcaagggaaaagatgtgtgatgttacttctgttgtaaactaaaaatcgagcttgtgtactgtggcttagggaagcagaattcattagtgtgtgactgtatccaccattagaggaacaacagggagaccacaaaaaccaaaacaaaaatctaaacaagttaaaagatagaacaggtgactcataaccttttcgtctaaaggacacctgcacttatctttcgaatagaccacaatgcatgccaggaatggtatcacatcgcaaaaaagtttcattttattgttttggtacgtgccaccgcaaaaaacacggagctgaaaaataccatcattttagcatcgacttgtagaacaggtcctacatgtcattctcatgtacgatgtcattttgcaattcgcgtatcttagtaaaggtggaacttacatgatgattttttttctcaaggtgcatgattattatcttcattatggaacattagaaaaacgttttcactaattcatttcttcttttctgggaaagggacttcacccctcctatttcgaggagatataaataagatttgcccaatttggatcgctaatcctctcctataggggcacttcatcttagctatgattttctgaataatggttcctacatgctgtgtgtattgttgctacagtttccgtgccgtctttgcgacagttaattagttgatcaataattaagtaactgtgctacatgttaatatttttatgttttattcactttaaacttaaaattacccacccgaaaatggtaaaagaaaattcgaggaacagtacttggaaaaataatattacctctgtttttacgcatgacgctgttagacttttccatagcgtttgacttcgtttattaaaaaaataatataaatgaatatttaaaaatatatcttaatattatggttcc

SEQ ID NO: 59435 - DNA, 4543 bp, Oryza sativa
attcctgcagcccaaataagttaaatggttaaatgttggcgtcataccatggaggtagtattaacgtgagacgggctcaaccaatctcagccgttgattttgcgatcggacggcgttgataaacccatgcaggaggtgggaaagaaatcgaacgggctgcacacgcgctcacctgtgaaggtggtgacgacgagctcgtagtaggcgccgacctcgacgccgacgaggtccaccacctcgccgtcgcggaccttctcgccgtcgccgtccttctccaccttgatgaactcgtagtagcacatgttgggcagcagcgtgtacaccacctcctccggcgggtccagcggccggaggttgatgccgaagtaggactccgacgacgcgtacatcgtcgacaccagcggcagcccgccgccgtagaactccagcagcgggatgtactgcgccatggaccccgtcacgatcacgtcgatgtacttggtccgcggccacagccgccgcacgatgccccgccacgacgcgccgccacactcggcggcgatggcgtcggcgaggtcggggtcggcgcgggcggcgaggacggcgtcgacggcgccgcggcaggcggcgtcggtgacgacggccgggtcggcgcggccggcgcggatgtcggcgcagagggcgcgccagtggccctcgaggaacttgacggcgcggaggaaggcggaggcgaagacggcgccgacgcggagcacctcgccgcggcgggcgaggccgcagagcagctgcgcgtacatgctctggcggctgtccgggcagaggatcgccgcgtcggggctcgtgtaccgcgtgtacgggctgtccggccgccgccggaagtggcggctcttgtagtagctcgtcagcaccggcctcgccaccatccccgacgccgtcgtgatctccggcttcacgaacagcaggtacatccccctcccctcgtccagcccctccacgtacctgcacctccatgtcagcatccatggcgatcgatggcgaagccagcgagagagactcacttgttcatgacggggacgaggaggttgtagaggaaggtcttgcggtcgagctcctcctccgtcgccggcatcagcttcggctgcccgcctgacgtgccggagctgcggcgcacatcgccatgatcgaccgagtgattgtgtcaaattgtgaggttagccatggcgagatcgagatcgatcgagcttgagcttacctcgtgaggagctcggtgatgggcttggaggagatgagcgacgacggggcgccgttggcgatgcgctcgatgtacggcttcacgtcctcgtactccaccaccggcacgcgctccttgaacgccgcggcgagctcgtcctcgccgccggcggcggcgacgacctcgtcgccgagaaaccggcggaggtagtcggtgccggtgttcatggcgaggacctcggcgaggacgcgccgctggacggcggcggcgcgcgtggtcagcacctcgatgagctccaggcacgccggcccgtcgtgcgggtcgcacgccgggatcatcggtggcagcgccgccgccgtcgccgtcgccggcgccggcgaagaggcgtcgtggtcgtggtcgtggtcgggcgcattttcagacgacgtggacgtcattgttagatgatccatgcatgcatgcactctggcctagttctcagcttattcagctttggtgtgtgtgtgtgtgtgttcttgtatgtgtgcaagctactgtttttgcagaggtgagctccttcttggtctctatgtgttatatacatctcatcataagcatgtggaaacttttttagtcggacaaagagagaaactttttagacaggggtgaggatcctctatcataatatcactaccattatagtcattggtatggtatgtgagtccaactctactattgtctcacacgtcagtgtctgtaatggtagattatggtagaggacgtgaaccctttagatagagaaatggagaaaaaaatttagggagagaaagaaagatttttttttgaggaaagagataaatgctttttatggagagaaagcttaagagagaatttgtttagaggaagacaaaaggagaaacttctttttagatatagagagaattttttttagggagagagaggggggagatgtggtgtggacttataggagtgtgaaatttttttgtgtgtggtgcaacaaaattatgggaaagagagcacaaggtagtgtgtgcatgttatatttgagagaagggcctacacacatgtgaccatgtcttggaccttgtgattagatgcagctattatgggtcaaagttcatattggttgcctgcatgcctctccttaattttagtgtctctttatgtttctgtcattctgtgatgactgtttctttttgatctcttggcaaatagagccaaagttcagttcttaccagatgactcacctgactttcttctgaattttgacagtccaaaggttattagcttagtcattgtaaactacagcagaaatgttcagactctgaactccagtatttagcatatatacatgcaaagggtagaagaaaatgaacttttttgagtttgacgaaaagctaggtcaacttgtcacttgggaaatggtttgcatttaaaagtgcatatgcatctgaagttctgaacttgctcttcttctacttcttcagccggcaatctgacaggctgcaggttctaccatataaaaaagaaaaggggagaaattaagaagatttcttttgatgccctttcaggtgtaaataaaatactggatatatatgagtccatttgattccttgaccaatctgaggcaggccgaaactgttgtaaaatatgggcaatattatttttctgctggatagccatgtcacctagaatgtactgttgatgctatttcagatttgtttatgtggtgccaaatattgtagacttcttttattcagtatttttttttctgttcctgctttttttaaattagtgatctgatgctcaatcaagtgcatacaagattggctttgacacaacagtctgaacttttgacagaaatattagcagacaaaaattaatctcatgccagtacaattttccagtgaccagctgttctccggaggttactttaatatctcgaatacgtctcttgttgctgatgcttttatgggtgcttatcaagggagcatttttagtggaatgttaagctgacttgttgggacaccttaatttcagtcaagagtataatgacacacacatgggaaaatctcttgatcccaagctgtctctcttttgctgctgcagctgcttctgcttctgaatccaatcatgcctgctgccaagaagtgcctacaaattcgacttgttttttataaaaaataagaacacaaaactgtcagtaggcgtaattgaattattcaggctcccctgcactgttgcatcacttgacaaccttgattggttttttaatcagccaatcttttaaatcagatgtgagatgatttagccagtcagtagaaagaagtaaaataagcttgggagagatcacaaggtcaggtctgcaccagctagctgtccagcttttggtctcttgctgccattagtataagatatgtcatagttgattgatttaattttgtcatgttgctctcatcaaattgacacacaatatgtgtcttattgcgtctctgttatttgttactacctcctcccaaaagtaatttatttttaacctattttgcgtataccaatataaaacaaaaatactaaaatatttttaacttgagtaaacttcaatgcacttgtccattacaaactacaaagcattgattgctctaaagatgaggttttcgtgagacaaataaaattaaggaaaaataaagttattttgggacggagagagtactgaactagcatttctctactagcttcaattatagcccctttcgataatggaaattaatccagctctccaattatggctaggtattctgttctcatagaccatagactgcaaagactgaacttctgcaacttgtacaaagtaagtgccagcttacttcagcaaactttctgctacttgtgtattctgcaacttgttgtttgaaagaacctagttattctgatcataatgcatcagtccttgtattaacaaataatttctatataaactaattaggaccatgttacagcgctgtgagctagctgcatctcagttgcagaacatgacagtgtgactgactatatatgccttgcattggaaagagagaaaactgatggagtcaatcaacacctaatagggtcagtaaataattgggcttgtctgcaaagaacaaatgctataaaaagaaactgttgttttattgtttgctagcaaaattcacacagtgttgggagaggataagcctgttgtttagtgaatatatcaattgaatggggatctgctagattcggttcttaaatttaagtaacagggaaaaatatgcaagatgcaggtgacaacagcttaattgtgcagggggcagaaga

SEQ ID NO: 59436 - DNA, 1134 bp, Oryza sativa
cccgatgtccgtgacggccagatatcatgcaggatactttggctaaagttcaatgcacatggttggtgaagattttatatggcatacgatggaggtattgtgtgcgtataggatgcggagtcgaatttgaaggagtccaaatttggtatgattggttatgtaaagtttgtttcttgtacgagaaggtttcctatggggattaggacttctagtatgagtttagttcgtggctttaggctgcctacctcatgtataaatagagagggagcgtgaggcttcccggtatcgcttttgagagcattgagttgctagtttagttagggtttcgagtttagttgagatttttgtaagaagtgctgttggtgcactttgtaaacacagagagaagcaataaagttgtcatctacttaaagagtttttcgatttgtgttttctcgggtgcagcggtccaaccggcaggacacctgcggtcagaccggtggcatcgaggtcagaccggcggagcaacggtggtcagaccggtggcagcgacaggagctggcaggcaatctcggcggttcgaccgatcgatctatatcggtcagatcgacgttcttcaggtggtcagaccggcgctgctactttggtcagaccgcgatccttcgaatttgagggtaacttttaatttcgcaaaaagttgggtttttgggcataccaaccattcaccccccctctggttggcttagttcttgtgattcgatcctacatatactagtcctatttggttacagttggatttaaagttgtaataggtgttagcggtggagttagagtcccacaatgtaaccatggcgactacaatgtagcgtagacacgcagggagataatggaggcgtggccatagactcgtagctgctaggtgctatattggttgggaggagcgcccataatcagagccccgaggatgtaggcttcggctgaacctcgttaacaaatatcgtgtgttcttgtgtcgtcatctggtgtgtcttgggtgatcaatgactaaagcgatcagaaaggttagtcgtcgttccactatatcgaccaacttttataatagtaaatgagaagatgttgcttgagatgttcaaacaagatttttttaaaaaaact

SEQ ID NO: 59437 - DNA, 7841 bp, Oryza sativa
  unsure (1)..(7841): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtccagtctccactcgcaaacccttctcgccgccattccttcccttccccaaagccaccgcaatctttctcctcctcgtcggcggcggctgcgaattccgacttcatattctccgagactccgatggccaccaaatcacagaagaagaagaggccttccgggcctaatccttctatcaaatccaaggcctcgtcctccgaccaaaaacctaagccttcgaaacccacggaggaggagagggaggagaaagcggcggcggcggtggcggcggagaagccgaagaagaagaaggcgaccaacgagatcgacaagatcttccaggccaccaagtcatccggcaagaagcgcaagcagcagcagcagcagggggaggaggaatctgtgcgagccaagaagcccaaggagaggtccgagggggccaagaagagcaataaggctaagaagggtagcaagggcagggacacggacgacgacgacgaagtcgaggagaagcggccgcggcggcgcacggcggacgggctggcgatatactccgccgacgagctcgggttcggcaagtccgacgccggcggcaccccgctctgccccttcgactgcgactgctgcttctgagctttttcccgggggttttcctgtgctcgaggtgatgttcttatgtcaaatcctttgtatgtttgtaatgcttgatggattctgttgggaacatgcgcttagatttgtgctctaatggaatgaaattttggttcgtgttattgatgatactggatgataacttggggggacctatctacctctgttttacatcacttctttgtggtgctaatgccatgtcaaatctctatgaatagaggatggtgtattcttacagcaaagaaagatggatactagttcacaggatcttgagaaattgagatgatatatgaatatgatcataggggaaaaggtaatgtgtattgtgtagcgttataagataatgcctagaaactttgctggtattgccactgttctgaaactgaagctcaaagcttattgttggccggaacatcaagaatgtgcatcaacattattcagttgaattaggctgattgtttcctgatatttacgcatattgagccctgtatggattttaattcttctagtgtatcagtgttcagttctaggcaatgagcccatgagtgtaccacagttgatttctgaattatgatatggtagtttatctgaataagagtaccctcttgtatgttctctgatattgttatgggtggcaggcagaacctcattctttgcctcagagtagcaaatggggctctgtctgggtgcctggaggccctggagaactcttattcagataaagatgaggtttggttgtactgttgtagaaatactttgccatgagcctccactcatatttggccatgcgctaacaagctccctgcaaaccttgagctctaaccatcccctccctctaagcatccaccccagcacctcatcagcctcaccgctgcctgaaaccttcttggcgccgtcgagctcatccctagccaccacaaggcctcgagcgttttcacatgaagtcactaccgttaaagcttgtcgtcggtcgctgcccacaagctctcacctcgtttatcaccgtccatgagtcgttcaagggaagaagaggatgagaaggataaaaaagaggagggaaaaagtccaaataccccccccctcccctgccccgaactttgaaaccggatattcaaccttccctaaactttacagtaccatttatataacccctaaggtggtttgcatagttgtttttatctaatttatatatatattggatgcgtttgatcacgtgacatacacattggacatatatattaaaatctccacctgaatctttcttttcaccccttgttagctctcacttacaaacaactaccaatatattaatagtatgatatcaatgtataagtataaattgatgacttacaaccgacgatatgcaaatatgttatattagttattcaaagttattcgtttaagctttcaaaatatacaaaaccacaatctaaaaccatcttagggctaatatgaatggtatcgcaaagtttatggggttgaatgtccgatgttaaagttcagggtgctagatagactttcatctcaagtttttatttatttatttgtggtggggggggggggggttagtgcccatgtgatgggccatatcaaatttacgactggcaataatacattctgcaagtttatggatttaaatatgtatggcatgtttggtagagctccatctcctaaatttatcttaggagttgggtttaaagtgtagttgtagagtagcctaaacccacctctatctctttactttagtttattttgtgaaagcacttcgcccagctccgttcccattttagatgaagttaaaactgtttggctgagctccaactctagaagaggtgcagtttgagctagagttgtgccaaacaagcatgtagtttcaagtttttagtttaggttcgcccttgcattttaaattgcaacgattgctcagattgggaactccgcgaggagcccaagatctggctaaaggctgagccggaattgggagtactgaaaaattgggagctggtttaggcatacgttggcgacatggttttagaccaaattcctaaaatttatcctttgggattggtattagcatattagaaagctattggagatgctcttacttggtcactccctttttgttatctgatttagacgtacatactcacgtttaggcatcgaaacattagggcatatttggtacagctccaactcctaaatataactccaggagttgagtctggagtgaagttgtggagctgcctagacacagctctacaactctagtacattttgtgagagagctccacccaactccacttccaattttggtggagctgaaattgtttggctgagctccagctccaggagaggtggagctggagctgtagctgtgccaaacaggcccttagaagggctgatgttgccccagcctggcagcatcgactacccaagcccactcccactgtcgcacaaagcgccccacccatacccaagcttcccgctaatgtaggctcgacgtgtcactcaaaccaccacacagtgcgctccacaggccggcgaggtcggggaggtgggtgcacagtgccctgcgagatggcggcgaccgcgctgctgcggcgcgcccggtgggcgctggtcgaccaccccgccgtcgcctccttccggtgggagcccggccgcacgcccgcctcgaccccgtccttcgccgccgccgtcatctgcgcctacctcgccacggtgttcctcctccaccgccgcgtggtcccgctcccgtcgccgcacccgcgcgcgctccgtgcggtctccgcgctccacagcgcggtcctcctggcgctctccgccgccatggccgccgggtgcgtgctctccgtggccgccacggcgccctccgcgtggtgggccttctgcttccctcccggcggcgccacggcggcgtcgggcccggtcttcttctgggcgcacgtgttctacctctccaaggtgtacgagctcggcgacacgctgctcatcctcctcggccgccgcccgctgacgctgctccacgtctaccaccacgccgccgtcatcgccatgtgctacctctggctcgccacgaggcagtcgctgatgcccatcgcgctcgccaccaacgccgccgtgcacgtcgccatgtacggctactacctctgctgcagcctcggcctccggtggccgccgcggtggaagcgcgccgtcacggagctgcagatcgcgcagttcctcttcagcttcgcggcgtcggcggtgatgctgtggcggcacttcgccgccggcgggtgcgaggggatggccgggtgggcgttcaacgccgtcttcaacgcgtcgctgctcgcgctcttcctcgacttccacggcgccgcctacgccgccgccaagggcaagaagagcagaagcgaggtggttaaagaagagtaatgaggtgattaataatcagaatgcaagaaatgtgataatctgtgggtctccgttttcctctaatttattggtttcctttttttttacatcatgatttcattgtgttaccaaacaagacgttattgtgcgataatcttgcttgtcatctgggatcgatttctctgctgtctgctcggtggagtaatttcagcatgaacttgaaaacaagaagagtgatgaacttgatatcgattaaaaactgggggcgatttctctgctctgtaatgggccgcgtcctcccaaccccgttctgggcctactaatatgggcctcacgagtaaactggattgttttatgtacacaattctttttgtcttcaaaaattaaaaatatacccctaactctctctgtaaagacgttttttatttttttatttattttgcgaaaaccgctctccaagaggtcaggaagggacttaaatgcattttttctatatagtttgccactttacaaatatgtcaaatgaagttggataaaataaaactttacatcaaaattacagagctcaacaagatccatcagcattactagtaactaaaacggacgggaagtgaaactgtaaattaaaaaaaatatttaaggatttcttttttgaaagggcgacttttacaatacacagtcatgcgttagagtatactccatctgttaaaaaaaaacaataaatttagacacgtgtgtctagttttgttggatttaaatctttttaggacagatggagtatttcgtttttttttccaattatttttaaaattttttaaagtaaatatataaataaaaattctcccgcgtaacacccacgggctaggcttcagttgggctgtaaaataggcctttttttcttttaaaaaaggcaccttttattgttcagccggtatttccgggaagatcaatcttgcagagttgctgtcagaaaatctgcaaaacttgtccccatttctacttctagctgcacgaaattttgtagttaaatcattatttttctgtatttcaagacttgctctcaagtggcacctgcgaggctgtgagcatgtgaccacggtgactgtggtgtgctcgtcgcatgttacgccatggcgattggtgtggtgagaggacagagggggcatcagccgatgccgtaatggcgtaatcacagttcgtttcattgccaaggttacataagtcaacttgagatttgccagccagtttcgatgaaatgagaaagaaaagcttgaacaatagcgtagactgatatgagaaaaaaagtattttttaagtacaatcgcagacgacaaaatagtcattgatgattgattgattggtaggagtatactggatcttcttttttgttttctatattgcacatttcagtgtcgcgtgaaccaggaaagaaagactaccatttcagcattttcgggaccttctctataattattgaagccacacggcgagatgaatagcataaggctgcctttttatatactcctatgaagaaagtggtataactcaggtggtatttttcttcaagagaaaaagggggaaagttgcaagaaagactactctccattgatgatcaaggaaaccactagaaaatctacacttttgacaagagtcattagcaaaaatgtaagtagaaatatataagcagggaaattatagaagaaactctcgactaaattcacatgagagggggccatggccatggcttttctttgatcaagactacacagtttgcaccttggcctcatgattctcctttcttacacaaaaaccgagacgaccgattccaccagaggatgaaaatccacgtagatccaccaatcagctcgcgaattaagggggaaagaagagatttgcacctccaaatttgtcgcggcatactagaagctactgggtgcccggccggagaaggccatggcgaagaggaggatgacgaggtagaagaggatgacgacgagcttcatctggaacatggcgaagaagagcttcaccatgaacaccagcaacagcgcgtcgaagatgatcgtgatcgccacctccagtggctccatccccgccgcaccagccacctgaaggctgcacttctcttaattagaccacaactgcgggagaaaccaacatcgtccggagaaaaagattggtaaagttggggattggtgcgctataagcgtcaagtagtggagcatggagtgagacgagtgggagaaggaaggagctagaaggcgcacctgacctgaccccgctgctgagggcgacgcggtttgatcggtgattgcgggtggggaaagaagaatatgcgtagtagtacacgcggatgtgaactgcccagccgctgaggtgtctgggctctgggcgtccggtgctgatcgggtaggccgacacgaggagggacaagagagtcaagccgcgtgccgacgatggcacgaggcagagcgatcaattgccaccggcaccggccagccaatttgaaccccgcggttcaatcggctgcaggttgatgtgattggcttggagtgcaatgcgcacgtcgtccagttaccttggctttgataatgaaatgcacagcacagaaacctaaggatctgcaccttccccaaagatgcatcctgagagggttcacacagaaagaaagtgatgttatttatacggtccacatgcactaatactccaccgtccaataatataacaatctaaaattagatgagacaatttataatacaataaatctgggcatgcatctatctagattcgttctaatatgaaatgttccatccgattctagattgttatattatgggatagatggagtatgtattagcttttcaaagattattatcgtgtactacctctgtattttaatagatatcatcattgttcttttattacacatttgatcattcgtcttattcaaaaaaattgtgtaattataattaattttgttgtgagttatttttgttactcaaagtactttaagcatgatttatatcttatatattcacataaatttttttaataagacgaatggttaaacgtgggttcaaaaatcaacggcgacatctattaaaaaacagagaaagtattatctacctgttatagggataaattaagtattttaagaaataaaactaacaaataatttataacaactgaatttcttttatatatcatatttttagaagcctagagcaaaattcgtgacaataatatagtgaataaactgaaaagaagatactagtctagtagtatgtaaacagataatgagttctgactgtgtttagttccttccaagtttagaagtttgggttgaaattagtacgatctgactgtgtgtacgacagattgatgtgatagaaaaagttagaagtttggattcaaatacagcctctgtatcagtcactatgctcgtcagtagtccgacagaccgacaggctaggttcgttctgacttcctgagactgagagggagtggcgactagtgtgcatctaatgctgccgttaatgtttatgggtggagatatacggttttctttcttttgtaaaaatagctgatttcccttcgttacaaaacatctatctattatattattaaagaaataaagaaaggagcctccacgttcgctctcatggcctagaaatcctcacattaatcggagaaaaagaaaaggcaaagtccatatagaaataca

SEQ ID NO: 59438 - DNA, 18828 bp, Oryza sativa
tattagaagaggagactagagatagaaataaaattaggaaatcactaaaattcggaattaaaaataataaatattagaagtagagtatagagtccatatagaaatacaattaggaaatagttgaaatttggaattaaaaaataaggaatattagaagtagagtatactgaaattcggaattaaaaataaggaatattagaagtagagtatagagttcatatagaaatacaattaggaaataactgaaattcggaattaaaaataaggaatattagaagtaaagtatagagtccatatagaaatacaattaggaaataactgaaattcgaaattaaaaataagaaatattagaagtagagtatagagtccatatagaatacaattagcaaataatataaatttggaattaaaaataaggaatattagaagtagagtatagagcccatatagaaatagaattaaggaaaaaatagaaattcagaattaaaaaataaggaatattagaagtagagtatagagtccatataggaatttaaaactaactaaaatttggaataaacataataaaattaaaagtatagtttagagtccgtataaaaatacaatttacaaataactaaaattcgaaattaagaaaaacatgggaagaagaggtgaaggtcaatataggaatacaatttagaagtaaatgaaattcgaaattaaaaattaaagaatattgaaagatgagtttagagtccacatagaaatacaattagaaataataaaaattcataaataaaaataaataatattggaagaagagcatagagtctatatagaaatacaatttacagaaaattcagaataaaaaaatatattaaaagacgagtctagagtccatatagaaatatatataatttacaaataactaaaatttgatagtaaaaataattaataaatagcacgtatataaaatataatatgaatattacacattagtagttttgtaaagttattacaaaatttaaaattatgttgtcattttaatatatttgaataatataatgagaaaacatatatgctattatatgagagaaaatataatgatgctagccgcgcaatctgcgcgggccaccatgctagtttggttaaactgcacattacttttttgaaatctaaaaactgcgaagccagcgcgtagaggaaaaacattattagtactatggcgtgcaatcaaaatccttttataatccataagtaaaaataaagaatacagagtaaatcactttataattataaagctttcatgtgaacgagtttacctcaaccggtaaagaagaatcagttccccaatcaagccatatacatgtagcagagacggcgtacacggtacacttctgagatttctcgaccgaacagcttctaagatccagttggctgtactgagaaaacaaataaatgtcaaaagatcattaaaatgaccagtaatgctgaaaagacttcgaaataaggcatgaatgctggtgcatccgtgcatgtccattgtcaattcacgagcagattataaaatatcaaaagggacgaagatagcaaagtatttacctgattttcgatcaaactggaataacgaaagcttagacattctttacccacttcaacggtgaccccagagagttcatactcaaaggttatcactaaagctagctcatagcacaattcatgcttagggttctcgcacccgggacatcttttgcagtaatcttcatttgaattccatatcaaaggaggcaatacaaggttcagtaaacaagtcaggatagtcacaatgcagtaaatacacagttgaattttctgaagttgttcatctgaagttggttgttgtcaaatcacacgaacttcagcaaaaagatacagacattctattccaggttgctaccatgccgaggtagtgctgttttgaagagcagattaaaaacaaaccacggtgctcaaagtcaataaaccaacaataatgccctaccttcttttgtaataatccagcacggctatcacaatttgctaaaattccagctagatggttggaagcaaataaccatgaatatttctggagcttagcatatgaaggcaactatcatttttggaatgtcaaaagcaatttcctttcagccattctccagaaacaactccatcctgctatcgttatctttatgaactaaagaagcaaaatgaggtcaaagcctcgaaggttttactcctatatgacatttttaaaaaaatcaagcaatcaattcccatgtcagcaaatccaacatctcataaacatccggtaacaagggatgctttgtctcccaagaaaagaaggcttgatattgacctcttatctgaacccaactacacccaccatcctttttaagattgatccctttcattagtatcctcatctcagcagcatctttccatttcccgcaagatgcatacatatttgagagtaacacataacctgctgtattatccttgtccaactcctggagcctctttgcagccctctcacccatttccttattcctgtaaatgttgcaggcactcagaagagcagcccatgaatttgcttctgatttgctttcgattttcaggagaagatcttctgcttctgccaaatgaccagctcgagcaaggacatcaaccatacatgtataatgttttgctttaggtgatataccacatgcctgcatcatttcgaaataatgcatggcatgctccaccaagccactgtgggagcaagcaaataaaatggctaaaaatgtctgctcatttggtgttattcctgctgagatcatatcctcaaataacagaatagactcctctgcaaaaccattttcagcaagtccttgaatcatggcagtccaagcaacatcatttcttttgggcatttcataaaataccctcttagagctatctaaatcccctgacttagcatacatatcactcagtgcagtcccaacaaagatgctttccttaattccaagcttaatgatcttagcatgaaccatcttgcccatctctaaagaacacaggctagcacaagccaggagaacacttgagaaggtaatttcccctggactctgccctgaagctaacattgcatggaaagattttaatgcatcaataaactgtctattttgtgcataaccagagatgattgaattccatgaagcaacattccttgcaggcatctttttgaagagttcctcagcttccaccatttttgagttgttgctataacctgaaatgagagagttccaacatactatgttcttttgtggtagggagtaaaaaatcatttgtgcatctggcaactgtttgcatttgcagtacatgtcaatcagagcgctggatacaaatacattattgctacaggccatctttaaagtctggttatggatctttcttccgcttcttaagtcctgaaggctagcacaagcaccaagaacgctggagaaacatgaaatgtttggcctacaaccatcagccagcatctgactatacaaactcactgcttcttttgcattgcctttctgttcatgcctagcaaccaaagtaccccaggagacctcgttcctctcaggcatttcatcaagaacccgtcgagctccctcgaggtcacccaattcagcatacacatcaagcaaagcagtccatgaaaccacatctctcacctccatttcatcaaacatcctgcgtgcagcatctgcatctcccttccttaagtatagtgtgatcaaggagttgcgtaccccaagatttttgtcaagcaagtttgatttcattgccaaccccacgatagacatggccagatcgaactcacctgcaccaatgcatgccttgatgacggagaccaaagtgatctcatttggactcacgccgcagctgagcatttcatggaacacgccgagcgcatccttggggagctcattgaggacaaaccccgcgatcatcgcggtgaagaagggaaccgagcagagcgggcactggcgatacagctcaaccgcatccctcacggacccgcgcttcatgagcgcatccaccatggtggtgtacgacacgacgctcctctcgggcattccgtcgaacagccggcgagcggagacgatgtccccggccttgacgtgctcccgcaccatgaaatcgtaggcgaacggggacgccgccccgacgacggagacgcagtcccggaaggccccgtcgcggtccgccgcgcgcgcgaaggcggcgtaggcggtgaggaggtgcgacgccaccgagccgtccgcggtcaggccggagacgagcgcgtgcgcgtggattgagaggacgagcggcaggtttgaggaggcggcagcggtgccggaggcggccgcggcggcggagcagagccggaggatggacgcgcaggtctccgcgtacgacttgaaggacttcggcgtgggcgcgagcggcgggccggcggccaggcgggacttgaacgacttgaggctctccagtagcgaggttgccggtgcacgggccttcgccggcttcgactccgcgctcggcttcggcggcggcggccgccgcggcagcggctgcggcggcggccgcttcgtccgcactgccgggctcatgctcccatggtttgaacgaaccaagaaagcgtttccgtagactaggctgtcgtggtggcctggccacaatcccctgtgaggcagcaaggcgcaaaattgattttgttgggtattgattggctgataaaatctaattttttagagcaaatttttgcacaaccctagattttgggacatccgtaacgcaaattgtttcatgaaacccaggttttagggcaaagtgtttcataaaacctcagctacaagtttatatcatctacccgactatatacttatctataattattgtaaaaaattgtatgagatatttttagtacatatacacattagttgcttttcaaccatcgttgatcattgttctatgatcatttatgtgtatatttaaccaattattatgtcattatcagttaggaaatattgaatttcttgttcaatgaaaaattcagaaaaaaaaaaactatacatatacacgttagttgcttttcaacgatcgttgatcattattctatgaccatttatgtgtatatttaaccagttattatgtcattatcagtgaggattatattgaatttttttgtacaatgaaaaattaaaaaaaaaactagactaggggaacacgtactttaagaattttattaaatatgagtgttttacataaatatgggtttttttttaaatgttttgctccaaaacatttggttccttgaaacaaaccacaataactggatttttttatggatgccccaatacccaagtttcgtgaaatttactcaattttaaattaggtcctaagtgtcctttaaaacttttatgatgaaaaaagataagtgctattttaagtgtttttatttattttatgttttaaccttggctttgaaccactaagagtataagtattaaagtcataccctgcaaccatttttttggtttgtttattttcagtactgtaaagaatatttctgttttgatgtgaatcgggcaaaaaattgcaaattaacctacatggccaacttgcacatggtgaacaatggaggccattgcaaattaaacaaagatggccattgatctgaacagattgattccatggaacatatattctgaagaacaagtcctacaaaccgatgattttgttttgttctctgcacaatcatactcaatgctacaaacaagacacgcctgcagtggtggcagtaattaattcctcactggctcttctccatcccgtaggtatcttcagcaccactggcaaccttccgcctcctctcagctatcatttcggtgtatgcctgacaattcagatggttagttctacttcgttctctgcacaaacaagcaattatctaacaggaactactgcagatcatgttgagacttgagagttgagaacacattcagatcaaagactacagatcgaaagtagacaatatgtgatggttacaccgacaaggtccagtcggaaatcagaaataatgctcgtcacttcaggaactacggcaacatctacaaaaaaaactatagtacagtgtatgaagcactagtcgaccagggtgatgttaaatctcaagtggccacaagatttctctgcactcacgccggccttttgcatgtagtacttgctatcttgataccatgcaatctcagttgaggctatcattagctaaatctaccctctagtgctctatgtttttagttctcatgtatacagctagctcgtgaattaaagtacatccccttaatgcaaacatatgctaaaaaactaaaattatagtgtccattaattttgagatattactatgtgattttgttaggagtaaaagtccaccaagacacagttacaaacattcttgtgcacaatatgatgtgatgaaagatgtatctgatagattctggtaagtggggggacgcacaatcagggtaagaaagctaagtgtataatttagcagtttgaaaagaacctatgcagttatgctataagcctgtaactacattagttgcataagaattatgtcaagaccaaacgagagtgttatttcaatctactttcatcaaccgtctgaaaattcattttttttacgcaaaaaaatatttttttgacgcaagtctgaaaattcatgatcatgggcttgtggaacaatcataagtggagccagtgtaacctacaaggctctgacctctagccaatcatataaacaccacaaagtggcaaaaagaataagggaaatggttttcaaaccttgggataggaataaagaaatatgtaccaccatgcacatattacaaaagaaacccctccggtgatcacagcggaatggatgggcaaccaactaccggcaattgcaacagcccctgaaagtaagattgtccaaggctgacacctgaaaatgggcattatatatagttgtagtgatcatactcggacaaaagcatatgaaaggatatagttctgtagagtcagaagagttaaagttgttagaatgttcaacagaaaacaataaaagatgttctttttccttcttatctgatacaacttgtgaagatctactaactttggaggttgataggaaattgaagaattggtagacatcaattaatccattgtttatttgaagcaaagacataatcaaaattcactggaccattcagtcattgacgatggacaatagtatcactgcatttatcatttggcattttggttataatttacaattcacaacatatcaacaaaatttcagattgtttttcctctcatatatgcagagaacagaattttagtctctactttgtcctactactattttgctcaactcaagctgcttcaatttacactgcaagaaacgaggaaccaagaaaccgtaccaagaaggcttggtgtcccagacggagtcgtactcgagcgacaggtagttgaggtacccgtccatgtcctccaccacgccgtcctccccgaagaactccgcccctccgctcgcgcccccgtcccccttgccgccgccgcctgcacgcgagctgcaaacctccaccggaagaagcggcgccagaggaggaggaggaggaggaggcgaaaggcgctgcggtcctcgcgagcctgggcgtccgcgagggcgacccgccgccgccggccgcgccgcaagagcagcacggcggcgtggacgggagcaggcagagcgcgcccatttttctcggcctccgctgacgtacggcgcggctttcctctctctcagagcggctaccgatgctgcgggttaatggccagtatttgttttgcgagcaaatcctgatttgtagcggaaaaattcgatcaaaattcattttgtctgcaaaaccgatcaccggccccggcccaattatcagataatgggccaggccgatgttacctggaactcgtcacggcccgtttatgattacaaaaggccaagttatacgccagcccaacaaccttcgacgtcgtcgccagccgtaccttttgctatcagttcttgacgtcaaatagggtgtaaagtttcgtggtgttaacgtccggtattggatagggtataatttatggtgttcaggtattaataaaaaaactaattatagaatccatcagtaaaccgcgagacgaatttattaagtctaattaattcgtcattggcaaatgtttactatagcaccacgtagtcaaatcatgtagcaattaagcttaaaagatttattttgcaaattaatcgtaatatgtgcaattagttatttttaaatctatatttaatattttatgcatgtgtttagataatgtgatgtctggacgagatctatacaccccctatagccgaaaaatgtactctctccgtccaaaaaaaaaaagtaaaccctgagtttccgtgccaacgtttgactatccgtcttatatgaaatttttttataattagtatttttattgttgttagatgataaaatatgattaatactttatgcgtgacttatctttttaattttttttcattattttttcaaataagacggacggttaaatattggacacggaaagtagggtttgtcttttttttttttttacggagggagtactcctgtacaacctcgacacacggggatcgtacgttccatcgtgaccgcgctttacaattctcgacctcaacacgtggcaactggctagtagctagctagggaaatatcctcacgtacacatgctatcctggccaaatgatcaatcgatgctgagcaacctactgtagcatgcatgcatgtgtccggtgagtctctttcgtccaacgcactacacgcccaacaaccgggagtgtgcccgatccacacgacacgcggacggcgtacgcgtgtgctcttatccgaaacgccgccgtttccggatgtttgtgttacaaccttatcgcagagaccgatcggtgggtgactgatgaatatccctccattattttactcaggtatatatactctttccgtcactaaatatttaacgctgttaattttttaaaacatatttgatcgtttatcttattttaaataattactaattattttttattgttaaataggacgaaagttcataacatgtttgaaaaaattgacggtattaaatatttaggacggaggactatatcgataagaacacgcgcgtacgcctcgtccccacgtacgtcgcgcgcacgccggcgacggcgacatgggctccgatccgcacctccccgcggagcaggaggaggaggatgcgcgcgaggccgctgtggatggcgacgacagcacggtgtgacgaggttagcagcgagcgatcctatctaaactgcccaaacccaacagctagcgtctagcgatcgatcgaggataaaaattctagaaacgtacgtacgcaccgtccgtccgtccgcgtcagcgcccacgcacgacgcttgcatccgccgaactgccggttgatgcgatgcgatccccgggcgacgcgtcggtccaatcaagttgccgcgcgcgagctgctagtaggtgataaggccaggcacatataaaaacgggtctccccatctttccatttggcaattggctgcacaagaagcagcaagggagtgactcggagtcgtaaaggcgaatatttagctgctactacctccgtcccatattacttgtctttttttgagtttttatttgtcaatatttgatcatttgtcttatttaaaaaaatttgaaattattatttattttgtttgtcatttgctttattatcaaaagtactttagatataacttatcttttttttatatttatactaatttttcaaataaaacgaatggtcaaacgttacaaataaaaagtcaaaaacatcgcctattataggacggagggagtaggacagtaggactgaacatactacaggtattacatatggcaatgactaatgacgaatagacagatttcgttttaaacgtggggaaagttcctcgattcctatatttaactagccagtttaaaattgaacgaaccaagttccacttgaaccgaatcgttccatatcaatggttcttttcataacagtggtccagttaattgtctaatgcataattacttctataatcttagaaggtatctactccttgatggatgcaagaacatttcatttgtatgggacagctgcatctgctattgtgcacggtgactactcattgcagctctacgattttttaaggggaaaaaatagcatgcttcaatttgtacagtggccacacacacacacacaaacaaaaaaaaaacagcaatcaaagacaaattccttgctcatagtgccatttacattttacagcaaacaaaagctgatcatcagaactgatatacacatgcatatttccttgtcagccaggcccatatacaaatacactgcacacgcactcagcatcaggaatcagaataatttacatgataattaatggacagtacttgcttttattagtggcgatttgtttatgtgcgaatggattaggaaccgattacgccaggactgacgttggctggatgatggagtccagatcggacctcattcccttcgtcttctccgcggcgccgtggtcgagctgttcgccggcgacggcgacggcgacgccgccccaaatctccgggatggctcgccggaggctgccgatgctctcaagagcgtagtcggcctccttgctcctcaccctcttgccaacctgaatattaattgagaagattaattagctaacgtaaattcgtgttcatgcaggaaacttagccgcaaagtatgcaaattagttgggtctcaatgggctatggcccctgttatcaaacgttggcacgtcatggatactgttcatcgatgcgatgggttaacggctgtacactggcagaggagattttttgtgtgtgtctcctgtttttttgccattatttttcactagcttttgttgtactagtaggaaaggactatatataagtgctatttttctttttagaaattggttgttgaaaccgaatccagcaaagaacacatcgaaaccatatatttaaaaagtctctatatttaaaattataaattttccctgctcaagtagtatcaagaggcaatttgttcaaccaatcatgggggatcatatatgccagatatatcaatcacaccgaccagagccgtgtcgacgacatggccaatttggtgccagccacaaatgcgagagcactaaattatgtgactaagcgtccatgtgcaaaagcaggattaaccaataatgcacacacagtttgagtgcataaaccaaactcttggcatcacggcaatgaagaaattgggatatatgcttttctaatccgacaaggccaacaccatcagcgatgcatcagctgcagggacgctgtgtgcaccggccacctgatcgaccaacccatcgacaaatggacaggcagagacagcaacttatatgcctcattgatttttgtgtatttttcccgataattactataggaattgaatcgatatctaccaatcatgtaaatttttggtgaaattaattttactgtgttttgaacacatctatgtcccgtttggagctagtaaggattttatggtagtggagaaaaagattcagatttcaaaacaaggaaaatactgtcacttggttatagtagcttaaaccaacagtgcggtacgaagaaaactgaaacacacaattaagttgtggtggttaattaccaggacggtgcggaggctaagagcttttcctgcggcgatgttcctctcgctgtcgtcgaggaagagctgacagagcaagaacgagttatttactagcttcgtgatcattgacaagagcacaaacgaagcacgtaaaatcacatataccatatgtgtgcgatatgtttgtttcgatggaaaaggatacgctgacaaagaccctattactactcgttactttctaagccttttgggtttacactcgatgtcactttccaagatgcataatacactctttggtccatagacattctatttccttgttgtgataagaaaaatggaagagtgattaatacattttgggtttgtaaattaacggtatcattagaggatagacctgctgttaaatgtacatggttagataaaaaaaatttggtacttcgagttacctatatcgactggagatactaaacttttcaccagaaaatgagttacttcccagtatatttttaagaatgataaaattgcccatatggttaactacatttacattgcaacaagctccaaaaaatcctactgaaaaatgtcgagcagggtgtggtggcttaccgtccggtgtggattggtgccggcgatgcgcagagccgcgacgatggcatcgggggacggtttgaggatcacgccggggcggtcatcgccggaggcgcacggcgcctcaccgaagaggtgagggttcatggtctcgaagcacacgacggcgtcgaagcagccctcgtcgacgctcagccgctgcagcgccttcctcatgtgcgcgcgatcagagttggtgaacagctgaaacacgaacacgaattagctgcctccaattaagtccggaaaaccacaggaatttcacaggaaaaaaagaggatgcgtgagcttacaattttgcgctgcgggatgctccgcagaaggccggcgagctgcgggtcggcggcgatccggtcgtagggcagcctcccgtgcacgtagctgcgacgataatcgatcaaccaagcagcgtcagcattcggattagacagaaaattagccgcttaataattactaattggcttgtcgaattggttaagcaaagctgcaaaggtaagtgatgtgatgtgttgtgctgacctgtggtactcatccgggtgcacgtcatagccgagagcctttgccgcgcggaaacccaaatccgaaagccaagttagaaacggaaacagaggacgaaaacagaggcgaatttggattgttcgagtgtgccgtgcgtgcgtgcgtggggggattgggaattggacgtacgatgaggccggcgagcgagctgccgtaggagcggaagagctcgacgcggagcgcggcggcccgctccgccgtgacgccgcaccgtgccatgaggaactcgtcgatgttgcgcttcgtcgccagcccgatgcccgcgcttcccgggtacagcgtgtcgtcgaggtcttcatagaaaagaaagaaagaaaaaaaaaacagcccgggaaaggcagagtttagacggagaattgaaagtgatcacgctatgagaggagcctagaatcgagagacaaacgtggttaccaaagaggacgcagtcgaaaggggaggaagcggcggcggtggaggccattgttcgacgagacagaggtgcgatggcgagagcgatcagactagcagagagcgtgtgctgattgtaacgcggggagaaggaggggagagcgggtttgggggtggggggtgcgtttaaatagagcgggagacgagctggggggaggcgtggatcacgagagggaattggaattttttttggtgtgtcgccgtggcggttcggctcgtgttcctcgctggacgcggcgctgtgttgtgcggtggtcagtgtgcgtgcaccgctggttcctttcctcgtgcgtgcttgcgggcgaaagaagggaagggggcggcactgcggcaccttggctggctcgctttcgcgatcggtttcggcagacgggcagacggcagcctgcgcgccttctcgccgtgcggttcgttctctgcttccggcctcctctgctgctgcagcccctgaaacgagggcaggaggatattttctggcggattgaccagactgggaatcggagatggattccgggtgaacctccactctgtttcttttatgcaaactctaatgattataaactttttttaaaaaatggtaagataaatttatatatgaaatatatcacttcacaacataaaaatttaaatctagcttttacaagttgtaataaaaataacaaagtgaactctaactaatatatttttttacagttagaagttcaattcgtatttgcatgtgcgtaaaataatatattaccattaatttattttatcattttttaaaacttttacgtaatcgtttagttaacggtaagaaatgggtgaatgtctacggaattgggattgttacggtagtagtaattctagtgaaatactcctagtcctattcagcatttgcatttttttccccagcagtctgatctgaaagtagtaaaccagtcagcagatcaaaggggattaaattagtataccaaagtactccctccatctacttttgatattcatatttctaaatctgaaaaatttatttttgattagcatatttcaatccaacaacttatcatatcaatggctttcttggatttaatgcgcgactcttcattcttacacacaagattggctacatgggcatcgagaaatataaatattaatgaatcgcctgtttacgatgaatgactagtagcatatttaaatggatgataagtagaatcatttatccttggtctgtgtgctaagatgaaatatgactatcaaaaatagatggagagagtattttccacacggcaaatacggagaaaacactgtttgtatgggctttgctttgcgcttaagtttgcacttagcaggcctaaagttaaactgggccaatcacctaccggtttactcttcactcaatccgaactccgaaaatcgagattcgagaaggttcgcgcgagaaacctttcgtgctcgatgcttccagaacccatcgatctcccaaaaacgaatgctcaaaaactatccatccatcctccgatccgccatgcggaacctccgattcgcctctccaaaatccaaagcaaagctaacccactctgcgagtgcgccaccgcgacccacccccactccggcgagccaatggacgtcctgaagcgcgagctacagcggaagcgccagctgctcgacgccgacttcggcggccgcaagctcctccgccgcgccgagatcgagcgccgcgagatggagcggatccgggaggccgagcgccggctcctcctccagaagcagctccggtcctcctcctcccaccaccgcgccgcgtcgcgctccacgaccacgccgggggctcccgacggcgacgagtcgtcgcggaccgagcaccgcggcgacggggaggagaaggagggcgcgccgctcctccccagggaggaggtcatccggcgcctgcgcgtgctgcgccagccggccacgctcttcggcgaggacgacgccgcgcgcctccgccgcctccacgccgtgctcgaggaccccgcggcgctcgccgacgtcgaagcggcggagatcggggagggccagaccaacgacttcctccgcgacatccaggcgctgcgggcgaaggccgttgcggcgtcggcgtcggcggcggcgaagcccaaggctggcgctgcaactgcagagagcgggggcgagacgagggaggaggtgccgttcgaggagctctgcgacgaggacaagatcatgaccttcttcaagaggctgatgagcgagtggagccaggagatggacgagatgcccgaggcggagaggcggacggcgaaagggaaggctgcggtggccacctgcaagcagtgcgcgcgctatctcgagccgctgttcaagctgtgcaagaagaaggtatgtgacagtattaattcacgcacacacttaagaatctgatgttctttggtgctgtaatcgaatttattgaatgcctccgatgctttcaaaacccaaagttagtggagtgagtctgtaagatgtgctaaaagaacagtatgaagcattacaattttacaaccaatgtttgctgcataaggacatgttaggagcttgggatgcttcactgtggaaggggaaatgcaagccttacagaacacatgatatagtgaagaagccaaataggttatgtgagcttccattttgaaaatgcacttcataagacatgcaacagtttcgatgaaacaccaaactgcctttgtactggtggcacattgtagatattgcaaaattcgtttccaatatcggctataattttgtaggcatgaactaagtggtaatgctactgagtgatttgagtgtgttgcaaatattgtttaatgtgttctcttcttagttccttgtagcatgaagatgttgacagacagaagctggtaatcatcatacattccggcgaacaagacagcagatattacatgtattcttctcaagttccaacctttgcgctttcttattatcaaagtgtctcatgatgtgttcagacttcagagttataaatctctgttccccgcaaaaaaaaaaaaagaagagagttataaatctctgtaacagaggaatatatttgtcttaatttttctctttgcctttgaaataggagggtgccattctgaatcttgaaacaacaaatcaattatcaggttgcagattatgcttttaggaagttcgataattccttcatgatttccctggattaacctactaccttccctccggatgataatgtcagagaatgtgctctctgtgatcaccactaaggttattttgtgttacttgtggcaacttattttctgtatgctagtgtgttcccactggaattatgggtagtttttcttgaaatggattgtttaacgttgccaatgcttgctgaattgttcaaaattgccagtgcttgccatcataggacctgctctgcagtatgatccaagaaaattatttgctgctactattcttcacctacagttgcctcattaatccaaactttttccttcttgatgtacccaaatataatgggtgtgaacaattctgaatcaccttgctaattccttccacattttgatgaatccaattatcccatgacagaccctgcccgaagatgtccgtggatcattgctggaggtggtgaggtgctgcatgagacgggactacttggcggcggtggacaactacatcaagctcgccatcggcaactcgccgtggccgatcggcgtcacgatggtgggcatccacgagcgctcggcgcgcgagaagatctacgccaacagcgtggcgcacatcatgaacgacgagacgaccaggaagtacctgcagtccgtgaagaggctgatgaccttctgccagaggaagtacccgacggacccgtccaggtcggtggagttcaacagcctggccaacggcagcgacctgcagtccctcctggcggagcagaactccaagaactcggaggagacgcttcggctggtggccgcgtcgtgacgatggaggaacctgtccgcgtgtggtggaattgatggtggtctcctctttacgcccgttagcaatttgccattgcactttgcacattagtaattggaaatcattacaggcgtgctgctggcgtgcttcctcgctgattataaattgcacattggtacaccatctagtcgtccttgactgtcaattactcaattgccgctgtgattaaattacaggcgtgtgctgctggactgtgtattcagttatccactatatcctgtcgcccttggaggcttggactgtgttaattggaatgatgattagtggtggtgttgccttgttggacatcgatcacaagattccatgattccatccaccgatcggtagccttgctcttccagctttttcaacgtaattcatcggtttttaagcccctaataacacacatataaaagttttatctatatttctttaaagatcttaataagtgttatgatttataatcaatcgtaggtgaaacgacgagtataatttatcgtaggcgaaacgatgaggtatctctgtgcattgagtataaacgaagtttcttggactaaaagctacccttaccaaatctttagggtttttaacgattgcaatagttcgctgaaatatctgcattccacgctaaaattggaagtttaaagaaattggaacgatgtgacagaaaagttgaaagtttgtgtgcatgaaaattcaatgtgacggaaaagttaaaagtttgaagaaaaagttgaaaactaaacaaggccttagcattaacaactttcgaggttaaaaaaaggtgatttgaaagaagagaagtaccttcaaacattttttttaagaagaatctctctaagcttttaacgattgcaatagttcgctgaaatatctgcacttagcattaacaacttttgggttaagaaaaacgtgatttgaaggaagagaaatccctccaaacatttttttaagaagaatctctctaagaaaaaattatgagcgtgctaagaattgaacacaagatcttgaggttgaattaataagagtttatacgttgaacacgggtccgcttccgtgtaaaccccgaggaactctccctccccaccccaaaacacgtcaggtttgttgccagttgtagccgcagatgcacaagctcgctggagcgagagaaggtgccacgatacaaatcttacaacagatctcggagggtcgaatgtatacaagatatccgataatacaaactgtttaagcctgtaattcttcttcttttgagaaggtatttcttcttttttaactggcttgagcctgaaactctcgttcgaacagggcctaagccagaaagagctaaaggggtaaacaagggaattacgggcctgtttggtacagctccaactccttaatataactccaggagttgagtctggagtg

SEQ ID NO: 59439 - DNA, 2443 bp, Oryza sativa
caaacaggccctacgtgcagaaggggaatcgcgatttctcagaaaactgatgctttcatttcgtcttagcaattaatagtcagaaagttctaacaatgcaaccctagaaatcaagcaccccaagctcaactgggacacagcagatattattttcagaaagtaaatactggttcctttttgaggttttcccagtggcccacagaatctaacctcaaccttcccctgacgacaatcgccatggagctgtcaaatctgttcgacttcaacctgcaggaatagatgcaatcagcatcaaaccacaagtacagcgacagtctacagcttgtgcggtatcaggacatacctcccgctccaagattagcaccagggtgatcaaggacagatgccgcttgagcacttgacagtagaagtatgcaaatgccatacatgttctcaaaagtcagtaaagcaaactcaaatcagcaagatggtcattctacacaagtctcagacaagcaacctaaattcaataggtaaggacataaggtgcgcagagaggtttgaaataatatgatatcaaaacatcaacgatcaaaattgttaatttacattttcttcaacccaactaattcctagtaaaatgaacatattgctttacaacttcacttgctgtgaagcagagattgctcagccccatacacatccatgatgttctgtgacagtatacacttctgatgcaaaccatgcccttcatacaaaagctcagggcatttgtatgctgcacaaactccaggaacccaagcacaaaaccacatgaaaacccaaaaaagaaggcaatatgtgaaggccacatgctcaacattgctgaggttactgttcagctatgatgacaacacagactgtagggcaagctgttgctgcggctgcaaagaagaccatgttgacgccagtactgaaggaggcaatgtagtctgaagctgtcttagcaaattaaccatcttactaaaagtttgttctgttgccagatccttacccgcacataatatctgcatccataaggaaatagatgtggtgttacaaaccaaacaatgttctaaaagccatggtggttaatcgcctaagtctcatactctcattaaagtataactactttctttctcaaaactcagagaaaacaaatcaccattttggaatgtctcccaaatatcttatttcaggggcttctaccaacgatactacacagcagtacatgagacaagcaaatgctatctttttaaattatctaaattaaagataaagacattgcattgtgaaaaatcagtggtgaaatatgttccttttttttttgtgtgtgtgtgtgtgtggggggggggggggggctacattatagaccagataagccataaaatgtcttgtttattcatattcgtttgagatctaaattggcagtaccctggtgctatgtactcctctactgaaaattatttagcccctataaagctatgttaagcttgtagcaacccagttcaggatcaaaaggtagttaacctaatggcctcagttggtgatgaattccaactgaccagccaaacacaatcaactcaaccccatttcaacataaacattccaatactgctctgcaactagttgtgttgcagttctttctatatagttaatcagaacaaaaaaggaaaaattaaggaaaaaaataaataggtacctccgcaaaaatagagacaatctttggaagatactggttgttatgacccaaaagctccctatctgacctgcaaaaattgaaatgagatcttcaatgaaatgaaaaataaacattataataaggaagcaatgaacaagattgatgtttctacaccatatataagccaagctgcgtaactgtacaaaaatactgagatcattacttacttctcaagcatcgtacagagttgttcatgaactatcttggcctcgattaagtcattttttattggcaaacaacttaaccaagcaggaacaacctgttaatatttaaaaaatgatacacggttagaacttagaagcattgcatggttaaggaaatactacacatagtataataaatctacgacgacttggcagacctaatgtaagtccaaaatggacactactctagtaaagaagagttctcatgtcatttaactgtatgttttagtagaaaattaattcaatagtactgagcagtcacttaaggctttcaacccgttcattcaatgtttttgcatgtagcatactgtatgcggctgaggctctttaggctgttacatgctttatgttattgacgttgatgtcaaaatttatcaagggcaactgaagaaacttggtattctttgtctctgtagacaagagtttaattaatcagcaggacaggtagcaacaccatgatttcaaatgagtaagaatacacttcagagtaagtatattaatt

SEQ ID NO: 59440 - DNA, 723 bp, Oryza sativa
atatgtatcataatatctgagaaccacagatcatacaaattacgtttcatcaaaagttagaagaatcatttcatccaataaaaaggttaaaagggtcattaaactgttacctgacagctgcttcgcgacagtgctctgcaacatcatcaaaaatgcatatggcaatccttcgttcctctactgttttgtccttggcctaatattattaacaaaaaaaatacttataatcgcagaaggttcttttttgtccttgacagagtattttttttgtaataagatgttctatgtttatcacaggctacaagatctgaaaatgaactggaatagtttctagtagctttatgtttactctttggaacatttaagcaaaagatttctatggcaagccaagaaaaattctgggtaaagggaatatctgaaaatgacccccaaaagatatagggtccaaggtttcacattgctagaaaaatcacttttggtgtaaagttcagcattcagtatgttgcccttctatcactaagaaaacagaagttccaatcaaatcagatggatccacttaccaacataggtgtcaaatagacggaaagttcatcaaagaatggaaggaaataagtcttgaacgtcttaacaagagtgcccaaacaatcaccaatctgtgaaaatcacaaaagataaatctgtataagttatttccaataaagcttggaaagtagggctgcagga

SEQ ID NO: 59441 - DNA, 8383 bp, Oryza sativa
  unsure (1)..(8383): unsure at all n locations
nnnnnnnnnnnnnnnnnnnnnnnnnnnnnnnnnnnnnnnnnnnnnnnnnnnnnnnnnnnnnnnnnnnnnnnnnnnnnnnntggtaagtgttggtgcttattgtagttttgttggtgaacctacgttttatccttctcaaatagctaataatttccctttattttttaatttcttctttttcgggatctttttggttgacaacactgtttttctcctattagagctctatgcgttgtgccggtacatgtcttctggaagagtacctggaaattcagaacctgctggactaattgaagacaaagagggtgaagacaataaagagagctcaaaaacagatgagtctgaactcagattggcacaacttcaacaccagctcccaactaatgaacctggagcgctgatgcatcttgtacaagaatctactgctgctgatgcagacgacgctgatgccaaagaatgcaggagtttattcaaaaacctgaagttctacctaagtcgtgaggtaggccagtggaaacttatgtaccctggggatatccctgggggtatgtttgttcaattagatcatcttcaatatacttatcttattatctgtcttgttttccactttcaggtgcctagggaatctctcttatttatcattccagcatttggtggtaccgtttcatgggaaggagaaggagctccttttgatgagacagatgaagacatcactcatcaggtatatttatctttctgtaagattacaccagaggttgcccaaattgatggataaaattattgttacccttttgttaaatataaaatactgtttaaatatcaaataatcatatataacaattagctcagccatttgtttccaatttatctctaatgtagttttatcttgtagttacggtattttgcagattactgatatcactcattattttgcagattgttgatagaccgacccaaagccacgttttcctctctagggagtatgttcaaccacagtggatatatgattgcgtgaatgctcgcatcatattgccgacagaaggttatattgtcgggaggtatacctcatggcacatgtattatatatgtaatttttattgattatttgtgtggccttgtgtgttgcttctacatatgtttgctaaaatttgtgggtggatatttgtgtttatttccaaccttagttgggggcagccttcactaatgacaattgcttgctgttaacatcatatggagatatccctttaatagttgttaagtgctgattatataatatttgcactcctgtagttgagagcccaatgtttgtcccacttccaacttaattaaaaatcactgtactgcaataccttaatttgtcgcatgctgttttcacattttggttgcacatattgatggttcttaggtggaaacaactttactgaaatatagttcatgtataatttaacatttagttaaattgacagcctttttttactgtctgtacttgcacagtttgcaaaaatgaactataaagatgcataaaagttgatctaattttttatacttatgtttgtcctaatttttgccatcaatattccttttttttttggtctcagggtgcctccaccacatttatctccctttgtggacaatgatgcagagggttacattcctgagtatgcagagaccattaagaggctgcaagctgctgctcaaagccaggtgttgcctctgccaagtttaggggacgaagatatggaaaattcactggtagaggcaattattgatcgatcagagtctaatgaaattgctgacaagaagaggaaggtaaattcaacaccatgtagtacaaaacattagtcctttctgctgtcatcttatttgcttcttgtacagaaagcattctctgttgtctcattttgcctttttctcttctaaagttggagatgctagagaagcagtaccacgatgagctgaggatggaatacgaaggaaagaccttctcaaataggacggcagataaccaaccagatgttgtggacaaaagtgatactaaagaagctgacgatcatatggaggactctcataaacaagccgagaaggatgctgctgacatttccaagacccttatgtctcgcaagcagagaggccttcttcaagcaattgaggtctgcgctcttatgccttgcatgtatttgtcactttctgcttgcttgctgtttcacatccgttcattgttgcagccatgtcatccattgaaattttagccacattgccaaattttataacatatgccttgtagatgccacaagcatttccctgtttcagcgtaaatttaagtggctttgagctaaactaatctgttaccctttgcaactacagattaaccaggaaaggaaaaaggacaaggtgaacttgctgaagaaaaggaaaaagaatgctgattccagtgcttcggccaaaggtcgctgaggctcgaacttcatttgctccatgctgtatctgttttgacaaattgttcatcggtcgctgcttctgtggagttgctgccatgatctgcacacctacgtattcttatgcatgataagcagctccattttgatgtttaggtgttttacatgggctttaagaatatgcccagatacctcagtagaaaattttgagctatttacctagtgtccaaagtgtgttccctgatgattagtagctattactcttccaaattttgacgcggttgctgctcaagtgctcatctagctacataattcttaatcaggagtttagggcctgatatctgttggccggttggtgatgctgcaaaatgcaacatgatgagtagatggcgatcttagctccagaaatttaacggctagaatgaaagcaaatcaaaattaagaaaatttacaagcagcgcgattcacatttaaacgagaaatttaaatctgtgttcaaactgtgctcccaaagtacaacgcaaataagcaaaccacgcgttctgaaagtcattgtttgaaatgcgagcccgggcgatatgacgaatttcaccaaatctcctgaaattcaacaacttactttcccccaaaactcgaccaaaacgaatttttgaagatttggaacacacaattgaagaaaatcatttctgaaacatccgagccgtccgatctcgcgacgggagaatcgaacagagaagataacgaacgggcacatccacgaccgtcgcctccaaacccagcagcaggcggggagggcccaccaccagccgccattctctcctcgatttccctccaccgtcgccgccatgccattctcccctccgtgcctggaccccgccgccgccgccgccgcctccctctccttcctccccgccgccgccgcgaggccaccggcgccatgcgcggtggcgccgcgctcgcgccgggcgctgagggtggcggcatccgtggccacggccccggagtcggcggccgcgcaggggcggctggagtcgctgagccaggtggccggggtgctgggcacgcagtggggcgacgaggggaagggaaagctcgtcgacatcctcgcgcagcgcttcgacatcgtcgcacgctgccaggtcggtccgtctcgcgccgtcgcgcgcgcttcttttgctgggtggggctgtttggttcccagccacactttaccattacttgctaataaaagttgtcacaccttgtctaaggtgaggtgatcaaattgttagccacaacttactaagtctaagggaatctgaatcttgccacacttttttgagccattgacacgtgggacccaatttgttagaggggaatcttgccacaactgttgctacaaccaaacacctgtcaaatctgcctaaccttaggcgtggcaaactgtggcaaagtgtggcttgcaaccaaacacacccgctctctgctcctctttgctttgtcagtttgtccggaaggtgttcgattaattggttccttgtggtaggatagtacgagttctcacgttggcgctggtgagtttccagaggcgatcctttagctgagatgtactccctctgtccaaaaaaaccaacatagtaggatgtctcacgttccgtactaggttggtttttttctgacagaggggagtagtaatttgcgttagtttgctttatgatcgttacttgaagggtgtttatcttccggcgccatccacgcagactgcctttaccgtactactgtaagctactgctactttgtactcctttgatcgcaacactatcacagaaagtcgttttatacatgggaaattcaactctagcagaacaggagaaattccgtgttacgaaggaagcttagtagtccaaggctcccttccattttggttcttgcttggttttgatgataagtactgatatcagcatgggttgtacttgtaccattggtccccagttttcttgaattgtgtgaagcccttccgatctcaacgtattcttgatgagactcgagagccttgctgttttctcattcttgaatatatctttaatttttatgatgataatttttatggctgtatcatcattaacgaataaggatagctgaactattctaagcatcagtttaatatatctgcagaaagcattttgtctattcccaatttttctaaacccataaccacaatggatattccttctatatgttcatttttttaatgtcgaatccttcgtactaacaaaatagaattataaaacatcttaaaataccgataacccttccggttatctagtcgaggcagtaatgcagtattgataactaatggtgcatttcctttatggcaaggatattgccttttcactttacacaagcagttcttatgggttaaaaaaaatgattatcctgcttcatggaaaaccttgattacatagtgctcatttctcctactgttctctctgcacttgttgtattgactaatttttataggtttttgcacacctttatgaagttcagttttcttaaggtggcaataagactagacttagttttgtccaataggatttgatcatatatatatatatatatatatatatatattgttttaacttgtagaatgttttatgttattagggtggagctaatgctgggcatactatatataattcagagggaaagaagttttcattacatcttgttccatcaggtatcctcaatgagaagacaatgtgtgtagttggtaatggagcagtagttcatcttcctgggttcttcaaagaaattgatgggttagaatcaaatggaatttcctgtgaaggaagaattttagtatcagatcgtgcccatcttttgtttgactttcatcaaactgttgacgggctcagagaggtagagcttggaaattcccttataggaacaacaaagaggggaattgggccatgctattcaaacaaagttataaggatggacttagagtcagtgatctgcggcatatggatacatttggtgctaaactcaataccttgctgagagatgcagctctgcgctttgaaggatttgaatacagtaccaagacccttaaagaggaggttgagaagtacgaaaagtttgccgagcgtctaggaccttatattactgataccggcacttcatgaatcaatcaatcttgcagaataagaaaatattggttgaaggtggtcaagccaccatgttagacattgactttggtacttacccatttgttacttcctcgagtccctcagctggtggtatttgcactggccttggtattgctcctagaagtatcggtgatctcattggagtggtcggtacagctatctttaaacttcttaacaatccatacttttcctctccctacaaaacttaatatttccatgtgcaggtaaaagcttacacaaccagggtaggttctggcccattcccaacagagctgttgggtaagactggtgatttgctccgcgcttctggaatggagtttgggacaacgacaggtcgaccgaggcgctgtggctggcttgatatagttgcactcaagtactgctgccaaataaacggtttctcatctttaaatctgaccaaactcgacgtgttaactggcctcaaggaagtaaagctgggaattgcatattgtactgaagatggtaaagaaattgaatcattccctgcagaccttgatcttctggagaaaattaaggtgaggaagagcagttgatcctgttccatttactcatattccatgccataattttacaggcagcatatgagagcactaaatcactcaatgtgactcttggtaattgatgaaaattcttatgttctctctgttggtataggtcaaatatgaggttctacctgggtgggaggacgacatttcctctgtacgaaactacagcgatctcccagagactgctcgtttgtacgtggagaggatagaagagctggttggtatcccagtccattacatcggcgtaggaccagggcgtgatgctctcatatacaaatagggggacttcaggaagcacgtatcctatcaaattcgttgtttagggcaataccaattttgttattccctaataagaaagacactggttgattggactgtataaaggcctggagggtgtaggaattccaaaatctttttttgccctaacaagattaaatacggtccccgctgctgtccaatggatattctttttctagctattgtcaatatattagtggaattttgagcacgataaaatgagagccggatatgggagctaccggctacagtcatatttaaggccaattagaggacgacttacatacatcgatgatttttcctatcgacgttcatagctcaaacaaacacgagtgcaagttcttcacgtatgtttatcagtattccaagggttgatgtaactttgagaagaaatcttaagaaatttggcaattttatattaaatgtttgatgaattttcttactcctctctgcagtgctaacgtatgtgaagttgtgatctcgcgttacgcccgctaccaaggtcaaaactccacatctgcagaatatcagacttggcccattcacattttatctatactaaggtctcatctggtttctaatcgtgtggaggctaatgatacagacgtggaactcctcgatacaagaaaataacggtatggttacaagatagcacctcattccaagatagactacttactaagtgctgcattccattccaaaacgatagaatcaccttcagagttatgttgaatcttatcaggatgcagaaaagaaaacagcacgatcactagatgatactactggagacaaaagacacttggcaaatcaccatagaagttaacagcaaacaaaacactggaagtaactagaagttaacttcaatcatattcaagttcatccggtgttattggtctcttcagtggtatgatggacttcttttcaacgtcttgtgacaaagctttcctcatatctaagcaaaaacaaggacagaagtgagcaacgccattagagcaatgaatttgaatatgacacaaagtgatgatttggcactgtggaagtgcttaccaaggccatcttcttcccctgagtaatagcggagcacccttcgataaaccacatagccaagctatggaaaccaggaacataatttgataagctcactagaaataatgtcattttggattcaaattttcaagaataaactctatgctgaaaccttcatacatgattttttttttcactaaaacaattctgtttaggggcagtagaagaaactagtttgaaagatcaagcgtttgttattcagtattcatatataaatgtgtaatcatataaatcagtgagttagagtgctagatgatcatgaaatttgtatgaagcttaccttttcatacatccttattgctggcatgttagatgctcttacgaagagatccacaaagtaggccttatccctgaaaggataaccatttttagcgtaatattagaatctataataaataacatgacaacaacagttatggaatcataaagtcgaaataaatgggacattagcaaaaacaagtataccacaatagagcaatggaacaggctgatatttttaattcaagaatccaattctttatctaaggtatgtgcttagtggaaggaaatacccagttaaactctacagaatcctactgaatggaaattgttcacagaactagtaggccagaacagtaatacattaccgtcttaccatactacaatttctagcttgcaatgcttatgatcatagctgataatctgatatgataatcagtcctcaattgaaaatttaaggtatatatttgagatattttctgattttataatgcctgcatgtcgatggaatgagcttcccaaccatgcccctgcttattatctttcctcaggg

SEQ ID NO: 59442 - DNA, 8993 bp, Oryza sativa
ggcaacagacactgctgtaacatgtccatgccaagattcaccttgtccttcaaccttacccatgactgcaacagacatccaaataaatgaatggccacaaagacataaactaaactaggagaatgtggaggaggaagaaatattgcagtcataacattacacaatggtggaaatgcagattgggggtcaactgaccccatagccttttgcaggtgaactttgtattacttggaaaatatataaattttaaaaattatacatatccactagaatattgcacagtgctcatctattcagacaggtgaatcatctcaatactccactatagaatactgcattcagcactaaaagggttactcttaacactactatgaacaacatgctcgcctgctcccaattcaggtcatagtgttccacccttcccaaagaggcaaataataagtcctaatcggcaaataaatagtactaccaagattacattagactccactggaacctccacaaatcataaatttcctgcgaaccacattccaatcgggcactgtaacgcccaaaagatccctaaattctcatgttttccagaggaaatgcagggtttactctacaatttcagcgaatctgacaaacaaagacgcagaatcactagcaacagctagcacagacccagccgcccccaagggcaagaacacgtactgtatcccatgacgcggtccccggggctgacggcggcgtggaagtagtcgggccagcgagccatgtacgtcatgtagaaggacatgttgaactgcgacgagcataccgacgggtaagctcgaaatcaagagaagaaaaaggagacggcgagggtttagggcggacgcacggtctcggtgaggtggtcgaggttgacggaggagaagcggaggaggtcgtcgcagcagaaccggcggatggtcgtcatggcccctcggcctcctggccgcggcggcggcggcgccggtgagggatctcgtcgtcggggcggcgctgtgctctcgagattccggtgagaagagagaagcttcgagcggcggagagccggtgcctggacgggtgttggacttcagataggcgctcctccgggcctaatgggccgtcctaactggccccactttgacgtgctcccttccggctcatcaaacccacgagtgtgaatcccaaattggatcatttttttagcgagtactcggagaatgctacgcgtcggacgtacggcgcgaaacgaaaaatcggacgtctcgcgcgacagttcgatccatgcacaggtgcgccagccatccatcatgcatggattaaacaaattttagactattttttctcttaaaatatttatccaaaacatgatccgattacaccattaaattcattgcaattaaaattttaaaacaagtccacacatgaatataatccgataaaaaaaattagcttattattgaattattttactgttgcacgctgttgcgccaagtatatcggaattgtttcattaagtagatcgaaaatgttttatcggatgctgtttcatcttatatgaaaataatgtttcagcgaatagcgaaagaatgtttcaattcacggtaacatttgatcattacagaatgaaacatcatgactatattaggtgaaacatttttaaattgaaaaaaaaatcgaacggttaaatattgcagttaaccaacaagtaaaacatgatgctatatatatggtgaaaaagaaaatcagcaattggaacatttagatattttatgaaatatggtgaagatacacgttgaaacatgccgctgtcacatatgaaacaacaagtattaacgaattgaaacacatgtttttcttttatcaaaatataatcaagcgatatcttgttgtaaagatttaattacaacaaatacaatgtagtgatcggatcataaattgaataggtaatttgagggaaaaatcattttgaagcttgctaaaacatatgcatgtatgcatgcatgaggtggagagagagtagtagcaggtagtttcaggaattttgtgaaacaagacacatattgaaacatatcactaacacgtatgaaacattttgttttaatggtttgaaacacatgtttttcttttgacataatataatcatgtaatatcttattgtaaatatttaattgcaacgaatacaacggtgtgatcggtccatagatcggataagtaatttaggagaaaaaatatttaaagagaggaggaaagaatgaaaagaaacaactaggcatgtgcatgtatattacagtacgataagggttcgtccaatccaccagactgctgatttgcagcatttccctggcatcaacataaagaaaggagaattagcatgtaagaactgagctggtcgtaggcatccgacgtttttcatttgattgaacgttcgaagaggagcattttcataccacataacgccgtaccgttgaacggaattacattaacgtaacttcatcacggtatggtaggtaccacttctattactatggtaccagaccatgaaccagattacgcccctgtttaattcctaaaaactttttaaaaaacatcacacgaatttttaaacatatgtatggagcattaaaaatagataaaaaaaataaggggcaattgtgtttctatccttgctttacgattcaattgtgattttatccctactttttagggtttgtgattttgcccctacttttttaaatgaagtagccgtctgcccctactttgttaactaatggtaccggtgttaaatttatggtgaatggacaaatatacccctgaaatgttttggcattcaatgataatttctagagcaaaacgaacactaatgcctaatgattagaaaaaaggagataaaaagtgacaaatatttgcacttttgctcgtgatagagatttagtcttgataaacgaacagttgcatggatgattttggcccacagcatgcatgggcatcgtgatcgatcaccattgtatttatgccatcccaaatcccaactaactaaacgcagaataatagaagcagcactaacactcaccttatgcccgtctcctccggcgtcggcagcgccatggaaggcgacgctccccgtgctcgactgcgacgtcttttcgtactccgacgctgacgacgccgacgcgcacttctcctccgtcttcgccagctcagcctctgactcggccatgtactcacactccgacgaggagcagttgctcaccaccggcaacggcagcccgagcgagtccctctcgtcgacggcaatgtcctcttcctcgccgacatcctcgtcgcggcgcctccaaaggccgtccctgcgcgtgcagccgcgcgagcgccgcacctccctgcgcgcgcgccagccgcgacgctgccgccgccgcacctccctgcccgcgcccgactccgccgcgcgctggcccgcaccgattctcctccctgccgcgcgctggccgcgcgtcgccgccgccaccacttgcaacccagcgcttgcaacccggacagtaaaggaattcgggattttgctcattgaaccaagggtagaatggtcattcacaaataataataacattttctttattcgtttaattcggaaatttcaggcccaccaaacttatgtcaaaaccagaggcagacgggtgcttcatttcataaaagcaggggcaaaatcacaaaccctaaaaagtaagggtaaaatcacaattgaattgtaaatcaaggactgaaacacaattgccccaaaaaataattgcacactttgcatgtaaatcgcgagacaaattttttgaggctaattaatccatgattagccataagtgttacagtaatccacatatgttaatgacggcttaattaggttcaaaagattcgtctcgcggtttccatgcgagttacttcctccgtttcacaatgtaagtcattctagcatttcccacattcgtattgatgttaatgaatctagatagatatatatgtctagattcattagcattaatatgaatgtgggatatgtctagattcattagcattaatatgaatgtgagaaatgctagaataacttacattgtgaaacggagggagtatgaaattagttttttcattcgtgtccgaaaaccccttccgatatctggtcaaacgtctgatgtgacatccaaaaattttcatttcaccgactaaacagacccttagtatcggtacaatacataggtataagatttacgatctacttgtggtaatcatagttataagattcgggatctttttgtagaaatttctagtttcaatttcttccagaattagaaacttctcaaatagttcagcctttaatttagattttgagaagttgtaatggtagaatcttaaaaataagctaaaagtccaaagctaggaaaacatagtttttcaaattctcaaaagctgatttgtcaaccgtctgcttttcaaaatattaaacttctcgaacaaattatttataagtagactactgttattataagattagctattaggtggtgtttggttggagggactaaagtagggctaaactttagtccctctcacagaaacatgtgagagggactaaatttagtcatggttttctaggcccgcgttagctattccgttaaaatactactaccgtcgtatttatgttttttgtttttcagataaaaattggatcgttaagcaaacgcggcggctgctgcgccgtgcacgcacaccactcgtcaacaccacaccacatatcatcccagactccgccacggccgcgccaccgcacgcgagccgcctcacctcgcgatctccctcctctcctccgatcctccaccggccgcggtagcggcggagctggcgccgcgcacgatcgcccccagccacagccatcctcctctcgcccgaggtgagctccgatccgtctttgcctttgccccgatcgtaccccggctgcgatggagggggggagcaacgacttcccgggggacctcctgcgcgcggtcctgcagaggctgccgccgcccgacctcgcgagggcggcgtgcgtctgccggctgtggcgcggggtcgcctccgaccgcgccgtgctggaggccgccttcgcgtcgccctggggggtgcgccgcgtcgtcggcgagccggagacgagggccttctggcgcgccgcgtccctcgcccggttcgcgctctcgcacaccgtccgccgcggggacaccgtccccggcatcgcgctcaagtactccatccaggtactaaccatcggcccgtctgatgctcgattatggctctatcgctagctctatgcatatttgcgcctagttatccttcttgttatacacaaaagggtatgattctcatatagatttgcccctaattaccccgtggaagatccaagcagcacttaattttgacaaccgatagttttaaacaacagtaacatgtctttttatccaaagatggagacactggagcttagaatattctgagtggttgctgagaagggaggtcatctggaatgaaatgaacaaaggttactagtcactgagacgctgataatgtgtagccataagaacaagcacgacaattcaatacattttttaaggtttaaataatctaggacctggcgtttgacacctttggccattctcagtattgtggagctcaccactaatttttgactgtgcaaaagttggacgattcctgctatgtgctaaactgttaatgatagttgcaaattcatgagattcactcttgttcaaagaagattatttagggattgctgcacaatgcctatgcaccttcagctgctagattctatctgttgccgtgtagagttgattatagatatagccatttgtgtggtgtgaattttgctggaatactctctttaatagttgatgcagctgaactttgaaaaccatacataactttactttgtacatttgtgaattctgtttatctataccattctgcacacttgtctcctttgttccacaaagatgcactttgcttgtgtgagcaacgttcttcactctttggtgctctatgaattgcaagcaggtgaccgatataaaacgtttcaacaacatgatgagcgaccatgggatctacttgagggagaggcttctgataccgatcagcaatcctgaaattcttcagggtagcacatgctacattgagatggattataacgctagaagagaggttgcagtcttttatccccagggacgccctagtggaaaagcagaatcctcgacgaacactgctgctgcagaacgacgaagcagaaggattttggagtcagtcaagcgaagcttgcataccgatgacagaaccgctgcgtactacttatctgtcacagacggtgatccaagggcagccatgatggagtactctgaggacctaaggtgggagaggcaacaaacaggccactagatgtaaggtcaatgggaagataagggcatggcatttgccgctgcgtactacttatctgtcacagacggtgatccaagggcagccatgatggagtactctgaggacctaaggtgggagcggcaacaaacaggccactagatgtaatcatgtaaggtcaatgggaagataagggcatggcataatgatgcaggttattggaagatcactactacctgtttggccgcttgaacaatatatatgtggtttaccctctgtacatgtaataatgtgaatttgtgaacatatgtaatgtatcatctttttttttctcggtgtgatgaacttgatgaaatccatagcaattgctttctttacatatataagtatgacgaattactcatgttatgatcatggcattttcggctggtgtccatctttatcgtgaaattgtccattgagcttttgttaaacttttcttgtctatgtcctgaaatatgggtttcgccaatatgtaccgtggggcttgagaactctcggcgacttctatgttcgaatagtatttttcatgctaatgaaaaaggcacgtgttacatttgcttcaaagcgttacatggccgttctacttaatcttattatgtgttgccatgttagtggtcaaatctggagaagtcctattaatgattggaaggttcgattttagttcatatttttacaacgaatctttcatgataggtgtacttccttggaagaaatatgctgcatgcgcacagaatcaaagagttgctaaaattggaggtagaaagaacattaaacacgctctactgaagcctatggaaatcggacgcatttaagcgcattcaactcaagtacatgaaaccaaatacaggaatctaattcaaatcagctcgatttcccatataaacggcaaaaataatcctgcctgcaaacgtgtcctaaagatagtcccaatttgcatatgctcctcatttcatttgctcctacctgaatttctgggactgcaattggcaagatccaagatgccggtcacatgatccaaactggagtaaaacatggacacaccttaggcccgtagctcaggtcttcgtcaatgacaattcgaaggcctcttgtttagttgcttggcacgggcatcaaatacgtttcaaactgctaataagttaatacagtcttcgttcagtgcttatccagtatactgtgcagctgaagtggacctgtcagcaagtaaagccaagaggccaatagggaataattaacaccttactgtaaatgacagttgatactaatgtaatgccataacttctataggatcactaagggtgaaacctcataataaaaaggataatgtagaaatatactagtactaggcaggaggccaatgtgtatcacacccatgaaaactgttcgaatatttttggcagcacacctcaagagccaagagttggtaaggttcacatacagatggttcatttcaatgccaatatgaacccagctcatacgactcaaaaatgtcgaacccttgcctggttctatcaacaagggaataagtattaatattttgacaaggctgtgagacaaggatgaccagctcgatctcttagacttcgaatttacaccctaaaaaattttcaagctaaaatgtgatactcttcaaagtttcaaaacaggagaaatatctctacaattctcgactaaaagaaagcaacttacagtgtgttgtccaagtgaatgggctagttgatgccttggggttcggtcttccacttgacatagtatccacttgcatagtcgcattagtagccaatactcatgggcacactgacatcgcgaacctccctctcccccttctataaaaactcagctgcattgctaagttcttccccatccattgcaacggcaacatacacacaccaccaccaacatagcttcttttgtcactgactacagtatcacagaatgctgggagggctcaaggacaagctgacagggaaaaatggaaataagatcaaaggcttggctgtgctgatgagccgaaaattactggatccaagggacttcactgcctcgctcctcgacaacgtccatgaggtctttggaaacagcatcacctgccagcttgtcagcgccactgttgccgaccaaagtactgatctttctccatttcttcctcgcttactttgcatgagtttgtacatgtttgctatgtagaaagaatcaaggatcagtactcagtactcagcacagattgaacggaaacaaggtgaaaacggccagtgacacaaatgaagtgactaacctattgtcttatatgctatgtgcagacaatgagggcagggggatagttggatcagaggcgaatctggagcaggggttgacagatttaccatcggtatcacaaggggagtccaagctcacagtgaggttcaactgggagatggacaagcatggtgtgccaggggccatcatcatcaagaaccaccacagtaccaagttattcctcaagaccatcaccctccatgatgtccctggctgtgacactattgtgt

SEQ ID NO: 59443 - DNA, 15039 bp, Oryza sativa
agttccccaaacctgatatcatcaaaggtaccatgatttagccattgtgtcaattgccatagtcgatgagcagtggacaattagcgaactgttgtactatgcattgttgcagagaacgaggttgcttggaggacagatgaggaatttgcacgagagattcttggtggtctgaatcccatggtcatcaggcgtctcacggtgaactatccaacattacatagtctttgatgttttgtgctcctagcaagcatgaacaaaacagctgatgctaatgtataattctctgttcataggaattcccaccaaaaagtactcttgatcttagcaagtacggtgaccagactagcacaatcaccccagctcacattgagaagaacctcgaaggcctcagcgtgcaacaggttaggcagtgatccatttcatttacagtgcaatcgatagtcatttgacaaactgccaaagttgatttgttgtcaattatggctctgcacaggcactggatagcaacaggctctacattctggatcatcatgatcatttcatgccattcctcattgacattaacagccttgatggtatcttcacctatgccacaaggaccctgttgttcttacgtgatgatgataccctgaagccactagcaattgaactgagcttgccacacatcgagggcaacctaacatctgcaaagagcaaggtccatacacctgcatcaagtggcattgagtcttgggtgtggcagctggccaaggcttatgttgctgttaatgactccggttggcaccagcttatcagccactggtacgtactggcagtggcaaactgtagttctttcctgaaagcagtaagctaacctcatcattgatgtaaactcttgtaggctcaacacacatgctgtgatggagcccttcgtgatcgctacaaaccgccagctcagtgtgacacaccctgtgtacaagctcctccagccacactatcgcgacacgatgacaatcaatgcattggcacgccagacactcatcaacggcggtggcattttcgaacaaactgtctttcctggcaaacatgctctggcaatgtcttcagcagtttacaagaactggaacttcacggaacagggccttccggatgatctaataaagaggtaattaaacaccgagagccacatcacaacaagaaccaacaataacataactttgaataacatcctaattttgtaatgcagaggcattgccatcaaggacccatcaagcccatccaaggtgaagctactgatcaaggactacccttatgcaacagatggcctggcgatctggcaagcaatcgagcagtgggtcactgagtactgtgccatctactacccaaacgatggtgtcctccagggagatgtggagctgcaagcatggtggaaggaggtgcgggaagtcgggcatggtgatctcaaggacgcggactggtggcccaagatgcagagcttgcctgagctcaccaaggcctgcaccacaatcatctggattgcatcagcactccacgcagccgtcaatttcgggcagtacccatacgcgggctatcttccaaaccgtccgaccataagccggcggccgatgcccgagccgggttccaaggagtacacagagctggacgagaacccagagaagttcttcatccgcaccatcaccagccaattccaaaccattctcggtgtctcgctcattgagattctatcaaagcactcagcggatgagatctatcttgggcagcgtgacacgccagagtggacatcagaccccaaggcactggaagcattcaagaggttcagcaggcagctggtggagattgagagcaaagtgttgaacatgaacaaggaccccctgctcaagaaccgggtcggtccagccaatttcccctacacactgatgttccccaacacgtcagacaataagggggcggctgaggggatcactgccaggggcatccccaatagcatctcaatatgagactgctgcacgcgtcacgcgctgctgagttggtgtaggtttgtggctgttatcttaggccctagggcacaagcaatgaagctgcatagtactatttgctacaaattatgcaagaataaagttttagtgctaataataaagttactgttgtagtgtttgtcccatttttaagcagcttcacatagcaagctcaaatgaagaggcaatgctgcaatatggatgattaattatgcagctttactcctatgatgttagggaggcagcttctgtggtcaaatttgcagcaataaaattcttcaaatttcctcaaatgtaatgattatatctcattcagtcacagatcgattcttacttgtaaatctagcataaccagtagcggaatcagaaattaaccacaaggcaggaaaacaagggctacgaagtgatttgattgccaatttgccatacagctatatatcgcgcgcgcctaattagttccatggcaacccgcatcgacattttgctcttttgctcacataggttgtagcattcagcaaaacaccaccttcgacacatgtcagaagctcttactagacaacaacacggtcactatccatcgcattgcgcacaaatccatctagtctacgtgcaagcagagagagcatctaactacgtggacattgcaaaatttaaaggggatgagaggggaggggaagggaaggagtggggagatactgaacctggggaagcagagaagagggagccgccgtcgtctcggtccacggcggcgagggcacaccggtggtcgacacgctcaagccccccacgaaaccgccatatcgccgccgccggccggcgccgccgcggggtcatcggagccggaggaaccgatttgtctcccgatcgaactgggctttgtattctcgctcgtttgctccgccgaatccaggagataaatgggccgaaactaggtagtaacagtttagacctgggcttacggcccataagcctggacgtccgggcctggttctctctaacatgtgaacctaccacttacatgcaatgtgattaggcaatgttccatgatataccactccgtgcaaaataaacctaattctagctacgaatctgaacataaatatgtaaataagtaaaacagaacagtacataagtggaacggttaacaagcgtgcacaactttccatatcacttcagcacatagctaataattgcacaaatctagcttgaacggaacactaaccaagcaattagtgtgtgagcatctccatttgcaaattaaacatgcatattcgtactggctggcagcacagagcctcccttatttgatcacacccagtaatcaacactgtcgtctacacaagtcacaacacatatggatgcacccagtttcggacgaatttagccggtagaaattgatcagttgatgcagacggcgcggcaggcctggccacagtagttgaggcacttcgagtagtaggcctggaggcagctcttgcagccggccttgttggatgggtcgccgcaggggacgctgcagtccgagttgcggccgtagcccttgcacgacttcttgcacgcgtggtcgcacttccggcaccggatcggcttcgtcgccgtcgccggcgccgccgccgcggccaccgcctccagcggctccacggcgaaggacaggaggagcagcgccaccacgacgcaggcgaccaccctaggagaagaggcgccgcctgccattgttcagaacttataagatagagaagatttgcaagtgaccgaggagtttatattaagctgcttgatcgatcggctgcctatttataggcagtacgcgagtacaggcgaccaccgggtaccgagatgtgctgtgcatgatcagcatgcgtgcatgtgggggtagcgtgcgtatgctccgatcgtggtaaaatgttgactaattaaggagtttacaatggcaagtcgatgctcaatatattgcaagtcagagcatctagacctggtttaatcagattcgtacatgatgattgtttgaccatcctagctaacatacgactacagataagcatatatcggtttaagtaaacacaaacataagaagctgtattggtttggtcagatgcgggatgatgagttgatgacgaagacacgcctccgaacccccggccgcctgcaatcaggcaaactaacggcccatctatagcaatgttttaaatagcgggctaagccatttagcgattagcttctcaaacagctatagcgacagctataacggactaaatggagctatagcggctaaattgtacatgagagcaaatagctaacccttctcaaacaattatagcgggagatagcggcagctatagcgggatatttaaaaccctgatctatggagagcgtcagagcgagtggatgaataaccaatgccaggctgtccctccgtctttgtcagttgtcacggcttcatcggagcagatggccgctcgccgccgacgaacgcgaggacgcgacgtcgcgtgcagcctctcgtgcacgtacggttggacttgcgatgggtttcctctttcggatacgtcgataacgtcgcctcgcccaaactgggcctggagcggcatcgtcaggacaatgatgagctattctcaacctaagttctactggatgaaaacggtacggcatttctcgacggctcatctgacctatggctcgcggaaagaatatggtatgtttgagaaaatgatatactggtaccattcgatttcgaattcaaatatgtaaggatatataggttaaaatacgagaagagttgcatgttggaagcttgaaacgatggttatttaactttttgctaattatagatggagattcacaaatactccctctgtctcgtaaagagacaactcctagcttcccaatgcatgattaaagaagaggataaaggaccaaaatacccatcattaatagcaaattagtattggtagataggtagataaggggtattgaaggaatacaatttttcgatttacgaaccgataatggatgagaaggtagaagttaatttattttgggacaaagtttgaattccagaagttgatgtattttgggacagagggagtatacttcaataaatgtgtactccgtatctttggttgggtatttcttttggttcggtgggtttttcaatgtttcattaaactacactctttttttattgctagactgtaataattggctatagctcttctgagtaaaggccaggatgtttgattccattatctaaaaatgtaaatctattataaattcacctacggatataatataagattggttaatcaatattttacgaactcacatgtaatattgtataattttttccttaatgtatctcttttaacactttaattgtctccctatatattatacaaatagatatctgttcccgaatttaattctaaaaatataatataggataggatatcggatgaatgatatgttattcataccggttccgaacttgaaaggaaaatatgggttagggcacttagcctagtgggtttcgaacttgcgaaagggcatgtagcctagtagttgcagtgacatgagtagcaccacaaggtcttgagtttaaatctccataggagtgaattttagattgggttgtttgcggggctaagttaccaatttaaatagcatcatatatctggttggatgtagaggtcaggtaaaaaaaaaccattctctaaaaagaagtgttaggacatggcgttgtcgagatccgaccaggggcgaatccaggaacaaaaaattggggggaaggggctcaattacgcagtttctttaacatccagccatctaagaacctttagtttattattcgtggtgaaaaaaattgaagggggtgctctgggggtatccatcgatcttgtggttgtaggggggactcaagtccccctgcacccacgttggatccgcccctggatccgaccgttcccgatccaatttcaccttagaaagtgtcgctggatctgccttgctcgtgttcggatctgttcgtgcaaggctaaattgtggcgtggggtgtctcctctgcatcccttgcctggatgacttcggcgagcaaaggcacagggggggggggggtcatgagttgctgaatttggatccattggatccagccaatggttaagacaaggtggcaaacgaaccaatcaaagatggatgaaacatgaatgagggttgtaggagttcggactgcctatcgagattggcttattccattttttgtgtggtatggctcgttaggcagcagaagatcgaaactagtcttttactccctccgttttatattataagactttctagtattttttacttcatatatgtgtctagattcattaacatctatataaatatggacaatgctaaaaagtcttataatatgaaacggagaaagtagcgttttagctttgttgtttctcagttataagaagataattaaaaaaatatttgcttctgagttcattgattttgtttctaaccaaatagaaacagtgtcaacaaagctacctacgtgcaaggctgctatgcatagacccaaaggatcaatggcttctacaaatatactcctaataaagagtcacaaatcgatcaaacacaacttctaaaaatactccctccatcacaaaatatttgacgccgttgacttttttttaaaatatttgactgcttgtcttattcaaaaaatttaagtaattattaattctttttctatcatttgatttattgttaaatatatttttatatatacatatagttttacacatttcacaaaagtttttaaataagacgaatggtcaaacatgtttaaaaaagtcaacgacgtcaaatatttaaggaaggagggagtataaatataactaccgaggaccaagatagcgataattaaataacataataacactcaaatgcaacaaaagcaagcgcgcgcccgtctctccagttgtggcatccagctgctaattaaacgcagttggaacggcagtagtcgccgcagcggggcaggcacctgtagaagtaggcctgcatgcagccctggcacgagccgcaggcgtagctgcacggctcgctgccggcgccctcgcaagaggagttgcacatctggtcgcactggctgcaggccatcggcgccgcctgcggcccggcggcctgcgcctccgcccgctccacggcggaggactgcagcaggaccagcaccacgtacgatgcaaacggcgacggcgccagaggccataggagaggaggaggcaactgtgagtttgagttagggcctgttcactttgatataaaaaaaacattaataaattttggcattgttgaaattttggcaactatgccaaaatttcggcgagttgctaaaattttggcaggatttcttatatagttaccaaaatttggcagcaaactaaatttagcttttttttataactttaccaaaatttgataagattgaaaatggtatcaaattgaacatgcccttaattaactagctctgatgaattgattggccgagagttactgtatctctctatttctatttataggcatatgggatatggcaaatgcaacattgtttctagttatcagtatggatatatttatactcaacgcatgtgcacgtcatgcatcagataaggcatggtaagtgttgacttcaaacgtgaccttgcgccattttattttctttataaagtcagagcttctgatttagttaaatcgatatgcatgtgttgattggccgactacccaactcttttggagctagatcctagaggtttgacttaggactgactattgagcaatattactagctagtcgctaatccgtatattacacggtctaaaaaatactttagtagcttatctaaaatagaaactctacatatataagaaagacacccaaccaaaacttgaatcaggtcgccccatcccaatatagcggcaaactcgtgacgacaataagggcttgtttagttctctaaatttttttcccagaaacgtcacatcaaatttttagacccatgcatggaacattaaatatagataaaatgaaaaactaattgcatggtttgcatgaaaatcgtgagacgaatcttttgagcctaagagcaggtacaatagcaggctataagccagctgcaaatatattttaagaagataaataaggagagagaagaggagtgggctacagatttgtagccagctgtagcacgaactccaaaacgcagtgtatgtatgccaggtaggaccaggtattaatagtgtagtatgtagctattatatgaatgagatattagattggctatagataaattggagctagcagttggctatactattaaacttgctctaattagtccatgattagccataagtgctacagtaacccacatgtgctaacgatagattaattatgcttaataaattcgtctcgcggtttccagacgagttatgaaattagttttttcatttgtgcccgaaaaccccttccgatatccggtcaaacgttcgatgtgacacacaaaatatttctttccgcgaactcaacaagacctaaggcgccggctctaggtacactgacctacgcactagggtgaggagggtgtactcctagctcaagctctatgagcagggacaaatgaatgttgactgctattaaacggaattctccattccgaacggtatgatacgagatggatattagctaggcttgctaccacgtgaataccggtcttgttacttatagcatccccagtagatgatctatatttgattctccaaatgcccgtataaagtatcatccaaaaaatatttctcatccatatcccatcattctatattttagtaatatcttccaactaaccttacatttgtattttaagaatatcttccaactaaccttacatttgtattttaagagatatattttttgaactacttatttatcgtgataatatttcaattagattttaacggaaatctttttaactgatatatttaaaatgtggtgtataaataaagtgtcaagtgtcaattatattttctatactgaaaagagctcttctgttccaaactttcgttttatctgttcttctatgctctcaaagagctcttcttttccaaacagggagaggcaggcaaagggacgggggagatggtgaggggcggcggcggcgggctgctcaggggtggcgctgggcgacggcggcaagggaggcgcggcggtggctcacgggcgcagggcggcggcggcggctcgtgggcgtagggccacagcggcaagcgaggggcggcggcggttggcgggcgcagggcggtgaccacgcgcggggagacggcaacagacgaaaggcgcgcacgccggaggaggaaggcgcatggagacggcgccccaaatctggtaaggctcgctccacaaatcgctgaaaaaaagcaaaaaacagggatggggaactcacctacgccggttggggacaatggcgatagaggggaaggctcgccagaggggaggtggttgccgatgtctggatgggggcgggatctcgatccggaggtgttgggggtgaaatggcgtgaggagagagaaacactatttttacctcttctctcttactatggcgcatccgctaattttagcgtgtgggttagcgcatccgctggagggcgttttttcgcctctacacgccaaaaccgggatggaggatcggttacaatatctgctgggatgctctcacaggtaccaagggtggtacctcgctatcatgcttagtaccataagtaccaaacctagtacatgtagatcttttatttttaaagagtacatgtacatgtagatcatgggtcttgaatcttgatcatggtggcaacggtaacaatactataatttcatatggaacatcacagtgataaaaaagtggcatatctccttaaaagaatcacccacaacatataatgcaaaatcaccctatttctctattggtccagatctgaaatcaaataaaatggaaaaggggttgagcggattttacctgctcattgccttagcagccgccggccatgcgtctcctagccgccgcgcgcgcgtcaccggctgtgggccgcccgcccgtgcgcgcgccggccgtccgcccactcgccggccaaccgcgcgccgccggaagccaaacttgttcgcctgctgctccaaggtgaggtgtgggttacgggatggagaggtgaggtggtttagggtagttagtggcatttttacataaatatgataaaaaaaataagtgagaatccactcactaccattgagctaatcacacttctacaatttaccactgactttgtcaagttcaattatatactatcatgttttctttaacctctactgcgtgccatcgccgtccatgagccattagtttgcatctgtttgctgtattgaattttttgttaatgactaaaataccctttgactaatatatccatccaagaaaatcagttgactgaaaacctgaaaaccctagcacaccgtccacccccaaatcgatctttcccagtctcccagcgagacggcgccgactccccatcgatgtgccggtcgccggactccccttgacgcgtcggcggcccgccgactcccggtcgacgcgcaattggcccaccgactgcccgtcgacgcgccgccggtcggccgacttctcgtctacacgccgccggtcgccagtctccccaatgatgacctggcgccgccatcgctaccgtccgcccaagtaacgatgccagcagcgtggctgcaaccggtgaccgactacaccttcgccaccggcgtcctggcgcttctatccccttcgccgcaaccacctgtcccagtgtcaccgcgaccagccgccgacctcacctccaccgtcgatgacatatttccctggacaaaaaaaataccatgtacaatgagttaggggcaaataggtctttttagagaggtaacagatgttaactggactgtgatggcacacagtagatgttaaagaaaactcgatggtatataattgaacttgataaagtcagtggtacattatagaagtgcgataaactcagtggcactgagtggattctcttaaaattaaagggtagtgggtcctttgtggtggagtggagttgtggagcagcaacaacccagctctaccccctagtatattttttaggaataactctgctaactacactcccaaaaacagaggatctgaattgtttggcacaactccgattctaattaagttgaagttgggagctataactgtgtcaaatagaaccaaacttggccttgaacaccttcttcgtactttaaatacgaatctaacaacataaatatcacaaaatcatatgcatttgtcaaaggttcatatcctaacgaaacaaaataagttttatattttttatggagggagtgacaaagtttaactaaaaccaaaggttccttggtactagtatgatactccctctgtttcaaaatgtttgacaccgttgactttttagtacgtgtttgaccattcgtcttattcaaaaaatttaagtaattatttattctttttatatcatttgatttattgttaaatatacttttatgtacatatatagttttacatattccacaaatttttttaataagacgaatggtcaaacatgtgctaaaaagttaatggtgtcaaacattttgaaacggagggagtaatacagtagtccacctatcaaacagattaatccgtaaaattctcgagatataaatttatcgttgaaaaatcatagggttagatttgtcttaaaacagttttaaatatttgttgataggttttaggagtactccctccggttatataataattaacgttttggacaaggttaaagtcaaacttttataactttgaccattaataaagtttaaagaaactagaataacatatatagatatatagatttgtgtttcaaaacactataataaaaataaacatgcatttatttattatgtatattataatagaaaattaaggtaatattttgtaaacagtgccattatccgaaacgttaattaaaataaaaccagacagagtacctctcttcgtgaccataccactgtcttagaagaccttggtaacaacgaaaggaagcattgaccacaatatatgaaatacagagccggtcggcatatagccatatactgtacatccacgccagctagcttattcgaaatagcagtactaactattgctagtatacaatactaacagtacgtgtacatgcacggtgcatcctcatgacacacatcaaggccttaggatcctccgggctaataattagccctctaaaatcttgctatttagaagtattaaatataaattactgataaaacttattttataaccaccaagctaatttgcaagacgaatataaaattagtccagagattatgaaatgagttttatcagtaatttatatttaatactcttaaatagtaaaatttgggagggctaattattattacggagtatccaaacaaggcccaagacgacggccggctgggcttttcagccgctggtgcaggtgacatggcaggacgggccacagtagttgacgcatttggagtagtacgcctccaggcagctctcgcatccgtccttgttggaggggtcgccgcagggggcgctgcacgacgacgagtcgcgcccgtagcccttgcacgattccttgcacgcctggtcgcactggctgcagggcacctgcgccgccgcccgctccacggcggaggacagcagcagcagggcggcgcagatcacgacggcgaaggccgcggcacggcggcggccggaagcagcagccattatttggtctgttggtgttgtcgttggatttgatgtggatcaagcaagtcacaggagagaagaacaggggatgcagatatgcgtatgtgttggatttgtggcagattaccagcgctatttataggcagtaaacgcgatacttcaacttgcaggtttttgtcactggattgcagatgcaaagcaaacatggcgtgccacggatatgatgatatttgaacgtggacttcttaaaccgtgctccacttcccaatgtatatttgttgatgattttgtgttatatgaattctatttgataacagtggagcgattattgtttaattacggtggtgcagggttaattaggaggtgagaagtacagatgctataatactcccggattatcttcctgctatgattctataagcacttttatcttagagaaaatttcaaaaagaaaacccgtgttttggggattctgtaacacaaaacgcccagttttgcaatttgtttatttgtcttatatatttatctgtaagcacttttatcttagagaatgtatgagatactttttagtacatatataacattagttgctttttaacaagcgttgatcatttatgtgtatatttaacctattattatattataattaacatgtattatgttaatctttttcagcacaaaattgagaaaaaaaatgaagtagacgagaagaatatgtccttttagccaactaatgtgaattgatgtagaaaacaatcttatgtaataataaaatatgagtattttacatgaatatgaggtttcttaaaacatttggctcaaaacatggggcttcgtgaaacaaatcacagtaaccagggttttatgtaacggatactccaataactgtggttttgtgaaattcactctttatcttatatgtaattattatgttttcagtggtagacgatgtacccgtcgatagcgaggcgcctgtggtgacttcgtcaatctccaagatttgccggctcagttatcgaagatgctcataagggtagggtttacgtacgtgcattcatagggtgagtatgcgtgcattgtgagtgtttatgttgtaaagtgtaattttaaaaaaatattgtaagcaaggcacaaagattgagtaatcccctacgtttgtaaacattcctcatttggtcgctattatttttttaaaacgatcagttacagacaacacgatcattcattgaatagagcagaaagaaattacaaaactattgccttaggagacattcgccaggaaagaaaaaatttaaccaccacgcaccgacagcgtctacacacatccaaagagaaggctagcaccaaatcaaccacttttaagcgtaacttatgtccctcttattgaactatgttcgtggctattattggttttcttccgtggttttttcaaagggccgcggtttttcaatgtgtagaactatgtcttgatcacttctttgtctgtccgtttatcgcatatatctatatggtcagagcacccgctttaattctttgatcttaagctgttctacatatattagtggtatttgaccgtcctaaattacgtcttagatgagccatgcatgaccaagaagttagattctgacttttggatatagatatgcatgacagtgaagacacgccacccaatgtgtattctatagaaaccagagtttttaagcagcacgaaaaaaaaaaactattacttcagtcctagactagctttttttcatgcagtagtaacttcgacagcagggaagagctttgttgatagtcacatttcgtgcagtgggagtggccgaggtgtgagcgccagagagtgtgacccatgtcatcagcggtgaggcactgcccttgcgctcaaagctcatcatgcgctccgagctctcgaaagcttgccgaggtcgctactacataaatgatatgatttttctggacataagtcatttttagattgcatacgaaacgtaaatagtcgcgtctgcaaaaaaatcatgttccattttcacgcgcggctctttaagacgactgcacgaaaaaaattaattttaacaagcaggccacttaataggtccgcacgcgaaaatagatgctaagtggcccgtacacgaaaatagccacccaccttttaatcgcgcg

SEQ ID NO: 59444 - DNA, 4008 bp, Oryza sativa
ctacatagcttggcacgtatagtggatgggcctttaagaactgaacggccgaattgcctgggtttgtttccttgagcttattaaaggtcgcgttcttccgaaggggttagggtaagttttataatggaggtgagtaccagatctaatttaaatcatgtcatattctcattaattaagaggtaacaagtacaacatgccacctctagtacacaaaccccaatattagtttactctcacatcatcttatatttttcttagagattatgtggaggttgcccctttcatgagaggtggctcattctctctctcctaacttctctcctccaactcatcacctaattttatgtggcaaatttaggggcaacatgtagaggcttatagtacttgcccttaggagcgcctaacctaatggaacgataattaaaatatgataaatgaagtacttcatccgtttcatatgtaactaaattcattagcatatatatgaatatgagcaatactagaaagtcttacattgtgaaacggaagaagtattagctaaagaaattccgaaggggttaggagcgcctaacctaatggaacgatagttaaaatatgataaatgaagtattagctaaagaaattttaaaaataatttaatatggctttttatagcaactttttatacatttttttaaaagaatatatcggttaataattcgggaaatttgcatgtgagaaatgagagacgaaggttgggaactttgagttaagaatacagcctaaggcatactccctccgtctcgaaaaaaaacggtgtccagttttaaactcaggattgggcagtgtcgtggaagacggttgatacggccgctatgacgcccgttaaaacggtgacggtaagcagtccgtcacattttggcaaaacggtcctcattagtcgtccaaaaacgcgtaattcctgttattaccgattaatccagcgtttttccgactaatcggccgtattggcagtatataatcgggcatgatcaaattcactgggcccagcccacgcacaatagcctatcctgttagttgtcttctctcgtactcctgtacagcatgcatgtactactatattaatctctttgaagaccaaatatttttcaaatgcactaatactagtataagatttcaataacgtgtaatgcaaattatcatggtattattatatataatttgttatagcagcaatggcaggcattataaactgaacctaccactagttaatgcataaatatgcattatgatattttttgcattattaactttagtacgtgtatgttaagttaatgtcatgttatggttgttctatttaaatatatatactaggaaactagaatgtgttcatatggatttaattacctctaaaaggacaaactattattaactatgtacttatatttgcaaaacgttaaatttccgtcatattccgactaatcatccgtattccgattaatcgtttggcggtactctccccgtccgacatccgtattccgtcttccacaacactgggatttggtttttttttttgacagtgggagtacgtgtctagagccagcatttgattctacattgatgtgcttgtcattccaacctgtgatagttatgatcttataaaatcaattctagctatgattttgatatggtatttttcatgtttataagataaaggtttataaataaaaaatgatttttattgaaggtgtaaaatatacataccgtcccataaaaaattaacttctgaggatgaatctggataaatatttgtttaattttttttttgttgtggtaagagcaggagtacttgtgtgctacaatgtctggataagtgttgattgtactgcctgccaatacgatagtagcagctgacacgtctgcatcatcctgtggatgaatccaactaccctcggaaaaaacgccaccaacggaatccacgaatggaaagtttggtactcgatcaactgtgattgtgacaagggtcgcaaaaatcggagctaagagcaagtttaacagtatagctaactactagctccaattcatttatagccattctaatagctcatccatacaatagttacatactacactattaatacctgctcctacctgttacacacactacgtcttaaagttcgtgctacagctgactacaaatttatagtccactgctcttctctcttcttatttatctccttaaaatatgtttgcagttggtttatagcctgctattgtacctgctataatccgactcctccatgcgcatatttagcatatgttgatatatggagtactcgcttcgtaaaaaaaaatggatgtgatacgttctaatacatcgaatttgaacatacgtatatctaaatttgtagtgctaggatgtggtacattactatgctgattttttatgggacggaggaagtatgtactatgcgcaccagattattcttccataaaaaccgtccactctaaaaaaaaataaaactgactttgacttctcaagaaaaccaatcattttaaaaaccaacaatccatttgatccaaatcctccactaaagtgaataaagaaaatgttgaacgcgtggacctataactagtagcagagaaaaactttagctatggttaaatgttattgaccgtcattatactctacaagaacttaaatgttatataccgtcattagccatggtttgatttgaattttgaaatcatactaaccccgtcgggtaacggccgggaaagcttccgaaaagagaaatttatgttactttaaaaagtacctcgaggtatataaattttacactaaagtttttagtttttggtacatcgaagtactaagtatccggagatactaaatttttacactagaaagtatggtatctcccgatatacttttttaaggatggtaaagttacccttccgaacatcatttggagcctcattggttgtccatatttcctaataagcttaaacataaaataaagagttaatttataggtacaactttttatatatttgttcgtatcgacttagaagtcaatactagaaaaaaagtatattgaaaatatcttaaaaccatctgcaatttcaattttgaaaattttgaaaatttaaatataggcttttacgtttattaggccaaccgggctacgcatctcggcaacgctaattaaccacatgatcaagtatgcagcaagagatcagaactgaagtttaatagtatagtccactactagctccaatttatttatagctaatctaatagtcaatttatacaatagttgcttactataatattaatatatggtcccacctgttagagcgggtacaataatcgacgataagaacgccagctcggattttgcgattacgtggaggagagaggggtcaagcgcgagcgcgagcgggcgactaatttgtcgcccagctgcacgctccgcccaaggttctggggccccttgtaccgatcatccgtgtctaagttcgtcgcaatcgccaccgtgcccatcgtcgtcgtccactgccgttgtaaccgttgtgtgcgtccgcctcctccgccaaggttggcgtcatcaccggcgtccgcctcattcgctgcgaccgtcggcggcggcggcgtccgctgtgaccatcgccccgtcctccgcagccatcgtcgtggctgtcgcctatccatcatcatccgccatggccgccactatggtccactgcattcgtcgctgtcgcatgcgttcgccgtcatccaccacagcagttgccgactcgccgtcgcgtgcgtccgcctcgtctgccacagctgccatggccgccatcatcgcctgcgtcccactggtagagaaaccatctttggtcggtcgacccaaatccacaatagtcccggttccattaaaaaccgggactaaaaatgatttttagtcccggttaataagaggaagatctttagtcccggttggtaactccaaccgggactaaagttcatttttagtcccg

SEQ ID NO: 59445 - DNA, 5388 bp, Oryza sativa
ccatctcaccaaccgggactaaagatcgatttttagtcctggttatttgaaccggaactaaagatagcgatctttagtcccggattcgtagtcccggttagaaaaccgggactacagggggttacgaaccgggactaaaaagcacttctccaccagtgtcccctgtcgtcagttgcgtccgccttgtccaccacggccgtctcctgcgcccgccgtcttctacgtccgccgcggcgaccagcctcgtccatcgtcgcactcgtcgcctgtatccctggcaggcttggctgtaaccttcatcgctgcatactttgcatatgcaggcaaaagaaacgaagagaagtaaagaaaggaagagaagctgagagaaagaaagagaagagacaggataagactgtgggacccacgaaaataataaaatatttatgttgagtaaacataaaatttcttcatggtacatatggactataatgtctactccctccgtcccagaaggaggacgttctgctcctaaccatttgtcccataattcttgacgctggcagcctggcagcctggcaggcactagcaaactcctagacaagcacacataaaaaaaagggtaaataaaaaaaagaagtggggccatctaaaacagtactagcgaactctttcttctccaaacgatttttgctctgaagcgctaccttatcctctcctctcgtattctcttcttccccatcgctcgtctctcgttttcttctccttccacgccgcgtcttccacaccagcaccccgcttctccctcccatcagcacaccgcaccaatccccatccatcccccctcccccacccccagacgagcaagccatatccggtgtgcgacaacatgctcaacggccgcggcaacactgagagcgccatcagcagcaatggcggaaaccctaggggttgcagtggcggcgaacctaggggctatggcggtggaggccgtagggatggctacggcgctggctttggcgagagatcgggttgtggaggtgatgatggaggcggaaactgtaggggccgcgatgttggaggccctaagggctacaacagcagcagccctaggggtgcagcccttccaccatgattatccggcagcaccgtccctaccacccgggtaacttcaacaagaaccaccatagtgacagtcacaacaatagtgagcagcacagcctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgccggacccaagttcgttcaggcccgtgttaatcatgcatctgcagaggaggcgcagtcagcaccagaggttatattgggcacattccccgtcaactcgacaccggcagtaatattgtttgattctggtgcaacccattcctttatttccaagcgttttgctggtgcacatgggttatctttagtgaagcttaagataccaatgcgagttcatactcctggaggtggcatgaccacaactcactactgcccatctgtgacagttgaaattcaagggttgatttttccagccaacctcattcttctcgaatccaaggacctagatgtcatacttggaatggattggttggcaaggcacagaggagtgattgattgcgccagccgcaccatcaagttgaccaatgcaaaaggagaggtggtaatcttccagtctccagtgccgcagaagccagggattagtttaaaccaggctgctggtgaagaacaagaggtagcagtggagaaaaccactaagaagctggaggatattcccatagtcagagagtatccagaggtttttccggatgatctgacaacaatgccaccaaaaagggatatcgagttccggattgacttggtacctggaactgcaccgatccacaagaggccttacagaatgggagccaacgagttggcggaagtcaagaagcaagttgatgaacagttacagaagggatacatccgcccgagcacgtcgccttggggtgctccggttatctttgtggagaagaaagacaaaaccaagaggatgtgcgttgactaccgcgcactcaatgaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgtcgtggttttcatcgatgacatactaatctactccaagtccgaggaagaacatgagcagcatcttcgactggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaagtggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcatgatctggaattagccgcagttgttcatgctttaaagatttggcggcactatctcatcggtaaccgttgtgaggtatatacagatcacaaaagtctaaagtacatcttcacccaacctgatctgaatctccgacaacgaagatggttggagctaatcaaagattatgatatgggaatacactatcatcccggcaaggccaatgtggtagcagatgccttgagcaggaagagttactgcaacgtcgcatgggtagaggaactatgctgtgaggttcaacatgatttggaacatttgaaccttggtatagttgagcacggattcgtggctgccctagaggcacagcccacactggtggagcaggttcgcatagctcaagcaagtgatcctgaaatagcagagctcaaaaagaacatgagggtcggaaaagcccgaggttttgttgaggatgaacaaggaacaatctggatgggagaaagattgtgtgtacccgaaaacaaggaattaaaagacctgatactaaccgaggctcatcaaactcaatattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcggggcatgattctatttgggtagtcgttgaccgactcaccaaagtggcccacttcattccggtgcacaccacctactcagggaagaaattagcagaactctatctggcaagaattatgtgtttacatggtgtacctaagaagatcgtgtctgatcggggaagccaattcacttcaaagttctggcagaaattacaagaagaattgggaacccggttgaatttcagcaccgcttaccatccacaaacagatggccagaccgagcgagtcaatcaaatactagaggatatgttgagagcctgtgcgcttgattttggtggggcatgggacaaaagcttgccgtatgctgagttctcgtacaacaacagttaccaagctagtctgcagatggcaccatttgaagcactgtatggacggaggtgtcgtactccgctcttctgggatcagacaggggaacgccagttgtttggtacagaagttttaaatgaggcagaagagaaagtcagagctgttagggaaagattgagaatcgcgcagtctcggcagaaaagctatgcagacaaccgccgaagggagctcgctttcgaaacaggggattatgtgtatctccgtgtcactccgctcaggggagtacatcgcttccaaaccaaaggaaagttggcaccacgctttgtgggaccatatcgggttttggaacgtagaggtgaagttgcttaccagctcgagcttccctccaacatgcttggcatccataatgtgttccacgtctcccagttgaagaaatgtttgagagttcctgaggaacaggcaagtccggatcaaatcgaaatccaggaagacttgacgtatgtggagaagccaactcgtatcctcgaaaccagcgagagaaagaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgccctgaagttttccccctttttgcttgctttaaaaatttggctaaataaatcgtccgaagaaattatcttaattaacctagagctaattccctaattaataaatgcaaataataatcggaatcggcatgtggaatttttcttggattctacattattaacaggatttttagtggaattttcagagccttggaaataattttaaccaattaaaaatcaccaaagtgcaatttttaattccagggaaaatccttttcctttttctttttcttttccctccctttttccctccttttttcttttcggatgggccgccggcccattcccctccttcctccccctcctccttgctgggccggccgcaggccgagggcccagcctggcagccgccgcccgcctcctctctcggggtcgccgacaggtggggcccacctgtcgggtccttcccccacctcccgccgatcccggcgcgccgccgcgccgaaaccgccgccgcgcccacgcctccgtctctcccgggccacgtcggccacgcccgcgcgtgcgccgcgtctcccgcgccctttcccct
